(12) United States Patent
Takeda et al.

(10) Patent No.: US 7,977,087 B2
(45) Date of Patent: Jul. 12, 2011

(54) DETECTION INSTRUMENT WITH THE USE OF POLYNUCLEOTIDES MAPPED ON BARLEY CHROMOSOME

(75) Inventors: Kazuyoshi Takeda, Kurashiki (JP); Kazuhiro Sato, Kurashiki (JP)

(73) Assignee: Japan Science and Technology Agency, Saitama (JP)

( * ) Notice: Subject to any disclaimer, the term of this patent is extended or adjusted under 35 U.S.C. 154(b) by 956 days.

(21) Appl. No.: 11/547,284

(22) PCT Filed: Mar. 31, 2005

(86) PCT No.: PCT/JP2005/006825
§ 371 (c)(1),
(2), (4) Date: Jul. 26, 2007

(87) PCT Pub. No.: WO2005/095603
PCT Pub. Date: Oct. 13, 2005

(65) Prior Publication Data
US 2009/0186402 A1    Jul. 23, 2009

(30) Foreign Application Priority Data

| | | |
|---|---|---|
| Mar. 31, 2004 | (JP) | 2004-101618 |
| Mar. 31, 2004 | (JP) | 2004-101626 |
| Mar. 31, 2004 | (JP) | 2004-101641 |
| Mar. 31, 2004 | (JP) | 2004-101646 |
| Mar. 31, 2004 | (JP) | 2004-101662 |
| Mar. 31, 2004 | (JP) | 2004-101675 |
| Mar. 31, 2004 | (JP) | 2004-101682 |
| Nov. 26, 2004 | (JP) | 2004-341944 |
| Nov. 26, 2004 | (JP) | 2004-342018 |
| Nov. 26, 2004 | (JP) | 2004-342097 |
| Nov. 26, 2004 | (JP) | 2004-342261 |
| Nov. 26, 2004 | (JP) | 2004-342406 |
| Nov. 26, 2004 | (JP) | 2004-342458 |
| Nov. 26, 2004 | (JP) | 2004-342598 |

(51) Int. Cl.
*C12M 1/00* (2006.01)
*C12M 3/00* (2006.01)
*C12Q 1/68* (2006.01)
*C12N 15/29* (2006.01)

(52) U.S. Cl. ...... 435/287.2; 435/6; 435/285.1; 536/23.6

(58) Field of Classification Search .................. None
See application file for complete search history.

(56) References Cited

U.S. PATENT DOCUMENTS

2009/0241220 A1*  9/2009  Abad et al. .......... 800/278

FOREIGN PATENT DOCUMENTS

| | | |
|---|---|---|
| EP | 1 026 258 A2 | 8/2000 |
| EP | 1 466973 A1 | 10/2004 |
| JP | 2000-228999 A | 8/2000 |
| JP | 2001-17181 A | 1/2001 |
| JP | 2002-524044 A * | 8/2002 |
| JP | 2002-291474 A | 10/2002 |
| JP | 2003-111593 A | 4/2003 |
| JP | 2003-144173 A | 5/2003 |
| JP | 2003-180362 | 7/2003 |
| JP | 2003-245075 | 9/2003 |
| JP | 2003-259898 | 9/2003 |
| JP | 2003-289885 A | 10/2003 |
| JP | 2004-065251 | 3/2004 |
| WO | WO 00/08160 | 2/2000 |
| WO | 03/057877 A1 | 7/2003 |
| WO | WO 2004/066719 A1 | 8/2004 |

OTHER PUBLICATIONS

K. Sato et al., "Single Nucleotide Polymorphisms Found in Barley ESTs"; Breeding Research, vol. 3, separate vol. 2, pp. 114, 2001.
Damian Jacoud et al., "Diversity Arrays: a Solid State Technology . . . ", Nucleic Acids Research, vol. 29, No. 4 e25, pp. 1-7, 2001.
Magnus Jobs et al., "DASH-2: Flexible, Low-Cost, and High-Throughput SNP . . . ", Genome Research, www.genome.org, pp. 916-924, May 2003.
Hajime Matsuzaki et al., "Parallel Genotyping of Over 10,000 SNPs . . . ", Genome Research, www.genome.org, pp. 414-425, May 2004.
International Search Report of PCT/JP2005/006825, mailed Jul. 26, 2005.
Vladimir et al; "Discovery and assay of single-nucleotide polymorphisms in barley (*Hordeum vulgare*)", Plant Molecular Biology 2002, vol. 48, pp. 529-536.
Raja et al; "Generation and comparison of EST-derived SSRs and SNPs in barley (*Hordeum vulgare* L.)", Hereditas 2001, vol. 135, pp. 145-151.
Yuzo Minobe, Risa Monna, Zi-Xuan Wang; "The breeding based on genome-wide selection: Rice breeding technology in the era of the post-genomic sequence"; Protein, Nucleic Acid, and Enzyme, vol. 48 No. 3(2003), p. 252-256.
A New Resource of Cereal Genomics: 22K Barley GeneChip Comes of Age, Plant Physiology, Mar. 2004, vol. 134, p. 960-968, Close et al.
Office Action mailed Jul. 17, 2007, by the Japanese Patent Office for Japanese Patent Application No. 2006-511892.
Japanese Interrogation for related JP 2006-511892 mailed May 25, 2010 and English translation thereof.

* cited by examiner

*Primary Examiner* — James Martinell
(74) *Attorney, Agent, or Firm* — Nixon & Vanderhye P.C.

(57) ABSTRACT

As the results of mass sequencing of cDNA clones originating in barley varieties "*H. spontaneum*", "Haruna Nijo" and "Akashinriki", a large number of sites showing single nucleotide polymorphisms (SNPs) among the varieties are found out. Because of involving nonsynonymous substitutions and likely relating to phenotypes inherent in respective varieties, these SNPs are usable for various purposes, for example, genetically distinguishing a variety, isolating a gene, producing/selecting a novel transformant and so on.

2 Claims, 3 Drawing Sheets

DETECTION INSTRUMENT WITH THE USE OF POLYNUCLEOTIDES MAPPED ON BARLEY CHROMOSOME

This application is US national phase of International application PCT/JP2005/006825, filed 31 Mar. 2005, which designated the U.S. and claims priority of JP 2004-101626 filed 31 Mar. 2004; JP 2004-101662 filed 31 Mar. 2004; JP 2004-101646 filed 31 Mar. 2004; JP 2004-101641 filed 31 Mar. 2004; JP 2004-101618 filed 31 Mar. 2004; JP 2004-101682 filed 31 Mar. 2004; JP 2004-101675 filed 31 Mar. 2004; JP 2004-342598 filed 26 Nov. 2004; JP 2004-342261 filed 26 Nov. 2004; JP 2004-342018 filed 26 Nov. 2004; JP 2004-341944 filed 26 Nov. 2004; JP 2004-342458 filed 26 Nov. 2004; JP 2004-342406 filed 26 Nov. 2004; and JP 2004-342097 filed 26 Nov. 2004, the entire contents of each of which are hereby incorporated by reference.

TECHNICAL FIELD

The present invention relates to a detection instrument that uses polynucleotides mapped on barley chromosomes. Particularly, the invention relates to a detection instrument for detecting, in Triticeae species, gene expression, gene polymorphism, proteins (polypeptides), and substances that interact with proteins (polypeptides).

BACKGROUND ART

Over the last years, the entire genomes of human and many other model organisms have been sequenced. In many of these organisms, sequencing of the entire genomes has been finished already. There has also been ongoing development in the analysis of transcripts and proteins based on the sequence information of genomes. Specifically, transcriptome analysis and proteome analysis have won the recognition. The transcriptome analysis is used for the analysis of transcripts, whereby the expression of all transcripts in an organism or cells are analyzed both systematically and comprehensively. The proteome analysis is a systematic and comprehensive method of analyzing proteins, in which the properties or expression of all proteins expressed at any given location and any given time in an organism or cells are analyzed.

For the systematic and comprehensive analyses, various array techniques are often used. The array technique refers to a technique using an array, in which biosubstances, such as DNA or various proteins obtained from the organism of interest being analyzed, or synthetic substances (for example, compounds with hydrophobic groups or ion exchange groups) that interact with such biosubstances are immobilized on a support in an orderly manner.

With the array technique, the systematic and comprehensive analysis can be performed efficiently. For example, for the analysis of gene transcription control mechanism, it is required to measure transcription level of genes, which varies according to the state of the cell. For this purpose, use of a DNA micro array, one form of the array technique, allows for systematic measurement of transcription level of several thousand to several ten thousand of genes. Among such DNA micro array techniques, one that has been widely used is the DNA micro array technique developed by Affymetrix. In this technique, oligonucleotides are directly synthesized on a silica substrate using a microfabrication technique employed in the fabrication of semiconductors (see Patent Document 1, for example). Meanwhile, arrays have been developed that are modified to detect single nucleotide polymorphism (SNP) (see Non-Patent Documents 1 and 2, for example).

In order to reduce breeding time, labor, and field area, breeding of Triticeae species nowadays employs a method whereby screening is made using genetic markers as an index. Genetic markers have been used since the advent of DNA markers in the late 1980s, and the study of linkage map has advanced greatly with the use of DNA markers. Today, linkage analysis is performed in many organisms based on their high-density linkage maps. Currently, genetic markers that are strongly linked to target traits are available. By using these genetic markers, breeding can be performed more efficiently. The inventors of the present invention have been actively developing genetic markers in Triticeae species. For example, the inventors have proposed (1) a technique concerning genetic markers that are linked to genes conferring aluminum resistance to barley, and use of such genetic markers (see Patent Publication 2), and (2) a technique concerning novel primer sets that are used to detect barley chromosome nucleic acid markers on a wheat background (see Patent Publication 3), and use of such primer sets.

[Patent Publication 1]
Japanese Laid-Open Patent Publication No. 2000-228999 (published on Aug. 22, 2000)
[Patent Publication 2]
Japanese Laid-Open Patent Publication No. 2002-291474 (published on Oct. 8, 2002)
[Patent Publication 3]
Japanese Laid-Open Patent Publication No. 2003-111593 (published on Apr. 15, 2003)
[Non-Patent Publication 1]
Jobs M, Howell W M, Stromqvist L, Mayr T, Brookes A J. Related Articles, Links. DASH-2: flexible, low-cost, and high-throughput SNP genotyping by dynamic allele-specific hybridization on membrane arrays. Genome Res. 2003 May; 13(5): 916-24.
[Non-Patent Publication 2]
Matsuzaki H, Loi H, Dong S, Tsai Y Y, Fang J, Law J, Di X, Liu W M, Yang G, Liu G, Huang J, Kennedy G C, Ryder T B, Marcus G A, Walsh P S, Shriver M D, Puck J M, Jones K W, Mei R. Links. Parallel Genotyping of Over 10,000 SNPs Using a One-Primer Assay on a High-Density Oligonucleotide Array. Genome Res. 2004 March; 14(3): 414-25.

As described above, genomes of many organisms have been sequenced and many type of arrays have been marketed. However, none of these arrays is usable for the breeding of Triticeae species. Meanwhile, while breeding using genetic markers can greatly improve efficiency as compared with the conventional screening conducted in a field, the genotype of each genetic marker needs to be confirmed individually. In breeding, large numbers of agriculturally desirable traits are screened for and undesirable traits are selected out. If genotypes of these multiple genetic markers were confirmed comprehensively, it would be possible to further improve efficiency of breeding.

The present invention was made in view of the foregoing problems, and an object of the invention is to provide a detection instrument for detecting, in Triticeae species, gene expression, gene polymorphism, proteins (polypeptides), and substances that interact with proteins (polypeptides).

DISCLOSURE OF INVENTION

In order to achieve the foregoing object, the inventors of the present invention designed primers based on the EST sequences independently developed by the inventors. By finding polymorphisms between different varieties in the amplified fragments that had been amplified using the genomic DNA as a template, genetic markers were developed. The genetic markers were mapped on barley chromosomes, and a detailed genetic map was made. Upon further study, the inventors have found that, if polynucleotides with the barley EST sequences or genetic marker sequences were immobilized on a support, it would be possible to realize a gene expression detection instrument or gene polymorphism detection instrument applicable to breeding of Triticeae species. Further, the inventors also found that a protein (polypeptide)-interacting substance detection instrument or protein (polypeptide) detection instrument could be realized when proteins encoded by the EST sequences, or antibodies against such proteins were immobilized on a support. The present invention was accomplished based on these findings.

Specifically, the present invention provides a gene detection instrument for detecting expression or polymorphism of genes existing in a genome of Triticeae species, the gene detection instrument comprising a support on which is immobilized at least one polynucleotide selected from: (a) polynucleotides with partial base sequences of chromosomal DNA of barley, or polynucleotides mutated by substitution, deletion, insertion, and/or addition of one or more bases in the partial base sequences of chromosomal DNA of barley; or (b) polynucleotides with combined partial base sequences of chromosomal DNA of barley, or polynucleotides mutated by substitution, deletion, insertion, and/or addition of one or more bases in the combined partial base sequences of chromosomal DNA of barley.

It is preferable that the polynucleotide immobilized on the support comprise at least one kind of polynucleotide selected from the group consisting of: (1) polynucleotides with the base sequences of SEQ ID NO: 1 through 5780, or polynucleotides mutated by substitution, deletion, insertion, and/or addition of one or more bases in the base sequences of SEQ ID NO: 1 through 5780; (2) a polynucleotide that comprises a part of any one of the polynucleotides set forth in (1); (3) a polynucleotide whose partial sequence comprises all of or part of any one of the polynucleotides set forth in (1); and (4) a polynucleotide whose partial sequence comprises: all of or part of a base sequence of SEQ ID NO: n (where n is an odd number), or its variant base sequence, in the polynucleotides set forth in (1); and all of or part of a base sequence of SEQ ID NO: n+1, or its variant base sequence, in the polynucleotides set forth in (1). Since the polynucleotides include base sequence of barley cDNA, gene expression or gene polymorphism in Triticeae species can be detected with a gene detection instrument in which the polynucleotides are immobilized on a support.

It is preferable that two or more kinds of polynucleotides be immobilized on the support, and that regions on the support in which the polynucleotides are respectively immobilized be arranged in the same order as a chromosomal order of the polynucleotides immobilized on the support. The gene detection instrument may be adapted so that two or more kinds of polynucleotides are immobilized on the support, and that information indicative of a chromosomal order of the polynucleotides immobilized on the support is appended to regions on the support in which the polynucleotides are respectively immobilized. With the immobilizing regions arranged in the chromosomal order or with the information indicative of the chromosomal order, the locations of recombination that has occurred in crossbreeding of Triticeae species can be found with ease. As a result, efficiency of breeding can be improved.

It is preferable that the polynucleotide immobilized on the support comprise cDNA. When the polynucleotide is cDNA, gene expression can be evaluated efficiently through hybridization with polynucleotides in a sample.

According to the present invention, there is provided a gene polymorphism detection instrument for detecting polymorphism of genes existing in a genome of Triticeae species, the gene polymorphism detection instrument comprising a support on which is immobilized at least one polynucleotide selected from: polynucleotides with partial base sequences of chromosomal DNA of barley; or polynucleotides mutated by substitution, deletion, insertion, and/or addition of one or more bases in the partial base sequences of chromosomal DNA of barley.

It is preferable that the polynucleotide immobilized on the support comprise a partial base sequence of at least one of DNA fragments amplified, using genomic DNA of Triticeae species as a template, with a primer set that comprises a combination of any two primers arbitrarily selected from: a plurality of primers designed based on a base sequence of SEQ ID NO: n (where n is an odd number) from among base sequences of SEQ ID NO: 1 through 5780; and a plurality of primers designed based on a base sequence of SEQ ID NO: n+1 from among the base sequences of SEQ ID NO: 1 through 5780. Gene polymorphism in Triticeae species can be detected with the gene polymorphism detection instrument in which a polynucleotide with a polymorphism-containing base sequence of the amplified DNA fragments is immobilized on a support.

It is preferable that two or more kinds of polynucleotides be immobilized on the support, and that regions on the support in which the polynucleotides are respectively immobilized be arranged in the same order as a chromosomal order of the polynucleotides immobilized on the support. The gene polymorphism detection instrument may be adapted so that two or more kinds of polynucleotides are immobilized on the support, and that information indicative of a chromosomal order of the polynucleotides immobilized on the support is appended to regions on the support in which the polynucleotides are respectively immobilized. With the immobilizing regions arranged in the chromosomal order or with the information indicative of the chromosomal order, the locations of recombination that has occurred in crossbreeding of Triticeae species can be found with ease. As a result, efficiency of breeding can be improved.

It is preferable that the polynucleotide immobilized on the support comprise a synthetic oligonucleotide. With an oligonucleotide synthesized to have a sequence suitable for detection of polymorphism, the efficiency of detection can be improved.

According to the present invention, there is provided a polypeptide-interacting substance detection instrument for detecting a substance which interacts with a polypeptide that comprises a protein, or part of a protein, encoded by a gene present in the genome of Triticeae species, the polypeptide-interacting substance detection instrument comprising a support on which is immobilized at least one of polypeptides encoded by: (a) polynucleotides with partial base sequences of chromosomal DNA of barley, or polynucleotides mutated by substitution, deletion, insertion, and/or addition of one or more bases in the partial base sequences of chromosomal DNA of barley; or (b) polynucleotides with combined partial base sequences of chromosomal DNA of barley, or polynucleotides mutated by substitution, deletion, insertion, and/ or addition of one or more bases in the combined partial base sequences of chromosomal DNA of barley.

It is preferable that the polypeptide immobilized on the support be encoded by a polynucleotide selected from the group consisting of: (1) polynucleotides with the base sequences of SEQ ID NO: 1 through 5780, or polynucleotides mutated by substitution, deletion, insertion, and/or addition of one or more bases in the base sequences of SEQ ID NO: 1 through 5780; (2) a polynucleotide that comprises a part of any one of the polynucleotides set forth in (1); (3) a polynucleotide whose partial sequence comprises all of or part of any one of the polynucleotides set forth in (1); and (4) a polynucleotide whose partial sequence comprises: all of or part of a base sequence of SEQ ID NO: n (where n is an odd number), or its variant base sequence, in the polynucleotides set forth in (1); and all of or part of a base sequence of SEQ ID NO: n+1, or its variant base sequence, in the polynucleotides set forth in (1). Substances that interact with proteins of Triticeae species can be detected with the polypeptide-interacting substance detection instrument in which the polypeptides are immobilized on a support.

It is preferable that two or more kinds of polypeptides are immobilized on the support, and that regions on the support in which the polypeptides are respectively immobilized are arranged in the same order as a chromosomal order of the polynucleotides respectively encoding the polypeptides immobilized on the support. The polypeptide-interacting substance detection instrument may be adapted so that two or more kinds of polypeptides are immobilized on the support, and that information indicative of a chromosomal order of the polynucleotides respectively encoding the polypeptides immobilized on the support is appended to regions on the support in which the polypeptides are respectively immobilized. With the immobilizing regions arranged in the chromosomal order or with the information indicative of the chromosomal order, the locations of recombination that has occurred in crossbreeding of Triticeae species can be found with ease. As a result, efficiency of breeding can be improved.

According to the present invention, there is provided a polypeptide detection instrument for detecting a polypeptide that comprises a protein, or part of a protein, encoded by a gene present in a genome of Triticeae species, the polypeptide detection instrument comprising a support on which is immobilized at least one of antibodies against polypeptides encoded by: (a) polynucleotides with partial base sequences of chromosomal DNA of barley, or polynucleotides mutated by substitution, deletion, insertion, and/or addition of one or more bases in the partial base sequences of chromosomal DNA of barley; or (b) polynucleotides with combined partial base sequences of chromosomal DNA of barley, or polynucleotides mutated by substitution, deletion, insertion, and/or addition of one or more bases in the combined partial base sequences of chromosomal DNA of barley.

It is preferable that the polynucleotide encoding the polypeptide used for production of the antibody immobilized on the support comprise at least one kind of polynucleotide selected from the group consisting of: (1) polynucleotides with the base sequences of SEQ ID NO: 1 through 5780, or polynucleotides mutated by substitution, deletion, insertion, and/or addition of one or more bases in the base sequences of SEQ ID NO: 1 through 5780; (2) a polynucleotide that comprises a part of any one of the polynucleotides set forth in (1); (3) a polynucleotide whose partial sequence comprises all of or part of any one of the polynucleotides set forth in (1); and (4) a polynucleotide whose partial sequence comprises: all of or part of a base sequence of SEQ ID NO: n (where n is an odd number), or its variant base sequence, in the polynucleotides set forth in (1); and all of or part of a base sequence of SEQ ID NO: n+1, or its variant base sequence, in the polynucleotides set forth in (1). Substances that interact with proteins of Triticeae species can be detected with the polypeptide-interacting substance detection instrument in which the antibodies are immobilized on a support.

It is preferable that two or more kinds of antibodies be immobilized on the support, and that regions on the support in which the antibodies are respectively immobilized be arranged in the same order as a chromosomal order of the polynucleotides respectively encoding polypeptides used for production of the antibodies immobilized on the support. The polypeptide detection instrument may be adapted so that two or more kinds of antibodies are immobilized on the support, and that information indicative of a chromosomal order of the polynucleotides respectively encoding polypeptides used for preparation of the antibodies immobilized on the support is appended to regions on the support in which the antibodies are respectively immobilized. With the immobilizing regions arranged in the chromosomal order or with the information indicative of the chromosomal order, the locations of recombination that has occurred in crossbreeding of Triticeae species can be found with ease. As a result, efficiency of breeding can be improved.

According to the present invention, there are provided polynucleotides usable for an instrument for detecting expression or polymorphism of genes present in the genome of Triticeae species, the polynucleotides comprising: base sequences of SEQ ID NO: 1 through 5780; or base sequences of SEQ ID NO: 1 through 5780, with substitution, deletion, insertion, and/or addition of one or more bases. Further, according to the present invention, there are provided polynucleotides whose partial sequence comprises polynucleotides usable for an instrument for detecting polymorphism of genes present in the genome of Triticeae species, the polynucleotides comprising DNA fragments amplified, using genomic DNA of Triticeae species as a template, with a primer set that comprises a combination of any two primers arbitrarily selected from: a plurality of primers designed based on a base sequence of SEQ ID NO: n (where n is an odd number) from among base sequences of SEQ ID NO: 1 through 5780; and a plurality of primers designed based on a base sequence of SEQ ID NO: n+1 from among the base sequences of SEQ ID NO: 1 through 5780.

The foregoing polynucleotides are suitable as the polynucleotides immobilized on a support of a gene detection instrument and a gene polymorphism detection instrument according to the present invention.

Additional objects, features, and strengths of the present invention will be made clear by the description below. Further, the advantages of the present invention will be evident from the following explanation in reference to the drawings.

BEST MODE FOR CARRYING OUT THE INVENTION

Figure 1:
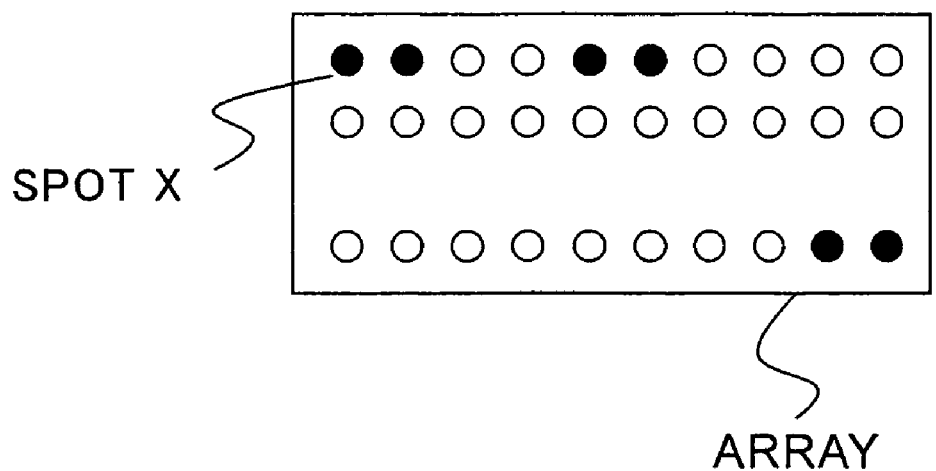
FIG. 1(a) is a plan view of an array as one example of a detection instrument according to the present invention, schematically illustrating expression of genes conferring certain characteristics.
FIG. 1(b) is a plan view of an array as one example of a detection instrument according to the present invention, schematically illustrating expression of genes conferring characteristics different from the characteristics represented in FIG. 1(a).
Figure 1:
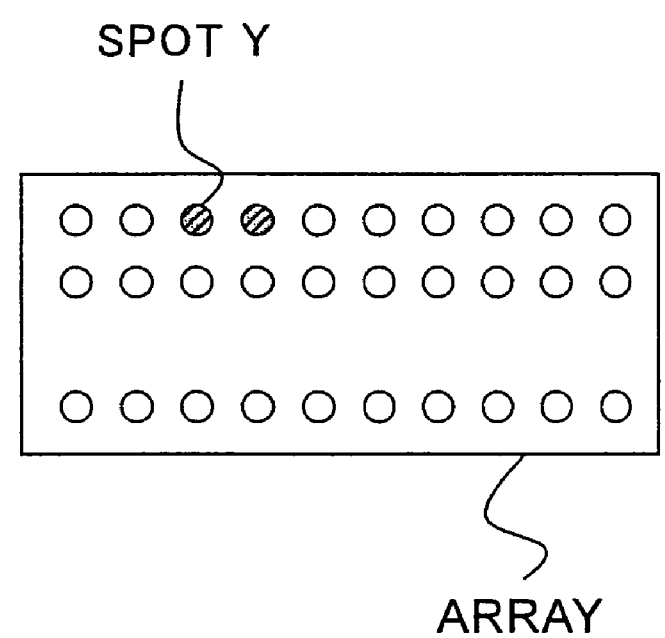

The following will describe one embodiment of the present invention. It should be appreciated that the invention is not limited in any way by the following description.

(1) Gene Detection Instrument according to the Present Invention

A gene detection instrument according to the present invention is an instrument for detecting expression or polymorphism of genes in the genomes of Triticeae species. The organisms to which a gene detection instrument of the invention is applicable may be any Triticeae species, among which barley, wheat, and rye are preferable. As will be described later, a gene detection instrument according to the present invention includes a support on which polynucleotides constituting part of barley chromosomal (1H, 2H, 3H, 4H, 5H, 6H, and 7H) DNA are immobilized. The polynucleotides immobilized on the support may solely be polynucleotides that constitute part of the barley chromosomal DNA, or other polynucleotides may additionally be immobilized on the support. Such additional polynucleotides are not particularly limited as long as they can detect expression or polymorphism of genes in the genomes of Triticeae species. For example, the additional polynucleotides may be those with the base sequences originating in non-barley organisms, or those with arbitrary base sequences that have been artificially synthesized.

In the case where the polynucleotides are immobilized in more than one region of the support, the polynucleotides immobilized in these regions may have non-overlapping base sequences or partially overlapping base sequences. Alternatively, polynucleotides with the same base sequence may be immobilized in these different regions of the support. In the case where the polynucleotides have overlapping base sequences, the polynucleotides may have partially overlapping base sequences, or the base sequence of one of the polynucleotides may be a partial sequence of the other polynucleotide.

Further, the polynucleotide immobilized in each region is not necessarily required to be of the same kind. More than one kind of polynucleotide may be immobilized in each region.

The support is not particularly limited as long as it can immobilize polynucleotides, and it may have any shape and may be made of any material. Examples of a support material generally include: inorganic materials such as glass and silicon wafer; natural polymers such as paper; synthetic polymers such as nitrocellulose and nylon; and gels using synthetic polymers or natural polymers. The shape of the support is not particularly limited as long as it provides enough area to support the polynucleotides. Generally, those with a two-dimensional plane, for example, such as a substrate with little or no flexibility, a flexible membrane, or a flexible substrate with intermediate flexibility can be preferably used. The thickness of the substrate or membrane is not particularly limited either, and it can be suitably set according to the material or use of the substrate or membrane. Various types of beads may be used as supports.

[Polynucleotides Immobilized on a Support of the Gene Detection Instrument]

In a gene detection instrument according to the present invention, at least one polynucleotide from the following polynucleotides (a) or (b) is immobilized on a support.

(a) Polynucleotides with base sequences constituting part of barley chromosomal DNA, or variants thereof with the substitution, deletion, insertion, and/or addition of one or more bases.

(b) Polynucleotides with a combination of base sequences constituting part of barley chromosomal DNA, or variants thereof with the substitution, deletion, insertion, and/or addition of one or more bases.

As used herein, a polynucleotide with a base sequence constituting part of barley chromosomal DNA is not particularly limited as long as it is a polynucleotide with a base sequence constituting part of the entire base sequences of chromosomal DNA of barley 1H, 2H, 3H, 4H, 5H, 6H, and 7H chromosomes. Further, a polynucleotide with a combination of base sequences constituting part of barley chromosomal DNA refers to a polynucleotide in which a base sequence constituting part of the entire base sequences of chromosomal DNA of barley 1H, 2H, 3H, 4H, 5H, 6H, and 7H chromosomes is joined to non-continuous base sequences constituting other parts of the chromosomes. For example, base sequences from two different parts of the chromosomes may constitute the polynucleotide, or three or more base sequences may join together to form the polynucleotide. Specifically, for example, cDNA with a plurality of exons from a protein-coding gene on barley chromosomal DNA can be regarded as a polynucleotide with a combination of base sequences constituting part of barley chromosomal DNA. However, the polynucleotide is not just limited to this specific example.

A variant with the substitution, deletion, insertion, and/or addition of one or more bases in the polynucleotide with a base sequence, or a combination of base sequences, constituting part of barley chromosomal DNA may be a polynucleotide that has been mutated on purpose, or a polynucleotide that exists in nature. For example, think of a base sequence of chromosomal DNA in a specific variety of barley. Comparing this base sequence with those of other varieties, no sequence is completely identical. Rather, these sequences are variants with the substitution, deletion, insertion, and/or addition of one or more bases.

Polynucleotides immobilized on a support of a gene detection instrument according to the present invention are preferably polynucleotides with the base sequences of SEQ ID NO: 1 through 5780, or variants with the substitution, deletion, insertion, and/or addition of one or more bases in the polynucleotides with the base sequences of SEQ ID NO: 1 through 5780. (Such polynucleotides and variants will be referred to as polynucleotides or the like with the base sequences of SEQ ID NO: 1 through 5780.)

The base sequences of SEQ ID NO: 1 through 5780 are base sequences of the barley EST (expressed sequence tag) independently developed by the inventors. The inventors have previously confirmed that a polynucleotide with the base sequences of SEQ ID NO: 1 through 770, a polynucleotide with the base sequences of SEQ ID NO: 771 through 1754, a polynucleotide with the base sequences of SEQ ID NO: 1755 through 2642, a polynucleotide with the base sequences of SEQ ID NO: 2643 through 3324, a polynucleotide with the base sequences of SEQ ID NO: 3325 through 4320, a polynucleotide with the base sequences of SEQ ID NO: 4321 through 4962, and a polynucleotide with the base sequences of SEQ ID NO: 4963 through 5780 are mapped on 1H, 2H, 3H, 4H, 5H, 6H, and 7H chromosomes, respectively.

The following briefly describes the inventors' EST and mapping. The inventors prepared mRNA from leaves of several different varieties of barley, and constructed cDNA libraries according to a conventional method. Plasmids with the cDNA were used as templates, and the base sequences in portions of the plasmids on the both ends of the inserts were used as primers. The base sequence that was read by a single sequence analysis on either end was adjusted, and a vector sequence was removed therefrom to obtain the barley EST sequence. Currently, about 140,000 EST sequences are available from the database of the inventors.

These EST sequences were divided into groups of about 10,000 genes based on homology of sequences at the 3' end. Using primer design software Primer 3, a primer set was designed for each EST, starting from the EST with the longest sequence. These primer sets were used to check for polymorphism in the hybrids of the mapped populations: malting barley Haruna Nijo and wild type barley H602. More specifically, first, the fragment lengths yielded by agarose gel electrophoresis were checked for polymorphism. If there were no difference in fragment length, the amplified fragments of the parents were aligned by direct sequencing. If the base sequences of the parents had differences to be recognized by restriction enzyme, the amplified fragments were digested with restriction enzyme and subjected to agarose gel electrophoresis to detect differences in fragment length. Then, using MAPMAKER/EXP, a linkage analysis was performed using the marker polymorphism information, together with the markers with known chromosomal locations. In this way, a genetic map based on the EST sequences was constructed.

It follows from this that the base sequences of SEQ ID NO: 1 through 5780 are partial sequences of barley cDNA. Thus, if polynucleotides with the base sequences of SEQ ID NO: 1 through 5780 were immobilized on the support, gene expression can be detected through hybridization with mRNA (probe based on mRNA) in a sample. Variants with the substitution, deletion, insertion, and/or addition of one or more bases in the base sequences of SEQ ID NO: 1 through 5780 may be polynucleotides that have been mutated on purpose, or polynucleotides that exist in nature.

A polynucleotide immobilized on a support of a gene detection instrument according to the present invention may be a part of the polynucleotides or the like with the base sequences of SEQ ID NO: 1 through 5780. Since the base sequence of such partial polynucleotide is a partial base sequence of barley cDNA, it can still be used to detect gene expression.

Further, a polynucleotide immobilized on a support of a gene detection instrument according to the present invention may be a polynucleotide whose partial sequence comprises all of or part of the base sequences of SEQ ID NO: 1 through 5780. The remaining base sequences of the polynucleotide are not limited. For example, since the base sequences of SEQ ID NO: 1 through 5780 are partial sequences of barley cDNA, these base sequences do not have the sequences on either end as originally found in the full length cDNA. Thus, a polynucleotide whose partial sequence comprises all of or part of the base sequences of SEQ ID NO: 1 through 5780, and which additionally includes the cDNA sequences on the both ends or one end as originally found in the full length cDNA can be regarded as a polynucleotide whose partial sequence comprises all of or part of the base sequences of SEQ ID NO: 1 through 5780. Further, vectors such as plasmids and BACs (bacterial artificial chromosomes) that have incorporated all of or part of the polynucleotides or the like with the base sequences of SEQ ID NO: 1 through 5780, and polynucleotides in which the partial sequence is ligated to arbitrary base sequences can also be regarded as polynucleotides whose partial sequence comprises all of or part of the base sequences of SEQ ID NO: 1 through 5780. Such polynucleotides at least include all of or part of the polynucleotides or the like with the base sequences of SEQ ID NO: 1 through 5780, i.e., part of barley cDNA, and are therefore capable of detecting gene expression.

Further, polynucleotides immobilized on a support of a gene detection instrument according to the present invention may be polynucleotides or the like whose partial sequences comprise all of or part of the base sequence, or a variant thereof, of SEQ ID NO: n (where n is an odd number), and all of or part of the base sequence, or a variant thereof, of SEQ ID NO: n+1, from among the base sequences of SEQ ID NO: 1 through 5780. As described above, the base sequences of SEQ ID NO: 1 through 5780 are EST sequences of barley, and comprise sequences that can be read by sequencing the cloned cDNA from the both ends only once. In other words, the base sequences of SEQ ID NO: n (where n is an odd number) and SEQ ID NO: n+1 among the base sequences of SEQ ID NO: 1 through 5780 are base sequences that are read from the both ends of the cDNA of the same clone. As such, these base sequences can realize a full length cDNA base sequence, which corresponds to all of or part of the full length cDNA. Thus, polynucleotides or the like whose partial sequences comprise all of or part of the base sequence, or a variant thereof, of SEQ ID NO: n (where n is an odd number), and all of or part of the base sequence, or a variant thereof, of SEQ ID NO: n+1, from among the base sequences of SEQ ID NO: 1 through 5780 can be regarded as polynucleotides with full length cDNA that comprises the base sequences of SEQ ID NO: n (where n is an odd number) and SEQ ID NO: n+1, or polynucleotides that comprise part of the full length cDNA. Further, the foregoing polynucleotides may be polynucleotides in which vector sequences or arbitrary base sequences for example are ligated to the both ends or one end of the full length cDNA or polynucleotides that comprise part of the full length cDNA. Further, the foregoing polynucleotides may be variants that have a base substitution or other mutations in sequences other than the base sequences of SEQ ID NO: 1 through 5780, i.e., a middle section of the total cDNA unspecified by SEQ ID NO: n (where n is an odd number) and SEQ ID NO: n+1. Such polynucleotides include the full length or part of barley cDNA, and are therefore capable of detecting gene expression.

The polynucleotide immobilized on a support is preferably cDNA. In this case, cDNA is not limited to full length cDNA. Rather, it may be a polynucleotide that comprises part of cDNA. Further, the polynucleotide may include other base sequences, for example, such as vector sequences, as long as it includes cDNA. Further, the polynucleotide may be a synthetic oligonucleotide that is produced by artificially synthesizing part of the cDNA base sequences.

In the case where a gene detection instrument according to the present invention is used for detection of gene expression, the substance to be detected in a sample is mRNA (probe based on mRNA). Therefore, for strong hybridization, it is preferable that the polynucleotide immobilized on a support be full length cDNA. The polynucleotide immobilized on a support may include any number of bases as long as it can detect gene expression. For example, in the case where only one polynucleotide is immobilized in each region, a polynucleotide with at least 50 bases is considered to be sufficient for detection of gene expression. When more than one polynucleotide (oligonucleotide) is immobilized in each region as in the Affymetrix system, a polynucleotide with about 25 bases is sufficient.

[Gene Detection Instrument with the Polynucleotides Immobilized in Regions that are Arranged in the Chromosomal Order]

As described above, the base sequences of SEQ ID NO: 1 through 5780 are base sequences of barley EST mapped on barley chromosomes. Further, the base sequences of SEQ ID NO: n (where n is an odd number) and SEQ ID NO: n+1 are base sequences that are read from the both ends of cDNA of the same clone, wherein n represents a base sequence on the 5' end, and n+1 represents a base sequence on the 3' end.

As used herein, the "chromosomal order" refers to the order from an arbitrary position of a chromosome. The distance by which the order is determined may be a genetic distance based on recombinations in hybrid populations, or a physical distance based on the number of bases or the length of chromosomes observed with a microscope.

As shown in Table 1-1 to Table 1-8, the chromosomal order in barley 1H chromosome (distance from the short arm end of 1H chromosome) has been specified for 385 clones including the base sequences of SEQ ID NO: n (where n is an odd number) and SEQ ID NO: n+1 from among the base sequences of SEQ ID NO: 1 through SEQ ID NO: 770. The chromosomal order in barley 1H chromosome has also been specified for 3 known clones (HVM20, Bmag211, and WMCIE8).

TABLE 1-1

| Order from the short arm end | Clones | SEQ ID NO: (5' end) | SEQ ID NO: (3' end) | Distance from the short arm end (cM) |
|---|---|---|---|---|
| 1 | bah55e06 | 1 | 2 | 0 |
| 2 | bags30b07 | 3 | 4 | 14 |
| 3 | baak21o3 | 5 | 6 | 17.4 |
| 4 | BaAK17D13 | 7 | 8 | 18.5 |
| 4 | basd26l20 | 9 | 10 | 18.5 |
| 4 | bah61p17 | 11 | 12 | 18.5 |
| 7 | BaGS11O06 | 13 | 14 | 19.6 |
| 7 | kr12H0216 | 15 | 16 | 19.6 |
| 7 | BaGS32E23 | 17 | 18 | 19.6 |
| 7 | basd13k20 | 19 | 20 | 19.6 |
| 11 | BaAK24O11 | 21 | 22 | 20.7 |
| 11 | kr26D0507 | 23 | 24 | 20.7 |
| 11 | BaSD2D08 | 25 | 26 | 20.7 |
| 11 | baak41n21 | 27 | 28 | 20.7 |
| 15 | bah11b15 | 29 | 30 | 21.8 |
| 15 | kr24B0903 | 31 | 32 | 21.8 |
| 17 | bast50E0709 | 33 | 34 | 22.9 |
| 18 | baal17o01 | 35 | 36 | 23.5 |
| 19 | baak41a04 | 37 | 38 | 24 |
| 20 | BaH28C07 | 39 | 40 | 24.2 |
| 21 | bags16g18 | 41 | 42 | 24.4 |
| 22 | BaSD3C22 | 43 | 44 | 25.1 |
| 23 | BaGS17B21 | 45 | 46 | 26.7 |
| 23 | basd27b10 | 47 | 48 | 26.7 |
| 25 | bah47d23 | 49 | 50 | 27.2 |
| 26 | BaAK21D02 | 51 | 52 | 27.7 |
| 27 | BaH17D02 | 53 | 54 | 32.1 |
| 28 | baal4f12 | 55 | 56 | 32.7 |
| 29 | BaGS11I03 | 57 | 58 | 33.8 |
| 29 | bah56a03 | 59 | 60 | 33.8 |
| 29 | kr16A0501 | 61 | 62 | 33.8 |
| 29 | bah19f01 | 63 | 64 | 33.8 |
| 33 | BaAK27F07 | 65 | 66 | 37 |
| 34 | bah47f18 | 67 | 68 | 41.1 |
| 34 | bah45l19 | 69 | 70 | 41.1 |
| 36 | BaAK12I12 | 71 | 72 | 44.1 |
| 37 | BaAL6N04 | 73 | 74 | 45.2 |
| 37 | baal16l05 | 75 | 76 | 45.2 |
| 37 | BaSD18O20 | 77 | 78 | 45.2 |
| 37 | BaSD3J13 | 79 | 80 | 45.2 |
| 41 | bah63j19 | 81 | 82 | 49.5 |
| 41 | BaH36O18 | 83 | 84 | 49.5 |
| 43 | BaAK20A06 | 85 | 86 | 50.6 |
| 43 | BaGS8G13 | 87 | 88 | 50.6 |
| 45 | bah25n06 | 89 | 90 | 53.8 |
| 45 | BaAK1P06 | 91 | 92 | 53.8 |
| 47 | BaAK16M07 | 93 | 94 | 55.1 |
| 47 | BaH36M15 | 95 | 96 | 55.1 |
| 49 | BaGS12K12 | 97 | 98 | 62.4 |
| 50 | BaAL39C22 | 99 | 100 | 71.9 |

TABLE 1-2

| Order from the short arm end | Clones | SEQ ID NO: (5' end) | SEQ ID NO: (3' end) | Distance from the short arm end (cM) |
|---|---|---|---|---|
| 50 | kr68B0303 | 101 | 102 | 71.9 |
| 52 | baak24d09 | 103 | 104 | 75.8 |
| 53 | BaGS11J13 | 105 | 106 | 76.9 |
| 54 | baal38l23 | 107 | 108 | 79.5 |
| 54 | BaAL36B15 | 109 | 110 | 79.5 |
| 56 | bast60D0610 | 111 | 112 | 80.6 |
| 56 | kr22D0808 | 113 | 114 | 80.6 |
| 56 | baal19i12 | 115 | 116 | 80.6 |
| 56 | basd23o02 | 117 | 118 | 80.6 |
| 56 | baak1i14 | 119 | 120 | 80.6 |
| 56 | baak24k18 | 121 | 122 | 80.6 |
| 56 | kr18G0814 | 123 | 124 | 80.6 |
| 63 | BaH38H09 | 125 | 126 | 82.3 |
| 64 | BaGS8B13 | 127 | 128 | 85.4 |
| 64 | BaH25J08 | 129 | 130 | 85.4 |
| 66 | baak3d11 | 131 | 132 | 88.6 |
| 67 | baal12p08 | 133 | 134 | 89.7 |
| 67 | bags39j20 | 135 | 136 | 89.7 |
| 67 | bags32m16 | 137 | 138 | 89.7 |
| 70 | kr15A0402 | 139 | 140 | 91.3 |
| 71 | baal3c01 | 141 | 142 | 91.9 |
| 72 | baak41i03 | 143 | 144 | 93.9 |
| 73 | BaGS29M13 | 145 | 146 | 95.7 |
| 74 | basdl7m22 | 147 | 148 | 98 |
| 74 | bags15g01 | 149 | 150 | 98 |
| 74 | BaH24I06 | 151 | 152 | 98 |
| 77 | BaH57E12 | 153 | 154 | 99.1 |
| 78 | BaSD25C22 | 155 | 156 | 99.7 |
| 79 | baal19m17 | 157 | 158 | 101.9 |
| 80 | bah46p14 | 159 | 160 | 102.3 |
| 80 | bags18d19 | 161 | 162 | 102.3 |
| 80 | BaAK34J19 | 163 | 164 | 102.3 |
| 83 | bags6d01 | 165 | 166 | 105.6 |
| 84 | bags3p11 | 167 | 168 | 108.9 |
| 84 | BaAK14J21 | 169 | 170 | 108.9 |
| 84 | baak2m05 | 171 | 172 | 108.9 |
| 87 | baak37g19 | 173 | 174 | 109.4 |
| 88 | BaGS31B11 | 175 | 176 | 109.9 |
| 88 | BaAL35M08 | 177 | 178 | 109.9 |
| 88 | BaSD16G03 | 179 | 180 | 109.9 |
| 88 | BaH58J20 | 181 | 182 | 109.9 |
| 88 | BaGS22B13 | 183 | 184 | 109.9 |
| 88 | BaAK43M01 | 185 | 186 | 109.9 |
| 88 | bah14i07 | 187 | 188 | 109.9 |
| 88 | BaH13F14 | 189 | 190 | 109.9 |
| 88 | baal9i16 | 191 | 192 | 109.9 |
| 88 | basd27b20 | 193 | 194 | 109.9 |
| 88 | BaAK2O24 | 195 | 196 | 109.9 |
| 88 | basd18l16 | 197 | 198 | 109.9 |
| 88 | BaAL19J14 | 199 | 200 | 109.9 |

TABLE 1-3

| Order from the short arm end | Clones | SEQ ID NO: (5' end) | SEQ ID NO: (3' end) | Distance from the short arm end (cM) |
|---|---|---|---|---|
| 88 | bags22i15 | 201 | 202 | 109.9 |
| 102 | baak44a23 | 203 | 204 | 111.5 |
| 102 | BaAK32N04 | 205 | 206 | 111.5 |
| 104 | basd21e22 | 207 | 208 | 112 |
| 104 | BaGS7K03 | 209 | 210 | 112 |
| 104 | baak42e22 | 211 | 212 | 112 |
| 107 | bast21D0808 | 213 | 214 | 113.1 |
| 107 | bast75E0610 | 215 | 216 | 113.1 |
| 107 | baet16A1002 | 217 | 218 | 113.1 |
| 107 | basd17m16 | 219 | 220 | 113.1 |
| 107 | bags17g08 | 221 | 222 | 113.1 |
| 107 | baak21i01 | 223 | 224 | 113.1 |
| 107 | baakl3n06 | 225 | 226 | 113.1 |
| 107 | baak22o23 | 227 | 228 | 113.1 |
| 107 | baet42E0410 | 229 | 230 | 113.1 |
| 116 | BaGS27M04 | 231 | 232 | 114.2 |

TABLE 1-3-continued

| Order from the short arm end | Clones | SEQ ID NO: (5' end) | SEQ ID NO: (3' end) | Distance from the short arm end (cM) |
|---|---|---|---|---|
| 116 | BaH52H18 | 233 | 234 | 114.2 |
| 116 | baak33k20 | 235 | 236 | 114.2 |
| 116 | bags21f16 | 237 | 238 | 114.2 |
| 116 | bags34e05 | 239 | 240 | 114.2 |
| 116 | bags15d20 | 241 | 242 | 114.2 |
| 116 | bags18g10 | 243 | 244 | 114.2 |
| 116 | bags19a02 | 245 | 246 | 114.2 |
| 116 | BaAK17J19 | 247 | 248 | 114.2 |
| 125 | bags35k02 | 249 | 250 | 115.3 |
| 126 | bah35a22 | 251 | 252 | 116.4 |
| 126 | BaGS17H13 | 253 | 254 | 116.4 |
| 126 | bah47n12 | 255 | 256 | 116.4 |
| 126 | baak12p11 | 257 | 258 | 116.4 |
| 126 | baet38B1004 | 259 | 260 | 116.4 |
| 126 | BaGS13K12 | 261 | 262 | 116.4 |
| 126 | BaAL25A05 | 263 | 264 | 116.4 |
| 133 | bah27k23 | 265 | 266 | 117.2 |
| 134 | BaAK24J12 | 267 | 268 | 118.3 |
| 135 | BaSD14M22 | 269 | 270 | 119.8 |
| 135 | bah17l24 | 271 | 272 | 119.8 |
| 137 | baal29i09 | 273 | 274 | 120.5 |
| 137 | bah16d09 | 275 | 276 | 120.5 |
| 137 | bah60d03 | 277 | 278 | 120.5 |
| 137 | bah45i13 | 279 | 280 | 120.5 |
| 137 | bah11h03 | 281 | 282 | 120.5 |
| 137 | bah47h17 | 283 | 284 | 120.5 |
| 143 | bags35d02 | 285 | 286 | 122.7 |
| 143 | bags37e17 | 287 | 288 | 122.7 |
| 143 | baak14c12 | 289 | 290 | 122.7 |
| 143 | baak34c01 | 291 | 292 | 122.7 |
| 143 | BaH35A11 | 293 | 294 | 122.7 |
| 148 | BaAK30M16 | 295 | 296 | 123.8 |
| 148 | BaSD11P04 | 297 | 298 | 123.8 |
| 148 | bah12i09 | 299 | 300 | 123.8 |

TABLE 1-4

| Order from the short arm end | Clones | SEQ ID NO: (5' end) | SEQ ID NO: (3' end) | Distance from the short arm end (cM) |
|---|---|---|---|---|
| 148 | BaAL2G20 | 301 | 302 | 123.8 |
| 152 | bags14j09 | 303 | 304 | 126 |
| 152 | kr26E0610 | 305 | 306 | 126 |
| 152 | bah37f01 | 307 | 308 | 126 |
| 152 | bags29m05 | 309 | 310 | 126 |
| 156 | BaGS17A18 | 311 | 312 | 126.5 |
| 157 | baet34A0501 | 313 | 314 | 127 |
| 157 | BaSD22O13 | 315 | 316 | 127 |
| 157 | bags15a22 | 317 | 318 | 127 |
| 157 | baet21H1016 | 319 | 320 | 127 |
| 157 | BaH30E13 | 321 | 322 | 127 |
| 157 | bags4e23 | 323 | 324 | 127 |
| 157 | baak45b03 | 325 | 326 | 127 |
| 157 | bah12o12 | 327 | 328 | 127 |
| 165 | baak34k14 | 329 | 330 | 127.9 |
| 166 | baal3e14 | 331 | 332 | 131.5 |
| 167 | bags22f12 | 333 | 334 | 136.3 |
| 168 | BaH45P03 | 335 | 336 | 137.2 |
| 168 | basd11d13 | 337 | 338 | 137.2 |
| 168 | Bmag211 | — | — | 137.2 |
| 168 | HVM20 | — | — | 137.2 |
| 168 | basd1j14 | 339 | 340 | 137.2 |
| 173 | bags35b18 | 341 | 342 | 138.3 |
| 173 | baal41i11 | 343 | 344 | 138.3 |
| 175 | bags13e23 | 345 | 346 | 139.4 |
| 176 | bah20d03 | 347 | 348 | 140 |
| 177 | baet19F0212 | 349 | 350 | 140.5 |
| 177 | bags12j05 | 351 | 352 | 140.5 |
| 179 | BaSD24D17 | 353 | 354 | 141.6 |
| 180 | BaGS24K10 | 355 | 356 | 142.1 |
| 181 | baal9e05 | 357 | 358 | 142.6 |
| 181 | BaGS33M23 | 359 | 360 | 142.6 |

TABLE 1-4-continued

| Order from the short arm end | Clones | SEQ ID NO: (5' end) | SEQ ID NO: (3' end) | Distance from the short arm end (cM) |
|---|---|---|---|---|
| 183 | bah46g14 | 361 | 362 | 143.1 |
| 184 | bags33h05 | 363 | 364 | 143.6 |
| 185 | baak24h12 | 365 | 366 | 143.9 |
| 186 | BaH50N19 | 367 | 368 | 144.2 |
| 187 | BaAK31O05 | 369 | 370 | 144.4 |
| 188 | BaGS39L14 | 371 | 372 | 144.7 |
| 189 | BaGS27C22 | 373 | 374 | 146.8 |
| 189 | bags20o24 | 375 | 376 | 146.8 |
| 189 | bags34j05 | 377 | 378 | 146.8 |
| 189 | bah56l03 | 379 | 380 | 146.8 |
| 189 | basd12k03 | 381 | 382 | 146.8 |
| 189 | BaAK39I18 | 383 | 384 | 146.8 |
| 189 | bags21h06 | 385 | 386 | 146.8 |
| 189 | bah56k04 | 387 | 388 | 146.8 |
| 189 | bah60e11 | 389 | 390 | 146.8 |
| 198 | baak22i05 | 391 | 392 | 147.9 |
| 198 | baal5i02 | 393 | 394 | 147.9 |
| 200 | BaAK2E05 | 395 | 396 | 149 |

TABLE 1-5

| Order from the short arm end | Clones | SEQ ID NO: (5' end) | SEQ ID NO: (3' end) | Distance from the short arm end (cM) |
|---|---|---|---|---|
| 201 | baak33g12 | 397 | 398 | 151.2 |
| 201 | bags4e05 | 399 | 400 | 151.2 |
| 203 | bast42C0806 | 401 | 402 | 155.4 |
| 204 | baak26c05 | 403 | 404 | 156.6 |
| 205 | bags19a16 | 405 | 406 | 158.6 |
| 206 | kr11F1212 | 407 | 408 | 159.7 |
| 206 | BaH28K13 | 409 | 410 | 159.7 |
| 206 | baak20d06 | 411 | 412 | 159.7 |
| 206 | BaSD1I24 | 413 | 414 | 159.7 |
| 206 | baak35l20 | 415 | 416 | 159.7 |
| 211 | bah57m07 | 417 | 418 | 161.8 |
| 211 | bah60k11 | 419 | 420 | 161.8 |
| 213 | basd20o09 | 421 | 422 | 162.9 |
| 213 | basd24i22 | 423 | 424 | 162.9 |
| 215 | bags30g20 | 425 | 426 | 164 |
| 216 | bags1m11 | 427 | 428 | 164.6 |
| 217 | bags23g20 | 429 | 430 | 165.1 |
| 218 | BaGS15B05 | 431 | 432 | 166.2 |
| 219 | BaGS24P05 | 433 | 434 | 167.3 |
| 220 | bags10g06 | 435 | 436 | 168.4 |
| 220 | bah32o04 | 437 | 438 | 168.4 |
| 220 | BaGS32P08 | 439 | 440 | 168.4 |
| 223 | bags4e02 | 441 | 442 | 169.5 |
| 223 | bast04H0315 | 443 | 444 | 169.5 |
| 223 | BaGS37L06 | 445 | 446 | 169.5 |
| 226 | basd2b18 | 447 | 448 | 170.6 |
| 227 | bags3h12 | 449 | 450 | 172.1 |
| 228 | bags1e21 | 451 | 452 | 174.6 |
| 228 | BaAK27M21 | 453 | 454 | 174.6 |
| 230 | BaSD18F05 | 455 | 456 | 174.9 |
| 231 | BaH35B05 | 457 | 458 | 175.3 |
| 232 | basd21h11 | 459 | 460 | 176.4 |
| 232 | BaH32E20 | 461 | 462 | 176.4 |
| 234 | BaGS22A20 | 463 | 464 | 177.5 |
| 235 | BaSD14B13 | 465 | 466 | 179 |
| 236 | bags29l04 | 467 | 468 | 182 |
| 236 | bags22g16 | 469 | 470 | 182 |
| 238 | BaAL4B14 | 471 | 472 | 184.2 |
| 238 | bah61h20 | 473 | 474 | 184.2 |
| 240 | bah15p01 | 475 | 476 | 186.4 |
| 240 | baak41p03 | 477 | 478 | 186.4 |
| 242 | BaSD12L06 | 479 | 480 | 187.7 |
| 242 | BaSD23P07 | 481 | 482 | 187.7 |
| 242 | BaGS7J05 | 483 | 484 | 187.7 |
| 245 | bah29b06 | 485 | 486 | 188.3 |
| 245 | BaGS31N17 | 487 | 488 | 188.3 |
| 247 | BaGS13F08 | 489 | 490 | 190.4 |
| 248 | BaAK39G10 | 491 | 492 | 195.7 |

TABLE 1-5-continued

| Order from the short arm end | Clones | SEQ ID NO: (5' end) | SEQ ID NO: (3' end) | Distance from the short arm end (cM) |
|---|---|---|---|---|
| 249 | BaAK39G03 | 493 | 494 | 200 |
| 249 | baak2a18 | 495 | 496 | 200 |

TABLE 1-6

| Order from the short arm end | Clones | SEQ ID NO: (5' end) | SEQ ID NO: (3' end) | Distance from the short arm end (cM) |
|---|---|---|---|---|
| 251 | bags39d12 | 497 | 498 | 201.1 |
| 251 | basd17l04 | 499 | 500 | 201.1 |
| 251 | BaAK20B19 | 501 | 502 | 201.1 |
| 251 | bags15j15 | 503 | 504 | 201.1 |
| 251 | BaAK30F02 | 505 | 506 | 201.1 |
| 256 | BaGS22A21 | 507 | 508 | 202.2 |
| 256 | baet45E0410 | 509 | 510 | 202.2 |
| 256 | BaGS22C14 | 511 | 512 | 202.2 |
| 256 | bah23k12 | 513 | 514 | 202.2 |
| 260 | BaH15O13 | 515 | 516 | 203.2 |
| 260 | kr24F0412 | 517 | 518 | 203.3 |
| 260 | BaGS28O21 | 519 | 520 | 203.3 |
| 260 | BaAL15N19 | 521 | 522 | 203.3 |
| 264 | bags10j15 | 523 | 524 | 207.6 |
| 265 | bags32j03 | 525 | 526 | 209.7 |
| 266 | bags20e14 | 527 | 528 | 211.1 |
| 267 | bags3c15 | 529 | 530 | 214 |
| 268 | basd27n01 | 531 | 532 | 216 |
| 269 | BaGS6M19 | 533 | 534 | 217.1 |
| 270 | baak13e03 | 535 | 536 | 219.2 |
| 271 | BaH15M10 | 537 | 538 | 221.5 |
| 271 | bags14k12 | 539 | 540 | 221.5 |
| 271 | bast61E0509 | 541 | 542 | 221.5 |
| 271 | BaGS31N04 | 543 | 544 | 221.5 |
| 275 | BaAK27D22 | 545 | 546 | 230 |
| 275 | baal5o19 | 547 | 548 | 230 |
| 277 | bah55b18 | 549 | 550 | 231.1 |
| 278 | bah23i02 | 551 | 552 | 232.6 |
| 278 | BaAK15H22 | 553 | 554 | 232.6 |
| 280 | bags32b03 | 555 | 556 | 244.3 |
| 281 | baak30c15 | 557 | 558 | 248.9 |
| 281 | BaGS22A05 | 559 | 560 | 248.9 |
| 281 | bah16m01 | 561 | 562 | 248.9 |
| 284 | bags15e08 | 563 | 564 | 250 |
| 284 | BaGS37D12 | 565 | 566 | 250 |
| 284 | BaAL37N24 | 567 | 568 | 250 |
| 287 | BaH28B09 | 569 | 570 | 251.1 |
| 287 | bah47h08 | 571 | 572 | 251.1 |
| 289 | BaH57N07 | 573 | 574 | 252.2 |
| 290 | baak38o02 | 575 | 576 | 253.5 |
| 290 | baak20f16 | 577 | 578 | 253.5 |
| 292 | baak28n19 | 579 | 580 | 257.4 |
| 292 | bah59j07 | 581 | 582 | 257.4 |
| 292 | bah44j20 | 583 | 584 | 257.4 |
| 292 | BaH47J05 | 585 | 586 | 257.4 |
| 296 | baet39B0303 | 587 | 588 | 260.7 |
| 297 | BaAK27D19 | 589 | 590 | 261.8 |
| 297 | basd25g01 | 591 | 592 | 261.8 |
| 299 | BaAL34K17 | 593 | 594 | 262.9 |
| 299 | basd21i17 | 595 | 596 | 262.9 |

TABLE 1-7

| Order from the short arm end | Clones | SEQ ID NO: (5' end) | SEQ ID NO: (3' end) | Distance from the short arm end (cM) |
|---|---|---|---|---|
| 301 | bags15o12 | 597 | 598 | 264 |
| 301 | baal2j10 | 599 | 600 | 264 |
| 303 | baak44n10 | 601 | 602 | 264.4 |
| 304 | baak21e08 | 603 | 604 | 264.8 |
| 305 | BaGS37F14 | 605 | 606 | 265.2 |

TABLE 1-7-continued

| Order from the short arm end | Clones | SEQ ID NO: (5' end) | SEQ ID NO: (3' end) | Distance from the short arm end (cM) |
|---|---|---|---|---|
| 306 | BaAK41I21 | 607 | 608 | 266.3 |
| 306 | BaGS19C07 | 609 | 610 | 266.3 |
| 308 | BaGS15O08 | 611 | 612 | 268.4 |
| 308 | baak40p22 | 613 | 614 | 268.4 |
| 310 | BaH21K05 | 615 | 616 | 269.5 |
| 310 | baal40n03 | 617 | 618 | 269.5 |
| 312 | bags23b08 | 619 | 620 | 269.9 |
| 313 | BaGS39L18 | 621 | 622 | 270.6 |
| 313 | BaGS25K24 | 623 | 624 | 270.6 |
| 313 | bags1a18 | 625 | 626 | 270.6 |
| 313 | baal15k07 | 627 | 628 | 270.6 |
| 313 | bags14o13 | 629 | 630 | 270.6 |
| 318 | BaH18D15 | 631 | 632 | 271.7 |
| 319 | bastl04F0911 | 633 | 634 | 272.8 |
| 319 | BaGS31E03 | 635 | 636 | 272.8 |
| 321 | BaGS19J21 | 637 | 638 | 273.9 |
| 322 | BaGS39P08 | 639 | 640 | 275 |
| 323 | BaH56B06 | 641 | 642 | 276.1 |
| 324 | baal13m24 | 643 | 644 | 277.2 |
| 324 | bags15h14 | 645 | 646 | 277.2 |
| 324 | bags35j22 | 647 | 648 | 277.2 |
| 324 | baak20h22 | 649 | 650 | 277.2 |
| 328 | baal34b14 | 651 | 652 | 278.3 |
| 328 | bah16j04 | 653 | 654 | 278.3 |
| 328 | BaH54J03 | 655 | 656 | 278.3 |
| 331 | bast58C1206 | 657 | 658 | 280.4 |
| 332 | BaH26M05 | 659 | 660 | 281.5 |
| 332 | bastl20B0404 | 661 | 662 | 281.5 |
| 334 | baak14e23 | 663 | 664 | 288.1 |
| 334 | BaH15P22 | 665 | 666 | 288.1 |
| 334 | BaGS17I22 | 667 | 668 | 288.1 |
| 337 | bags15h01 | 669 | 670 | 292.4 |
| 338 | bags7p13 | 671 | 672 | 294.5 |
| 339 | BaGS29H13 | 673 | 674 | 296.7 |
| 339 | bah47b01 | 675 | 676 | 296.7 |
| 341 | bastl45E1109 | 677 | 678 | 299.9 |
| 341 | bags32m15 | 679 | 680 | 299.9 |
| 341 | basd12c09 | 681 | 682 | 299.9 |
| 344 | baal27m11 | 683 | 684 | 301 |
| 344 | basd12k01 | 685 | 686 | 301 |
| 344 | baak41n15 | 687 | 688 | 301 |
| 344 | bags1b01 | 689 | 690 | 301 |
| 348 | BaH56O11 | 691 | 692 | 302.1 |
| 349 | bah15k16 | 693 | 694 | 303.2 |
| 349 | bags31a22 | 695 | 696 | 303.2 |

TABLE 1-8

| Order from the short arm end | Clones | SEQ ID NO: (5' end) | SEQ ID NO: (3' end) | Distance from the short arm end (cM) |
|---|---|---|---|---|
| 349 | bags21e21 | 697 | 698 | 303.2 |
| 349 | baak32n05 | 699 | 700 | 303.2 |
| 353 | baet02B0503 | 701 | 702 | 304.3 |
| 353 | BaH29L05 | 703 | 704 | 304.3 |
| 355 | baet43H1016 | 705 | 706 | 305.4 |
| 356 | BaGS38N20 | 707 | 708 | 306.5 |
| 356 | BaGS23O09 | 709 | 710 | 306.5 |
| 356 | bastl26B0410 | 711 | 712 | 306.5 |
| 359 | BaH15N14 | 713 | 714 | 309.6 |
| 359 | baak20b06 | 715 | 716 | 309.6 |
| 361 | BaH16I04 | 717 | 718 | 311.7 |
| 362 | bah22p07 | 719 | 720 | 312.8 |
| 363 | baak21j02 | 721 | 722 | 313.9 |
| 363 | bah30o13 | 723 | 724 | 313.9 |
| 363 | bags38f18 | 725 | 726 | 313.9 |
| 363 | bah13o05 | 727 | 728 | 313.9 |
| 363 | baak36b12 | 729 | 730 | 313.9 |
| 363 | bags18o09 | 731 | 732 | 313.9 |
| 363 | BaAK16L10 | 733 | 734 | 313.9 |
| 363 | BaAK38E16 | 735 | 736 | 313.9 |
| 371 | bah13e15 | 737 | 738 | 317.4 |

TABLE 1-8-continued

| Order from the short arm end | Clones | SEQ ID NO: (5' end) | SEQ ID NO: (3' end) | Distance from the short arm end (cM) |
|---|---|---|---|---|
| 372 | bags1f22 | 739 | 740 | 319.8 |
| 373 | bags21o12 | 741 | 742 | 321.4 |
| 374 | BaGS9B14 | 743 | 744 | 324.7 |
| 375 | BaAL1N23 | 745 | 746 | 325.2 |
| 375 | bbak1a17 | 747 | 748 | 325.2 |
| 377 | BaH32B01 | 749 | 750 | 326.3 |
| 377 | BaSD18L13 | 751 | 752 | 326.3 |
| 379 | baak12p07 | 753 | 754 | 328.4 |
| 379 | BaH58A04 | 755 | 756 | 328.4 |
| 381 | bags1p04 | 757 | 758 | 329.1 |
| 381 | BaAL17O03 | 759 | 760 | 329.1 |
| 383 | baal8e17 | 761 | 762 | 332 |
| 384 | BaH50I05 | 763 | 764 | 335.2 |
| 384 | bastl28A0101 | 765 | 766 | 335.2 |
| 386 | BaH39L18 | 767 | 768 | 336.3 |
| 387 | bags18e18 | 769 | 770 | 342.1 |
| 388 | WMCIE8 | — | — | 362.7 |

As shown in Table 2-1 to Table 2-10, the chromosomal order in barley 2H chromosome (distance from the short arm end of 2H chromosome) has been specified for 492 clones including the base sequences of SEQ ID NO: n (where n is an odd number) and SEQ ID NO: n+1 from among the base sequences of SEQ ID NO: 771 through SEQ ID NO: 1754. The chromosomal order in barley 2H chromosome has also been specified for 8 known clones (Bmac134, cMWG682, HVM36, cMWG699, Bmag125, cMWG694, EBmac415, and MWG2076).

TABLE 2-1

| Order from the short arm end | Clones | SEQ ID NO: (5' end) | SEQ ID NO: (3' end) | Distance from the short arm end (cM) |
|---|---|---|---|---|
| 1 | BaGS20L10 | 771 | 772 | 0 |
| 2 | BaSD15P22 | 773 | 774 | 15.4 |
| 2 | bags7b16 | 775 | 776 | 15.4 |
| 4 | BaAK34H02 | 777 | 778 | 20.7 |
| 5 | BaAK22H13 | 779 | 780 | 21.7 |
| 6 | BaGS37P19 | 781 | 782 | 23.2 |
| 7 | BaAL19P17 | 783 | 784 | 24.3 |
| 8 | BaH41L14 | 785 | 786 | 25.2 |
| 9 | BaAK24H17 | 787 | 788 | 26.3 |
| 10 | bast21a0602 | 789 | 790 | 26.4 |
| 10 | BaAL27L20 | 791 | 792 | 26.4 |
| 12 | Bmac134 | — | — | 26.7 |
| 12 | cMWG682 | — | — | 26.7 |
| 12 | bags34p10 | 793 | 794 | 26.7 |
| 12 | basd18b14 | 795 | 796 | 26.7 |
| 16 | bags38p20 | 797 | 798 | 27.8 |
| 17 | BaAK41N22 | 799 | 800 | 28.9 |
| 17 | BaAK21D17 | 801 | 802 | 28.9 |
| 19 | BaAL29B07 | 803 | 804 | 30 |
| 19 | baak20o16 | 805 | 806 | 30 |
| 21 | bast42A0602 | 807 | 808 | 31.1 |
| 21 | BaH36B07 | 809 | 810 | 31.1 |
| 21 | BaAK26L07 | 811 | 812 | 31.1 |
| 21 | baal12a06 | 813 | 814 | 31.1 |
| 25 | BaSD3C20 | 815 | 816 | 33.3 |
| 26 | bastl17G0113 | 817 | 818 | 34.6 |
| 27 | baak11h14 | 819 | 820 | 39.2 |
| 28 | baal12m14 | 821 | 822 | 40.2 |
| 29 | baal33a18 | 823 | 824 | 41.3 |
| 30 | bah28a18 | 825 | 826 | 43.5 |
| 30 | bags39o04 | 827 | 828 | 43.5 |
| 30 | BaH48H04 | 829 | 830 | 43.5 |
| 30 | BaGS6B11 | 831 | 832 | 43.5 |
| 34 | bags4p16 | 833 | 834 | 44.6 |
| 34 | basd24j22 | 835 | 836 | 44.6 |
| 34 | basd16p15 | 837 | 838 | 44.6 |
| 34 | bags15k16 | 839 | 840 | 44.6 |

TABLE 2-1-continued

| Order from the short arm end | Clones | SEQ ID NO: (5' end) | SEQ ID NO: (3' end) | Distance from the short arm end (cM) |
|---|---|---|---|---|
| 34 | bast23D1208 | 841 | 842 | 44.6 |
| 39 | BaAL32B22 | 843 | 844 | 45.3 |
| 39 | BaGS39D07 | 845 | 846 | 45.3 |
| 41 | BaH19L09 | 847 | 848 | 48 |
| 41 | bags38a17 | 849 | 850 | 48 |
| 41 | BaAK39I11 | 851 | 852 | 48 |
| 44 | BaSD3I24 | 853 | 854 | 49.9 |
| 44 | BaH35F01 | 855 | 856 | 49.9 |
| 46 | BaAL30K02 | 857 | 858 | 53.9 |
| 47 | bah13l23 | 859 | 860 | 54.9 |
| 48 | BaAL26H21 | 861 | 862 | 55.7 |
| 49 | BaGS22H22 | 863 | 864 | 56.8 |
| 49 | bags13n11 | 865 | 866 | 56.8 |

TABLE 2-2

| Order from the short arm end | Clones | SEQ ID NO: (5' end) | SEQ ID NO: (3' end) | Distance from the short arm end (cM) |
|---|---|---|---|---|
| 51 | bags1h03 | 867 | 868 | 62 |
| 52 | baak32l16 | 869 | 870 | 63.2 |
| 52 | baal19a12 | 871 | 872 | 63.2 |
| 52 | BaAK45G16 | 873 | 874 | 63.2 |
| 55 | BaGS37N19 | 875 | 876 | 64.3 |
| 56 | baak3f03 | 877 | 878 | 65.4 |
| 57 | bags5c02 | 879 | 880 | 66.4 |
| 58 | BaGS35P07 | 881 | 882 | 67.4 |
| 58 | HVM36 | — | — | 67.4 |
| 60 | bah45e07 | 883 | 884 | 70.5 |
| 61 | BaAK24B09 | 885 | 886 | 71.6 |
| 61 | bags33a11 | 887 | 888 | 71.6 |
| 63 | bah62i11 | 889 | 890 | 72.7 |
| 64 | BaH56A24 | 891 | 892 | 74.9 |
| 65 | BaSD21D14 | 893 | 894 | 77.1 |
| 66 | basd1a17 | 895 | 896 | 78.2 |
| 66 | bah17n24 | 897 | 898 | 78.2 |
| 68 | kr70G0113 | 899 | 900 | 79.3 |
| 68 | basd15f08 | 901 | 902 | 79.3 |
| 68 | BaGS4J04 | 903 | 904 | 79.3 |
| 68 | baak33f06 | 905 | 906 | 79.3 |
| 72 | basd14f16 | 907 | 908 | 79.9 |
| 73 | BaH59K20 | 909 | 910 | 80.4 |
| 73 | baal35h05 | 911 | 912 | 80.4 |
| 73 | BaGS20M01 | 913 | 914 | 80.4 |
| 76 | BaH25N22 | 915 | 916 | 82.6 |
| 77 | baak14a24 | 917 | 918 | 83.7 |
| 77 | baak30d07 | 919 | 920 | 83.7 |
| 79 | bah11n18 | 921 | 922 | 84.8 |
| 79 | kr14C0305 | 923 | 924 | 84.8 |
| 79 | baet18F0911 | 925 | 926 | 84.8 |
| 79 | BaGS4J18 | 927 | 928 | 84.8 |
| 83 | bast74C0705 | 929 | 930 | 85.9 |
| 83 | BaAL4G17 | 931 | 932 | 85.9 |
| 85 | bastl43H0515 | 933 | 934 | 86.2 |
| 85 | BaH58M22 | 935 | 936 | 86.2 |
| 87 | bags10i21 | 937 | 938 | 87 |
| 87 | bah20h16 | 939 | 940 | 87 |
| 87 | BaH17P13 | 941 | 942 | 87 |
| 87 | baak41d10 | 943 | 944 | 87 |
| 91 | BaGS14F01 | 945 | 946 | 88.1 |
| 91 | BaAK16E24 | 947 | 948 | 88.1 |
| 93 | BaSD18F09 | 949 | 950 | 92.4 |
| 93 | baet42A0501 | 951 | 952 | 92.4 |
| 93 | BaAK20L07 | 953 | 954 | 92.4 |
| 96 | baak16e20 | 955 | 956 | 92.9 |
| 97 | BaGS13N14 | 957 | 958 | 93.5 |
| 98 | basd13m14 | 959 | 960 | 94.6 |
| 99 | bags20g23 | 961 | 962 | 95.2 |
| 100 | basd1l17 | 963 | 964 | 95.7 |

TABLE 2-3

| Order from the short arm end | Clones | SEQ ID NO: (5' end) | SEQ ID NO: (3' end) | Distance from the short arm end (cM) |
|---|---|---|---|---|
| 100 | basd26l01 | 965 | 966 | 95.7 |
| 100 | BaAL37J18 | 967 | 968 | 95.7 |
| 103 | bags7i05 | 969 | 970 | 96.8 |
| 103 | bah60m17 | 971 | 972 | 96.8 |
| 105 | bags21l01 | 973 | 974 | 99 |
| 106 | baet31E0109 | 975 | 976 | 101.2 |
| 107 | bags34m12 | 977 | 978 | 102.3 |
| 107 | bah50n02 | 979 | 980 | 102.3 |
| 107 | BaH50M11 | 981 | 982 | 102.3 |
| 107 | bast27E1010 | 983 | 984 | 102.3 |
| 107 | bags23c12 | 985 | 986 | 102.3 |
| 107 | bah51m11 | 987 | 988 | 102.3 |
| 113 | baak20d17 | 989 | 990 | 102.8 |
| 114 | bags23l21 | 991 | 992 | 103.4 |
| 115 | BaH52K04 | 993 | 994 | 104.5 |
| 115 | BaAL37F24 | 995 | 996 | 104.5 |
| 115 | bags23d01 | 997 | 998 | 104.5 |
| 118 | BaSD11K22 | 999 | 1000 | 105 |
| 119 | baal29m02 | 1001 | 1002 | 105.5 |
| 119 | bah17e21 | 1003 | 1004 | 105.5 |
| 119 | bah56j18 | 1005 | 1006 | 105.5 |
| 119 | bags38n06 | 1007 | 1008 | 105.5 |
| 119 | baet44D1208 | 1009 | 1010 | 105.5 |
| 119 | BaAL34O13 | 1011 | 1012 | 105.5 |
| 125 | BaGS4N05 | 1013 | 1014 | 108.7 |
| 125 | BaSD15P20 | 1015 | 1016 | 108.7 |
| 125 | baal13d11 | 1017 | 1018 | 108.7 |
| 125 | bah27g02 | 1019 | 1020 | 108.7 |
| 125 | basd27m10 | 1021 | 1022 | 108.7 |
| 125 | basd23f16 | 1023 | 1024 | 108.7 |
| 125 | bah16i19 | 1025 | 1026 | 108.7 |
| 125 | BaH50I20 | 1027 | 1028 | 108.7 |
| 125 | BaH34M23 | 1029 | 1030 | 108.7 |
| 134 | bah28b24 | 1031 | 1032 | 109.3 |
| 135 | BaH50P13 | 1033 | 1034 | 109.8 |
| 135 | basd11m16 | 1035 | 1036 | 109.8 |
| 137 | bags10p15 | 1037 | 1038 | 110.9 |
| 137 | bags4g01 | 1039 | 1040 | 110.9 |
| 137 | bags10k08 | 1041 | 1042 | 110.9 |
| 137 | bags5e16 | 1043 | 1044 | 110.9 |
| 141 | bags18l02 | 1045 | 1046 | 114.1 |
| 141 | baak44k02 | 1047 | 1048 | 114.1 |
| 141 | bags35a20 | 1049 | 1050 | 114.1 |
| 141 | BaGS26M11 | 1051 | 1052 | 114.1 |
| 141 | basd14h21 | 1053 | 1054 | 114.1 |
| 141 | BaSD13D12 | 1055 | 1056 | 114.1 |
| 147 | bags38k23 | 1057 | 1058 | 114.3 |
| 147 | BaH42E05 | 1059 | 1060 | 114.3 |
| 147 | bastl55A0701 | 1061 | 1062 | 114.3 |
| 147 | bags13g18 | 1063 | 1064 | 114.3 |

TABLE 2-4

| Order from the short arm end | Clones | SEQ ID NO: (5' end) | SEQ ID NO: (3' end) | Distance from the short arm end (cM) |
|---|---|---|---|---|
| 147 | BaH15D23 | 1065 | 1066 | 114.3 |
| 147 | kr28B0604 | 1067 | 1068 | 114.3 |
| 147 | bags10f01 | 1069 | 1070 | 114.3 |
| 154 | BaGS33I07 | 1071 | 1072 | 116.4 |
| 154 | BaSD27B02 | 1073 | 1074 | 116.4 |
| 154 | BaGS30N12 | 1075 | 1076 | 116.4 |
| 154 | basd3h13 | 1077 | 1078 | 116.4 |
| 154 | BaGS37L19 | 1079 | 1080 | 116.4 |
| 159 | bah16g18 | 1081 | 1082 | 117.5 |
| 159 | bags20i15 | 1083 | 1084 | 117.5 |
| 161 | bags35c23 | 1085 | 1086 | 118 |
| 162 | bah56k07 | 1087 | 1088 | 118.5 |
| 162 | bags37d02 | 1089 | 1090 | 118.5 |
| 164 | BaAK19K05 | 1091 | 1092 | 121.6 |
| 164 | bah11i16 | 1093 | 1094 | 121.6 |
| 166 | bags22l23 | 1095 | 1095 | 123.6 |
| 166 | kr33A0901 | 1097 | 1098 | 123.6 |
| 168 | bastl38C0606 | 1099 | 1100 | 125.4 |
| 168 | baak11i13 | 1101 | 1102 | 125.4 |
| 168 | BaH58E19 | 1103 | 1104 | 125.4 |
| 168 | BaGS31G22 | 1105 | 1106 | 125.4 |
| 168 | bah37h01 | 1107 | 1108 | 125.4 |
| 168 | BaAL29P13 | 1109 | 1110 | 125.4 |
| 174 | bags39a22 | 1111 | 1112 | 126 |
| 175 | bah19g10 | 1113 | 1114 | 126.4 |
| 175 | BaAL31A14 | 1115 | 1116 | 126.4 |
| 175 | BaH50G15 | 1117 | 1118 | 126.4 |
| 175 | BaH51M12 | 1119 | 1120 | 126.4 |
| 175 | bags18k22 | 1121 | 1122 | 126.4 |
| 175 | BaGS20N21 | 1123 | 1124 | 126.4 |
| 175 | BaSD17O21 | 1125 | 1126 | 126.4 |
| 175 | BaH37G17 | 1127 | 1128 | 126.4 |
| 183 | bags30l22 | 1129 | 1130 | 128.6 |
| 184 | baak22b17 | 1131 | 1132 | 129.7 |
| 184 | bags20f22 | 1133 | 1134 | 129.7 |
| 186 | bast72G0113 | 1135 | 1136 | 131.8 |
| 186 | BaH30B05 | 1137 | 1138 | 131.8 |
| 186 | BaH60B14 | 1139 | 1140 | 131.8 |
| 186 | BaH17B16 | 1141 | 1142 | 131.8 |
| 190 | basd12n23 | 1143 | 1144 | 133.9 |
| 190 | BaH61A21 | 1145 | 1146 | 133.9 |
| 190 | BaAK19H17 | 1147 | 1148 | 133.9 |
| 190 | bah47l12 | 1149 | 1150 | 133.9 |
| 190 | baak18p11 | 1151 | 1152 | 133.9 |
| 190 | baet29H0715 | 1153 | 1154 | 133.9 |
| 190 | BaH13D11 | 1155 | 1156 | 133.9 |
| 190 | baet39D1107 | 1157 | 1158 | 133.9 |
| 190 | BaH53E15 | 1159 | 1160 | 133.9 |
| 190 | bags32o15 | 1161 | 1162 | 133.9 |
| 190 | bast48A0701 | 1163 | 1164 | 133.9 |

TABLE 2-5

| Order from the short arm end | Clones | SEQ ID NO: (5' end) | SEQ ID NO: (3' end) | Distance from the short arm end (cM) |
|---|---|---|---|---|
| 190 | bast62D0907 | 1165 | 1166 | 133.9 |
| 190 | BaH45P22 | 1167 | 1168 | 133.9 |
| 190 | BaGS32L16 | 1169 | 1170 | 133.9 |
| 190 | BaAK30J05 | 1171 | 1172 | 133.9 |
| 190 | bah52a14 | 1173 | 1174 | 133.9 |
| 190 | bah58i22 | 1175 | 1176 | 133.9 |
| 190 | BaH56L16 | 1177 | 1178 | 133.9 |
| 190 | bah52a21 | 1179 | 1180 | 133.9 |
| 190 | BaSD14G11 | 1181 | 1182 | 133.9 |
| 190 | bags6a03 | 1183 | 1184 | 133.9 |
| 190 | bast72E0109 | 1185 | 1186 | 133.9 |
| 190 | bags21a21 | 1187 | 1188 | 133.9 |
| 190 | BaH58P13 | 1189 | 1190 | 133.9 |
| 214 | bah27n22 | 1191 | 1192 | 134.4 |
| 215 | bags20c13 | 1193 | 1194 | 134.9 |
| 215 | bags30i14 | 1195 | 1196 | 134.9 |
| 215 | BaAK17E11 | 1197 | 1198 | 134.9 |
| 215 | baal1d17 | 1199 | 1200 | 134.9 |
| 215 | bags22f06 | 1201 | 1202 | 134.9 |
| 215 | baal10l01 | 1203 | 1204 | 134.9 |
| 215 | baak26e17 | 1205 | 1206 | 134.9 |
| 215 | bah16a03 | 1207 | 1208 | 134.9 |
| 215 | BaAL11F18 | 1209 | 1210 | 134.9 |
| 215 | BaAK29E10 | 1211 | 1212 | 134.9 |
| 215 | bags32d21 | 1213 | 1214 | 134.9 |
| 215 | bah54j22 | 1215 | 1216 | 134.9 |
| 215 | baak16f14 | 1217 | 1218 | 134.9 |
| 215 | baak44c12 | 1219 | 1220 | 134.9 |
| 215 | bah13f11 | 1221 | 1222 | 134.9 |
| 215 | baal39m19 | 1223 | 1224 | 134.9 |
| 215 | baak4e02 | 1225 | 1226 | 134.9 |
| 215 | baak46f04 | 1227 | 1228 | 134.9 |

TABLE 2-5-continued

| Order from the short arm end | Clones | SEQ ID NO: (5' end) | SEQ ID NO: (3' end) | Distance from the short arm end (cM) |
|---|---|---|---|---|
| 215 | BaAK13N23 | 1229 | 1230 | 134.9 |
| 215 | BaGS20E09 | 1231 | 1232 | 134.9 |
| 215 | baal4f01 | 1233 | 1234 | 134.9 |
| 215 | BaSD19I17 | 1235 | 1236 | 134.9 |
| 215 | baal4l21 | 1237 | 1238 | 134.9 |
| 215 | BaAK19P01 | 1239 | 1240 | 134.9 |
| 215 | BaAK31O14 | 1241 | 1242 | 134.9 |
| 240 | BaH26P22 | 1243 | 1244 | 135.3 |
| 241 | baal13d17 | 1245 | 1246 | 136 |
| 242 | bags22j12 | 1247 | 1248 | 138.3 |
| 242 | bags33p05 | 1249 | 1250 | 138.3 |
| 242 | bags38j07 | 1251 | 1252 | 138.3 |
| 242 | kr59F0311 | 1253 | 1254 | 138.3 |
| 242 | baal13e10 | 1255 | 1256 | 138.3 |
| 242 | bags15d19 | 1257 | 1258 | 138.3 |
| 242 | BaGS5K11 | 1259 | 1260 | 138.3 |
| 242 | BaGS10J14 | 1261 | 1262 | 138.3 |
| 242 | baak41m17 | 1263 | 1264 | 138.3 |

TABLE 2-6

| Order from the short arm end | Clones | SEQ ID NO: (5' end) | SEQ ID NO: (3' end) | Distance from the short arm end (cM) |
|---|---|---|---|---|
| 242 | bah57o03 | 1265 | 1266 | 138.3 |
| 242 | baak41d22 | 1267 | 1268 | 138.3 |
| 242 | bah61c16 | 1269 | 1270 | 138.3 |
| 242 | BaAL7M13 | 1271 | 1272 | 138.3 |
| 242 | BaAK31F11 | 1273 | 1274 | 138.3 |
| 242 | basd22k05 | 1275 | 1276 | 138.3 |
| 242 | basd3p19 | 1277 | 1278 | 138.3 |
| 242 | baak17o09 | 1279 | 1280 | 138.3 |
| 242 | baal33d23 | 1281 | 1282 | 138.3 |
| 242 | BaAK12F04 | 1283 | 1284 | 138.3 |
| 242 | bah53j16 | 1285 | 1286 | 138.3 |
| 262 | BaSD2E24 | 1287 | 1288 | 138.5 |
| 263 | bags39h08 | 1289 | 1290 | 138.7 |
| 264 | BaSD1N02 | 1291 | 1292 | 139.5 |
| 264 | bags20m21 | 1293 | 1294 | 139.5 |
| 264 | baal10h19 | 1295 | 1296 | 139.5 |
| 264 | basd12m11 | 1297 | 1298 | 139.5 |
| 264 | bah29d24 | 1299 | 1300 | 139.5 |
| 264 | BaGS39P09 | 1301 | 1302 | 139.5 |
| 264 | BaGS31F17 | 1303 | 1304 | 139.5 |
| 264 | BaGS23D08 | 1305 | 1306 | 139.5 |
| 264 | bags39d15 | 1307 | 1308 | 139.5 |
| 264 | BaGS34I17 | 1309 | 1310 | 139.5 |
| 274 | BaH32N02 | 1311 | 1312 | 141.6 |
| 274 | BaSD18H19 | 1313 | 1314 | 141.6 |
| 274 | bast63A0101 | 1315 | 1316 | 141.6 |
| 274 | BaH50N04 | 1317 | 1318 | 141.6 |
| 278 | baal4a13 | 1319 | 1320 | 147.5 |
| 278 | baal41l18 | 1321 | 1322 | 147.5 |
| 280 | BaH31A03 | 1323 | 1324 | 152.2 |
| 280 | bastl39A0901 | 1325 | 1326 | 152.2 |
| 280 | baet46D0507 | 1327 | 1328 | 152.2 |
| 283 | baal27e20 | 1329 | 1330 | 153.3 |
| 283 | bags37l16 | 1331 | 1332 | 153.3 |
| 283 | baak34o06 | 1333 | 1334 | 153.3 |
| 286 | BaAL30I11 | 1335 | 1336 | 155.4 |
| 286 | BaH62C15 | 1337 | 1338 | 155.4 |
| 286 | basd12i15 | 1339 | 1340 | 155.4 |
| 286 | BaAK40I03 | 1341 | 1342 | 155.4 |
| 286 | BaAK23E14 | 1343 | 1344 | 155.4 |
| 286 | BaAL21F11 | 1345 | 1346 | 155.4 |
| 286 | BaAK16L19 | 1347 | 1348 | 155.4 |
| 293 | baal27a24 | 1349 | 1350 | 156.5 |
| 294 | kr41H0315 | 1351 | 1352 | 157.6 |
| 294 | BaH62I23 | 1353 | 1354 | 157.6 |
| 296 | bah52i24 | 1355 | 1356 | 158.7 |
| 296 | bastl33A0301 | 1357 | 1358 | 158.7 |
| 296 | BaH28J15 | 1359 | 1360 | 158.7 |

TABLE 2-6-continued

| Order from the short arm end | Clones | SEQ ID NO: (5' end) | SEQ ID NO: (3' end) | Distance from the short arm end (cM) |
|---|---|---|---|---|
| 299 | bastl56A0301 | 1361 | 1362 | 159.8 |
| 299 | baal39a03 | 1363 | 1364 | 159.8 |

TABLE 2-7

| Order from the short arm end | Clones | SEQ ID NO: (5' end) | SEQ ID NO: (3' end) | Distance from the short arm end (cM) |
|---|---|---|---|---|
| 242 | bah57o03 | 1265 | 1266 | 138.3 |
| 242 | baak41d22 | 1267 | 1268 | 138.3 |
| 242 | bah61c16 | 1269 | 1270 | 138.3 |
| 242 | BaAL7M13 | 1271 | 1272 | 138.3 |
| 242 | BaAK31F11 | 1273 | 1274 | 138.3 |
| 242 | basd22k05 | 1275 | 1276 | 138.3 |
| 242 | basd3p19 | 1277 | 1278 | 138.3 |
| 242 | baak17o09 | 1279 | 1280 | 138.3 |
| 242 | baal33d23 | 1281 | 1282 | 138.3 |
| 242 | BaAK12F04 | 1283 | 1284 | 138.3 |
| 242 | bah53j16 | 1285 | 1286 | 138.3 |
| 262 | BaSD2E24 | 1287 | 1288 | 138.5 |
| 263 | bags39h08 | 1289 | 1290 | 138.7 |
| 264 | BaSD1N02 | 1291 | 1292 | 139.5 |
| 264 | bags20m21 | 1293 | 1294 | 139.5 |
| 264 | baal10h19 | 1295 | 1296 | 139.5 |
| 264 | basd12m11 | 1297 | 1298 | 139.5 |
| 264 | bah29d24 | 1299 | 1300 | 139.5 |
| 264 | BaGS39P09 | 1301 | 1302 | 139.5 |
| 264 | BaGS31F17 | 1303 | 1304 | 139.5 |
| 264 | BaGS23D08 | 1305 | 1306 | 139.5 |
| 264 | bags39d15 | 1307 | 1308 | 139.5 |
| 264 | BaGS34I17 | 1309 | 1310 | 139.5 |
| 274 | BaH32N02 | 1311 | 1312 | 141.6 |
| 274 | BaSD18H19 | 1313 | 1314 | 141.6 |
| 274 | bast63A0101 | 1315 | 1316 | 141.6 |
| 274 | BaH50N04 | 1317 | 1318 | 141.6 |
| 278 | baal4a13 | 1319 | 1320 | 147.5 |
| 278 | baal41l18 | 1321 | 1322 | 147.5 |
| 280 | BaH31A03 | 1323 | 1324 | 152.2 |
| 280 | bastl39A0901 | 1325 | 1326 | 152.2 |
| 280 | baet46D0507 | 1327 | 1328 | 152.2 |
| 283 | baal27e20 | 1329 | 1330 | 153.3 |
| 283 | bagsS7l16 | 1331 | 1332 | 153.3 |
| 283 | baak34o06 | 1333 | 1334 | 153.3 |
| 286 | BaAL30I11 | 1335 | 1336 | 155.4 |
| 286 | BaH62C15 | 1337 | 1338 | 155.4 |
| 286 | basd12i15 | 1339 | 1340 | 155.4 |
| 286 | BaAK40I03 | 1341 | 1342 | 155.4 |
| 286 | BaAK23E14 | 1343 | 1344 | 155.4 |
| 286 | BaAL21F11 | 1345 | 1346 | 155.4 |
| 286 | BaAK16L19 | 1347 | 1348 | 155.4 |
| 293 | baal27a24 | 1349 | 1350 | 156.5 |
| 294 | kr41H0315 | 1351 | 1352 | 157.6 |
| 294 | BaH62I23 | 1353 | 1354 | 157.6 |
| 296 | bah52i24 | 1355 | 1356 | 158.7 |
| 296 | bastl33A0301 | 1357 | 1358 | 158.7 |
| 296 | BaH28J15 | 1359 | 1360 | 158.7 |
| 299 | bastl56A0301 | 1361 | 1362 | 159.8 |
| 299 | baal39a03 | 1363 | 1364 | 159.8 |

TABLE 2-8

| Order from the short arm end | Clones | SEQ ID NO: (5' end) | SEQ ID NO: (3' end) | Distance from the short arm end (cM) |
|---|---|---|---|---|
| 345 | kr14F0911 | 1459 | 1460 | 190.8 |
| 352 | BaGS36A04 | 1461 | 1462 | 192.8 |
| 352 | bags13a16 | 1463 | 1464 | 192.8 |
| 354 | bags26e20 | 1465 | 1466 | 196.1 |
| 355 | baet45G1214 | 1467 | 1468 | 197.6 |

TABLE 2-8-continued

| Order from the short arm end | Clones | SEQ ID NO: (5' end) | SEQ ID NO: (3' end) | Distance from the short arm end (cM) |
|---|---|---|---|---|
| 356 | BaAK35F14 | 1469 | 1470 | 202 |
| 357 | BaAK23N21 | 1471 | 1472 | 203.2 |
| 357 | basd13j22 | 1473 | 1474 | 203.2 |
| 359 | BaAK46E10 | 1475 | 1476 | 208.4 |
| 359 | bastl55F0812 | 1477 | 1478 | 208.4 |
| 361 | baak46l06 | 1479 | 1480 | 209.4 |
| 361 | BaAL2D11 | 1481 | 1482 | 209.4 |
| 363 | baak15p17 | 1483 | 1484 | 210.5 |
| 364 | BaGS33J16 | 1485 | 1486 | 211.6 |
| 364 | bags7p21 | 1487 | 1488 | 211.6 |
| 366 | BaAK22E05 | 1489 | 1490 | 212.7 |
| 366 | bah42m05 | 1491 | 1492 | 212.7 |
| 368 | BaAK25L01 | 1493 | 1494 | 213.8 |
| 369 | bags39e24 | 1495 | 1496 | 214.9 |
| 369 | BaH56N24 | 1497 | 1498 | 214.9 |
| 371 | baak44i12 | 1499 | 1500 | 215.4 |
| 372 | bah21j03 | 1501 | 1502 | 215.9 |
| 373 | kr71B0103 | 1503 | 1504 | 217.4 |
| 373 | BaGS16D15 | 1505 | 1506 | 217.4 |
| 375 | baak21p23 | 1507 | 1508 | 217.9 |
| 376 | BaGS6G09 | 1509 | 1510 | 219 |
| 376 | BaSD15M02 | 1511 | 1512 | 219 |
| 376 | basd13f02 | 1513 | 1514 | 219 |
| 376 | BaH19F21 | 1515 | 1516 | 219 |
| 380 | bags20b10 | 1517 | 1518 | 224.5 |
| 380 | bah26j10 | 1519 | 1520 | 224.5 |
| 382 | bast65G0113 | 1521 | 1522 | 225.5 |
| 383 | baak4k13 | 1523 | 1524 | 226.5 |
| 383 | baal19j23 | 1525 | 1526 | 226.5 |
| 383 | bags34h11 | 1527 | 1528 | 226.5 |
| 386 | bags37j03 | 1529 | 1530 | 227.6 |
| 387 | baal15e13 | 1531 | 1532 | 230.5 |
| 387 | BaAL5O10 | 1533 | 1534 | 230.5 |
| 389 | BaGS29J10 | 1535 | 1536 | 234.4 |
| 390 | bah22o08 | 1537 | 1538 | 235.7 |
| 390 | bags6k13 | 1539 | 1540 | 235.7 |
| 392 | bastl43C0705 | 1541 | 1542 | 236.8 |
| 393 | BaAL4D10 | 1543 | 1544 | 237.4 |
| 393 | basd12n12 | 1545 | 1546 | 237.4 |
| 395 | bags23h03 | 1547 | 1548 | 240.3 |
| 395 | bags6l02 | 1549 | 1550 | 240.3 |
| 397 | bast63B0703 | 1551 | 1552 | 243.4 |
| 397 | BaSD13E02 | 1553 | 1554 | 243.4 |
| 399 | BaSD14P15 | 1555 | 1556 | 248.7 |
| 399 | bah13a17 | 1557 | 1558 | 248.7 |

TABLE 2-9

| Order from the short arm end | Clones | SEQ ID NO: (5' end) | SEQ ID NO: (3' end) | Distance from the short arm end (cM) |
|---|---|---|---|---|
| 401 | BaH50L23 | 1559 | 1560 | 250.9 |
| 401 | bags19g04 | 1561 | 1562 | 250.9 |
| 403 | bast73E0210 | 1563 | 1564 | 252 |
| 403 | BaH50O21 | 1565 | 1566 | 252 |
| 403 | basd21g05 | 1567 | 1568 | 252 |
| 406 | bah33p11 | 1569 | 1570 | 253.1 |
| 406 | baal5i19 | 1571 | 1572 | 253.1 |
| 406 | bah16e04 | 1573 | 1574 | 253.1 |
| 406 | baak32p24 | 1575 | 1576 | 253.1 |
| 406 | EBmac415 | — | — | 253.1 |
| 411 | bags38f12 | 1577 | 1578 | 254.2 |
| 411 | basd26p18 | 1579 | 1580 | 254.2 |
| 413 | baak45h16 | 1581 | 1582 | 255.3 |
| 414 | bah28p12 | 1583 | 1584 | 257.5 |
| 415 | bah19a10 | 1585 | 1586 | 258.6 |
| 416 | baak13d11 | 1587 | 1588 | 258.8 |
| 417 | bah49p10 | 1589 | 1590 | 259.1 |
| 417 | baal32n15 | 1591 | 1592 | 259.1 |
| 419 | bast09C0305 | 1593 | 1594 | 260.6 |
| 420 | basd16l09 | 1595 | 1596 | 263.9 |
| 420 | BaAK22H04 | 1597 | 1598 | 263.9 |

TABLE 2-9-continued

| Order from the short arm end | Clones | SEQ ID NO: (5' end) | SEQ ID NO: (3' end) | Distance from the short arm end (cM) |
|---|---|---|---|---|
| 422 | BaGS15J13 | 1599 | 1600 | 265 |
| 422 | kr66G0414 | 1601 | 1602 | 265 |
| 424 | BaSD22C07 | 1603 | 1604 | 266.1 |
| 424 | kr71C1105 | 1605 | 1606 | 266.1 |
| 424 | bags34i11 | 1607 | 1608 | 266.1 |
| 427 | BaH23K17 | 1609 | 1610 | 267.3 |
| 428 | bast39D0107 | 1611 | 1612 | 270.5 |
| 428 | BaH44K24 | 1613 | 1614 | 270.5 |
| 430 | BaGS18N21 | 1615 | 1616 | 273.5 |
| 430 | baak32k15 | 1617 | 1618 | 273.5 |
| 432 | bah61a13 | 1619 | 1620 | 275.7 |
| 432 | bags35n11 | 1621 | 1622 | 275.7 |
| 432 | BaAK24I03 | 1623 | 1624 | 275.7 |
| 435 | baal4h20 | 1625 | 1626 | 277.5 |
| 435 | BaH28N23 | 1627 | 1628 | 277.5 |
| 435 | bags10e13 | 1629 | 1630 | 277.5 |
| 438 | baak27i10 | 1631 | 1632 | 278.5 |
| 438 | bags19d13 | 1633 | 1634 | 278.5 |
| 438 | baak19d04 | 1635 | 1636 | 278.5 |
| 438 | BaAL34O19 | 1637 | 1638 | 278.5 |
| 438 | baal12l02 | 1639 | 1640 | 278.5 |
| 438 | BaAK1P04 | 1641 | 1642 | 278.5 |
| 438 | baak35m13 | 1643 | 1644 | 278.5 |
| 438 | bags35a12 | 1645 | 1646 | 278.5 |
| 446 | bah41n09 | 1647 | 1648 | 279.6 |
| 446 | BaGS23I12 | 1649 | 1650 | 279.6 |
| 448 | BaH16P20 | 1651 | 1652 | 280.4 |
| 448 | BaAK42L17 | 1653 | 1654 | 280.4 |
| 450 | baak36d23 | 1655 | 1656 | 284.2 |

TABLE 2-10

| Order from the short arm end | Clones | SEQ ID NO: (5' end) | SEQ ID NO: (3' end) | Distance from the short arm end (cM) |
|---|---|---|---|---|
| 450 | bast78C1006 | 1657 | 1658 | 284.2 |
| 452 | BaH45O16 | 1659 | 1660 | 285 |
| 453 | bah21h09 | 1661 | 1662 | 286.1 |
| 454 | bah58p22 | 1663 | 1664 | 287.2 |
| 455 | bags20l19 | 1665 | 1666 | 288.8 |
| 456 | bah13i10 | 1667 | 1668 | 290.4 |
| 457 | BaAK36B07 | 1669 | 1670 | 291.5 |
| 458 | baak26b05 | 1671 | 1672 | 295.5 |
| 459 | baal7c15 | 1673 | 1674 | 296.6 |
| 459 | bah63f05 | 1675 | 1676 | 296.6 |
| 461 | bags15j16 | 1677 | 1678 | 297.9 |
| 462 | BaGS6N10 | 1679 | 1680 | 299.2 |
| 462 | bah41e10 | 1681 | 1682 | 299.2 |
| 464 | BaH54D08 | 1683 | 1684 | 299.7 |
| 465 | baak18c01 | 1685 | 1686 | 300.2 |
| 466 | basd21o07 | 1687 | 1688 | 301.3 |
| 467 | bah41b23 | 1689 | 1690 | 301.9 |
| 468 | basd18g15 | 1691 | 1692 | 302.4 |
| 468 | baak43c03 | 1693 | 1694 | 302.4 |
| 468 | bastl30D0408 | 1695 | 1696 | 302.4 |
| 468 | bah17p16 | 1697 | 1698 | 302.4 |
| 472 | baal13f18 | 1699 | 1700 | 303.5 |
| 472 | bags18i22 | 1701 | 1702 | 303.5 |
| 472 | bags9b02 | 1703 | 1704 | 303.5 |
| 475 | bah11e22 | 1705 | 1706 | 323.4 |
| 476 | bah58h09 | 1707 | 1708 | 332.9 |
| 477 | basd16e16 | 1709 | 1710 | 334.9 |
| 478 | BaAK4C12 | 1711 | 1712 | 340 |
| 479 | bags37a05 | 1713 | 1714 | 343.4 |
| 480 | bags9p10 | 1715 | 1716 | 351.7 |
| 481 | baak24m01 | 1717 | 1718 | 352.7 |
| 482 | basd27d09 | 1719 | 1720 | 353.2 |
| 483 | baak34a14 | 1721 | 1722 | 353.7 |
| 483 | baak36a20 | 1723 | 1724 | 353.7 |
| 483 | BaSD17P09 | 1725 | 1726 | 353.7 |
| 486 | bags5m04 | 1727 | 1728 | 354.8 |
| 487 | BaGS5E06 | 1729 | 1730 | 355.9 |

TABLE 2-10-continued

| Order from the short arm end | Clones | SEQ ID NO: (5' end) | SEQ ID NO: (3' end) | Distance from the short arm end (cM) |
|---|---|---|---|---|
| 487 | MWG2076 | — | — | 355.9 |
| 487 | bags15f03 | 1731 | 1732 | 355.9 |
| 487 | bags18j23 | 1733 | 1734 | 355.9 |
| 487 | baal13m04 | 1735 | 1736 | 355.9 |
| 487 | bags9o24 | 1737 | 1738 | 355.9 |
| 493 | kr49E0610 | 1739 | 1740 | 356.4 |
| 494 | bah12h16 | 1741 | 1742 | 356.9 |
| 494 | baak33n16 | 1743 | 1744 | 356.9 |
| 494 | BaGS22E05 | 1745 | 1746 | 356.9 |
| 497 | bah26n01 | 1747 | 1748 | 358 |
| 497 | BaGS39E07 | 1749 | 1750 | 358 |
| 497 | BaH45O03 | 1751 | 1752 | 358 |
| 500 | BaH38A09 | 1753 | 1754 | 360.2 |

As shown in Table 3-1 to Table 3-10, the chromosomal order in barley 3H chromosome (distance from the short arm end of 3H chromosome) has been specified for 444 clones including the base sequences of SEQ ID NO: n (where n is an odd number) and SEQ ID NO: n+1 from among the base sequences of SEQ ID NO: 1755 through SEQ ID NO: 2642. The chromosomal order in barley 3H chromosome has also been specified for 13 known clones (MWG848, HvLTPPB, HVM9, Bmac67, Bmag136, Bmac209, HVM27, HvBRI1, HVM33, HVM60, Bmag225, Bmag13, and HVM62).

TABLE 3-1

| Order from the short arm end | Clones | SEQ ID NO: (5' end) | SEQ ID NO: (3' end) | Distance from the short arm end (cM) |
|---|---|---|---|---|
| 1 | BaAL15P01 | 1755 | 1756 | 0 |
| 2 | BaAK42D06 | 1757 | 1758 | 9.8 |
| 2 | bags12k16 | 1759 | 1760 | 9.8 |
| 2 | BaAL36H19 | 1761 | 1762 | 9.8 |
| 2 | bags1d06 | 1763 | 1764 | 9.8 |
| 6 | bast18A0602 | 1765 | 1766 | 10.9 |
| 6 | basd22i04 | 1767 | 1768 | 10.9 |
| 8 | BaGS31M01 | 1769 | 1770 | 12 |
| 9 | BaH63H24 | 1771 | 1772 | 12.4 |
| 10 | basd15n13 | 1773 | 1774 | 12.8 |
| 11 | MWG848 | — | — | 13.1 |
| 11 | BaAK13C16 | 1775 | 1776 | 13.1 |
| 13 | BaGS32C19 | 1777 | 1778 | 15.3 |
| 13 | baak36f08 | 1779 | 1780 | 15.3 |
| 15 | bastl04C0406 | 1781 | 1782 | 16.4 |
| 15 | bastl42D1107 | 1783 | 1784 | 16.4 |
| 17 | BaGS31B20 | 1785 | 1786 | 17.5 |
| 17 | baak39l17 | 1787 | 1788 | 17.5 |
| 19 | BaAL17J24 | 1789 | 1790 | 20.7 |
| 19 | bah15p03 | 1791 | 1792 | 20.7 |
| 21 | baak20g06 | 1793 | 1794 | 21.8 |
| 21 | baal22c16 | 1795 | 1796 | 21.8 |
| 21 | baak46o05 | 1797 | 1798 | 21.8 |
| 24 | basd15h22 | 1799 | 1800 | 22.9 |
| 25 | BaSD19C07 | 1801 | 1802 | 24 |
| 26 | bags22i13 | 1803 | 1804 | 25.7 |
| 27 | baak39a14 | 1805 | 1806 | 26.8 |
| 28 | bah31e12 | 1807 | 1808 | 27.9 |
| 28 | BaSD15L22 | 1809 | 1810 | 27.9 |
| 30 | BaGS20D21 | 1811 | 1812 | 30.1 |
| 31 | bags39o21 | 1813 | 1814 | 30.7 |
| 31 | basd21j11 | 1815 | 1816 | 30.7 |
| 33 | BaH48C10 | 1817 | 1818 | 32.3 |
| 34 | BaH54J07 | 1819 | 1820 | 33.9 |
| 35 | BaSD19H23 | 1821 | 1822 | 36.1 |
| 35 | baak35n06 | 1823 | 1824 | 36.1 |
| 37 | bags35b22 | 1825 | 1826 | 39.3 |
| 37 | BaAK30H06 | 1827 | 1828 | 39.3 |
| 37 | BaAL15M07 | 1829 | 1830 | 39.3 |
| 40 | BaGS20N02 | 1831 | 1832 | 40.4 |
| 40 | BaAL19L12 | 1833 | 1834 | 40.4 |

TABLE 3-1-continued

| Order from the short arm end | Clones | SEQ ID NO: (5' end) | SEQ ID NO: (3' end) | Distance from the short arm end (cM) |
|---|---|---|---|---|
| 42 | bags25b05 | 1835 | 1836 | 41.5 |
| 42 | HvLTPPB | — | — | 41.5 |
| 42 | baal1h04 | 1837 | 1838 | 41.5 |
| 45 | baet46B0903 | 1839 | 1840 | 42.6 |
| 45 | BaGS19F16 | 1841 | 1842 | 42.6 |
| 45 | baak13g18 | 1843 | 1844 | 42.6 |
| 48 | BaH45N12 | 1845 | 1846 | 47 |
| 49 | bast74H0216 | 1847 | 1848 | 48.1 |
| 50 | bah24l06 | 1849 | 1850 | 50.5 |

TABLE 3-2

| Order from the short arm end | Clones | SEQ ID NO: (5' end) | SEQ ID NO: (3' end) | Distance from the short arm end (cM) |
|---|---|---|---|---|
| 51 | BaAK45C14 | 1851 | 1852 | 53.4 |
| 51 | baal5k12 | 1853 | 1854 | 53.4 |
| 53 | kr63F0111 | 1855 | 1856 | 54.1 |
| 53 | baak13h18 | 1857 | 1858 | 54.1 |
| 53 | baak12j16 | 1859 | 1860 | 54.1 |
| 56 | BaAK28J20 | 1861 | 1862 | 55.2 |
| 56 | BaH27G14 | 1863 | 1864 | 55.2 |
| 56 | BaH49B13 | 1865 | 1866 | 55.2 |
| 59 | BaGS35A09 | 1867 | 1868 | 57.4 |
| 60 | BaGS38L24 | 1869 | 1870 | 58.6 |
| 61 | BaAK43H20 | 1871 | 1872 | 66.5 |
| 61 | bast16A0802 | 1873 | 1874 | 66.5 |
| 61 | basd18k01 | 1875 | 1876 | 66.5 |
| 64 | BaH58D17 | 1877 | 1878 | 67.6 |
| 65 | BaAK30M07 | 1879 | 1880 | 69.2 |
| 65 | bags6a04 | 1881 | 1882 | 69.2 |
| 67 | kr15H0915 | 1883 | 1884 | 69.7 |
| 67 | bags26d01 | 1885 | 1886 | 69.7 |
| 69 | basd14k04 | 1887 | 1888 | 70.8 |
| 69 | BaSD24D11 | 1889 | 1890 | 70.8 |
| 69 | BaH53L10 | 1891 | 1892 | 70.8 |
| 72 | BaH60D22 | 1893 | 1894 | 73 |
| 72 | BaSD1G06 | 1895 | 1896 | 73 |
| 72 | BaAK21L13 | 1897 | 1898 | 73 |
| 72 | bah57m03 | 1899 | 1900 | 73 |
| 76 | baal30b10 | 1901 | 1902 | 74.1 |
| 77 | bah62n16 | 1903 | 1904 | 74.7 |
| 78 | BaGS22F15 | 1905 | 1906 | 75.2 |
| 78 | BaH50J14 | 1907 | 1908 | 75.2 |
| 80 | bah19d23 | 1909 | 1910 | 75.7 |
| 81 | bags38c06 | 1911 | 1912 | 76.2 |
| 81 | BaGS25N05 | 1913 | 1914 | 76.2 |
| 81 | bastl29B0503 | 1915 | 1916 | 76.2 |
| 84 | baak27d01 | 1917 | 1918 | 77.3 |
| 84 | baak43n21 | 1919 | 1920 | 77.3 |
| 86 | BaAL4F05 | 1921 | 1922 | 78.4 |
| 86 | baal4a06 | 1923 | 1924 | 78.4 |
| 88 | bast17D1008 | 1925 | 1926 | 80 |
| 89 | BaGS16B17 | 1927 | 1928 | 81.1 |
| 90 | BaGS27P18 | 1929 | 1930 | 81.7 |
| 90 | BaGS4J14 | 1931 | 1932 | 81.7 |
| 90 | BaAK16B19 | 1933 | 1934 | 81.7 |
| 90 | baal40p07 | 1935 | 1936 | 81.7 |
| 94 | bah49c19 | 1937 | 1938 | 84 |
| 95 | bast58C0406 | 1939 | 1940 | 87.4 |
| 95 | BaAK35M24 | 1941 | 1942 | 87.4 |
| 95 | bags19h13 | 1943 | 1944 | 87.4 |
| 95 | bah57c21 | 1945 | 1946 | 87.4 |
| 99 | BaH53P15 | 1947 | 1948 | 88.5 |
| 99 | BaGS20A10 | 1949 | 1950 | 88.5 |

TABLE 3-3

| Order from the short arm end | Clones | SEQ ID NO: (5' end) | SEQ ID NO: (3' end) | Distance from the short arm end (cM) |
|---|---|---|---|---|
| 99 | bast02D0808 | 1951 | 1952 | 88.5 |
| 99 | bags31c04 | 1953 | 1954 | 88.5 |
| 99 | BaH32J06 | 1955 | 1956 | 88.5 |
| 99 | bah60o22 | 1957 | 1958 | 88.5 |
| 99 | BaH50C16 | 1959 | 1960 | 88.5 |
| 99 | BaH57K23 | 1961 | 1962 | 88.5 |
| 99 | bags21g23 | 1963 | 1964 | 88.5 |
| 99 | HVM9 | — | — | 88.5 |
| 109 | Bmac67 | — | — | 89.6 |
| 109 | baak43e04 | 1965 | 1966 | 89.6 |
| 111 | kr17G1113 | 1967 | 1968 | 92.8 |
| 111 | bags19k19 | 1969 | 1970 | 92.8 |
| 111 | baak38b13 | 1971 | 1972 | 92.8 |
| 111 | baak1d12 | 1973 | 1974 | 92.8 |
| 111 | BaH28M14 | 1975 | 1976 | 92.8 |
| 116 | BaH48I15 | 1977 | 1978 | 93.9 |
| 116 | basd27h23 | 1979 | 1980 | 93.9 |
| 116 | BaAK21A11 | 1981 | 1982 | 93.9 |
| 119 | bast04B0804 | 1983 | 1984 | 94.4 |
| 120 | bah45f13 | 1985 | 1986 | 94.9 |
| 120 | BaAL8J18 | 1987 | 1988 | 94.9 |
| 120 | BaGS9D01 | 1989 | 1990 | 94.9 |
| 120 | baal12d12 | 1991 | 1992 | 94.9 |
| 120 | baal4i06 | 1993 | 1994 | 94.9 |
| 125 | bah26i01 | 1995 | 1996 | 96.5 |
| 125 | BaGS15C17 | 1997 | 1998 | 96.5 |
| 127 | baak1k08 | 1999 | 2000 | 97 |
| 127 | bags9b03 | 2001 | 2002 | 97 |
| 127 | baet42G1214 | 2003 | 2004 | 97 |
| 127 | bah18d12 | 2005 | 2006 | 97 |
| 127 | BaSD14G02 | 2007 | 2008 | 97 |
| 127 | bags22b22 | 2009 | 2010 | 97 |
| 127 | bah13f10 | 2011 | 2012 | 97 |
| 134 | baal36g05 | 2013 | 2014 | 97.5 |
| 135 | bags33j15 | 2015 | 2016 | 98 |
| 135 | BaAL12H04 | 2017 | 2018 | 98 |
| 135 | BaGS16I18 | 2019 | 2020 | 98 |
| 138 | bast61D0707 | 2021 | 2022 | 98.5 |
| 139 | bah11k22 | 2023 | 2024 | 99 |
| 139 | baak32p21 | 2025 | 2026 | 99 |
| 139 | bah63l21 | 2027 | 2028 | 99 |
| 139 | BaGS38D03 | 2029 | 2030 | 99 |
| 143 | BaSD23A04 | 2031 | 2032 | 100.1 |
| 144 | BaSD14C15 | 2033 | 2034 | 101.2 |
| 144 | bast63C0105 | 2035 | 2036 | 101.2 |
| 144 | bast23C1105 | 2037 | 2038 | 101.2 |
| 147 | bags23b01 | 2039 | 2040 | 102.3 |
| 147 | bags29c09 | 2041 | 2042 | 102.3 |
| 147 | bags6b06 | 2043 | 2044 | 102.3 |
| 147 | BaAK27G06 | 2045 | 2046 | 102.3 |

TABLE 3-4

| Order from the short arm end | Clones | SEQ ID NO: (5' end) | SEQ ID NO: (3' end) | Distance from the short arm end (cM) |
|---|---|---|---|---|
| 147 | BaAK39I07 | 2047 | 2048 | 102.3 |
| 147 | BaGS20G21 | 2049 | 2050 | 102.3 |
| 147 | bastl22E0810 | 2051 | 2052 | 102.3 |
| 147 | bah11m03 | 2053 | 2054 | 102.3 |
| 147 | BaAL3C04 | 2055 | 2056 | 102.3 |
| 156 | BaAL19H10 | 2057 | 2058 | 103.4 |
| 156 | bags24n16 | 2059 | 2060 | 103.4 |
| 156 | BaSD24B15 | 2061 | 2062 | 103.4 |
| 156 | bah48n17 | 2063 | 2064 | 103.4 |
| 156 | bags9i05 | 2065 | 2066 | 103.4 |
| 156 | bags1l22 | 2067 | 2068 | 103.4 |
| 156 | bah62p18 | 2069 | 2070 | 103.4 |
| 156 | bah55n21 | 2071 | 2072 | 103.4 |
| 156 | bah44a05 | 2073 | 2074 | 103.4 |
| 156 | bah19c13 | 2075 | 2076 | 103.4 |
| 156 | baal12b04 | 2077 | 2078 | 103.4 |
| 156 | Bmag136 | — | — | 103.4 |
| 156 | Bmac209 | — | — | 103.4 |
| 156 | BaAK28A10 | 2079 | 2080 | 103.4 |
| 156 | kr28B0703 | 2081 | 2082 | 103.4 |
| 156 | bastl50C0606 | 2083 | 2084 | 103.4 |
| 156 | BaGS36B01 | 2085 | 2086 | 103.4 |
| 156 | BaH19A05 | 2087 | 2088 | 103.4 |
| 156 | baal10c06 | 2089 | 2090 | 103.4 |
| 156 | bags19p04 | 2091 | 2092 | 103.4 |
| 176 | BaAK21A17 | 2093 | 2094 | 104.5 |
| 176 | bah20j14 | 2095 | 2096 | 104.5 |
| 176 | BaAK19A03 | 2097 | 2098 | 104.5 |
| 176 | BaGS30E19 | 2099 | 2100 | 104.5 |
| 176 | BaAK28C21 | 2101 | 2102 | 104.5 |
| 176 | bags11o14 | 2103 | 2104 | 104.5 |
| 182 | BaGS13P22 | 2105 | 2106 | 105.6 |
| 182 | kr27A1101 | 2107 | 2108 | 105.6 |
| 182 | HVM27 | — | — | 105.6 |
| 185 | baal12i18 | 2109 | 2110 | 106.7 |
| 186 | BaAL8G07 | 2111 | 2112 | 107.8 |
| 187 | bast58F0412 | 2113 | 2114 | 108.9 |
| 187 | bags3f23 | 2115 | 2116 | 108.9 |
| 189 | baal4m06 | 2117 | 2118 | 109.3 |
| 190 | baal32p23 | 2119 | 2120 | 109.7 |
| 191 | basd23m17 | 2121 | 2122 | 110 |
| 191 | bastl30E0509 | 2123 | 2124 | 110 |
| 191 | bah44b08 | 2125 | 2126 | 110 |
| 191 | BaGS14N10 | 2127 | 2128 | 110 |
| 191 | BaGS32B13 | 2129 | 2130 | 110 |
| 191 | BaH30B03 | 2131 | 2132 | 110 |
| 191 | basd1l23 | 2133 | 2134 | 110 |
| 191 | basd11o06 | 2135 | 2136 | 110 |
| 191 | bah17f24 | 2137 | 2138 | 110 |
| 191 | BaAK26L17 | 2139 | 2140 | 110 |

TABLE 3-5

| Order from the short arm end | Clones | SEQ ID NO: (5' end) | SEQ ID NO: (3' end) | Distance from the short arm end (cM) |
|---|---|---|---|---|
| 191 | bags23f03 | 2141 | 2142 | 110 |
| 191 | bags20o06 | 2143 | 2144 | 110 |
| 203 | bags19n12 | 2145 | 2146 | 111.1 |
| 203 | baal12a09 | 2147 | 2148 | 111.1 |
| 203 | bast14F0612 | 2149 | 2150 | 111.1 |
| 203 | baak13p20 | 2151 | 2152 | 111.1 |
| 207 | BaGS16K13 | 2153 | 2154 | 111.9 |
| 207 | baak22c16 | 2155 | 2156 | 111.9 |
| 209 | baal40m06 | 2157 | 2158 | 115.4 |
| 210 | BaH29I03 | 2159 | 2160 | 116.8 |
| 211 | bah16h01 | 2161 | 2162 | 117.6 |
| 211 | bah57a11 | 2163 | 2164 | 117.6 |
| 211 | BaH41E23 | 2165 | 2166 | 117.6 |
| 211 | baal11c11 | 2167 | 2168 | 117.6 |
| 215 | BaSD14L18 | 2169 | 2170 | 118.1 |
| 216 | bah14d17 | 2171 | 2172 | 118.7 |
| 216 | BaGS1N17 | 2173 | 2174 | 118.7 |
| 216 | bags27h17 | 2175 | 2176 | 118.7 |
| 219 | bah47p22 | 2177 | 2178 | 119.8 |
| 219 | BaH50A16 | 2179 | 2180 | 119.8 |
| 219 | bags7b20 | 2181 | 2182 | 119.8 |
| 219 | bags22a02 | 2183 | 2184 | 119.8 |
| 223 | HvBRI1 | — | — | 120.4 |
| 224 | basd12g02 | 2185 | 2186 | 122.6 |
| 225 | basd15o18 | 2187 | 2188 | 123.1 |
| 226 | baal25d19 | 2189 | 2190 | 125.3 |
| 226 | bast52G0414 | 2191 | 2192 | 125.3 |
| 228 | baal11c20 | 2193 | 2194 | 126.4 |
| 229 | bags37k06 | 2195 | 2196 | 127 |
| 230 | bags6e22 | 2197 | 2198 | 127.5 |
| 230 | basd15a02 | 2199 | 2200 | 127.5 |
| 230 | bags7b06 | 2201 | 2202 | 127.5 |

TABLE 3-5-continued

| Order from the short arm end | Clones | SEQ ID NO: (5' end) | SEQ ID NO: (3' end) | Distance from the short arm end (cM) |
|---|---|---|---|---|
| 230 | bah15k11 | 2203 | 2204 | 127.5 |
| 230 | bast46C0406 | 2205 | 2206 | 127.5 |
| 230 | bastl45E0509 | 2207 | 2208 | 127.5 |
| 236 | baal35p14 | 2209 | 2210 | 128.6 |
| 237 | BaH41G07 | 2211 | 2212 | 129.3 |
| 237 | bast46H1016 | 2213 | 2214 | 129.3 |
| 239 | bah60d12 | 2215 | 2216 | 131.8 |
| 239 | baal39a19 | 2217 | 2218 | 131.8 |
| 241 | baak11n24 | 2219 | 2220 | 132.9 |
| 241 | bastl4E0909 | 2221 | 2222 | 132.9 |
| 241 | baet13G0713 | 2223 | 2224 | 132.9 |
| 244 | HVM33 | — | — | 135.8 |
| 244 | BaSD14L04 | 2225 | 2226 | 135.8 |
| 246 | baak13c05 | 2227 | 2228 | 136 |
| 246 | bastl41G0513 | 2229 | 2230 | 136 |
| 248 | BaGS39M09 | 2231 | 2232 | 137.6 |
| 249 | baal19b12 | 2233 | 2234 | 138.6 |
| 250 | BaAL39B05 | 2235 | 2236 | 144 |

TABLE 3-6

| Order from the short arm end | Clones | SEQ ID NO: (5' end) | SEQ ID NO: (3' end) | Distance from the short arm end (cM) |
|---|---|---|---|---|
| 250 | BaAL1J03 | 2237 | 2238 | 144 |
| 250 | basd11k09 | 2239 | 2240 | 144 |
| 253 | BaGS33N15 | 2241 | 2242 | 146.1 |
| 253 | baet43H0416 | 2243 | 2244 | 146.1 |
| 253 | bah11m06 | 2245 | 2246 | 146.1 |
| 253 | baak31a24 | 2247 | 2248 | 146.1 |
| 253 | bags27h20 | 2249 | 2250 | 146.1 |
| 253 | basd27c09 | 2251 | 2252 | 146.1 |
| 259 | BaAL25O01 | 2253 | 2254 | 146.6 |
| 260 | bags7f08 | 2255 | 2256 | 147.1 |
| 261 | BaGS13O12 | 2257 | 2258 | 148.2 |
| 261 | bags38b06 | 2259 | 2260 | 148.2 |
| 263 | BaAK19J09 | 2261 | 2262 | 149.3 |
| 263 | bags9e16 | 2263 | 2264 | 149.3 |
| 265 | bags20n14 | 2265 | 2266 | 150.4 |
| 265 | bah42o12 | 2267 | 2268 | 150.4 |
| 265 | baak31k16 | 2269 | 2270 | 150.4 |
| 265 | bags4p14 | 2271 | 2272 | 150.4 |
| 265 | bah27a22 | 2273 | 2274 | 150.4 |
| 270 | bags21n02 | 2275 | 2276 | 151.5 |
| 271 | BaH62B09 | 2277 | 2278 | 153.7 |
| 271 | BaGS19J10 | 2279 | 2280 | 153.7 |
| 273 | bags15k18 | 2281 | 2282 | 154.2 |
| 274 | BaAK29G03 | 2283 | 2284 | 154.7 |
| 274 | baak23e11 | 2285 | 2286 | 154.7 |
| 274 | bags31k04 | 2287 | 2288 | 154.7 |
| 274 | bast56C0305 | 2289 | 2290 | 154.7 |
| 278 | basd26c09 | 2291 | 2292 | 159 |
| 278 | BaSD20B11 | 2293 | 2294 | 159 |
| 278 | HVM60 | — | — | 159 |
| 281 | BaH46F11 | 2295 | 2296 | 160.1 |
| 281 | BaH30F03 | 2297 | 2298 | 160.1 |
| 281 | BaSD27G02 | 2299 | 2300 | 160.1 |
| 284 | Bmag225 | — | — | 161.2 |
| 284 | BaAK33I12 | 2301 | 2302 | 161.2 |
| 286 | baak32m10 | 2303 | 2304 | 162.3 |
| 286 | BaAL4L02 | 2305 | 2306 | 162.3 |
| 286 | kr44F0911 | 2307 | 2308 | 162.3 |
| 289 | BaGS37A16 | 2309 | 2310 | 163.5 |
| 290 | bags39p06 | 2311 | 2312 | 163.9 |
| 290 | BaAL12N06 | 2313 | 2314 | 163.9 |
| 292 | bags22p05 | 2315 | 2316 | 165.4 |
| 293 | bags9a03 | 2317 | 2318 | 166.5 |
| 293 | baet24F1212 | 2319 | 2320 | 166.5 |
| 295 | baak29d10 | 2321 | 2322 | 167.6 |
| 295 | bags13i12 | 2323 | 2324 | 167.6 |
| 295 | BaAL16A23 | 2325 | 2326 | 167.6 |
| 298 | bastl16B1204 | 2327 | 2328 | 171.6 |

TABLE 3-6-continued

| Order from the short arm end | Clones | SEQ ID NO: (5' end) | SEQ ID NO: (3' end) | Distance from the short arm end (cM) |
|---|---|---|---|---|
| 298 | bastl29F0711 | 2329 | 2330 | 171.6 |
| 300 | BaGS32M17 | 2331 | 2332 | 172.1 |

TABLE 3-7

| Order from the short arm end | Clones | SEQ ID NO: (5' end) | SEQ ID NO: (3' end) | Distance from the short arm end (cM) |
|---|---|---|---|---|
| 301 | baal15e10 | 2333 | 2334 | 172.5 |
| 301 | basd3g08 | 2335 | 2336 | 172.5 |
| 303 | baal33m18 | 2337 | 2338 | 173.6 |
| 303 | baak24e23 | 2339 | 2340 | 173.6 |
| 303 | baak46j13 | 2341 | 2342 | 173.6 |
| 306 | bah49o05 | 2343 | 2344 | 174.7 |
| 306 | baal15e05 | 2345 | 2346 | 174.7 |
| 306 | BaAK1O08 | 2347 | 2348 | 174.7 |
| 306 | BaGS30P02 | 2349 | 2350 | 174.7 |
| 310 | BaSD15D05 | 2351 | 2352 | 178.9 |
| 311 | BaAL7B16 | 2353 | 2354 | 179.2 |
| 312 | bags38n23 | 2355 | 2356 | 180.3 |
| 313 | baak36a14 | 2357 | 2358 | 181.6 |
| 313 | baak34g01 | 2359 | 2360 | 181.6 |
| 313 | baak12f01 | 2361 | 2362 | 181.6 |
| 316 | BaGS30I18 | 2363 | 2364 | 183.7 |
| 316 | bags35n24 | 2365 | 2366 | 183.7 |
| 316 | bah37j21 | 2367 | 2368 | 183.7 |
| 316 | bah31e13 | 2369 | 2370 | 183.7 |
| 320 | bags22g10 | 2371 | 2372 | 190 |
| 320 | bags22f17 | 2373 | 2374 | 190 |
| 322 | baal30l05 | 2375 | 2376 | 190.9 |
| 322 | bags38o10 | 2377 | 2378 | 190.9 |
| 324 | baak40o04 | 2379 | 2380 | 193.1 |
| 325 | BaH49L21 | 2381 | 2382 | 193.6 |
| 325 | bastl30A0701 | 2383 | 2384 | 193.6 |
| 327 | bags19l03 | 2385 | 2386 | 195.1 |
| 328 | bah18m13 | 2387 | 2388 | 196.6 |
| 329 | baak44p03 | 2389 | 2390 | 198.2 |
| 329 | kr10H0216 | 2391 | 2392 | 198.2 |
| 331 | bags11i04 | 2393 | 2394 | 199.4 |
| 332 | bah52o06 | 2395 | 2396 | 200.5 |
| 333 | bah35c14 | 2397 | 2398 | 200.8 |
| 333 | BaAL30C02 | 2399 | 2400 | 200.8 |
| 335 | bah11i21 | 2401 | 2402 | 201.9 |
| 336 | BaAK36B11 | 2403 | 2404 | 204.1 |
| 337 | BaAK20K23 | 2405 | 2406 | 206 |
| 337 | basd14n22 | 2407 | 2408 | 206 |
| 339 | BaAL25P17 | 2409 | 2410 | 207.6 |
| 339 | BaH49A01 | 2411 | 2412 | 207.6 |
| 341 | basd13p12 | 2413 | 2414 | 209.5 |
| 341 | bags39m17 | 2415 | 2416 | 209.5 |
| 343 | baet44D0707 | 2417 | 2418 | 212.8 |
| 344 | BaH16P10 | 2419 | 2420 | 213.9 |
| 344 | BaAK42J01 | 2421 | 2422 | 213.9 |
| 346 | kr24E0709 | 2423 | 2424 | 215.8 |
| 346 | BaAK38O08 | 2425 | 2426 | 215.8 |
| 348 | BaAL13N01 | 2427 | 2428 | 217.7 |
| 349 | baak12c12 | 2429 | 2430 | 219.8 |
| 350 | BaGS31N06 | 2431 | 2432 | 220.9 |

TABLE 3-8

| Order from the short arm end | Clones | SEQ ID NO: (5' end) | SEQ ID NO: (3' end) | Distance from the short arm end (cM) |
|---|---|---|---|---|
| 351 | baal15f24 | 2433 | 2434 | 221.5 |
| 352 | BaSD18B21 | 2435 | 2436 | 222 |
| 352 | BaSD17G23 | 2437 | 2438 | 222 |
| 354 | baak41k22 | 2439 | 2440 | 223.7 |
| 355 | baak21o03 | 2441 | 2442 | 225.4 |

TABLE 3-8-continued

| Order from the short arm end | Clones | SEQ ID NO: (5' end) | SEQ ID NO: (3' end) | Distance from the short arm end (cM) |
|---|---|---|---|---|
| 356 | BaSD16B18 | 2443 | 2444 | 227 |
| 356 | bast79C1105 | 2445 | 2446 | 227 |
| 358 | BaAK4J17 | 2447 | 2448 | 228.1 |
| 359 | BaAL37H08 | 2449 | 2450 | 228.6 |
| 359 | BaH36L17 | 2451 | 2452 | 228.6 |
| 361 | BaH46A12 | 2453 | 2454 | 229.7 |
| 361 | bags11i15 | 2455 | 2456 | 229.7 |
| 361 | baak20g24 | 2457 | 2458 | 229.7 |
| 364 | baak20h23 | 2459 | 2460 | 230.8 |
| 365 | baak35b18 | 2461 | 2462 | 231.9 |
| 365 | Bmag13 | — | — | 231.9 |
| 365 | baak41o03 | 2463 | 2464 | 231.9 |
| 365 | baet46C0206 | 2465 | 2466 | 231.9 |
| 369 | bags10i20 | 2467 | 2468 | 233 |
| 369 | baal1b16 | 2469 | 2470 | 233 |
| 369 | baal5i05 | 2471 | 2472 | 233 |
| 369 | BaH27B05 | 2473 | 2474 | 233 |
| 369 | bah14a11 | 2475 | 2476 | 233 |
| 369 | basd19k10 | 2477 | 2478 | 233 |
| 369 | bags30n17 | 2479 | 2480 | 233 |
| 369 | bags31e24 | 2481 | 2482 | 233 |
| 369 | BaGS5B16 | 2483 | 2484 | 233 |
| 378 | BaAL5F06 | 2485 | 2486 | 234.1 |
| 378 | bags34a11 | 2487 | 2488 | 234.1 |
| 378 | bags6c16 | 2489 | 2490 | 234.1 |
| 378 | bah42g19 | 2491 | 2492 | 234.1 |
| 378 | BaH47O14 | 2493 | 2494 | 234.1 |
| 383 | BaH12L06 | 2495 | 2496 | 235.2 |
| 383 | basd11a10 | 2497 | 2498 | 235.2 |
| 385 | BaH50I12 | 2499 | 2500 | 237.3 |
| 385 | BaH51A21 | 2501 | 2502 | 237.3 |
| 385 | baak45p02 | 2503 | 2504 | 237.3 |
| 388 | BaSD12P12 | 2505 | 2506 | 241.6 |
| 389 | bags9l16 | 2507 | 2508 | 242.7 |
| 389 | BaSD26O20 | 2509 | 2510 | 242.7 |
| 389 | bags5d10 | 2511 | 2512 | 242.7 |
| 389 | baal0e07 | 2513 | 2514 | 242.7 |
| 393 | baak14e02 | 2515 | 2516 | 243.8 |
| 394 | BaH63F14 | 2517 | 2518 | 244.9 |
| 394 | bah33f19 | 2519 | 2520 | 244.9 |
| 394 | bags19l10 | 2521 | 2522 | 244.9 |
| 397 | BaH56J21 | 2523 | 2524 | 246 |
| 397 | baal40i22 | 2525 | 2526 | 246 |
| 397 | kr42C0105 | 2527 | 2528 | 246 |
| 400 | bags16i19 | 2529 | 2530 | 246.5 |

TABLE 3-9

| Order from the short arm end | Clones | SEQ ID NO: (5' end) | SEQ ID NO: (3' end) | Distance from the short arm end (cM) |
|---|---|---|---|---|
| 400 | BaH54H01 | 2531 | 2532 | 246.5 |
| 402 | kr69E0810 | 2533 | 2534 | 247.8 |
| 403 | bags17j14 | 2535 | 2536 | 250 |
| 404 | bags20e19 | 2537 | 2538 | 253 |
| 405 | bast74C0206 | 2539 | 2540 | 255.1 |
| 405 | BaAK13L10 | 2541 | 2542 | 255.1 |
| 407 | bags20i01 | 2543 | 2544 | 256.2 |
| 407 | basd19n14 | 2545 | 2546 | 256.2 |
| 407 | baak42g21 | 2547 | 2548 | 256.2 |
| 407 | BaAK39A15 | 2549 | 2550 | 256.2 |
| 411 | basd18o21 | 2551 | 2552 | 257.3 |
| 411 | BaAK22K17 | 2553 | 2554 | 257.3 |
| 413 | baal6o24 | 2555 | 2556 | 260.9 |
| 414 | BaH22C09 | 2557 | 2558 | 262.7 |
| 414 | HVM62 | — | — | 262.7 |
| 416 | bags23k14 | 2559 | 2560 | 263.8 |
| 416 | baal24n12 | 2561 | 2562 | 263.8 |
| 418 | BaGS21H17 | 2563 | 2564 | 268.1 |
| 418 | BaSD16I09 | 2565 | 2566 | 268.1 |
| 418 | BaAL13B22 | 2567 | 2568 | 268.1 |
| 421 | bah41l03 | 2569 | 2570 | 270.2 |

TABLE 3-9-continued

| Order from the short arm end | Clones | SEQ ID NO: (5' end) | SEQ ID NO: (3' end) | Distance from the short arm end (cM) |
|---|---|---|---|---|
| 422 | bastl30F0111 | 2571 | 2572 | 272.5 |
| 423 | BaH15L04 | 2573 | 2574 | 275.9 |
| 423 | baak40c12 | 2575 | 2576 | 275.9 |
| 425 | kr23D0408 | 2577 | 2578 | 277 |
| 425 | bah57d15 | 2579 | 2580 | 277 |
| 427 | baak31e03 | 2581 | 2582 | 278.1 |
| 428 | BaAL13O01 | 2583 | 2584 | 281.8 |
| 429 | BaSD26P04 | 2585 | 2586 | 286.3 |
| 430 | bags20f18 | 2587 | 2588 | 287.4 |
| 431 | BaH42J22 | 2589 | 2590 | 288.5 |
| 431 | BaAL3K03 | 2591 | 2592 | 288.5 |
| 431 | kr30B1103 | 2593 | 2594 | 288.5 |
| 434 | baak14i02 | 2595 | 2596 | 289.6 |
| 434 | bags28c17 | 2597 | 2598 | 289.6 |
| 434 | baal4e21 | 2599 | 2600 | 289.6 |
| 434 | BaGS29D05 | 2601 | 2602 | 289.6 |
| 438 | bah54d24 | 2603 | 2604 | 290.7 |
| 439 | basd22g20 | 2605 | 2606 | 291.8 |
| 439 | BaH62H20 | 2607 | 2608 | 291.8 |
| 441 | bags38h17 | 2609 | 2610 | 292.9 |
| 441 | BaAK30B23 | 2611 | 2612 | 292.9 |
| 441 | BaAK24P09 | 2613 | 2614 | 292.9 |
| 441 | baak23i12 | 2615 | 2616 | 292.9 |
| 441 | BaGS22D06 | 2617 | 2618 | 292.9 |
| 441 | BaAL34P18 | 2619 | 2620 | 292.9 |
| 441 | BaAL39F24 | 2621 | 2622 | 292.9 |
| 441 | BaGS4L04 | 2623 | 2624 | 292.9 |
| 441 | bah12e02 | 2625 | 2626 | 292.9 |
| 441 | BaAL15F23 | 2627 | 2628 | 292.9 |

TABLE 3-10

| Order from the short arm end | Clones | SEQ ID NO: (5' end) | SEQ ID NO: (3' end) | Distance from the short arm end (cM) |
|---|---|---|---|---|
| 441 | BaGS25O15 | 2629 | 2630 | 292.9 |
| 441 | BaGS7G14 | 2631 | 2632 | 292.9 |
| 441 | basd24i11 | 2633 | 2634 | 292.9 |
| 454 | baak20l21 | 2635 | 2636 | 294 |
| 455 | bags33m02 | 2637 | 2638 | 295 |
| 455 | BaH48G21 | 2639 | 2640 | 295 |
| 457 | bags27p13 | 2641 | 2642 | 300.4 |

As shown in Table 4-1 to Table 4-7, the chromosomal order in barley 4H chromosome (distance from the short arm end of 4H chromosome) has been specified for 341 clones including the base sequences of SEQ ID NO: n (where n is an odd number) and SEQ ID NO: n+1 from among the base sequences of SEQ ID NO: 2643 through SEQ ID NO: 3324. The chromosomal order in barley 4H chromosome has also been specified for 9 known clones (HVM40, MWG2033, HVM3, MWG058, Bmag353, HVM68, HVM67, sh, and VRN2).

TABLE 4-1

| Order from the short arm end | Clones | SEQ ID NO: (5' end) | SEQ ID NO: (3' end) | Distance from the short arm end (cM) |
|---|---|---|---|---|
| 1 | BaGS10N17 | 2643 | 2644 | 0 |
| 2 | BaAK38K23 | 2645 | 2646 | 1.1 |
| 2 | bah14a22 | 2647 | 2648 | 1.1 |
| 4 | BaAL19O06 | 2649 | 2650 | 2.2 |
| 4 | BaGS32P17 | 2651 | 2652 | 2.2 |
| 6 | bah11j04 | 2653 | 2654 | 3.3 |
| 7 | baak35b06 | 2655 | 2656 | 4.1 |
| 7 | basd21f17 | 2657 | 2658 | 4.1 |
| 9 | BaAK44O11 | 2659 | 2660 | 7 |

TABLE 4-1-continued

| Order from the short arm end | Clones | SEQ ID NO: (5' end) | SEQ ID NO: (3' end) | Distance from the short arm end (cM) |
|---|---|---|---|---|
| 10 | bastl14D0408 | 2661 | 2662 | 8.2 |
| 11 | BaAK42C15 | 2663 | 2664 | 9 |
| 12 | baak40n12 | 2665 | 2666 | 10 |
| 12 | basd2j05 | 2667 | 2668 | 10 |
| 12 | baak46n05 | 2669 | 2670 | 10 |
| 12 | baak24g04 | 2671 | 2672 | 10 |
| 16 | BaAL22H02 | 2673 | 2674 | 11 |
| 17 | bah56g24 | 2675 | 2676 | 16.4 |
| 17 | BaAL2I22 | 2677 | 2678 | 16.4 |
| 19 | bags20c22 | 2679 | 2680 | 17.5 |
| 20 | BaH50O22 | 2681 | 2682 | 18.6 |
| 20 | baak32f06 | 2683 | 2684 | 18.6 |
| 20 | bags35i24 | 2685 | 2686 | 18.6 |
| 20 | BaSD21D13 | 2687 | 2688 | 18.6 |
| 20 | bast46D0408 | 2689 | 2690 | 18.6 |
| 25 | bast55B1204 | 2691 | 2692 | 22.1 |
| 26 | BaGS39M07 | 2693 | 2694 | 24.5 |
| 27 | bags39b15 | 2695 | 2696 | 27.6 |
| 27 | baak37p11 | 2697 | 2698 | 27.6 |
| 27 | bah29o22 | 2699 | 2700 | 27.6 |
| 27 | baak12k14 | 2701 | 2702 | 27.6 |
| 31 | baet31E1010 | 2703 | 2704 | 28.7 |
| 32 | HVM40 | — | — | 29.8 |
| 32 | baal39h14 | 2705 | 2706 | 29.8 |
| 34 | bags14g22 | 2707 | 2708 | 30.9 |
| 35 | baal18m18 | 2709 | 2710 | 32.1 |
| 36 | BaSD24E02 | 2711 | 2712 | 33.2 |
| 36 | BaH50N14 | 2713 | 2714 | 33.2 |
| 36 | kr70A0202 | 2715 | 2716 | 33.2 |
| 39 | baak11d04 | 2717 | 2718 | 34.3 |
| 40 | MWG2033 | — | — | 35.4 |
| 40 | bags20h01 | 2719 | 2720 | 35.4 |
| 42 | BaH39P15 | 2721 | 2722 | 35.9 |
| 43 | BaAK46O20 | 2723 | 2724 | 36.4 |
| 43 | baal33m06 | 2725 | 2726 | 36.4 |
| 43 | bastl50E0309 | 2727 | 2728 | 36.4 |
| 43 | bags20i17 | 2729 | 2730 | 36.4 |
| 47 | BaGS22A07 | 2731 | 2732 | 37.5 |
| 48 | bah41b09 | 2733 | 2734 | 37.7 |
| 49 | kr18G0913 | 2735 | 2736 | 39 |
| 49 | BaGS19O23 | 2737 | 2738 | 39 |

TABLE 4-2

| Order from the short arm end | Clones | SEQ ID NO: (5' end) | SEQ ID NO: (3' end) | Distance from the short arm end (cM) |
|---|---|---|---|---|
| 51 | bags15e12 | 2739 | 2740 | 39.6 |
| 52 | bags29i09 | 2741 | 2742 | 40.1 |
| 52 | baak19m23 | 2743 | 2744 | 40.1 |
| 54 | bags14h12 | 2745 | 2746 | 40.6 |
| 55 | bah32e15 | 2747 | 2748 | 41.2 |
| 55 | bah11l02 | 2749 | 2750 | 41.2 |
| 55 | bags39e16 | 2751 | 2752 | 41.2 |
| 55 | bags10l12 | 2753 | 2754 | 41.2 |
| 59 | BaGS31M13 | 2755 | 2756 | 42.3 |
| 59 | baal32m10 | 2757 | 2758 | 42.3 |
| 59 | basd12b23 | 2759 | 2760 | 42.3 |
| 62 | baal39e15 | 2761 | 2762 | 43.5 |
| 63 | baal16l11 | 2763 | 2764 | 45.8 |
| 64 | BaGS31B01 | 2765 | 2766 | 46.9 |
| 64 | BaSD17F09 | 2767 | 2768 | 46.9 |
| 64 | BaH48L11 | 2769 | 2770 | 46.9 |
| 67 | BaSD14M08 | 2771 | 2772 | 48 |
| 67 | bah56c09 | 2773 | 2774 | 48 |
| 67 | baak17g07 | 2775 | 2776 | 48 |
| 67 | bags20k09 | 2777 | 2778 | 48 |
| 67 | BaSD25B08 | 2779 | 2780 | 48 |
| 67 | bast27E0309 | 2781 | 2782 | 48 |
| 73 | baet20D0107 | 2783 | 2784 | 52.3 |
| 74 | BaAL17L08 | 2785 | 2786 | 56.3 |
| 75 | bah61p18 | 2787 | 2788 | 65.2 |

TABLE 4-2-continued

| Order from the short arm end | Clones | SEQ ID NO: (5' end) | SEQ ID NO: (3' end) | Distance from the short arm end (cM) |
|---|---|---|---|---|
| 75 | bah63d12 | 2789 | 2790 | 65.2 |
| 75 | BaAK26A03 | 2791 | 2792 | 65.2 |
| 78 | baak26n10 | 2793 | 2794 | 67.4 |
| 78 | bast22B0204 | 2795 | 2796 | 67.4 |
| 80 | BaAL3C05 | 2797 | 2798 | 68.5 |
| 80 | BaGS38H14 | 2799 | 2800 | 68.5 |
| 80 | BaAL4D19 | 2801 | 2802 | 68.5 |
| 83 | BaAK20B09 | 2803 | 2804 | 69.6 |
| 83 | BaAK37H01 | 2805 | 2806 | 69.6 |
| 83 | BaGS33P13 | 2807 | 2808 | 69.6 |
| 86 | basd13l12 | 2809 | 2810 | 70.7 |
| 86 | bags11m01 | 2811 | 2812 | 70.7 |
| 88 | BaGS18H09 | 2813 | 2814 | 77.5 |
| 89 | basd3d13 | 2815 | 2816 | 86.5 |
| 89 | baal9m23 | 2817 | 2818 | 86.5 |
| 89 | bags23f08 | 2819 | 2820 | 86.5 |
| 92 | BaGS15L23 | 2821 | 2822 | 87.6 |
| 92 | baak2k13 | 2823 | 2824 | 87.6 |
| 92 | baak17d18 | 2825 | 2826 | 87.6 |
| 92 | bags13a12 | 2827 | 2828 | 87.6 |
| 96 | baak44g22 | 2829 | 2830 | 88.7 |
| 97 | kr34F0212 | 2831 | 2832 | 89.8 |
| 98 | baal16d11 | 2833 | 2834 | 92 |
| 99 | bah22d04 | 2835 | 2836 | 93.1 |
| 99 | bah48m23 | 2837 | 2838 | 93.1 |

TABLE 4-3

| Order from the short arm end | Clones | SEQ ID NO: (5' end) | SEQ ID NO: (3' end) | Distance from the short arm end (cM) |
|---|---|---|---|---|
| 99 | basd15p13 | 2839 | 2840 | 93.1 |
| 99 | BaGS6O07 | 2841 | 2842 | 93.1 |
| 99 | BaH37O10 | 2843 | 2844 | 93.1 |
| 99 | bags21k10 | 2845 | 2846 | 93.1 |
| 99 | bah56n18 | 2847 | 2848 | 93.1 |
| 99 | baal9i11 | 2849 | 2850 | 93.1 |
| 99 | BaAL39N06 | 2851 | 2852 | 93.1 |
| 99 | bags9d05 | 2853 | 2854 | 93.1 |
| 99 | BaAL19I19 | 2855 | 2856 | 93.1 |
| 99 | basd12I11 | 2857 | 2858 | 93.1 |
| 99 | bastl46D1008 | 2859 | 2860 | 93.1 |
| 99 | BaH50H16 | 2861 | 2862 | 93.1 |
| 99 | bags9n05 | 2863 | 2864 | 93.1 |
| 99 | kr61B1103 | 2865 | 2866 | 93.1 |
| 115 | kr27B0103 | 2867 | 2868 | 95.2 |
| 115 | kr33H1115 | 2869 | 2870 | 95.2 |
| 115 | baak30l02 | 2871 | 2872 | 95.2 |
| 115 | bah55a12 | 2873 | 2874 | 95.2 |
| 115 | BaH26K14 | 2875 | 2876 | 95.2 |
| 120 | HVM3 | — | — | 96.3 |
| 120 | BaAK33K19 | 2877 | 2878 | 96.3 |
| 120 | basd18m17 | 2879 | 2880 | 96.3 |
| 120 | BaH50G09 | 2881 | 2882 | 96.3 |
| 120 | BaH53B03 | 2883 | 2884 | 96.3 |
| 120 | BaH54L11 | 2885 | 2886 | 96.3 |
| 120 | basd13i14 | 2887 | 2888 | 96.3 |
| 120 | bah56g09 | 2889 | 2890 | 96.3 |
| 120 | bah41b06 | 2891 | 2892 | 96.3 |
| 120 | bags14d19 | 2893 | 2894 | 96.3 |
| 120 | baal20f05 | 2895 | 2896 | 96.3 |
| 120 | BaH18H12 | 2897 | 2898 | 96.3 |
| 120 | baal9o21 | 2899 | 2900 | 96.3 |
| 120 | bags21a02 | 2901 | 2902 | 96.3 |
| 120 | BaAL3G19 | 2903 | 2904 | 96.3 |
| 120 | baal7a09 | 2905 | 2906 | 96.3 |
| 120 | BaAL29I16 | 2907 | 2906 | 96.3 |
| 137 | bast70B0804 | 2909 | 2910 | 98.4 |
| 137 | bags14n08 | 2911 | 2912 | 98.4 |
| 139 | bastl14F0412 | 2913 | 2914 | 99.5 |
| 139 | BaAK36I12 | 2915 | 2916 | 99.5 |
| 139 | baal3f19 | 2917 | 2916 | 99.5 |

TABLE 4-3-continued

| Order from the short arm end | Clones | SEQ ID NO: (5' end) | SEQ ID NO: (3' end) | Distance from the short arm end (cM) |
|---|---|---|---|---|
| 142 | baal1e10 | 2919 | 2920 | 101.6 |
| 142 | bags6k02 | 2921 | 2922 | 101.6 |
| 142 | kr42H0315 | 2923 | 2924 | 101.6 |
| 145 | bah39p02 | 2925 | 2926 | 102.7 |
| 146 | BaGS9L14 | 2927 | 2928 | 106 |
| 146 | baal35l03 | 2929 | 2930 | 106 |
| 146 | basd12m15 | 2931 | 2932 | 106 |
| 146 | BaAK35P01 | 2933 | 2934 | 106 |
| 146 | basd11d18 | 2935 | 2936 | 106 |

TABLE 4-4

| Order from the short arm end | Clones | SEQ ID NO: (5' end) | SEQ ID NO: (3' end) | Distance from the short arm end (cM) |
|---|---|---|---|---|
| 146 | BaH38E07 | 2937 | 2938 | 106 |
| 146 | BaGS18H13 | 2939 | 2940 | 106 |
| 146 | bags18g16 | 2941 | 2942 | 106 |
| 146 | bags27f21 | 2943 | 2944 | 106 |
| 146 | BaGS7M13 | 2945 | 2946 | 106 |
| 146 | baal39c19 | 2947 | 2948 | 106 |
| 146 | baak46j05 | 2949 | 2950 | 106 |
| 146 | BaAK32D20 | 2951 | 2952 | 106 |
| 146 | MWG058 | — | — | 106 |
| 146 | BaGS18M02 | 2953 | 2954 | 106 |
| 146 | bags9c05 | 2955 | 2956 | 106 |
| 146 | baak46m13 | 2957 | 2958 | 106 |
| 146 | bags35n16 | 2959 | 2960 | 106 |
| 146 | bags39g08 | 2961 | 2962 | 106 |
| 146 | baal33a06 | 2963 | 2964 | 106 |
| 146 | BaSD17F20 | 2965 | 2966 | 106 |
| 146 | bags22i21 | 2967 | 2968 | 106 |
| 168 | bah32g18 | 2969 | 2970 | 107.1 |
| 169 | BaAL37O23 | 2971 | 2972 | 108.2 |
| 169 | bags22p03 | 2973 | 2974 | 108.2 |
| 171 | bags38l18 | 2975 | 2976 | 109.3 |
| 172 | BaGS35C13 | 2977 | 2978 | 112.6 |
| 172 | bah47h04 | 2979 | 2980 | 112.6 |
| 174 | bags30m11 | 2981 | 2982 | 114.7 |
| 174 | BaH22L15 | 2983 | 2984 | 114.7 |
| 176 | bags39e15 | 2985 | 2986 | 115.8 |
| 177 | kr65H0816 | 2987 | 2988 | 116.9 |
| 177 | basd11h11 | 2989 | 2990 | 116.9 |
| 177 | baak2b06 | 2991 | 2992 | 116.9 |
| 177 | Bmag353 | — | — | 116.9 |
| 177 | bags37j11 | 2993 | 2994 | 116.9 |
| 177 | BaAK46L15 | 2995 | 2996 | 116.9 |
| 183 | BaSD14A23 | 2997 | 2998 | 122.3 |
| 183 | bast25C0705 | 2999 | 3000 | 122.3 |
| 185 | bast21B1204 | 3001 | 3002 | 123.3 |
| 186 | bags1l16 | 3003 | 3004 | 129.7 |
| 186 | BaAK21G02 | 3005 | 3006 | 129.7 |
| 188 | bastl26E1109 | 3007 | 3008 | 130.6 |
| 188 | basd13k24 | 3009 | 3010 | 130.6 |
| 188 | BaAL13F02 | 3011 | 3012 | 130.6 |
| 191 | bags13c10 | 3013 | 3014 | 134.7 |
| 191 | bags11o11 | 3015 | 3016 | 134.7 |
| 191 | BaAK36P01 | 3017 | 3018 | 134.7 |
| 194 | bah52d09 | 3019 | 3020 | 135.9 |
| 194 | BaGS26D18 | 3021 | 3022 | 135.9 |
| 196 | baak33c22 | 3023 | 3024 | 137 |
| 196 | basd1d10 | 3025 | 3026 | 137 |
| 196 | baak11c22 | 3027 | 3028 | 137 |
| 196 | bags34l06 | 3029 | 3030 | 137 |
| 196 | baak33j06 | 3031 | 3032 | 137 |

TABLE 4-5

| Order from the short arm end | Clones | SEQ ID NO: (5' end) | SEQ ID NO: (3' end) | Distance from the short arm end (cM) |
|---|---|---|---|---|
| 196 | bags23a11 | 3033 | 3034 | 137 |
| 196 | bags34f02 | 3035 | 3036 | 137 |
| 196 | bags20p21 | 3037 | 3038 | 137 |
| 196 | bah52m01 | 3039 | 3040 | 137 |
| 196 | basd15d07 | 3041 | 3042 | 137 |
| 196 | BaAL20A14 | 3043 | 3044 | 137 |
| 207 | BaGS21B04 | 3045 | 3046 | 137.7 |
| 208 | HVM68 | — | — | 138.1 |
| 209 | BaAL36B07 | 3047 | 3048 | 139.2 |
| 209 | basd11p10 | 3049 | 3050 | 139.2 |
| 209 | BaGS33E17 | 3051 | 3052 | 139.2 |
| 212 | kr67C0206 | 3053 | 3054 | 140.3 |
| 213 | bags15i20 | 3055 | 3056 | 141.4 |
| 214 | BaH15E05 | 3057 | 3058 | 142.5 |
| 215 | BaH58K02 | 3059 | 3060 | 143.6 |
| 216 | basd13d17 | 3061 | 3062 | 146.9 |
| 216 | BaGS17A15 | 3063 | 3064 | 146.9 |
| 216 | BaAK30F13 | 3065 | 3066 | 146.9 |
| 216 | baal17m22 | 3067 | 3068 | 146.9 |
| 216 | baak42f04 | 3069 | 3070 | 146.9 |
| 216 | baal2n22 | 3071 | 3072 | 146.9 |
| 222 | kr30C0705 | 3073 | 3074 | 148 |
| 222 | BaSD19J21 | 3075 | 3076 | 148 |
| 222 | BaH34N22 | 3077 | 3078 | 148 |
| 225 | BaAK2I20 | 3079 | 3080 | 149.1 |
| 225 | BaGS1E22 | 3081 | 3082 | 149.1 |
| 225 | baak34b17 | 3083 | 3084 | 149.1 |
| 228 | BaSD11L18 | 3085 | 3086 | 151.3 |
| 228 | kr32A0202 | 3087 | 3088 | 151.3 |
| 230 | bags27h21 | 3089 | 3090 | 151.9 |
| 231 | bah62d17 | 3091 | 3092 | 152.4 |
| 231 | bah43e22 | 3093 | 3094 | 152.4 |
| 231 | BaAL30I23 | 3095 | 3096 | 152.4 |
| 231 | BaSD13H20 | 3097 | 3098 | 152.4 |
| 231 | BaSD14O04 | 3099 | 3100 | 152.4 |
| 236 | baak34p06 | 3101 | 3102 | 153.5 |
| 237 | bah63b08 | 3103 | 3104 | 156.8 |
| 238 | bastl03F0812 | 3105 | 3106 | 157.9 |
| 239 | basd14m17 | 3107 | 3108 | 159.2 |
| 240 | BaSD2J03 | 3109 | 3110 | 162.2 |
| 241 | bah13b17 | 3111 | 3112 | 171.1 |
| 242 | baal32b23 | 3113 | 3114 | 176.5 |
| 242 | bastl50D1208 | 3115 | 3116 | 176.5 |
| 242 | BaGS9H13 | 3117 | 3118 | 176.5 |
| 242 | baal33e04 | 3119 | 3120 | 176.5 |
| 246 | BaAL40L16 | 3121 | 3122 | 177.6 |
| 247 | bah44n03 | 3123 | 3124 | 178.7 |
| 247 | bags20h05 | 3125 | 3126 | 178.7 |
| 247 | bags20fM5 | 3127 | 3128 | 178.7 |
| 250 | BaGS7E03 | 3129 | 3130 | 179.8 |

TABLE 4-6

| Order from the short arm end | Clones | SEQ ID NO: (5' end) | SEQ ID NO: (3' end) | Distance from the short arm end (cM) |
|---|---|---|---|---|
| 250 | bags9k13 | 3131 | 3132 | 179.8 |
| 252 | bast55E0709 | 3133 | 3134 | 181.1 |
| 253 | bags8a14 | 3135 | 3136 | 184.6 |
| 254 | baak38k04 | 3137 | 3138 | 185.1 |
| 255 | BaH33B15 | 3139 | 3140 | 185.6 |
| 256 | bags29m17 | 3141 | 3142 | 186.7 |
| 257 | BaSD23P08 | 3143 | 3144 | 187.8 |
| 257 | BaH42L12 | 3145 | 3146 | 187.8 |
| 259 | bast79G0313 | 3147 | 3148 | 191 |
| 259 | baet46C0905 | 3149 | 3150 | 191 |
| 259 | baal4o09 | 3151 | 3152 | 191 |
| 259 | bah26e10 | 3153 | 3154 | 191 |
| 263 | BaH32J04 | 3155 | 3156 | 193.1 |
| 264 | bags20l07 | 3157 | 3158 | 194.2 |
| 265 | kr18C0505 | 3159 | 3160 | 195.3 |
| 266 | basd11m24 | 3161 | 3162 | 199.7 |

TABLE 4-6-continued

| Order from the short arm end | Clones | SEQ ID NO: (5' end) | SEQ ID NO: (3' end) | Distance from the short arm end (cM) |
|---|---|---|---|---|
| 266 | basd1i15 | 3163 | 3164 | 199.7 |
| 266 | bah45b02 | 3165 | 3166 | 199.7 |
| 269 | bast40C0206 | 3167 | 3168 | 201.8 |
| 269 | baal40g05 | 3169 | 3170 | 201.8 |
| 269 | bah13i21 | 3171 | 3172 | 201.8 |
| 269 | basd27o20 | 3173 | 3174 | 201.8 |
| 269 | BaAK12L24 | 3175 | 3176 | 201.8 |
| 274 | BaAL12F24 | 3177 | 3178 | 204 |
| 274 | baak45l08 | 3179 | 3180 | 204 |
| 274 | BaAL36N04 | 3181 | 3182 | 204 |
| 274 | baak41d17 | 3183 | 3184 | 204 |
| 274 | kr39E0810 | 3185 | 3186 | 204 |
| 274 | BaGS32G16 | 3187 | 3188 | 204 |
| 274 | BaGS25M06 | 3189 | 3190 | 204 |
| 274 | BaH36F21 | 3191 | 3192 | 204 |
| 274 | BaAK13B12 | 3193 | 3194 | 204 |
| 283 | baal29j18 | 3195 | 3196 | 205.1 |
| 284 | bast63B0604 | 3197 | 3198 | 206.2 |
| 284 | baak11n06 | 3199 | 3200 | 206.2 |
| 286 | kr13F1012 | 3201 | 3202 | 208.4 |
| 287 | bags20k06 | 3203 | 3204 | 209.5 |
| 288 | baak15p20 | 3205 | 3206 | 210.6 |
| 288 | bah18n11 | 3207 | 3208 | 210.6 |
| 290 | BaH23J08 | 3209 | 3210 | 213.9 |
| 291 | baet30B1004 | 3211 | 3212 | 215 |
| 291 | bags34p06 | 3213 | 3214 | 215 |
| 291 | bastl33H0816 | 3215 | 3216 | 215 |
| 294 | BaSD17I17 | 3217 | 3218 | 216.1 |
| 294 | basd19p22 | 3219 | 3220 | 216.1 |
| 294 | bags4e03 | 3221 | 3222 | 216.1 |
| 294 | BaAK36A13 | 3223 | 3224 | 216.1 |
| 294 | bags33i03 | 3225 | 3226 | 216.1 |
| 299 | BaAK14F03 | 3227 | 3228 | 217.2 |
| 300 | BaAK42K19 | 3229 | 3230 | 219.3 |

TABLE 4-7

| Order from the short arm end | Clones | SEQ ID NO: (5' end) | SEQ ID NO: (3' end) | Distance from the short arm end (cM) |
|---|---|---|---|---|
| 300 | bast60A1101 | 3231 | 3232 | 219.3 |
| 302 | bah52l06 | 3233 | 3234 | 220.4 |
| 302 | bah23h10 | 3235 | 3236 | 220.4 |
| 302 | BaGS15O23 | 3237 | 3238 | 220.4 |
| 302 | BaAK20E08 | 3239 | 3240 | 220.4 |
| 306 | kr61A1202 | 3241 | 3242 | 222.6 |
| 307 | bast03F0212 | 3243 | 3244 | 223.7 |
| 307 | bags39m22 | 3245 | 3246 | 223.7 |
| 309 | BaAK30O17 | 3247 | 3248 | 227.3 |
| 310 | baak29a01 | 3249 | 3250 | 232.1 |
| 310 | basd1e04 | 3251 | 3252 | 232.1 |
| 312 | BaGS23K09 | 3253 | 3254 | 233 |
| 313 | BaAL2N04 | 3255 | 3256 | 234.3 |
| 314 | BaH42C12 | 3257 | 3258 | 235.5 |
| 315 | bah39o14 | 3259 | 3260 | 236.1 |
| 316 | bast26A1202 | 3261 | 3262 | 236.6 |
| 317 | BaGS30N15 | 3263 | 3264 | 237.4 |
| 317 | BaAL34D18 | 3265 | 3266 | 237.4 |
| 319 | baak15k23 | 3267 | 3268 | 240.3 |
| 319 | bags37i06 | 3269 | 3270 | 240.3 |
| 319 | BaGS19N09 | 3271 | 3272 | 240.3 |
| 322 | BaSD13H09 | 3273 | 3274 | 241.4 |
| 323 | bags3h19 | 3275 | 3276 | 242.5 |
| 323 | baak28o08 | 3277 | 3278 | 242.5 |
| 325 | BaH15K08 | 3279 | 3280 | 243.6 |
| 325 | HVM67 | — | — | 243.6 |
| 325 | bah17h20 | 3281 | 3282 | 243.6 |
| 325 | BaAL5L13 | 3283 | 3284 | 243.6 |
| 325 | BaGS31P13 | 3285 | 3286 | 243.6 |
| 330 | BaH28A11 | 3287 | 3288 | 247.9 |
| 330 | BaSD25E01 | 3289 | 3290 | 247.9 |
| 330 | sh | — | — | 247.9 |

TABLE 4-7-continued

| Order from the short arm end | Clones | SEQ ID NO: (5' end) | SEQ ID NO: (3' end) | Distance from the short arm end (cM) |
|---|---|---|---|---|
| 333 | baet23F0111 | 3291 | 3292 | 249 |
| 333 | VRN2 | — | — | 249 |
| 333 | bastl41C0806 | 3293 | 3294 | 249 |
| 333 | basd11c04 | 3295 | 3296 | 249 |
| 333 | bags22k17 | 3297 | 3298 | 249 |
| 338 | bastl27A1101 | 3299 | 3300 | 250.2 |
| 338 | bags22a16 | 3301 | 3302 | 250.2 |
| 340 | BaAL5E04 | 3303 | 3304 | 250.3 |
| 341 | baal39f20 | 3305 | 3306 | 250.5 |
| 342 | baak43d13 | 3307 | 3308 | 250.7 |
| 342 | baak41l23 | 3309 | 3310 | 250.7 |
| 344 | baet23B0604 | 3311 | 3312 | 252.3 |
| 345 | BaAK28I08 | 3313 | 3314 | 255.6 |
| 346 | bastl26C1206 | 3315 | 3316 | 258.8 |
| 346 | bah27p20 | 3317 | 3318 | 258.8 |
| 346 | baal12d24 | 3319 | 3320 | 258.8 |
| 346 | bastl41F0511 | 3321 | 3322 | 258.8 |
| 346 | BaGS17E03 | 3323 | 3324 | 258.8 |

As shown in Table 5-1 to Table 5-11, the chromosomal order in barley 5H chromosome (distance from the short arm end of 5H chromosome) has been specified for 498 clones including the base sequences of SEQ ID NO: n (where n is an odd number) and SEQ ID NO: n+1 from among the base sequences of SEQ ID NO: 3325 through SEQ ID NO: 4320. The chromosomal order in barley 5H chromosome has also been specified for 8 known clones (MWG502, Bmac113, HVM30, Bmag223, HvLOX, MWG2077, MWG2249, and HVM6).

TABLE 5-1

| Order from the short arm end | Clones | SEQ ID NO: (5' end) | SEQ ID NO: (3' end) | Distance from the short arm end (cM) |
|---|---|---|---|---|
| 1 | baal10j04 | 3325 | 3326 | 0 |
| 1 | BaAK33J17 | 3327 | 3328 | 0 |
| 1 | BaAL21J19 | 3329 | 3330 | 0 |
| 4 | bast17H0515 | 3331 | 3332 | 0.5 |
| 5 | bags22c02 | 3333 | 3334 | 1 |
| 6 | BaAK35A06 | 3335 | 3336 | 2.2 |
| 7 | BaGS11K08 | 3337 | 3338 | 5.6 |
| 8 | bastl30A0602 | 3339 | 3340 | 6.7 |
| 9 | BaGS39H16 | 3341 | 3342 | 8.8 |
| 9 | MWG502 | — | — | 8.8 |
| 11 | BaAK18M22 | 3343 | 3344 | 9.9 |
| 12 | bast26G0614 | 3345 | 3346 | 11.5 |
| 13 | BaSD22F13 | 3347 | 3348 | 15.9 |
| 14 | BaAK28L16 | 3349 | 3350 | 20.5 |
| 15 | bags35o06 | 3351 | 3352 | 24.9 |
| 16 | bags13d07 | 3353 | 3354 | 25.9 |
| 16 | BaAL24F18 | 3355 | 3356 | 25.9 |
| 16 | bah63l18 | 3357 | 3358 | 25.9 |
| 19 | BaGS9H22 | 3359 | 3360 | 26.4 |
| 20 | BaAK18A05 | 3361 | 3362 | 26.9 |
| 20 | BaH38D03 | 3363 | 3364 | 26.9 |
| 20 | BaH17N17 | 3365 | 3366 | 26.9 |
| 23 | bah18d08 | 3367 | 3368 | 30.1 |
| 24 | bags34a05 | 3369 | 3370 | 31.9 |
| 24 | bags1m23 | 3371 | 3372 | 31.9 |
| 24 | BaH50B05 | 3373 | 3374 | 31.9 |
| 24 | bags1h11 | 3375 | 3376 | 31.9 |
| 28 | BaH47G19 | 3377 | 3378 | 32.4 |
| 29 | BaAK38H10 | 3379 | 3380 | 32.9 |
| 29 | bah47e01 | 3381 | 3382 | 32.9 |
| 29 | bast52E0109 | 3383 | 3384 | 32.9 |
| 32 | bags1o08 | 3385 | 3386 | 34 |
| 32 | BaH31H16 | 3387 | 3388 | 34 |
| 34 | baak32l14 | 3389 | 3390 | 36.1 |
| 34 | BaH50O06 | 3391 | 3392 | 36.1 |
| 34 | BaSD26I01 | 3393 | 3394 | 36.1 |

TABLE 5-1-continued

| Order from the short arm end | Clones | SEQ ID NO: (5' end) | SEQ ID NO: (3' end) | Distance from the short arm end (cM) |
|---|---|---|---|---|
| 37 | bags1h24 | 3395 | 3396 | 38.3 |
| 38 | basd27g16 | 3397 | 3398 | 40.5 |
| 38 | BaGS16G24 | 3399 | 3400 | 40.5 |
| 40 | BaGS34C19 | 3401 | 3402 | 43.7 |
| 40 | bah20k17 | 3403 | 3404 | 43.7 |
| 40 | bah54e13 | 3405 | 3406 | 43.7 |
| 40 | bags35i06 | 3407 | 3408 | 43.7 |
| 40 | bah29g09 | 3409 | 3410 | 43.7 |
| 45 | BaAK29C12 | 3411 | 3412 | 44.8 |
| 46 | bah56c06 | 3413 | 3414 | 48.2 |
| 47 | baal6a09 | 3415 | 3416 | 51.8 |
| 48 | bags6j06 | 3417 | 3418 | 53.1 |
| 49 | BaH30P15 | 3419 | 3420 | 54.2 |
| 50 | baak30k04 | 3421 | 3422 | 55.3 |

TABLE 5-2

| Order from the short arm end | Clones | SEQ ID NO: (5' end) | SEQ ID NO: (3' end) | Distance from the short arm end (cM) |
|---|---|---|---|---|
| 51 | basd25d22 | 3423 | 3424 | 56 |
| 51 | BaGS39M02 | 3425 | 3426 | 56 |
| 53 | baak13n10 | 3427 | 3428 | 58.9 |
| 53 | BaGS18J21 | 3429 | 3430 | 58.9 |
| 53 | BaSD22G22 | 3431 | 3432 | 58.9 |
| 53 | bags18b17 | 3433 | 3434 | 58.9 |
| 53 | bags33j02 | 3435 | 3436 | 58.9 |
| 53 | baak36b16 | 3437 | 3438 | 58.9 |
| 59 | bags37f05 | 3439 | 3440 | 60 |
| 59 | BaAL17L15 | 3441 | 3442 | 60 |
| 61 | BaGS20H12 | 3443 | 3444 | 62.4 |
| 62 | kr65A0802 | 3445 | 3446 | 64 |
| 62 | BaGS13E12 | 3447 | 3448 | 64 |
| 64 | basd3h06 | 3449 | 3450 | 65.2 |
| 65 | basd22j16 | 3451 | 3452 | 66.3 |
| 65 | bah39n18 | 3453 | 3454 | 66.3 |
| 67 | bags20d19 | 3455 | 3456 | 67.4 |
| 67 | BaGS34H19 | 3457 | 3458 | 67.4 |
| 69 | baak42n10 | 3459 | 3460 | 68.5 |
| 69 | BaSD24F03 | 3461 | 3462 | 68.5 |
| 69 | BaGS23N21 | 3463 | 3464 | 68.5 |
| 69 | BaAK45E04 | 3465 | 3466 | 68.5 |
| 69 | bags5n23 | 3467 | 3468 | 68.5 |
| 74 | bast52H1216 | 3469 | 3470 | 69.4 |
| 75 | bags22f23 | 3471 | 3472 | 69.7 |
| 76 | BaH38E02 | 3473 | 3474 | 70.5 |
| 76 | BaH50O07 | 3475 | 3476 | 70.5 |
| 78 | kr07C1006 | 3477 | 3478 | 73.3 |
| 78 | baak26a02 | 3479 | 3480 | 73.3 |
| 78 | BaAK2J22 | 3481 | 3482 | 73.3 |
| 78 | bah45h23 | 3483 | 3484 | 73.3 |
| 82 | bah11h09 | 3485 | 3486 | 74.8 |
| 82 | BaAK46M16 | 3487 | 3488 | 74.8 |
| 84 | bah55m23 | 3489 | 3490 | 75.2 |
| 84 | bah59c05 | 3491 | 3492 | 75.2 |
| 84 | basd11l17 | 3493 | 3494 | 75.2 |
| 84 | bah19e08 | 3495 | 3496 | 75.2 |
| 84 | BaAK21N24 | 3497 | 3498 | 75.2 |
| 84 | BaH50E09 | 3499 | 3500 | 75.2 |
| 84 | BaAK17P18 | 3501 | 3502 | 75.2 |
| 84 | BaAL7A04 | 3503 | 3504 | 75.2 |
| 84 | bast47B0303 | 3505 | 3506 | 75.2 |
| 84 | bah28o17 | 3507 | 3508 | 75.2 |
| 84 | bah37k03 | 3509 | 3510 | 75.2 |
| 84 | bastl38A0501 | 3511 | 3512 | 75.2 |
| 84 | bags23c03 | 3513 | 3514 | 75.2 |
| 84 | basd13j01 | 3515 | 3516 | 75.2 |
| 84 | bags21c02 | 3517 | 3518 | 75.2 |
| 84 | bah28l03 | 3519 | 3520 | 75.2 |
| 84 | BaAK36B17 | 3521 | 3522 | 75.2 |

TABLE 5-3

| Order from the short arm end | Clones | SEQ ID NO: (5' end) | SEQ ID NO: (3' end) | Distance from the short arm end (cM) |
|---|---|---|---|---|
| 84 | bags6k10 | 3523 | 3524 | 75.2 |
| 84 | BaAK32J23 | 3525 | 3526 | 75.2 |
| 84 | bags9k18 | 3527 | 3528 | 75.2 |
| 84 | baal18c19 | 3529 | 3530 | 75.2 |
| 84 | baak27p14 | 3531 | 3532 | 75.2 |
| 84 | BaGS30N21 | 3533 | 3534 | 75.2 |
| 84 | bah55p23 | 3535 | 3536 | 75.2 |
| 84 | bah54p22 | 3537 | 3538 | 75.2 |
| 84 | bags34f05 | 3539 | 3540 | 75.2 |
| 84 | Bmac113 | — | — | 75.2 |
| 84 | bags15i11 | 3541 | 3542 | 75.2 |
| 84 | BaH26I21 | 3543 | 3544 | 75.2 |
| 84 | BaSD20M22 | 3545 | 3546 | 75.2 |
| 114 | bah14a24 | 3547 | 3548 | 75.6 |
| 115 | BaH50J11 | 3549 | 3550 | 76 |
| 116 | bags7a20 | 3551 | 3552 | 76.4 |
| 116 | bah25l12 | 3553 | 3554 | 76.4 |
| 116 | bags6k09 | 3555 | 3556 | 76.4 |
| 116 | BaGS29P21 | 3557 | 3558 | 76.4 |
| 116 | bah58f18 | 3559 | 3560 | 76.4 |
| 116 | bags39i18 | 3561 | 3562 | 76.4 |
| 122 | basd22l21 | 3563 | 3564 | 77.1 |
| 123 | bags4o22 | 3565 | 3566 | 77.5 |
| 124 | kr27E0909 | 3567 | 3568 | 78 |
| 125 | bastl41H0216 | 3569 | 3570 | 78.5 |
| 125 | baak36o17 | 3571 | 3572 | 78.5 |
| 125 | BaH31P15 | 3573 | 3574 | 78.5 |
| 125 | kr07D0208 | 3575 | 3576 | 78.5 |
| 125 | bags9h03 | 3577 | 3578 | 78.5 |
| 130 | BaGS38M11 | 3579 | 3580 | 79.6 |
| 130 | kr26C0705 | 3581 | 3582 | 79.6 |
| 130 | bags3k24 | 3583 | 3584 | 79.6 |
| 130 | bah53e16 | 3585 | 3586 | 79.6 |
| 130 | bags21n10 | 3587 | 3588 | 79.6 |
| 130 | BaGS25E06 | 3589 | 3590 | 79.6 |
| 130 | bah38n03 | 3591 | 3592 | 79.6 |
| 130 | BaAK38G14 | 3593 | 3594 | 79.6 |
| 130 | baal5a06 | 3595 | 3596 | 79.6 |
| 130 | basd26d19 | 3597 | 3598 | 79.6 |
| 140 | BaSD26D07 | 3599 | 3600 | 80.7 |
| 140 | BaH50G14 | 3601 | 3602 | 80.7 |
| 140 | bah21h17 | 3603 | 3604 | 80.7 |
| 140 | bags5d21 | 3605 | 3606 | 80.7 |
| 140 | BaAK34D14 | 3607 | 3608 | 80.7 |
| 140 | baak18a16 | 3609 | 3610 | 80.7 |
| 140 | bags4b01 | 3611 | 3612 | 80.7 |
| 140 | bags38c19 | 3613 | 3614 | 80.7 |
| 140 | BaGS38J23 | 3615 | 3616 | 80.7 |
| 140 | kr42D0208 | 3617 | 3618 | 80.7 |
| 140 | BaH33A16 | 3619 | 3620 | 80.7 |

TABLE 5-4

| Order from the short arm end | Clones | SEQ ID NO: (5' end) | SEQ ID NO: (3' end) | Distance from the short arm end (cM) |
|---|---|---|---|---|
| 140 | bags10e03 | 3621 | 3622 | 80.7 |
| 140 | bags14f17 | 3623 | 3624 | 80.7 |
| 140 | BaAK35N11 | 3625 | 3626 | 80.7 |
| 140 | bags26n10 | 3627 | 3628 | 80.7 |
| 140 | bags37n02 | 3629 | 3630 | 80.7 |
| 140 | baal39l05 | 3631 | 3632 | 80.7 |
| 157 | BaAK26L11 | 3633 | 3634 | 81.3 |
| 158 | BaH57C19 | 3635 | 3636 | 81.7 |
| 158 | bags7a01 | 3637 | 3638 | 81.7 |
| 158 | bah19l15 | 3639 | 3640 | 81.7 |
| 158 | baal4o02 | 3641 | 3642 | 81.7 |
| 158 | bah58a12 | 3643 | 3644 | 81.7 |
| 158 | HVM30 | — | — | 81.7 |
| 158 | bah11b08 | 3645 | 3646 | 81.7 |
| 158 | bags14m15 | 3647 | 3648 | 81.7 |
| 158 | baak1e17 | 3649 | 3650 | 81.7 |

TABLE 5-4-continued

| Order from the short arm end | Clones | SEQ ID NO: (5' end) | SEQ ID NO: (3' end) | Distance from the short arm end (cM) |
|---|---|---|---|---|
| 167 | bags14i11 | 3651 | 3652 | 83.2 |
| 168 | bastl04B1103 | 3653 | 3654 | 87 |
| 169 | bags13g08 | 3655 | 3656 | 94.7 |
| 170 | basd27p03 | 3657 | 3658 | 102.2 |
| 170 | bast38D0707 | 3659 | 3660 | 102.2 |
| 172 | baak35j18 | 3661 | 3662 | 103.7 |
| 172 | baal19k05 | 3663 | 3664 | 103.7 |
| 174 | BaH19C21 | 3665 | 3666 | 104.2 |
| 174 | bah49g10 | 3667 | 3668 | 104.2 |
| 174 | bags14h08 | 3669 | 3670 | 104.2 |
| 174 | bags23g18 | 3671 | 3672 | 104.2 |
| 174 | bags22o22 | 3673 | 3674 | 104.2 |
| 174 | BaAL20A03 | 3675 | 3676 | 104.2 |
| 174 | bags5e24 | 3677 | 3678 | 104.2 |
| 174 | bags5f11 | 3679 | 3680 | 104.2 |
| 174 | BaAK33B10 | 3681 | 3682 | 104.2 |
| 174 | BaSD15J20 | 3683 | 3684 | 104.2 |
| 174 | bags38b22 | 3685 | 3686 | 104.2 |
| 185 | bah39b06 | 3687 | 3688 | 105.3 |
| 185 | bags19j08 | 3689 | 3690 | 105.3 |
| 187 | BaGS1G09 | 3691 | 3692 | 106.4 |
| 188 | bah63j06 | 3693 | 3694 | 107.5 |
| 188 | BaAL39J02 | 3695 | 3696 | 107.5 |
| 188 | BaSD27H14 | 3697 | 3698 | 107.5 |
| 191 | BaH50M01 | 3699 | 3700 | 112 |
| 192 | BaSD24E13 | 3701 | 3702 | 113.3 |
| 193 | baal5j24 | 3703 | 3704 | 116.7 |
| 194 | bah15h18 | 3705 | 3706 | 117.8 |
| 194 | bast62E0610 | 3707 | 3708 | 117.8 |
| 196 | bah28k24 | 3709 | 3710 | 118.9 |
| 196 | bah47c11 | 3711 | 3712 | 118.9 |
| 196 | BaSD26M15 | 3713 | 3714 | 118.9 |
| 196 | bah60o02 | 3715 | 3716 | 118.9 |
| 196 | BaH50G06 | 3717 | 3718 | 118.9 |

TABLE 5-5

| Order from the short arm end | Clones | SEQ ID NO: (5' end) | SEQ ID NO: (3' end) | Distance from the short arm end (cM) |
|---|---|---|---|---|
| 201 | bast15G0913 | 3719 | 3720 | 120 |
| 201 | bah62n12 | 3721 | 3722 | 120 |
| 201 | baal10n23 | 3723 | 3724 | 120 |
| 204 | bags20c12 | 3725 | 3726 | 121.1 |
| 205 | basd16f13 | 3727 | 3728 | 122.2 |
| 206 | baak21h06 | 3729 | 3730 | 124.2 |
| 207 | bags3b05 | 3731 | 3732 | 125.2 |
| 208 | bags22p08 | 3733 | 3734 | 128.3 |
| 208 | BaH23N06 | 3735 | 3736 | 128.3 |
| 208 | bags29c08 | 3737 | 3738 | 128.3 |
| 211 | BaGS11O23 | 3739 | 3740 | 129.4 |
| 211 | baak16a11 | 3741 | 3742 | 129.4 |
| 213 | baak15n22 | 3743 | 3744 | 131.6 |
| 213 | BaAL18J13 | 3745 | 3746 | 131.6 |
| 213 | bah15m02 | 3747 | 3748 | 131.6 |
| 213 | baak38d20 | 3749 | 3750 | 131.6 |
| 213 | BaSD12L21 | 3751 | 3752 | 131.6 |
| 213 | kr68B1103 | 3753 | 3754 | 131.6 |
| 219 | BaAK28L22 | 3755 | 3756 | 133.7 |
| 219 | bags15b10 | 3757 | 3758 | 133.7 |
| 219 | bags20h21 | 3759 | 3760 | 133.7 |
| 219 | BaAK29K06 | 3761 | 3762 | 133.7 |
| 219 | bags21l05 | 3763 | 3764 | 133.7 |
| 219 | bah56j14 | 3765 | 3766 | 133.7 |
| 219 | basd15e02 | 3767 | 3768 | 133.7 |
| 226 | bags3j24 | 3769 | 3770 | 134.8 |
| 226 | bags38m08 | 3771 | 3772 | 134.8 |
| 228 | bah11m18 | 3773 | 3774 | 136.9 |
| 228 | bags35g06 | 3775 | 3776 | 136.9 |
| 228 | bags37b01 | 3777 | 3778 | 136.9 |
| 228 | BaAL19F02 | 3779 | 3780 | 136.9 |
| 232 | BaAL4D09 | 3781 | 3782 | 138 |

TABLE 5-5-continued

| Order from the short arm end | Clones | SEQ ID NO: (5' end) | SEQ ID NO: (3' end) | Distance from the short arm end (cM) |
|---|---|---|---|---|
| 232 | BaAK30H10 | 3783 | 3784 | 138 |
| 234 | bags38b16 | 3785 | 3786 | 142.3 |
| 235 | bags27f15 | 3787 | 3788 | 143.7 |
| 236 | bags10k14 | 3789 | 3790 | 146.6 |
| 236 | bags22f10 | 3791 | 3792 | 146.6 |
| 236 | baak38n21 | 3793 | 3794 | 146.6 |
| 236 | baak30e05 | 3795 | 3796 | 146.6 |
| 236 | bastl04A0101 | 3797 | 3798 | 146.6 |
| 236 | BaAK28P18 | 3799 | 3800 | 146.6 |
| 236 | BaGS34E01 | 3801 | 3802 | 146.6 |
| 236 | BaH54H04 | 3803 | 3804 | 146.6 |
| 236 | bah13o19 | 3805 | 3806 | 146.6 |
| 245 | BaAK29B22 | 3807 | 3808 | 147.7 |
| 245 | BaAK27C16 | 3809 | 3810 | 147.7 |
| 245 | BaGS22H13 | 3811 | 3812 | 147.7 |
| 245 | BaSD27A15 | 3813 | 3814 | 147.7 |
| 249 | BaAK27E07 | 3815 | 3816 | 151 |
| 250 | BaGS9N02 | 3817 | 3818 | 152.1 |

TABLE 5-6

| Order from the short arm end | Clones | SEQ ID NO: (5' end) | SEQ ID NO: (3' end) | Distance from the short arm end (cM) |
|---|---|---|---|---|
| 251 | Bmag223 | — | — | 153.2 |
| 252 | bags28o18 | 3819 | 3820 | 154.3 |
| 253 | baal25b05 | 3821 | 3822 | 155.4 |
| 253 | bastl30A0202 | 3823 | 3824 | 155.4 |
| 253 | bags37d20 | 3825 | 3826 | 155.4 |
| 256 | BaGS22K12 | 3827 | 3828 | 155.8 |
| 257 | BaAK13G12 | 3829 | 3830 | 156.1 |
| 258 | basd2a02 | 3831 | 3832 | 156.5 |
| 258 | BaGS31L06 | 3833 | 3834 | 156.5 |
| 258 | bags17j17 | 3835 | 3836 | 156.5 |
| 258 | baal12j15 | 3837 | 3838 | 156.5 |
| 258 | BaAK19H14 | 3839 | 3840 | 156.5 |
| 263 | BaH34J11 | 3841 | 3842 | 159.8 |
| 263 | BaGS30I11 | 3843 | 3844 | 159.8 |
| 265 | BaH49L06 | 3845 | 3846 | 161 |
| 265 | baal18m24 | 3847 | 3848 | 161 |
| 267 | baak15l06 | 3849 | 3850 | 163.2 |
| 267 | basd18o14 | 3851 | 3852 | 163.2 |
| 269 | bags24p22 | 3853 | 3854 | 164.3 |
| 269 | BaAL37A09 | 3855 | 3856 | 164.3 |
| 269 | bags5l01 | 3857 | 3858 | 164.3 |
| 269 | BaAK12P03 | 3859 | 3860 | 164.3 |
| 273 | baak21f10 | 3861 | 3862 | 164.5 |
| 274 | bastl30E0410 | 3863 | 3864 | 164.7 |
| 274 | kr25C0206 | 3865 | 3866 | 164.7 |
| 276 | baak4j01 | 3867 | 3868 | 166.2 |
| 276 | BaAK27E01 | 3869 | 3870 | 166.2 |
| 278 | bah54n06 | 3871 | 3872 | 167.3 |
| 278 | bags19p05 | 3873 | 3874 | 167.3 |
| 278 | bast22F0311 | 3875 | 3876 | 167.3 |
| 281 | basd1m04 | 3877 | 3878 | 170.6 |
| 282 | bags35i04 | 3879 | 3880 | 171.7 |
| 282 | baak41d01 | 3881 | 3882 | 171.7 |
| 282 | baal19m08 | 3883 | 3884 | 171.7 |
| 282 | baak13j10 | 3885 | 3886 | 171.7 |
| 282 | baak44h11 | 3887 | 3888 | 171.7 |
| 287 | baal19j09 | 3889 | 3890 | 172.2 |
| 288 | baet37C1105 | 3891 | 3892 | 172.7 |
| 288 | baak12d06 | 3893 | 3894 | 172.7 |
| 288 | basd23f10 | 3895 | 3896 | 172.7 |
| 288 | BaH41P07 | 3897 | 3898 | 172.7 |
| 292 | baak1g13 | 3899 | 3900 | 173.8 |
| 293 | basd14b04 | 3901 | 3902 | 174.9 |
| 294 | bags22l14 | 3903 | 3904 | 177.1 |
| 294 | bast26E1210 | 3905 | 3906 | 177.1 |
| 296 | baet25F0911 | 3907 | 3908 | 180 |
| 296 | BaAK32N13 | 3909 | 3910 | 180 |
| 298 | BaSD2C09 | 3911 | 3912 | 180.3 |

TABLE 5-6-continued

| Order from the short arm end | Clones | SEQ ID NO: (5' end) | SEQ ID NO: (3' end) | Distance from the short arm end (cM) |
|---|---|---|---|---|
| 299 | BaGS31P01 | 3913 | 3914 | 180.7 |
| 299 | baak30m11 | 3915 | 3916 | 180.7 |

TABLE 5-7

| Order from the short arm end | Clones | SEQ ID NO: (5' end) | SEQ ID NO: (3' end) | Distance from the short arm end (cM) |
|---|---|---|---|---|
| 301 | BaAK4N16 | 3917 | 3918 | 181.2 |
| 302 | bastl46F1012 | 3919 | 3920 | 181.7 |
| 302 | bags3e06 | 3921 | 3922 | 181.7 |
| 302 | bags31o10 | 3923 | 3924 | 181.7 |
| 305 | bags33j12 | 3925 | 3926 | 182.8 |
| 306 | BaGS30N07 | 3927 | 3928 | 183.8 |
| 307 | BaH37I18 | 3929 | 3930 | 188.1 |
| 307 | baak46p24 | 3931 | 3932 | 188.1 |
| 309 | baak46o19 | 3933 | 3934 | 188.7 |
| 310 | basd3c19 | 3935 | 3936 | 189.2 |
| 310 | bags30f01 | 3937 | 3938 | 189.2 |
| 310 | BaGS20F10 | 3939 | 3940 | 189.2 |
| 313 | BaGS32D08 | 3941 | 3942 | 191.4 |
| 314 | BaAK23M23 | 3943 | 3944 | 193.6 |
| 314 | bah21a16 | 3945 | 3946 | 193.6 |
| 314 | BaAL3M08 | 3947 | 3948 | 193.6 |
| 314 | BaAK21I09 | 3949 | 3950 | 193.6 |
| 314 | baet33A0301 | 3951 | 3952 | 193.6 |
| 319 | baak24k02 | 3953 | 3954 | 195.7 |
| 319 | bah33p03 | 3955 | 3956 | 195.7 |
| 319 | bast75D1208 | 3957 | 3958 | 195.7 |
| 322 | BaSD12K20 | 3959 | 3960 | 196 |
| 323 | bags34f06 | 3961 | 3962 | 196.4 |
| 324 | bags6f09 | 3963 | 3964 | 196.8 |
| 324 | bags7b10 | 3965 | 3966 | 196.8 |
| 326 | BaGS25H01 | 3967 | 3968 | 199 |
| 326 | baak33m08 | 3969 | 3970 | 199 |
| 326 | bags37e01 | 3971 | 3972 | 199 |
| 326 | bags32n20 | 3973 | 3974 | 199 |
| 326 | BaH47A11 | 3975 | 3976 | 199 |
| 326 | BaGS24M06 | 3977 | 3978 | 199 |
| 332 | bags22m23 | 3979 | 3980 | 200.1 |
| 332 | basd18d18 | 3981 | 3982 | 200.1 |
| 332 | bastl06F0212 | 3983 | 3984 | 200.1 |
| 332 | BaH49O16 | 3985 | 3986 | 200.1 |
| 332 | bags39e22 | 3987 | 3988 | 200.1 |
| 332 | BaH38N06 | 3989 | 3990 | 200.1 |
| 332 | BaH56P16 | 3991 | 3992 | 200.1 |
| 339 | BaSD13O13 | 3993 | 3994 | 200.3 |
| 340 | bags19i06 | 3995 | 3996 | 201.4 |
| 340 | bah34f11 | 3997 | 3998 | 201.4 |
| 340 | bags37g04 | 3999 | 4000 | 201.4 |
| 343 | basd11k21 | 4001 | 4002 | 201.7 |
| 344 | HvLOX | — | — | 202.8 |
| 345 | baak43o03 | 4003 | 4004 | 203.6 |
| 345 | BaAL4J21 | 4005 | 4006 | 203.6 |
| 345 | BaH51J22 | 4007 | 4008 | 203.6 |
| 345 | bah58l03 | 4009 | 4010 | 203.6 |
| 345 | BaGS21M18 | 4011 | 4012 | 203.6 |
| 345 | BaGS31K06 | 4013 | 4014 | 203.6 |

TABLE 5-8

| Order from the short arm end | Clones | SEQ ID NO: (5' end) | SEQ ID NO: (3' end) | Distance from the short arm end (cM) |
|---|---|---|---|---|
| 351 | baal4o01*VRN2(sh2) | 4015 | 4016 | 204 |
| 352 | BaAK24H19 | 4017 | 4018 | 204.6 |
| 352 | BaGS17D21 | 4019 | 4020 | 204.6 |
| 352 | bah39o04 | 4021 | 4022 | 204.6 |
| 352 | baak46e06 | 4023 | 4024 | 204.6 |
| 352 | basd13j03 | 4025 | 4026 | 204.6 |
| 357 | bast14H0416 | 4027 | 4028 | 206.8 |
| 357 | BaSD18I03 | 4029 | 4030 | 206.8 |
| 357 | bastl44H1115 | 4031 | 4032 | 206.8 |
| 357 | bast34D0608 | 4033 | 4034 | 206.8 |
| 357 | BaGS30F06 | 4035 | 4036 | 206.8 |
| 357 | bags21k16 | 4037 | 4038 | 206.8 |
| 363 | BaH48G01 | 4039 | 4040 | 207.9 |
| 363 | bags39a24 | 4041 | 4042 | 207.9 |
| 363 | bags15i03 | 4043 | 4044 | 207.9 |
| 363 | bags23f02 | 4045 | 4046 | 207.9 |
| 363 | bastl40E1010 | 4047 | 4048 | 207.9 |
| 368 | bags17p10 | 4049 | 4050 | 211 |
| 369 | BaH57L13 | 4051 | 4052 | 212.6 |
| 369 | bags10e22 | 4053 | 4054 | 212.6 |
| 371 | bags4p07 | 4055 | 4056 | 213.6 |
| 371 | bah63a08 | 4057 | 4058 | 213.6 |
| 373 | baak12f13 | 4059 | 4060 | 214.7 |
| 373 | bah56j15 | 4061 | 4062 | 214.7 |
| 373 | bah15e16 | 4063 | 4064 | 214.7 |
| 373 | BaH50F21 | 4065 | 4066 | 214.7 |
| 373 | basd27o16 | 4067 | 4068 | 214.7 |
| 378 | kr66G0713 | 4069 | 4070 | 216.2 |
| 378 | baak46c17 | 4071 | 4072 | 216.2 |
| 380 | baet19C1206 | 4073 | 4074 | 216.7 |
| 380 | bags34e15 | 4075 | 4076 | 216.7 |
| 380 | baal4d18 | 4077 | 4078 | 216.7 |
| 380 | bah13b13 | 4079 | 4080 | 216.7 |
| 384 | BaGS26G20 | 4081 | 4082 | 217.2 |
| 385 | BaGS28C14 | 4083 | 4084 | 217.7 |
| 385 | kr61G1214 | 4085 | 4086 | 217.7 |
| 385 | bags9g08 | 4087 | 4088 | 217.7 |
| 385 | bags5p01 | 4089 | 4090 | 217.7 |
| 385 | BaAL4D04 | 4091 | 4092 | 217.7 |
| 385 | bah26p09 | 4093 | 4094 | 217.7 |
| 385 | bah11e02 | 4095 | 4096 | 217.7 |
| 385 | MWG2077 | — | — | 217.7 |
| 385 | bast41F0311 | 4097 | 4098 | 217.7 |
| 385 | bastl54D0307 | 4099 | 4100 | 217.7 |
| 395 | BaSD3F21 | 4101 | 4102 | 219.9 |
| 395 | bah56fl8 | 4103 | 4104 | 219.9 |
| 397 | BaH41C21 | 4105 | 4106 | 221 |
| 397 | basd19g21 | 4107 | 4108 | 221 |
| 399 | kr33H0816 | 4109 | 4110 | 223.2 |
| 399 | BaH38F16 | 4111 | 4112 | 223.2 |

TABLE 5-9

| Order from the short arm end | Clones | SEQ ID NO: (5' end) | SEQ ID NO: (3' end) | Distance from the short arm end (cM) |
|---|---|---|---|---|
| 399 | BaGS21P09 | 4113 | 4114 | 223.2 |
| 402 | BaGS36M20 | 4115 | 4116 | 224.2 |
| 403 | bags21m10 | 4117 | 4118 | 228.5 |
| 403 | BaAK14G11 | 4119 | 4120 | 228.5 |
| 405 | BaGS30L20 | 4121 | 4122 | 230.7 |
| 406 | basd21g02 | 4123 | 4124 | 231.8 |
| 406 | bah22m17 | 4125 | 4126 | 231.8 |
| 406 | BaGS9H19 | 4127 | 4128 | 231.8 |
| 409 | bah26m24 | 4129 | 4130 | 232.9 |
| 410 | BaH56D01 | 4131 | 4132 | 234 |
| 411 | bah53i08 | 4133 | 4134 | 237.1 |
| 411 | bags21d10 | 4135 | 4136 | 237.1 |
| 411 | bags9a01 | 4137 | 4138 | 237.1 |
| 414 | baal9m13 | 4139 | 4140 | 238.3 |
| 414 | baak20m05 | 4141 | 4142 | 238.3 |
| 416 | baak21k16 | 4143 | 4144 | 238.6 |
| 417 | bags34d17 | 4145 | 4146 | 239.4 |
| 418 | baal40k24 | 4147 | 4148 | 240.5 |
| 419 | BaGS19O14 | 4149 | 4150 | 243.4 |
| 419 | baak35m03 | 4151 | 4152 | 243.4 |
| 419 | baak33o23 | 4153 | 4154 | 243.4 |

TABLE 5-9-continued

| Order from the short arm end | Clones | SEQ ID NO: (5' end) | SEQ ID NO: (3' end) | Distance from the short arm end (cM) |
|---|---|---|---|---|
| 419 | kr57F1012 | 4155 | 4156 | 243.4 |
| 419 | bah53i05 | 4157 | 4158 | 243.4 |
| 419 | bags22l16 | 4159 | 4160 | 243.4 |
| 419 | baet43C0505 | 4161 | 4162 | 243.4 |
| 419 | BaH33H02 | 4163 | 4164 | 243.4 |
| 419 | bastl22E1010 | 4165 | 4166 | 243.4 |
| 428 | BaH53N24 | 4167 | 4168 | 244.6 |
| 429 | baal8e24 | 4169 | 4170 | 245.9 |
| 429 | BaH62H21 | 4171 | 4172 | 245.9 |
| 431 | BaH42K01 | 4173 | 4174 | 250.7 |
| 432 | basd26p09 | 4175 | 4176 | 252.1 |
| 433 | bags4p18 | 4177 | 4178 | 253.1 |
| 433 | BaH60H14 | 4179 | 4180 | 253.1 |
| 433 | bast70D1107 | 4181 | 4182 | 253.1 |
| 433 | bah26i23 | 4183 | 4184 | 253.1 |
| 437 | baal39g02 | 4185 | 4186 | 253.6 |
| 437 | bags10e02 | 4187 | 4188 | 253.6 |
| 439 | bags22c13 | 4189 | 4190 | 255.1 |
| 439 | bags35n03 | 4191 | 4192 | 255.1 |
| 439 | BaAL16H03 | 4193 | 4194 | 255.1 |
| 442 | BaAL15N07 | 4195 | 4196 | 255.8 |
| 443 | bags18o20 | 4197 | 4198 | 258 |
| 444 | bags37g12 | 4199 | 4200 | 258.4 |
| 445 | bags22l12 | 4201 | 4202 | 259.5 |
| 446 | BaAK44K01 | 4203 | 4204 | 260.6 |
| 446 | BaAK31G07 | 4205 | 4206 | 260.6 |
| 446 | bah53n21 | 4207 | 4208 | 260.6 |
| 449 | BaGS19C02 | 4209 | 4210 | 263.8 |
| 450 | BaH52E20 | 4211 | 4212 | 265.9 |

TABLE 5-10

| Order from the short arm end | Clones | SEQ ID NO: (5' end) | SEQ ID NO: (3' end) | Distance from the short arm end (cM) |
|---|---|---|---|---|
| 450 | BaAL4N05 | 4213 | 4214 | 265.9 |
| 450 | bags7p06 | 4215 | 4216 | 265.9 |
| 453 | bast70C0905 | 4217 | 4218 | 270.9 |
| 453 | BaSD15J01 | 4219 | 4220 | 270.9 |
| 455 | BaH56H18 | 4221 | 4222 | 272.9 |
| 455 | BaGS4N04 | 4223 | 4224 | 272.9 |
| 455 | bags31o13 | 4225 | 4226 | 272.9 |
| 455 | kr29D0107 | 4227 | 4228 | 272.9 |
| 459 | BaAK21A15 | 4229 | 4230 | 274 |
| 459 | bags7h14 | 4231 | 4232 | 274 |
| 459 | basd26b20 | 4233 | 4234 | 274 |
| 459 | baal1g06 | 4235 | 4236 | 274 |
| 459 | bags5n14 | 4237 | 4238 | 274 |
| 464 | BaAK34H17 | 4239 | 4240 | 274.5 |
| 465 | bastl32H0816 | 4241 | 4242 | 275 |
| 465 | basd18m12 | 4243 | 4244 | 275 |
| 465 | baak31p06 | 4245 | 4246 | 275 |
| 465 | bah52i03 | 4247 | 4248 | 275 |
| 469 | BaAK33K05 | 4249 | 4250 | 276.1 |
| 469 | BaAK44J08 | 4251 | 4252 | 276.1 |
| 469 | baak18g16 | 4253 | 4254 | 276.1 |
| 469 | baak11a11 | 4255 | 4256 | 276.1 |
| 473 | BaH25B20 | 4257 | 4258 | 279.3 |
| 473 | bastl12G0113 | 4259 | 4260 | 279.3 |
| 473 | baal9n02 | 4261 | 4262 | 279.3 |
| 473 | bags20f08 | 4263 | 4264 | 279.3 |
| 477 | BaGS9C24 | 4265 | 4266 | 281.5 |
| 477 | BaGS22O02 | 4267 | 4268 | 281.5 |
| 479 | baak13k16 | 4269 | 4270 | 282.6 |
| 479 | MWG2249 | — | — | 282.6 |
| 479 | bah41b17 | 4271 | 4272 | 282.6 |
| 482 | bah63m11 | 4273 | 4274 | 283.7 |
| 482 | BaGS28P07 | 4275 | 4276 | 283.7 |
| 482 | bags1h15 | 4277 | 4278 | 283.7 |
| 482 | kr26H0515 | 4279 | 4280 | 283.7 |
| 482 | bags6n05 | 4281 | 4282 | 283.7 |
| 487 | BaH24P17 | 4283 | 4284 | 284.1 |

TABLE 5-10-continued

| Order from the short arm end | Clones | SEQ ID NO: (5' end) | SEQ ID NO: (3' end) | Distance from the short arm end (cM) |
|---|---|---|---|---|
| 488 | bast03D0408 | 4285 | 4286 | 284.8 |
| 488 | BaAL17G06 | 4287 | 4288 | 284.8 |
| 488 | BaH32G11 | 4289 | 4290 | 284.8 |
| 488 | BaGS4P17 | 4291 | 4292 | 284.8 |
| 488 | baal31o21 | 4293 | 4294 | 284.8 |
| 488 | BaGS36A16 | 4295 | 4296 | 284.8 |
| 488 | bags4d11 | 4297 | 4298 | 284.8 |
| 488 | basd13n18 | 4299 | 4300 | 284.8 |
| 496 | basd0a08 | 4301 | 4302 | 285.2 |
| 497 | BaGS32P24 | 4303 | 4304 | 285.9 |
| 498 | baak12i02 | 4305 | 4306 | 288.2 |
| 498 | kr06H0315 | 4307 | 4308 | 288.2 |
| 498 | BaAL26B09 | 4309 | 4310 | 288.2 |

TABLE 5-11

| Order from the short arm end | Clones | SEQ ID NO: (5' end) | SEQ ID NO: (3' end) | Distance from the short arm end (cM) |
|---|---|---|---|---|
| 498 | kr32C11O5 | 4311 | 4312 | 288.2 |
| 498 | BaH53B15 | 4313 | 4314 | 288.2 |
| 503 | bags13hO4 | 4315 | 4316 | 291.4 |
| 504 | baal15i11 | 4317 | 4318 | 295.7 |
| 505 | bags1m19 | 4319 | 4320 | 307.4 |
| 506 | HVM6 | — | — | 331.7 |

As shown in Table 6-1 to Table 6-7, the chromosomal order in barley 6H chromosome (distance from the short arm end of 6H chromosome) has been specified for 321 clones including the base sequences of SEQ ID NO: n (where n is an odd number) and SEQ ID NO: n+1 from among the base sequences of SEQ ID NO: 4321 through SEQ ID NO: 4962. The chromosomal order in barley 6H chromosome has also been specified for 6 known clones (MWG620, Bmac316, MWG2218, HVM31, Bmac40, and MWG897).

TABLE 6-1

| Order from the short arm end | Clones | SEQ ID NO: (5' end) | SEQ ID NO: (3' end) | Distance from the short arm end (cM) |
|---|---|---|---|---|
| 1 | MWG620 | — | — | 0 |
| 2 | basd14f03 | 4321 | 4322 | 12.1 |
| 2 | BaH30E11 | 4323 | 4324 | 12.1 |
| 4 | BaH59J05 | 4325 | 4326 | 12.6 |
| 5 | BaAL39O22 | 4327 | 4328 | 13.1 |
| 6 | baal16j24 | 4329 | 4330 | 14.2 |
| 7 | BaAL30P12 | 4331 | 4332 | 15.3 |
| 7 | BaGS21H12 | 4333 | 4334 | 15.3 |
| 9 | BaAK15J05 | 4335 | 4336 | 16.4 |
| 9 | BaGS9G15 | 4337 | 4338 | 16.4 |
| 9 | BaAK41J04 | 4339 | 4340 | 16.4 |
| 12 | baak43j24 | 4341 | 4342 | 16.9 |
| 13 | bah26n19 | 4343 | 4344 | 17.4 |
| 13 | Bmac316 | — | — | 17.4 |
| 13 | bags38a05 | 4345 | 4346 | 17.4 |
| 13 | BaH43D06 | 4347 | 4348 | 17.4 |
| 17 | bags9j07 | 4349 | 4350 | 19.6 |
| 17 | baak31p11 | 4351 | 4352 | 19.6 |
| 19 | BaGS17P19 | 4353 | 4354 | 20.7 |
| 20 | baal32j05 | 4355 | 4356 | 23.6 |
| 20 | baal16l16 | 4357 | 4358 | 23.6 |
| 22 | baal6a11 | 4359 | 4360 | 24.4 |
| 22 | bah55p06 | 4361 | 4362 | 24.4 |
| 22 | bags8f03 | 4363 | 4364 | 24.4 |
| 22 | bags3m02 | 4365 | 4366 | 24.4 |
| 22 | BaAL36L08 | 4367 | 4368 | 24.4 |
| 22 | baet19E0309 | 4369 | 4370 | 24.4 |

TABLE 6-1-continued

| Order from the short arm end | Clones | SEQ ID NO: (5' end) | SEQ ID NO: (3' end) | Distance from the short arm end (cM) |
|---|---|---|---|---|
| 22 | BaSD18J06 | 4371 | 4372 | 24.4 |
| 29 | bast48D0307 | 4373 | 4374 | 28.5 |
| 30 | kr55D0707 | 4375 | 4376 | 29.8 |
| 30 | BaAL4B09 | 4377 | 4378 | 29.8 |
| 30 | bags32f21 | 4379 | 4380 | 29.8 |
| 33 | BaGS24F04 | 4381 | 4382 | 31.4 |
| 33 | BaGS10G07 | 4383 | 4384 | 31.4 |
| 35 | BaGS26P07 | 4385 | 4386 | 31.9 |
| 35 | bags12f11 | 4387 | 4388 | 31.9 |
| 35 | MWG2218 | — | — | 31.9 |
| 35 | BaH63O04 | 4389 | 4390 | 31.9 |
| 39 | BaGS26D21 | 4391 | 4392 | 32.3 |
| 40 | bags20o14 | 4393 | 4394 | 33 |
| 41 | baak36d08 | 4395 | 4396 | 34.1 |
| 41 | bast75H0616 | 4397 | 4398 | 34.1 |
| 41 | basd16g17 | 4399 | 4400 | 34.1 |
| 41 | baal4k16 | 4401 | 4402 | 34.1 |
| 41 | bags32b14 | 4403 | 4404 | 34.1 |
| 46 | baal4d01 | 4405 | 4406 | 35.2 |
| 46 | baal7d23 | 4407 | 4408 | 35.2 |
| 46 | BaH62C20 | 4409 | 4410 | 35.2 |
| 49 | BaH21K13 | 4411 | 4412 | 36.3 |
| 49 | BaAK14J02 | 4413 | 4414 | 36.3 |

TABLE 6-2

| Order from the short arm end | Clones | SEQ ID NO: (5' end) | SEQ ID NO: (3' end) | Distance from the short arm end (cM) |
|---|---|---|---|---|
| 51 | bah22c08 | 4415 | 4416 | 38.1 |
| 51 | baak25d07 | 4417 | 4418 | 38.1 |
| 53 | BaAK29M05 | 4419 | 4420 | 40.3 |
| 54 | BaGS31I08 | 4421 | 4422 | 44.7 |
| 54 | bah12n12 | 4423 | 4424 | 44.7 |
| 54 | baal30o06 | 4425 | 4426 | 44.7 |
| 54 | baak13n14 | 4427 | 4428 | 44.7 |
| 54 | bags7a09 | 4429 | 4430 | 44.7 |
| 54 | baak32l04 | 4431 | 4432 | 44.7 |
| 60 | bah31o16 | 4433 | 4434 | 45.8 |
| 60 | BaAL7C19 | 4435 | 4436 | 45.8 |
| 62 | BaAK23F04 | 4437 | 4438 | 46.1 |
| 63 | kr40D0707 | 4439 | 4440 | 46.8 |
| 64 | basd0g08 | 4441 | 4442 | 47.9 |
| 64 | BaAL30H03 | 4443 | 4444 | 47.9 |
| 66 | BaAL21B21 | 4445 | 4446 | 50.9 |
| 66 | BaGS30E05 | 4447 | 4448 | 50.9 |
| 68 | BaAK13G04 | 4449 | 4450 | 52.9 |
| 69 | BaGS27N11 | 4451 | 4452 | 55.8 |
| 70 | BaGS9A04 | 4453 | 4454 | 62.5 |
| 71 | BaAK23M11 | 4455 | 4456 | 68.4 |
| 72 | basd3f22 | 4457 | 4458 | 70.5 |
| 73 | baak41p21 | 4459 | 4460 | 71.6 |
| 73 | BaAK41K07 | 4461 | 4462 | 71.6 |
| 73 | BaH53I11 | 4463 | 4464 | 71.6 |
| 73 | baak26i14 | 4465 | 4466 | 71.6 |
| 73 | BaAL18N03 | 4467 | 4468 | 71.6 |
| 73 | baak40c08 | 4469 | 4470 | 71.6 |
| 73 | bags17l19 | 4471 | 4472 | 71.6 |
| 73 | BaSD25N02 | 4473 | 4474 | 71.6 |
| 81 | BaAK37E04 | 4475 | 4476 | 73.8 |
| 82 | baal33h17 | 4477 | 4478 | 75.4 |
| 83 | bags20d08 | 4479 | 4480 | 77 |
| 84 | BaGS4J01 | 4481 | 4482 | 78.1 |
| 84 | bah48o03 | 4483 | 4484 | 78.1 |
| 84 | bastl31A0901 | 4485 | 4486 | 78.1 |
| 84 | bah20k22 | 4487 | 4488 | 78.1 |
| 84 | BaGS15J17 | 4489 | 4490 | 78.1 |
| 84 | BaAK17I01 | 4491 | 4492 | 78.1 |
| 84 | BaAK30F08 | 4493 | 4494 | 78.1 |
| 84 | bah47a17 | 4495 | 4496 | 78.1 |
| 84 | basd15e10 | 4497 | 4498 | 78.1 |
| 93 | BaH56C11 | 4499 | 4500 | 79.2 |

TABLE 6-2-continued

| Order from the short arm end | Clones | SEQ ID NO: (5' end) | SEQ ID NO: (3' end) | Distance from the short arm end (cM) |
|---|---|---|---|---|
| 93 | BaH18C17 | 4501 | 4502 | 79.2 |
| 93 | BaGS20G24 | 4503 | 4504 | 79.2 |
| 96 | bags19g17 | 4505 | 4506 | 81.5 |
| 97 | BaAK21L02 | 4507 | 4508 | 84.9 |
| 98 | BaH52H21 | 4509 | 4510 | 89.2 |
| 99 | bags9l13 | 4511 | 4512 | 90.2 |
| 99 | BaSD18C12 | 4513 | 4514 | 90.2 |

TABLE 6-3

| Order from the short arm end | Clones | SEQ ID NO: (5' end) | SEQ ID NO: (3' end) | Distance from the short arm end (cM) |
|---|---|---|---|---|
| 101 | baak23k07 | 4515 | 4516 | 91.1 |
| 102 | bags16j16 | 4517 | 4518 | 91.9 |
| 103 | BaSD15O17 | 4519 | 4520 | 93.1 |
| 104 | baak12i20 | 4521 | 4522 | 93.6 |
| 104 | BaAK3M04 | 4523 | 4524 | 93.6 |
| 104 | BaGS4N23 | 4525 | 4526 | 93.6 |
| 104 | baak34k24 | 4527 | 4528 | 93.6 |
| 104 | bah15n23 | 4529 | 4530 | 93.6 |
| 104 | baak45i02 | 4531 | 4532 | 93.6 |
| 104 | basd13i08 | 4533 | 4534 | 93.6 |
| 111 | BaSD17P01 | 4535 | 4536 | 94.7 |
| 111 | HVM31 | — | — | 94.7 |
| 111 | baak13d19 | 4537 | 4538 | 94.7 |
| 111 | baal3h14 | 4539 | 4540 | 94.7 |
| 111 | bags33j18 | 4541 | 4542 | 94.7 |
| 111 | BaH45B01 | 4543 | 4544 | 94.7 |
| 111 | baak21n07 | 4545 | 4546 | 94.7 |
| 111 | BaH36H18 | 4547 | 4548 | 94.7 |
| 119 | BaAL23O14 | 4549 | 4550 | 95.8 |
| 120 | bah53f05 | 4551 | 4552 | 99.1 |
| 121 | baak12d02 | 4553 | 4554 | 100.2 |
| 122 | bags11h12 | 4555 | 4556 | 101.8 |
| 122 | baet01F1212 | 4557 | 4558 | 101.8 |
| 124 | baak17l11 | 4559 | 4560 | 102.3 |
| 124 | basd20e17 | 4561 | 4562 | 102.3 |
| 124 | bah29p24 | 4563 | 4564 | 102.3 |
| 124 | bags30o05 | 4565 | 4566 | 102.3 |
| 124 | kr68D0208 | 4567 | 4568 | 102.3 |
| 124 | bags37l11 | 4569 | 4570 | 102.3 |
| 124 | baal4d14 | 4571 | 4572 | 102.3 |
| 124 | BaH58I23 | 4573 | 4574 | 102.3 |
| 124 | bags39l04 | 4575 | 4576 | 102.3 |
| 124 | baak29i13 | 4577 | 4578 | 102.3 |
| 124 | bags20p18 | 4579 | 4580 | 102.3 |
| 124 | BaAK12J13 | 4581 | 4582 | 102.3 |
| 124 | BaH13K17 | 4583 | 4584 | 102.3 |
| 124 | bah60p09 | 4585 | 4586 | 102.3 |
| 124 | BaH27N11 | 4587 | 4588 | 102.3 |
| 124 | BaGS34D11 | 4589 | 4590 | 102.3 |
| 124 | BaGS39G07 | 4591 | 4592 | 102.3 |
| 124 | bah22o14 | 4593 | 4594 | 102.3 |
| 124 | bah14l20 | 4595 | 4596 | 102.3 |
| 124 | bah42p22 | 4597 | 4598 | 102.3 |
| 124 | BaAK21G03 | 4599 | 4600 | 102.3 |
| 124 | BaAL35D24 | 4601 | 4602 | 102.3 |
| 124 | baak45h14 | 4603 | 4604 | 102.3 |
| 124 | bags28o05 | 4605 | 4606 | 102.3 |
| 124 | BaAK31P07 | 4607 | 4608 | 102.3 |
| 124 | bah36c06 | 4609 | 4610 | 102.3 |
| 124 | BaGS37H24 | 4611 | 4612 | 102.3 |

TABLE 6-4

| Order from the short arm end | Clones | SEQ ID NO: (5' end) | SEQ ID NO: (3' end) | Distance from the short arm end (cM) |
|---|---|---|---|---|
| 124 | bast65B0303 | 4613 | 4614 | 102.3 |
| 124 | BaH51A22 | 4615 | 4616 | 102.3 |
| 153 | BaGS39K23 | 4617 | 4618 | 103.4 |
| 153 | BaSD14O12 | 4619 | 4620 | 103.4 |
| 153 | BaH57F12 | 4621 | 4622 | 103.4 |
| 153 | BaGS32G02 | 4623 | 4624 | 103.4 |
| 153 | BaAL40N06 | 4625 | 4626 | 103.4 |
| 153 | bah11b14 | 4627 | 4628 | 103.4 |
| 153 | bah15j14 | 4629 | 4630 | 103.4 |
| 153 | bast21C1105 | 4631 | 4632 | 103.4 |
| 153 | bags29f03 | 4633 | 4634 | 103.4 |
| 153 | BaAK46B16 | 4635 | 4636 | 103.4 |
| 153 | basd11p22 | 4637 | 4638 | 103.4 |
| 153 | baal16h16 | 4639 | 4640 | 103.4 |
| 165 | BaSD21L07 | 4641 | 4642 | 104.9 |
| 165 | BaH42D07 | 4643 | 4644 | 104.9 |
| 167 | BaGS23K24 | 4645 | 4646 | 106.4 |
| 167 | BaAK24L01 | 4647 | 4648 | 106.4 |
| 167 | BaAL11H22 | 4649 | 4650 | 106.4 |
| 167 | BaAL13O24 | 4651 | 4652 | 106.4 |
| 167 | BaAL6M22 | 4653 | 4654 | 106.4 |
| 167 | BaH56I06 | 4655 | 4656 | 106.4 |
| 167 | BaSD19A18 | 4657 | 4658 | 106.4 |
| 174 | BaSD20P03 | 4659 | 4660 | 108.2 |
| 174 | BaH19B13 | 4661 | 4662 | 108.2 |
| 176 | kr59H0416 | 4663 | 4664 | 110.7 |
| 177 | BaGS14A02 | 4665 | 4666 | 112.2 |
| 177 | BaH34P05 | 4667 | 4668 | 112.2 |
| 177 | bah61o16 | 4669 | 4670 | 112.2 |
| 177 | BaH24N07 | 4671 | 4672 | 112.2 |
| 177 | BaAL20M22 | 4673 | 4674 | 112.2 |
| 177 | BaAL11H20 | 4675 | 4676 | 112.2 |
| 177 | bah54b04 | 4677 | 4678 | 112.2 |
| 177 | BaAK14H23 | 4679 | 4680 | 112.2 |
| 177 | BaSD20M23 | 4681 | 4682 | 112.2 |
| 177 | BaAL15B12 | 4683 | 4684 | 112.2 |
| 177 | baal15d09 | 4685 | 4686 | 112.2 |
| 177 | baak39n20 | 4687 | 4688 | 112.2 |
| 177 | BaH43N16 | 4689 | 4690 | 112.2 |
| 177 | bags39h18 | 4691 | 4692 | 112.2 |
| 177 | BaAL3L23 | 4693 | 4694 | 112.2 |
| 192 | basd22c03 | 4695 | 4696 | 115.6 |
| 193 | bast55G0913 | 4697 | 4698 | 117.9 |
| 193 | kr47F0511 | 4699 | 4700 | 117.9 |
| 195 | bah15l24 | 4701 | 4702 | 118.4 |
| 196 | bast77A0402 | 4703 | 4704 | 118.9 |
| 196 | BaH58F04 | 4705 | 4706 | 118.9 |
| 196 | BaAK30L09 | 4707 | 4708 | 118.9 |
| 196 | kr39G1113 | 4709 | 4710 | 118.9 |
| 196 | baak1c16 | 4711 | 4712 | 118.9 |

TABLE 6-5

| Order from the short arm end | Clones | SEQ ID NO: (5' end) | SEQ ID NO: (3' end) | Distance from the short arm end (cM) |
|---|---|---|---|---|
| 196 | basd20e05 | 4713 | 4714 | 118.9 |
| 196 | BaAK12F18 | 4715 | 4716 | 118.9 |
| 196 | BaH50L11 | 4717 | 4718 | 118.9 |
| 196 | bast50G0814 | 4719 | 4720 | 118.9 |
| 196 | bast70D0107 | 4721 | 4722 | 118.9 |
| 196 | baal17d05 | 4723 | 4724 | 118.9 |
| 196 | baak46g03 | 4725 | 4726 | 118.9 |
| 196 | bah63m17 | 4727 | 4728 | 118.9 |
| 209 | BaH15L15 | 4729 | 4730 | 120 |
| 209 | BaGS19N01 | 4731 | 4732 | 120 |
| 209 | BaAK32P07 | 4733 | 4734 | 120 |
| 212 | bags14l13 | 4735 | 4736 | 121.1 |
| 213 | bags37o24 | 4737 | 4738 | 121.7 |
| 214 | baal5e24 | 4739 | 4740 | 122.8 |
| 215 | BaH46B06 | 4741 | 4742 | 124.5 |
| 215 | bags11a16 | 4743 | 4744 | 124.5 |
| 215 | baal27m03 | 4745 | 4746 | 124.5 |
| 215 | BaAK1C18 | 4747 | 4748 | 124.5 |
| 215 | BaAK38H16 | 4749 | 4750 | 124.5 |
| 215 | BaGS37K02 | 4751 | 4752 | 124.5 |
| 221 | bah28a10 | 4753 | 4754 | 125.6 |
| 221 | bah27c03 | 4755 | 4756 | 125.6 |
| 221 | BaH52B11 | 4757 | 4758 | 125.6 |
| 224 | bah27f05 | 4759 | 4760 | 127.8 |
| 224 | bags37g15 | 4761 | 4762 | 127.8 |
| 224 | bah59c10 | 4763 | 4764 | 127.8 |
| 224 | bags38j06 | 4765 | 4766 | 127.8 |
| 224 | basd14e01 | 4767 | 4768 | 127.8 |
| 224 | BaGS24L06 | 4769 | 4770 | 127.8 |
| 224 | bags17b02 | 4771 | 4772 | 127.8 |
| 224 | BaH54L03 | 4773 | 4774 | 127.8 |
| 224 | BaAK21J17 | 4775 | 4776 | 127.8 |
| 233 | BaGS23G08 | 4777 | 4778 | 128.9 |
| 233 | basd18e06 | 4779 | 4780 | 128.9 |
| 233 | baak19o02 | 4781 | 4782 | 128.9 |
| 233 | basd2o16 | 4783 | 4784 | 128.9 |
| 237 | baak16e08 | 4785 | 4786 | 130 |
| 237 | bags18h01 | 4787 | 4788 | 130 |
| 239 | BaGS4L20 | 4789 | 4790 | 133.4 |
| 240 | BaAL2M19 | 4791 | 4792 | 135.8 |
| 241 | BaH36F15 | 4793 | 4794 | 139.1 |
| 242 | bah58l07 | 4795 | 4796 | 140.2 |
| 243 | baet29C0406 | 4797 | 4798 | 141.3 |
| 243 | BaAK35B04 | 4799 | 4800 | 141.3 |
| 243 | bags34k13 | 4801 | 4802 | 141.3 |
| 246 | baal29i08 | 4803 | 4804 | 142.1 |
| 246 | baak11p10 | 4805 | 4806 | 142.1 |
| 248 | BaH30J08 | 4807 | 4808 | 145.1 |
| 249 | bags4e12 | 4809 | 4810 | 147.3 |
| 250 | bastl05C1206 | 4811 | 4812 | 148.4 |

TABLE 6-6

| Order from the short arm end | Clones | SEQ ID NO: (5' end) | SEQ ID NO: (3' end) | Distance from the short arm end (cM) |
|---|---|---|---|---|
| 250 | bast22G0313 | 4813 | 4814 | 148.4 |
| 252 | basd24b08 | 4815 | 4816 | 149.5 |
| 252 | bastl16C0206 | 4817 | 4818 | 149.5 |
| 252 | bags33n21 | 4819 | 4820 | 149.5 |
| 255 | baak33c11 | 4821 | 4822 | 151.7 |
| 255 | baal13o10 | 4823 | 4824 | 151.7 |
| 257 | BaH36P06 | 4825 | 4826 | 154.9 |
| 258 | basd12l01 | 4827 | 4828 | 157.1 |
| 259 | baet25H0115 | 4829 | 4830 | 158.2 |
| 259 | bags15d14 | 4831 | 4832 | 158.2 |
| 259 | BaGS37E09 | 4833 | 4834 | 158.2 |
| 259 | BaAK29I15 | 4835 | 4836 | 158.2 |
| 259 | BaAK18I01 | 4837 | 4838 | 158.2 |
| 264 | bast62B0404 | 4839 | 4840 | 160.4 |
| 265 | bah25l03 | 4841 | 4842 | 163.9 |
| 266 | BaGS19I11 | 4843 | 4844 | 167.2 |
| 266 | baal1n11 | 4845 | 4846 | 167.2 |
| 268 | baak16l07 | 4847 | 4848 | 167.6 |
| 268 | BaGS18P04 | 4849 | 4850 | 167.6 |
| 270 | bags19e06 | 4851 | 4852 | 168.9 |
| 270 | baak35n07 | 4853 | 4854 | 168.9 |
| 272 | BaAK29K23 | 4855 | 4856 | 173 |
| 272 | baal13c18 | 4857 | 4858 | 173 |
| 272 | bags7d17 | 4859 | 4860 | 173 |
| 275 | bags20j08 | 4861 | 4862 | 174.1 |
| 275 | baal9c20 | 4863 | 4864 | 174.1 |
| 277 | bags20l05 | 4865 | 4866 | 175.2 |
| 278 | bah63k05 | 4867 | 4868 | 176.3 |
| 279 | BaAK14C17 | 4869 | 4870 | 178.5 |
| 280 | Bmac40 | — | — | 179.6 |
| 280 | baal15i23 | 4871 | 4872 | 179.6 |
| 282 | BaAK1N06 | 4873 | 4874 | 181.7 |

TABLE 6-6-continued

| Order from the short arm end | Clones | SEQ ID NO: (5' end) | SEQ ID NO: (3' end) | Distance from the short arm end (cM) |
|---|---|---|---|---|
| 282 | bags38d10 | 4875 | 4876 | 181.7 |
| 282 | BaAK19J15 | 4877 | 4878 | 181.7 |
| 285 | BaH50L14 | 4879 | 4880 | 182.8 |
| 285 | BaGS37E11 | 4881 | 4882 | 182.8 |
| 287 | BaSD27E20 | 4883 | 4884 | 183 |
| 288 | basd17f18 | 4885 | 4886 | 184.1 |
| 289 | baal32m04 | 4887 | 4888 | 188.5 |
| 290 | BaSD12L12 | 4889 | 4890 | 191.7 |
| 291 | BaGS37D24 | 4891 | 4892 | 194 |
| 291 | BaGS9K15 | 4893 | 4894 | 194 |
| 293 | BaGS33L03 | 4895 | 4896 | 196 |
| 293 | BaAK24G10 | 4897 | 4898 | 196 |
| 295 | kr58F0511 | 4899 | 4900 | 196.5 |
| 296 | BaH50F16 | 4901 | 4902 | 197 |
| 296 | basd17d11 | 4903 | 4904 | 197 |
| 298 | BaH37P24 | 4905 | 4906 | 198.1 |
| 298 | bah47l21 | 4907 | 4908 | 198.1 |
| 298 | baet45C1105 | 4909 | 4910 | 198.1 |

TABLE 6-7

| Order from the short arm end | Clones | SEQ ID NO: (5' end) | SEQ ID NO: (3' end) | Distance from the short arm end (cM) |
|---|---|---|---|---|
| 301 | baak39o18 | 4911 | 4912 | 199.2 |
| 301 | bags20p12 | 4913 | 4914 | 199.2 |
| 301 | bags38f23 | 4915 | 4916 | 199.2 |
| 304 | baak14b08 | 4917 | 4918 | 201.4 |
| 304 | bah54n10 | 4919 | 4920 | 201.4 |
| 306 | bags3k09 | 4921 | 4922 | 202.5 |
| 307 | bags34p08 | 4923 | 4924 | 203.6 |
| 308 | baal1e06 | 4925 | 4926 | 204.7 |
| 308 | baak34p14 | 4927 | 4928 | 204.7 |
| 308 | baak14k12 | 4929 | 4930 | 204.7 |
| 308 | BaSD13G17 | 4931 | 4932 | 204.7 |
| 308 | MWG897 | — | — | 204.7 |
| 308 | bags27h05 | 4933 | 4934 | 204.7 |
| 308 | basd15m11 | 4935 | 4936 | 204.7 |
| 308 | BaH28G09 | 4937 | 4938 | 204.7 |
| 308 | bags21b06 | 4939 | 4940 | 204.7 |
| 308 | basd12g17 | 4941 | 4942 | 204.7 |
| 318 | BaH18F07 | 4943 | 4944 | 205 |
| 319 | BaH44A23 | 4945 | 4946 | 205.3 |
| 320 | bags3d07 | 4947 | 4948 | 205.6 |
| 321 | BaAL6A21 | 4949 | 4950 | 205.9 |
| 321 | BaAK24E07 | 4951 | 4952 | 205.9 |
| 321 | BaAL29L09 | 4953 | 4954 | 205.9 |
| 321 | kr66D1107 | 4955 | 4956 | 205.9 |
| 321 | bastl47C0606 | 4957 | 4958 | 205.9 |
| 321 | BaH50M03 | 4959 | 4960 | 205.9 |
| 327 | basd27k17 | 4961 | 4962 | 207.3 |

As shown in Table 7-1 to Table 7-9, the chromosomal order in barley 7H chromosome (distance from the short arm end of 7H chromosome) has been specified for 409 clones including the base sequences of SEQ ID NO: n (where n is an odd number) and SEQ ID NO: n+1 from among the base sequences of SEQ ID NO: 4963 through SEQ ID NO: 5780. The chromosomal order in barley 7H chromosome has also been specified for 16 known clones (HVM4, HVCMA, cMWG704, MWG511, Bmag359, MWG2031, KT3, KT9, MWG975, EBmac764, Bmac0064, Bmag120, Bmac156, HVM49, MWG2062, and HVM5).

TABLE 7-1

| Order from the short arm end | Clones | SEQ ID NO: (5' end) | SEQ ID NO: (3' end) | Distance from the short arm end (cM) |
|---|---|---|---|---|
| 1 | basd2p19 | 4963 | 4964 | 0 |
| 2 | BaAK38B18 | 4965 | 4966 | 4.7 |
| 3 | bah42i06 | 4967 | 4968 | 6.6 |
| 3 | bags6f02 | 4969 | 4970 | 6.6 |
| 5 | BaAK39J07 | 4971 | 4972 | 7.2 |
| 5 | BaAK1L23 | 4973 | 4974 | 7.2 |
| 5 | baak17e10 | 4975 | 4976 | 7.2 |
| 5 | BaH50H08 | 4977 | 4978 | 7.2 |
| 5 | baal17e10 | 4979 | 4980 | 7.2 |
| 5 | BaSD17C05 | 4981 | 4982 | 7.2 |
| 11 | BaGS14P02 | 4983 | 4984 | 8.3 |
| 11 | bastl42H0115 | 4985 | 4986 | 8.3 |
| 11 | BaAK19C08 | 4987 | 4988 | 8.3 |
| 11 | bastl40H1115 | 4989 | 4990 | 8.3 |
| 15 | bags12l21 | 4991 | 4992 | 9.4 |
| 15 | baak12j24 | 4993 | 4994 | 9.4 |
| 15 | bags14d22 | 4995 | 4996 | 9.4 |
| 15 | BaAK21P12 | 4997 | 4998 | 9.4 |
| 15 | baal6b02 | 4999 | 5000 | 9.4 |
| 15 | baak29f13 | 5001 | 5002 | 9.4 |
| 21 | bast79C0406 | 5003 | 5004 | 11.3 |
| 22 | BaH45M08 | 5005 | 5006 | 12.4 |
| 23 | kr28A0301 | 5007 | 5008 | 16.4 |
| 23 | bags19e04 | 5009 | 5010 | 16.4 |
| 25 | BaH28L07 | 5011 | 5012 | 18.6 |
| 26 | baak21m18 | 5013 | 5014 | 20.9 |
| 26 | baak21l22 | 5015 | 5016 | 20.9 |
| 28 | basd15h01 | 5017 | 5018 | 25.2 |
| 28 | BaH19O11 | 5019 | 5020 | 25.2 |
| 28 | BaH59A20 | 5021 | 5022 | 25.2 |
| 31 | bags39l05 | 5023 | 5024 | 27.3 |
| 31 | BaAK31N06 | 5025 | 5026 | 27.3 |
| 33 | BaH58P03 | 5027 | 5028 | 28.4 |
| 34 | bags29c18 | 5029 | 5030 | 29.5 |
| 35 | BaAL4O04 | 5031 | 5032 | 30.6 |
| 35 | bags37n23 | 5033 | 5034 | 30.6 |
| 35 | BaAL39N03 | 5035 | 5036 | 30.6 |
| 38 | BaAK14C23 | 5037 | 5038 | 31.7 |
| 38 | kr61A1101 | 5039 | 5040 | 31.7 |
| 38 | BaH42J17 | 5041 | 5042 | 31.7 |
| 41 | BaH58H08 | 5043 | 5044 | 39.2 |
| 42 | bast78A0202 | 5045 | 5046 | 40.4 |
| 43 | BaGS21E20 | 5047 | 5048 | 42.5 |
| 43 | bags22j18 | 5049 | 5050 | 42.5 |
| 45 | BaGS33H15 | 5051 | 5052 | 45.7 |
| 45 | HVM4 | — | — | 45.7 |
| 47 | BaSD18O16 | 5053 | 5054 | 47.9 |
| 47 | baak22j11 | 5055 | 5056 | 47.9 |
| 49 | BaAK20K04 | 5057 | 5058 | 50.4 |
| 50 | bags29l11 | 5059 | 5060 | 55.2 |

TABLE 7-2

| Order from the short arm end | Clones | SEQ ID NO: (5' end) | SEQ ID NO: (3' end) | Distance from the short arm end (cM) |
|---|---|---|---|---|
| 51 | BaAK17G18 | 5061 | 5062 | 60.3 |
| 52 | baak14o13 | 5063 | 5064 | 61.7 |
| 53 | baal8d17 | 5065 | 5066 | 63.2 |
| 54 | BaAK37P20 | 5067 | 5068 | 64.2 |
| 55 | bags28k04 | 5069 | 5070 | 71.5 |
| 56 | bah34b22 | 5071 | 5072 | 73.8 |
| 57 | BaGS37M03 | 5073 | 5074 | 78.3 |
| 58 | BaGS18C14 | 5075 | 5076 | 79.5 |
| 59 | bast23G0214 | 5077 | 5078 | 80.6 |
| 59 | bah47p02 | 5079 | 5080 | 80.6 |
| 61 | baak42a24 | 5081 | 5082 | 81.7 |
| 61 | baak16f06 | 5083 | 5084 | 81.7 |
| 61 | bah11m12 | 5085 | 5086 | 81.7 |
| 64 | kr66H0216 | 5087 | 5088 | 84.9 |
| 64 | BaGS23D15 | 5089 | 5090 | 84.9 |
| 64 | baal22c17 | 5091 | 5092 | 84.9 |

TABLE 7-2-continued

| Order from the short arm end | Clones | SEQ ID NO: (5' end) | SEQ ID NO: (3' end) | Distance from the short arm end (cM) |
|---|---|---|---|---|
| 67 | baak33d06 | 5093 | 5094 | 86 |
| 67 | bags34l17 | 5095 | 5096 | 86 |
| 67 | BaGS25G03 | 5097 | 5098 | 86 |
| 67 | bah14j16 | 5099 | 5100 | 86 |
| 67 | bah34a23 | 5101 | 5102 | 86 |
| 67 | BaAK21B17 | 5103 | 5104 | 86 |
| 67 | bast42C0406 | 5105 | 5106 | 86 |
| 74 | baak21m13 | 5107 | 5108 | 87.3 |
| 75 | baet45H0115 | 5109 | 5110 | 87.7 |
| 76 | BaH38E01 | 5111 | 5112 | 88.1 |
| 76 | bast03G0313 | 5113 | 5114 | 88.1 |
| 78 | baak38p18 | 5115 | 5116 | 89.5 |
| 79 | basd18g06 | 5117 | 5118 | 90.6 |
| 80 | baak40i22 | 5119 | 5120 | 92 |
| 80 | baal2n12 | 5121 | 5122 | 92 |
| 82 | BaSD3C24 | 5123 | 5124 | 94.1 |
| 83 | BaAK46M07 | 5125 | 5126 | 96.3 |
| 84 | BaGS17N04 | 5127 | 5128 | 99.6 |
| 85 | bags12d09 | 5129 | 5130 | 100.7 |
| 85 | basd20c08 | 5131 | 5132 | 100.7 |
| 87 | bags17i04 | 5133 | 5134 | 101.7 |
| 87 | baak15p03 | 5135 | 5136 | 101.7 |
| 89 | baak24b20 | 5137 | 5138 | 104.9 |
| 89 | baal18g11 | 5139 | 5140 | 104.9 |
| 89 | baal40b06 | 5141 | 5142 | 104.9 |
| 89 | baak40g02 | 5143 | 5144 | 104.9 |
| 93 | baal1m11 | 5145 | 5146 | 106.1 |
| 94 | BaH26B16 | 5147 | 5148 | 107.9 |
| 94 | baal5n08 | 5149 | 5150 | 107.9 |
| 96 | BaSD27F05 | 5151 | 5152 | 109.5 |
| 96 | bags9c08 | 5153 | 5154 | 109.5 |
| 96 | baak3c01 | 5155 | 5156 | 109.5 |
| 99 | basd1j22 | 5157 | 5158 | 110.6 |
| 99 | BaH23N03 | 5159 | 5160 | 110.6 |

TABLE 7-3

| Order from the short arm end | Clones | SEQ ID NO: (5' end) | SEQ ID NO: (3' end) | Distance from the short arm end (cM) |
|---|---|---|---|---|
| 99 | bast46D0808 | 5161 | 5162 | 110.6 |
| 99 | bast22A0802 | 5163 | 5164 | 110.6 |
| 99 | bast34D0808 | 5165 | 5166 | 110.6 |
| 104 | bast48E0509 | 5167 | 5168 | 114.9 |
| 104 | bast26F1012 | 5169 | 5170 | 114.9 |
| 106 | baal30e07 | 5171 | 5172 | 115.5 |
| 107 | bags23n06 | 5173 | 5174 | 116.1 |
| 108 | BaGS18I05 | 5175 | 5176 | 116.6 |
| 109 | BaH52L11 | 5177 | 5178 | 116.8 |
| 110 | baal18b16 | 5179 | 5180 | 117 |
| 111 | bags1a17 | 5181 | 5182 | 118.1 |
| 111 | HVCMA | — | — | 118.1 |
| 111 | bags8o06 | 5183 | 5184 | 118.1 |
| 111 | baak46e14 | 5185 | 5186 | 118.1 |
| 115 | BaGS38N08 | 5187 | 5188 | 118.6 |
| 115 | BaH49P17 | 5189 | 5190 | 118.6 |
| 117 | bah60l22 | 5191 | 5192 | 120.2 |
| 117 | bags21m22 | 5193 | 5194 | 120.2 |
| 117 | BaH54E07 | 5195 | 5196 | 120.2 |
| 120 | BaAK39A20 | 5197 | 5198 | 121.3 |
| 121 | bags21d11 | 5199 | 5200 | 123.5 |
| 122 | kr39H0816 | 5201 | 5202 | 125.6 |
| 123 | baet32B1103 | 5203 | 5204 | 131.1 |
| 124 | BaAK31O16 | 5205 | 5206 | 132.1 |
| 124 | bags39l20 | 5207 | 5208 | 132.1 |
| 124 | BaGS15L12 | 5209 | 5210 | 132.1 |
| 127 | kr67D0208 | 5211 | 5212 | 134.3 |
| 128 | BaAK1H16 | 5213 | 5214 | 135.4 |
| 128 | BaH26F10 | 5215 | 5216 | 135.4 |
| 130 | bags14n02 | 5217 | 5218 | 135.9 |
| 131 | bah36f01 | 5219 | 5220 | 136.4 |
| 132 | bast79F0711 | 5221 | 5222 | 137.5 |

TABLE 7-3-continued

| Order from the short arm end | Clones | SEQ ID NO: (5' end) | SEQ ID NO: (3' end) | Distance from the short arm end (cM) |
|---|---|---|---|---|
| 132 | BaGS29G21 | 5223 | 5224 | 137.5 |
| 134 | bast79D1107 | 5225 | 5226 | 139.6 |
| 134 | BaGS26O20 | 5227 | 5228 | 139.6 |
| 134 | bags11h08 | 5229 | 5230 | 139.6 |
| 134 | bags22h11 | 5231 | 5232 | 139.6 |
| 134 | baet19D0608 | 5233 | 5234 | 139.6 |
| 139 | bags23a14 | 5235 | 5236 | 140.7 |
| 139 | cMWG704 | — | — | 140.7 |
| 139 | bah62d14 | 5237 | 5238 | 140.7 |
| 142 | BaGS37C09 | 5239 | 5240 | 142.6 |
| 142 | bags20a01 | 5241 | 5242 | 142.6 |
| 144 | bah53m11 | 5243 | 5244 | 144.5 |
| 144 | BaGS26L01 | 5245 | 5246 | 144.5 |
| 144 | bags21p23 | 5247 | 5248 | 144.5 |
| 144 | BaAK24B01 | 5249 | 5250 | 144.5 |
| 144 | BaAK13L03 | 5251 | 5252 | 144.5 |
| 149 | MWG511 | — | — | 145.6 |
| 149 | bastl56C0105 | 5253 | 5254 | 145.6 |

TABLE 7-4

| Order from the short arm end | Clones | SEQ ID NO: (5' end) | SEQ ID NO: (3' end) | Distance from the short arm end (cM) |
|---|---|---|---|---|
| 149 | basd20j22 | 5255 | 5256 | 145.6 |
| 149 | bags28d11 | 5257 | 5258 | 145.6 |
| 153 | BaGS4I11 | 5259 | 5260 | 146.7 |
| 153 | BaH52G15 | 5261 | 5262 | 146.7 |
| 153 | baak11d12 | 5263 | 5264 | 146.7 |
| 153 | BaH42A07 | 5265 | 5266 | 146.7 |
| 157 | BaGS38F01 | 5267 | 5268 | 147.2 |
| 158 | BaAK32I05 | 5269 | 5270 | 147.7 |
| 158 | bah60f18 | 5271 | 5272 | 147.7 |
| 160 | baal2n10 | 5273 | 5274 | 148.8 |
| 161 | BaAK14F01 | 5275 | 5276 | 149.9 |
| 161 | bah57o01 | 5277 | 5278 | 149.9 |
| 161 | basd12f05 | 5279 | 5280 | 149.9 |
| 161 | bah58e21 | 5281 | 5282 | 149.9 |
| 161 | bags1d07 | 5283 | 5284 | 149.9 |
| 161 | BaH23J15 | 5285 | 5286 | 149.9 |
| 161 | baak1p09 | 5287 | 5288 | 149.9 |
| 168 | BaAK32C23 | 5289 | 5290 | 151 |
| 168 | baal9e06 | 5291 | 5292 | 151 |
| 168 | baal18g23 | 5293 | 5294 | 151 |
| 168 | bastl47E0309 | 5295 | 5296 | 151 |
| 168 | baak30o08 | 5297 | 5298 | 151 |
| 168 | baet44C0606 | 5299 | 5300 | 151 |
| 174 | bags39g18 | 5301 | 5302 | 152.1 |
| 174 | BaH50P14 | 5303 | 5304 | 152.1 |
| 176 | bags38m06 | 5305 | 5306 | 152.6 |
| 177 | baal33e12 | 5307 | 5308 | 153.2 |
| 177 | bags3i04 | 5309 | 5310 | 153.2 |
| 179 | BaAL1A11 | 5311 | 5312 | 153.7 |
| 179 | BaSD2M23 | 5313 | 5314 | 153.7 |
| 181 | Bmag359 | — | — | 155.3 |
| 181 | BaAK23L23 | 5315 | 5316 | 155.3 |
| 181 | bags7a23 | 5317 | 5318 | 155.3 |
| 181 | bah56l04 | 5319 | 5320 | 155.3 |
| 185 | basd12k23 | 5321 | 5322 | 156.4 |
| 185 | bast22C0105 | 5323 | 5324 | 156.4 |
| 185 | BaGS38H20 | 5325 | 5326 | 156.4 |
| 185 | bah61p21 | 5327 | 5328 | 156.4 |
| 185 | basd11h13 | 5329 | 5330 | 156.4 |
| 185 | BaAL41J12 | 5331 | 5332 | 156.4 |
| 185 | baal0f04 | 5333 | 5334 | 156.4 |
| 185 | kr18E0810 | 5335 | 5336 | 156.4 |
| 185 | BaH15J07 | 5337 | 5338 | 156.4 |
| 185 | BaAL6G08 | 5339 | 5340 | 156.4 |
| 185 | BaGS24F02 | 5341 | 5342 | 156.4 |
| 185 | baal19m12 | 5343 | 5344 | 156.4 |
| 185 | bah34h16 | 5345 | 5346 | 156.4 |
| 185 | baak2e06 | 5347 | 5348 | 156.4 |

TABLE 7-4-continued

| Order from the short arm end | Clones | SEQ ID NO: (5' end) | SEQ ID NO: (3' end) | Distance from the short arm end (cM) |
|---|---|---|---|---|
| 185 | bast10C0406 | 5349 | 5350 | 156.4 |
| 185 | baak12l16 | 5351 | 5352 | 156.4 |

TABLE 7-5

| Order from the short arm end | Clones | SEQ ID NO: (5' end) | SEQ ID NO: (3' end) | Distance from the short arm end (cM) |
|---|---|---|---|---|
| 185 | baak29d01 | 5353 | 5354 | 156.4 |
| 185 | BaAK19N06 | 5355 | 5356 | 156.4 |
| 185 | BaAK4I02 | 5357 | 5358 | 156.4 |
| 185 | BaH49K10 | 5359 | 5360 | 156.4 |
| 185 | baal2o03 | 5361 | 5362 | 156.4 |
| 185 | baak28g14 | 5363 | 5364 | 156.4 |
| 185 | bah62n05 | 5365 | 5366 | 156.4 |
| 185 | bags16e11 | 5367 | 5368 | 156.4 |
| 185 | bags23g13 | 5369 | 5370 | 156.4 |
| 210 | BaSD23C05 | 5371 | 5372 | 157 |
| 211 | BaH19F17 | 5373 | 5374 | 157.4 |
| 211 | BaH15J02 | 5375 | 5376 | 157.4 |
| 211 | baak20d11 | 5377 | 5378 | 157.4 |
| 211 | BaAL6D19 | 5379 | 5380 | 157.4 |
| 211 | baak43e16 | 5381 | 5382 | 157.4 |
| 216 | baak40b02 | 5383 | 5384 | 158.5 |
| 217 | bah62m03 | 5385 | 5386 | 159.6 |
| 218 | BaGS26G17 | 5387 | 5388 | 161.8 |
| 219 | baal6j16 | 5389 | 5390 | 162.9 |
| 219 | bags29b09 | 5391 | 5392 | 162.9 |
| 219 | baal20e03 | 5393 | 5394 | 162.9 |
| 219 | BaGS9L23 | 5395 | 5396 | 162.9 |
| 219 | bah32e22 | 5397 | 5398 | 162.9 |
| 219 | BaAK17O14 | 5399 | 5400 | 162.9 |
| 225 | bah56g23 | 5401 | 5402 | 164 |
| 225 | basd22f14 | 5403 | 5404 | 164 |
| 227 | BaH42O04 | 5405 | 5406 | 164.7 |
| 227 | bast74F0111 | 5407 | 5408 | 164.7 |
| 229 | BaSD21F13 | 5409 | 5410 | 167.3 |
| 230 | BaAK26G13 | 5411 | 5412 | 167.4 |
| 231 | BaAK44D07 | 5413 | 5414 | 168.2 |
| 231 | bast61C0206 | 5415 | 5416 | 168.2 |
| 233 | BaAL29L08 | 5417 | 5418 | 169.4 |
| 233 | BaH34B20 | 5419 | 5420 | 169.4 |
| 233 | baak21a04 | 5421 | 5422 | 169.4 |
| 233 | BaGS37F18 | 5423 | 5424 | 169.4 |
| 233 | baal12h12 | 5425 | 5426 | 169.4 |
| 233 | BaAK42B16 | 5427 | 5428 | 169.4 |
| 233 | BaAK26F12 | 5429 | 5430 | 169.4 |
| 233 | BaH27B21 | 5431 | 5432 | 169.4 |
| 233 | BaGS12B05 | 5433 | 5434 | 169.4 |
| 233 | baal12h24 | 5435 | 5436 | 169.4 |
| 243 | baal35j16 | 5437 | 5438 | 173.5 |
| 243 | BaGS37C07 | 5439 | 5440 | 173.5 |
| 243 | BaAK45D23 | 5441 | 5442 | 173.5 |
| 243 | BaH42G09 | 5443 | 5444 | 173.5 |
| 243 | BaAL40P01 | 5445 | 5446 | 173.5 |
| 243 | kr61A0901 | 5447 | 5448 | 173.5 |
| 249 | baal4d05 | 5449 | 5450 | 174.6 |
| 249 | basd20l03 | 5451 | 5452 | 174.6 |

TABLE 7-6

| Order from the short arm end | Clones | SEQ ID NO: (5' end) | SEQ ID NO: (3' end) | Distance from the short arm end (cM) |
|---|---|---|---|---|
| 249 | baal31b03 | 5453 | 5454 | 174.6 |
| 252 | bags27k21 | 5455 | 5456 | 176.8 |
| 252 | bah55n15 | 5457 | 5458 | 176.8 |
| 254 | BaH44B17 | 5459 | 5460 | 177.9 |
| 254 | BaSD2K11 | 5461 | 5462 | 177.9 |
| 256 | BaAK20B23 | 5463 | 5464 | 180.1 |
| 256 | BaGS23E20 | 5465 | 5466 | 180.1 |
| 256 | bags33i10 | 5467 | 5468 | 180.1 |
| 256 | bags35k06 | 5469 | 5470 | 180.1 |
| 260 | bags22c18 | 5471 | 5472 | 181.2 |
| 260 | MWG2031 | — | — | 181.2 |
| 260 | BaGS22M17 | 5473 | 5474 | 181.2 |
| 263 | baak21j24 | 5475 | 5476 | 184.4 |
| 263 | BaH29D20 | 5477 | 5478 | 184.4 |
| 263 | bah44f20 | 5479 | 5480 | 184.4 |
| 263 | BaAL16O08 | 5481 | 5482 | 184.4 |
| 263 | BaAL27L17 | 5483 | 5484 | 184.4 |
| 263 | sKT3 | — | — | 184.4 |
| 263 | sKT9 | — | — | 184.4 |
| 263 | baet31B1103 | 5485 | 5486 | 184.4 |
| 263 | MWG975 | — | — | 184.4 |
| 272 | BaAL4A11 | 5487 | 5488 | 185.9 |
| 272 | BaGS22I18 | 5489 | 5490 | 185.9 |
| 274 | BaGS24K08 | 5491 | 5492 | 186.4 |
| 274 | bah16c17 | 5493 | 5494 | 186.4 |
| 274 | bah42m04 | 5495 | 5496 | 186.4 |
| 274 | bags28l21 | 5497 | 5498 | 186.4 |
| 274 | basd12f23 | 5499 | 5500 | 186.4 |
| 274 | bah31m22 | 5501 | 5502 | 186.4 |
| 274 | BaAL30C17 | 5503 | 5504 | 186.4 |
| 274 | BaAK40P18 | 5505 | 5506 | 186.4 |
| 274 | baak37n01 | 5507 | 5508 | 186.4 |
| 274 | BaGS24O11 | 5509 | 5510 | 186.4 |
| 274 | BaH27K19 | 5511 | 5512 | 186.4 |
| 274 | BaGS15J07 | 5513 | 5514 | 186.4 |
| 286 | bah19a07 | 5515 | 5516 | 188.9 |
| 287 | BaH50I23 | 5517 | 5518 | 194 |
| 288 | BaH56D06 | 5519 | 5520 | 195 |
| 288 | BaAK39M05 | 5521 | 5522 | 195 |
| 288 | bah11m16 | 5523 | 5524 | 195 |
| 291 | bah49d03 | 5525 | 5526 | 196.1 |
| 291 | bah62l23 | 5527 | 5528 | 196.1 |
| 291 | BaAK38J13 | 5529 | 5530 | 196.1 |
| 291 | BaH37N04 | 5531 | 5532 | 196.1 |
| 291 | basd27c06 | 5533 | 5534 | 196.1 |
| 291 | bah39g10 | 5535 | 5536 | 196.1 |
| 291 | BaSD18P05 | 5537 | 5538 | 196.1 |
| 298 | BaGS20A13 | 5539 | 5540 | 196.6 |
| 299 | bah44n05 | 5541 | 5542 | 197.2 |
| 300 | EBmac764 | — | — | 198.2 |

TABLE 7-7

| Order from the short arm end | Clones | SEQ ID NO: (5' end) | SEQ ID NO: (3' end) | Distance from the short arm end (cM) |
|---|---|---|---|---|
| 301 | BaH27L15 | 5543 | 5544 | 199.3 |
| 301 | BaAK21I02 | 5545 | 5546 | 199.3 |
| 303 | Bmac0064 | — | — | 200.3 |
| 304 | BaH59F07 | 5547 | 5548 | 210.4 |
| 304 | bags9l05 | 5549 | 5550 | 210.4 |
| 306 | BaGS13H12 | 5551 | 5552 | 211.7 |
| 307 | BaAL19B06 | 5553 | 5554 | 212.9 |
| 308 | BaSD15P23 | 5555 | 5556 | 215.1 |
| 309 | bah53j21 | 5557 | 5558 | 217.2 |
| 309 | bah21f16 | 5559 | 5560 | 217.2 |
| 309 | baet39E0309 | 5561 | 5562 | 217.2 |
| 312 | bags5l04 | 5563 | 5564 | 217.7 |
| 313 | bags7g10 | 5565 | 5566 | 218.3 |
| 314 | BaGS9D22 | 5567 | 5568 | 219.5 |
| 315 | kr27H1216 | 5569 | 5570 | 221.2 |
| 315 | BaAK25O11 | 5571 | 5572 | 221.2 |
| 317 | bah18j14 | 5573 | 5574 | 221.7 |
| 317 | bags37k14 | 5575 | 5576 | 221.7 |
| 317 | baak26n19 | 5577 | 5578 | 221.7 |
| 317 | bah42k03 | 5579 | 5580 | 221.7 |
| 317 | BaH36N15 | 5581 | 5582 | 221.7 |

TABLE 7-7-continued

| Order from the short arm end | Clones | SEQ ID NO: (5' end) | SEQ ID NO: (3' end) | Distance from the short arm end (cM) |
|---|---|---|---|---|
| 317 | Bmag120 | — | — | 221.7 |
| 323 | bags12i02 | 5583 | 5584 | 225 |
| 323 | BaAK38E05 | 5585 | 5586 | 225 |
| 325 | baet25B0604 | 5587 | 5588 | 226.1 |
| 325 | BaAK46E21 | 5589 | 5590 | 226.1 |
| 327 | BaGS37J12 | 5591 | 5592 | 229.9 |
| 328 | bast60C0105 | 5593 | 5594 | 231 |
| 328 | baak30b08 | 5595 | 5596 | 231 |
| 328 | BaAL29N13 | 5597 | 5598 | 231 |
| 328 | BaAL24O04 | 5599 | 5600 | 231 |
| 332 | baak20o12 | 5601 | 5602 | 232.1 |
| 332 | basd14k23 | 5603 | 5604 | 232.1 |
| 332 | BaAK23L05 | 5605 | 5606 | 232.1 |
| 332 | BaGS31G02 | 5607 | 5608 | 232.1 |
| 332 | bags33o01 | 5609 | 5610 | 232.1 |
| 332 | basd18g14 | 5611 | 5612 | 232.1 |
| 332 | bah24d24 | 5613 | 5614 | 232.1 |
| 332 | BaGS12F09 | 5615 | 5616 | 232.1 |
| 332 | BaAK33H23 | 5617 | 5618 | 232.1 |
| 332 | bah47p03 | 5619 | 5620 | 232.1 |
| 342 | BaSD14F09 | 5621 | 5622 | 232.3 |
| 343 | bah11k13 | 5623 | 5624 | 232.5 |
| 343 | BaSD22F10 | 5625 | 5626 | 232.5 |
| 345 | bags32a01 | 5627 | 5628 | 234 |
| 346 | bags27o20 | 5629 | 5630 | 235.1 |
| 347 | baak31o10 | 5631 | 5632 | 236.2 |
| 347 | bags10f16 | 5633 | 5634 | 236.2 |
| 347 | baal37j12 | 5635 | 5636 | 236.2 |
| 350 | BaGS9H02 | 5637 | 5638 | 239.5 |

TABLE 7-8

| Order from the short arm end | Clones | SEQ ID NO: (5' end) | SEQ ID NO: (3' end) | Distance from the short arm end (cM) |
|---|---|---|---|---|
| 351 | BaAK40H10 | 5639 | 5640 | 240.3 |
| 352 | bah56m09 | 5641 | 5542 | 240.6 |
| 353 | kr66C0705 | 5643 | 5644 | 240.9 |
| 354 | BaGS33M05 | 5645 | 5646 | 242 |
| 355 | bast60B0204 | 5647 | 5648 | 243.2 |
| 356 | bah56p08 | 5649 | 5650 | 245.4 |
| 357 | baak12e19 | 5651 | 5652 | 246.9 |
| 357 | BaGS1D05 | 5653 | 5654 | 246.9 |
| 359 | BaH29M21 | 5655 | 5656 | 247.6 |
| 359 | bags21c04 | 5657 | 5658 | 247.6 |
| 361 | baak32p09 | 5659 | 5660 | 250.9 |
| 362 | BaAL24B02 | 5661 | 5662 | 254.2 |
| 362 | BaGS34F08 | 5663 | 5664 | 254.2 |
| 364 | bast36D1208 | 5665 | 5666 | 255.3 |
| 364 | kr25B1103 | 5667 | 5668 | 255.3 |
| 366 | kr08D0303 | 5669 | 5670 | 256.4 |
| 367 | baal19g05 | 5671 | 5672 | 257.5 |
| 367 | BaH22B15 | 5673 | 5674 | 257.5 |
| 367 | bags19c10 | 5675 | 5676 | 257.5 |
| 370 | bags29k01 | 5677 | 5678 | 260.7 |
| 370 | bastl54G0414 | 5679 | 5680 | 260.7 |
| 370 | BaGS23J01 | 5681 | 5682 | 260.7 |
| 370 | bags34b15 | 5683 | 5684 | 260.7 |
| 374 | baak46i07 | 5685 | 5686 | 262.9 |
| 375 | BaAL6J13 | 5687 | 5688 | 265 |
| 375 | bah31l17 | 5689 | 5690 | 265 |
| 375 | BaAK32A05 | 5691 | 5692 | 265 |
| 375 | BaGS30N22 | 5693 | 5694 | 265 |
| 379 | BaH54J20 | 5695 | 5696 | 266.4 |
| 380 | BaGS7F20 | 5697 | 5698 | 269.4 |
| 381 | bah63p18 | 5699 | 5700 | 272.8 |
| 382 | bags11p11 | 5701 | 5702 | 274.9 |
| 383 | BaH27L17 | 5703 | 5704 | 277.1 |
| 384 | basd17e11 | 5705 | 5706 | 278.2 |
| 384 | bags15i06 | 5707 | 5708 | 278.2 |
| 384 | BaAK36F09 | 5709 | 5710 | 278.2 |
| 384 | bast57A0101 | 5711 | 5712 | 278.2 |

TABLE 7-8-continued

| Order from the short arm end | Clones | SEQ ID NO: (5' end) | SEQ ID NO: (3' end) | Distance from the short arm end (cM) |
|---|---|---|---|---|
| 388 | baak26h17 | 5713 | 5714 | 280.3 |
| 388 | basd13b15 | 5715 | 5716 | 280.3 |
| 388 | bags9d11 | 5717 | 5718 | 280.3 |
| 391 | BaH20K03 | 5719 | 5720 | 281.4 |
| 391 | BaSD27N21 | 5721 | 5722 | 281.4 |
| 391 | baal13a10 | 5723 | 5724 | 281.4 |
| 394 | kr30F1212 | 5725 | 5726 | 282.5 |
| 394 | bastl45B0903 | 5727 | 5728 | 282.5 |
| 394 | Bmac156 | — | — | 282.5 |
| 394 | bah60k06 | 5729 | 5730 | 282.5 |
| 398 | BaGS32I12 | 5731 | 5732 | 283.6 |
| 398 | BaGS4H02 | 5733 | 5734 | 283.6 |
| 398 | bah44k12 | 5735 | 5736 | 283.6 |

TABLE 7-9

| Order from the short arm end | Clones | SEQ ID NO: (5' end) | SEQ ID NO: (3' end) | Distance from the short arm end (cM) |
|---|---|---|---|---|
| 398 | bags21m21 | 5739 | 5740 | 283.6 |
| 398 | BaSD14J15 | 5741 | 5742 | 283.6 |
| 404 | HVM49 | — | — | 285.7 |
| 404 | basd16e11 | 5743 | 5744 | 285.7 |
| 406 | BaAK21N09 | 5745 | 5746 | 287.9 |
| 407 | baal0e10 | 5747 | 5748 | 289 |
| 408 | baak1g17 | 5749 | 5750 | 290.1 |
| 409 | BaH14K12 | 5751 | 5752 | 291.2 |
| 409 | BaAK31G05 | 5753 | 5754 | 291.2 |
| 411 | MWG2062 | — | — | 291.5 |
| 412 | BaH50G17 | 5755 | 5756 | 292.3 |
| 413 | HVM5 | — | — | 293.4 |
| 413 | bags38n21 | 5757 | 5758 | 293.4 |
| 413 | bastl04B0303 | 5759 | 5760 | 293.4 |
| 413 | baal35f12 | 5761 | 5762 | 293.4 |
| 417 | BaH49M02 | 5763 | 5764 | 293.9 |
| 418 | baak38f04 | 5765 | 5766 | 294.5 |
| 419 | bah29b02 | 5767 | 5768 | 295 |
| 420 | basd15d20 | 5769 | 5770 | 296.1 |
| 421 | kr61C0305 | 5771 | 5772 | 297.1 |
| 421 | BaH23B08 | 5773 | 5774 | 297.1 |
| 423 | kr40H1115 | 5775 | 5776 | 298.6 |
| 424 | bah51g17 | 5777 | 5778 | 301.4 |
| 425 | BaSD22E19 | 5779 | 5780 | 315.4 |

The order on each chromosome can be specified based on the distance from the short arm end or long arm end. In the case where the order on each chromosome was specified by the distance from the short arm end, the polynucleotides mapped on 1H chromosome are first placed based on the distance from the short end, and the polynucleotides mapped on 2H and the subsequent chromosomes (3H to 7H) are placed based on the same reference (distances from the short arm end).

More specifically, in the case where the distance from the short arm end is used as a reference for positioning the polynucleotides with the base sequences of SEQ ID NO: 1 through 5780, the polynucleotides are placed according to the order from the short arm end as shown in Table 1-1 to Table 7-9. For clones that have the same order from the short arm end, the order by which these clones are placed is not particularly limited. Once the precise order of these clones were specified by a future study, these clones will be able to be placed accordingly. Note that, the reference (origin) on the chromosome is not just limited to the short arm end of 1H chromosome. Any position on a chromosome can be used as a reference point.

When using more than one polynucleotide with base sequences from the base sequence of any one of SEQ ID NO:

1 through 5780 for example, the polynucleotides can be placed in order from the 5' end. Further, in the case where a polynucleotide with the base sequence of any one of SEQ ID NO: 1 through 5780 is used together with more than one polynucleotide with base sequences from the base sequence of any one of SEQ ID NO: 1 through 5780 for example, a polynucleotide that is closest to the 5' end is placed first. The same criteria can be used to place other polynucleotides as well.

With the polynucleotides immobilized on a support in the order they are arranged on the chromosomes, the value of a gene detection instrument according to the present invention can be greatly improved in crossbreeding of Triticeae species. More specifically, by using a gene detection instrument according to the present invention for comprehensive investigation of transcripts in hybrids of Triticeae species, the expression level or the presence or absence of polymorphism can be determined for target genes. Further, the location and extent of recombination on chromosomes can be checked to see if unnecessary recombination has occurred. This makes it easy to determine target individuals of screening and thereby improves the efficiency of breeding.

[Gene Detection Instrument with the Polynucleotides Immobilized in Regions Appended with Chromosomal Order Information]

The regions in which the polynucleotides are immobilized (hereinafter, may be referred to as "spots") may be appended with information indicative of the order in which the polynucleotides are arranged on barley chromosomes. The spots may be arranged in any way as long as they are appended with the order information. With the order information added to the spots, the data obtained from the spots can be rearranged in the chromosomal order even when the spots are randomly placed on a support. In this way, a gene detection instrument according to the present invention can improve the efficiency of breeding. Note that, the order information added to the spots can follow the foregoing criteria used to place the polynucleotides.

Adding order information enables the spots to be arranged in an arbitrary order in a gene detection instrument of an array type, in which more than one polynucleotide is immobilized on a support such as a membrane or a glass slide. Further, the chromosomal order information of individual polynucleotides can also be added in a gene detection instrument that employs a collection of beads (bead array) in which the polynucleotide is immobilized on each bead serving as a support.

[Examples of a Gene Detection Instrument According to the Present Invention]

(i) For Detecting Gene Expression

A gene detection instrument according to the present invention can be fabricated according to a conventional gene expression array fabrication method. For example, a cDNA array can be fabricated by preparing a solution of polynucleotide that comprises cDNA (full length or partial), and by spotting it on a support with a spotter or the like. The polynucleotides immobilized on the support may be synthetic oligonucleotides with the base sequences of cDNA. Alternatively, a technique known as the Affymetrix DNA chip technique may be used, in which DNA is synthesized on a substrate.

Various conventional techniques that are designed for detection of gene expression can suitably be used in a gene detecting instrument according to the present invention. For example, cDNA or cRNA prepared from total RNA or mRNA of Triticeae species can be used for the present invention. More specifically, cDNA or cRNA is fluorescent-labeled and hybridized with the polynucleotides immobilized on the support. The expression level of genes can be evaluated by measuring the intensity of hybridization, using the fluorescence as an index. Further, cDNA or cRNA prepared from two kinds of samples may be labeled with fluorescent substances that emit different colors, and hybridized with polynucleotides immobilized on the same support. By measuring the color tone and fluorescent intensity, differences of gene expression can be evaluated.

In breeding of Triticeae species, target individuals can be screened for according to changes in the expression levels of genes that regulate target traits. Further, target individuals can also be screened for according to the expression levels of genes that are linked to target genes.

(ii) For Detecting Gene Polymorphism

Various conventional techniques that are designed for detection of gene polymorphism can suitably be used in a gene detection instrument according to the present invention.

For example, a gene detection instrument according to the present invention can be used to detect fragment length polymorphism such as RFLP (restriction fragment length polymorphism). More specifically, fragment length polymorphism can be detected by immobilizing more than one partial sequence of cDNA of the same clone on the same spot. Here, the hybridization intensity of the spot immobilizing three partial sequences is the strongest in fragments that hybridize with all of the three partial sequences, and is weaker in fragments that hybridize with two partial sequences or only one partial sequence. Thus, fragment length polymorphism can be detected by measuring fluorescence intensity or the like used as an index of hybridization intensity. In the case where fragments hybridize with distinctively different regions in the same spot, fragment length polymorphism can be detected by labeling the two fragments with different fluorescent dyes.

(2) Gene Polymorphism Detection Instrument according to the Present Invention

A gene polymorphism detection instrument according to the present invention is an instrument for detecting polymorphisms of genes in the genomes of Triticeae species. The organisms to which a gene detection instrument of the invention is applicable may be any Triticeae species, among which barley, wheat, and rye are preferable. A gene detection instrument according to the present invention includes a support on which polynucleotides constituting part of barley chromosomal (1H, 2H, 3H, 4H, 5H, 6H, and 7H) DNA are immobilized. The polynucleotides immobilized on the support may solely be polynucleotides that constitute part of barley chromosomal DNA, or other polynucleotides may additionally be immobilized on the support. Such additional polynucleotides are not particularly limited as long as they can detect expression or polymorphism of genes in the genomes of Triticeae species. For example, the additional polynucleotides may be those with the base sequences originating in non-barley organisms, or those with arbitrary base sequences that have been artificially synthesized.

In the case where the polynucleotides are immobilized in more than one region of the support, the polynucleotides immobilized in these regions may have non-overlapping base sequences or partially overlapping base sequences. Alternatively, polynucleotides of the same base sequence may be immobilized in these different regions of the support. In the case where the polynucleotides have overlapping base sequences, the polynucleotides may have partially overlapping base sequences, or the base sequence of one of the polynucleotides may be a partial sequence of the other polynucleotide.

Further, the polynucleotide immobilized in each region is not necessarily required to be of the same kind. More than one kind of polynucleotide may be immobilized in each region.

The support is not particularly limited as long as it can immobilize polynucleotides, and it may have any shape and may be made of any material. Examples of a support material generally include: inorganic materials such as glass and silicon wafer; natural polymers such as paper; synthetic polymers such as nitrocellulose and nylon; and gels using synthetic polymers or natural polymers. The shape of the support is not particularly limited as long as it provides enough area to support the polynucleotides. Generally, those with a two-dimensional plane, for example, such as a substrate with little or no flexibility, a flexible membrane, or a flexible substrate with intermediate flexibility can be preferably used. The thickness of the substrate or membrane is not particularly limited either, and it can be suitably set according to the material or use of the substrate or membrane. Various types of beads may be used as supports.

[Polynucleotides Immobilized on a Support of the Gene Polymorphism Detection Instrument]

In a gene polymorphism detection instrument according to the present invention, at least one polynucleotide from the following polynucleotides is immobilized on a support.

Polynucleotides with base sequences constituting part of barley chromosomal DNA, or variants thereof with the substitution, deletion, insertion, and/or addition of one or more bases.

As used herein, a polynucleotide with a base sequence constituting part of barley chromosomal DNA is not particularly limited as long as it is a polynucleotide with a base sequence constituting part of the entire base sequences of chromosomal DNA of barley 1H, 2H, 3H, 4H, 5H, 6H, and 7H chromosomes.

A variant with the substitution, deletion, insertion, and/or addition of one or more bases in the polynucleotide with a base sequence constituting part of barley chromosomal DNA may be a polynucleotide that has been mutated on purpose, or a polynucleotide that exists in nature. For example, think of a base sequence of chromosomal DNA in a specific variety of barley. Comparing this base sequence with those of other varieties, no sequence is completely identical. Rather, these sequences are variants with the substitution, deletion, insertion, and/or addition of one or more bases.

A polynucleotide immobilized on a support of a gene polymorphism detection instrument according to the present invention is preferably a polynucleotide that constitutes part of the base sequence of at least one DNA fragment that has been amplified with a primer set that comprises two primers arbitrarily selected from a plurality of primers that have been designed based on base sequences of SEQ ID NO: n (where n is an odd number) and SEQ ID NO: n+1 from the base sequences of SEQ ID NO: 1 through 5780, using the genomic DNA of Triticeae species as a template.

The base sequences of SEQ ID NO: 1 through 5780 are base sequences of the barley EST (expressed sequence tag) independently developed by the inventors. The inventors have previously confirmed that a polynucleotide with the base sequences of SEQ ID NO: 1 through 770, a polynucleotide with the base sequences of SEQ ID NO: 771 through 1754, a polynucleotide with the base sequences of SEQ ID NO: 1755 through 2642, a polynucleotide with the base sequences of SEQ ID NO: 2643 through 3324, a polynucleotide with the base sequences of SEQ ID NO: 3325 through 4320, a polynucleotide with the base sequences of SEQ ID NO: 4321 through 4962, and a polynucleotide with the base sequences of SEQ ID NO: 4963 through 5780 are mapped on 1H, 2H, 3H, 4H, 5H, 6H, and 7H chromosomes, respectively.

The primers are not particularly limited as long as they are designed based on the base sequences of SEQ ID NO: 1 through 5780. As such, primer profiles, such as the number of bases and GC content are not particularly limited. Further, as described above, since the base sequence of SEQ ID NO: n (where n is an odd number) and the base sequence of SEQ ID NO: n+1 are base sequences that are read from the both ends of cDNA of the same clone, the primer set with a combination of two primers arbitrarily selected from a plurality of primers that have been designed based on these base sequences flank a specific region of the barley chromosomal DNA. For example, in amplifying DNA with the primer set using the genomic DNA of barley as a template, the base sequences of the amplified fragments will be the same as the base sequences of the cDNA when the primer set is within the same exon. On the other hand, when the primers of the primer set are in different exons, the amplified fragments will include base sequences of the intron portions.

The primers that are designed based on the base sequences of SEQ ID NO: 1 through 5780 may be primers with the base sequences of SEQ ID NO: 5781 through 17340, or primers with the complementary sequences thereof, for example. More specifically, the primers that are designed based on SEQ ID NO: 1 are primers with the base sequences of SEQ ID NO: 5781 and 5782 or the complementary sequences thereof, and the primers that are designed based on SEQ ID NO: 2 are primers with the base sequences of SEQ ID NO: 5783 and 5784 or the complementary sequences thereof. In other words, the SEQ ID NOs for the base sequences of the primers designed based on the individual base sequences of SEQ ID NO: 1 through 5780 are represented by $(2 \times m - 1) + 5780$ and $(2 \times m) + 5780$, where m is the SEQ ID NO of the base sequence used to designed the primer.

As a specific example, amplified DNA fragments can be obtained by PCR that uses the genomic—DNA of barley as a template and is performed with a primer set including a combination of two primers arbitrarily selected from (i) primers that have been designed based on the base sequence of SEQ ID NO: 1 and having the base sequences of SEQ ID NO: 5781 through 5782 or complementary sequences thereof, and (ii) primers that have been designed based on the base sequence of SEQ ID NO: 2 and having the base sequences of SEQ ID NO: 5783 through 5784 or complementary sequences thereof. A means by which amplification is performed is not particularly limited, and PCR and other conventional methods can be used.

The polynucleotides immobilized on a support of a gene polymorphism detection instrument according to the present invention are part of the amplified DNA fragments. When amplification is performed using genomic DNA of different Triticeae species as a template and when polymorphism exists in the amplified fragments, it is preferable that the polynucleotides immobilized on the support include polymorphism-containing portions of the base sequences. The polymorphism may be amplified fragment length polymorphism or single nucleotide polymorphism (SNP), for example.

The inventors of the present invention amplified DNA fragments by using genomic DNA of Triticeae species as a template and with the use of a primer set that included a combination of two primers arbitrarily selected from (i) primers that had been designed based on the base sequence of SEQ ID NO: n (where n is an odd number), and (ii) primers that had been designed based on the base sequence of SEQ ID NO: n+1, from among the base sequences of SEQ ID NO: 1 through 5780. The inventors have found that these DNA fragments could be used as genetic markers for distinguishing different varieties of Triticeae species. That is, the inventors have specified at least 2890 genetic markers.

Specifically, the inventors have found fragment length polymorphism in the DNA fragments that were amplified by PCR that was performed with a primer set that had been designed based on SEQ ID NO: 2 and included a combination of primers with the base sequences of SEQ ID NO: 5783 and 5784, using the genomic DNA of malting barley "Haruna Nijo" (Hordeum vulgare ssp. vulgare variety Harunanijo) and the genomic DNA of wild type barley "H602" (Hordeum vulgare ssp. spontaneum H602) as templates. Further, the inventors have found SNP in the DNA fragments that were amplified by PCR that was performed with a primer set that had been designed based on SEQ ID NO: 4 and included a combination of primers with the base sequences of SEQ ID NO: 5787 and 5788, using the genomic DNA of the foregoing barley varieties as templates. It was found as a result that these DNA fragments with SNPs were CAPS (cleaved amplified polymorphic sequence) markers, which are excised by restriction enzyme in one of the varieties but not in the other varieties.

Table 8-1 through Table 14-9 show kinds of polymorphisms that were found by the inventors between Haruna Nijo and H602. Tables 8-1 through 8-8 show polymorphisms in 1H chromosome, Tables 9-1 through 9-10 in 2H chromosome, Tables 10-1 through 10-9 in 3H chromosome, Tables 11-1 through 11-7 in 4H chromosome, Tables 12-1 through 12-10 in 5H chromosome, Tables 13-1 through 13-7 in 6H chromosome, and Tables 14-1 through 14-9 in 7H chromosome. Corresponding EST sequences of the respective clones are shown in Table 1-1 through Table 7-9. The "Primers Used" are primers that were actually used from among the primers that had been designed based on the EST sequences (SEQ ID NO: n (where n is an odd number) and SEQ ID NO: n+1) corresponding to the respective clones. The primers used for each clone had the base sequences with the SEQ ID NOs shown in the tables. The DNA fragments amplified with these primer sets using the genomic DNA of Haruna Nijo and the genomic DNA of H602 as templates had polymorphisms shown in Table 8-1 through Table 14-9.

The clones are known genetic markers, which have been identified as SSR (simple sequence repeat) marker, STS (sequence tagged site) marker, dCAPS (derived cleaved amplified polymorphic sequence) marker, trait marker, CAPS marker, or size_poly (fragment length polymorphism) marker. SSR is a fragment length polymorphism based on differences in the number of repeats of recurring units of two or three bases of DNA. STS is a sequence site that has been set only for a specific location of DNA. Starting from such a specific sequence site, specific DNA fragments are amplified by PCR or the like, and electrophoresis is run for the amplified products so that polymorphism can be detected based on the presence or absence of bands, or differences in molecular weight. In dCAPS, a mismatch is induced between PCR primers and template DNA, so that polymorphism (the presence or absence of restriction enzyme site) occurs in the PCR products. Trait marker sh is an isolated gene that controls vernalization requirement. Since Haruna Nijo and H602 have polymorphism in the sequence of this gene, it can be used as a marker. CAPS and size_poly will be described later.

TABLE 8-1

| Name | Primers used (SEQ ID NO:) | | marker type |
|---|---|---|---|
| bah55e06 | 5783 | 5784 | size_poly (codominant) |
| bags30b07 | 5787 | 5788 | SNP |
| baak2l03 | 5791 | 5792 | CAPS |
| BaAK17D13 | 5795 | 5796 | SNP |
| basd26l20 | 5799 | 5800 | SNP |
| bah61p17 | 5803 | 5804 | SNP |
| BaGS11O06 | 5807 | 5808 | size_poly (codominant) |
| kr12H0216 | 5811 | 5812 | SNP |
| BaGS32E23 | 5815 | 5816 | CAPS |
| basd13k20 | 5819 | 5820 | CAPS |
| BaAK24O11 | 5823 | 5824 | CAPS |
| kr26D0507 | 5827 | 5828 | SNP |
| BaSD2D08 | 5831 | 5832 | CAPS |
| baak41n21 | 5835 | 5836 | SNP |
| bah11b15 | 5839 | 5840 | CAPS |
| kr24B0903 | 5843 | 5844 | SNP |
| bast50E0709 | 5847 | 5848 | size_poly (codominant) |
| baal17o01 | 5851 | 5852 | SNP |
| baak41a04 | 5855 | 5856 | SNP |
| BaH28C07 | 5859 | 5860 | size_poly (codominant) |
| bags16g18 | 5863 | 5864 | SNP |
| BaSD3C22 | 5867 | 5868 | SNP |
| BaGS17B21 | 5871 | 5872 | CAPS |
| basd27b10 | 5875 | 5876 | SNP |
| bah47d23 | 5879 | 5880 | SNP |
| BaAK21D02 | 5883 | 5884 | CAPS |
| BaH17D02 | 5887 | 5888 | CAPS |
| baal4f12 | 5891 | 5892 | CAPS |
| baGS11I03 | 5895 | 5896 | CAPS |
| bah56a03 | 5899 | 5900 | size_poly (codominant) |
| kr16A0501 | 5903 | 5904 | size_poly (codominant) |
| bah19f01 | 5907 | 5908 | CAPS |
| BaAK27F07 | 5911 | 5912 | CAPS |
| bah47f18 | 5915 | 5916 | size_poly (codominant) |
| bah45l19 | 5919 | 5920 | size_poly (codominant) |
| BaAK12I12 | 5923 | 5924 | SNP |
| BaAL6N04 | 5927 | 5928 | SNP |
| baal16l05 | 5931 | 5932 | CAPS |
| BaSD18O20 | 5935 | 5936 | size_poly (codominant) |
| BaSD3J13 | 5939 | 5940 | SNP |
| bah63j19 | 5943 | 5944 | size_poly (codominant) |
| BaH36O18 | 5947 | 5948 | CAPS |
| BaAK20A06 | 5951 | 5952 | CAPS |
| BaGS8G13 | 5955 | 5956 | CAPS |
| bah25n06 | 5959 | 5960 | CAPS |
| BaAK1P06 | 5963 | 5964 | size_poly (dominant) |
| BaAK16M07 | 5967 | 5968 | SNP |
| BaH36M15 | 5971 | 5972 | SNP |
| BaGS12K12 | 5975 | 5976 | size_poly (dominant) |
| BaAL39C22 | 5979 | 5980 | SNP |
| kr68B0303 | 5983 | 5984 | SNP |

TABLE 8-2

| Name | Primers used (SEQ ID NO:) | | marker type |
|---|---|---|---|
| baak24d09 | 5987 | 5988 | SNP |
| BaGS11J13 | 5991 | 5992 | CAPS |
| baal38l23 | 5995 | 5996 | CAPS |
| BaAL36B15 | 5999 | 6000 | CAPS |
| bast60D0610 | 6003 | 6004 | CAPS |
| kr22D0808 | 6007 | 6008 | CAPS |
| baal19i12 | 6011 | 6012 | SNP |
| basd23o02 | 6015 | 6016 | CAPS |
| baak1j14 | 6019 | 6020 | CAPS |
| baak24k18 | 6023 | 6024 | CAPS |
| kr18G0814 | 6027 | 6028 | SNP |
| BaH38H09 | 6031 | 6032 | CAPS |
| BaGS8B13 | 6035 | 6036 | SNP |
| BaH25J08 | 6039 | 6040 | SNP |
| baak3d11 | 6043 | 6044 | SNP |
| baal12p08 | 6047 | 6048 | SNP |
| bags39i20 | 6051 | 6052 | SNP |
| bags32m16 | 6055 | 6056 | size_poly (codominant) |
| kr15A0402 | 6059 | 6060 | SNP |

TABLE 8-2-continued

| Name | Primers used (SEQ ID NO:) | | marker type |
|---|---|---|---|
| baal3c01 | 6063 | 6064 | SNP |
| baak41i03 | 6067 | 6068 | SNP |
| BaGS29M13 | 6071 | 6072 | SNP |
| basd17m22 | 6075 | 6076 | CAPS |
| bags15g01 | 6079 | 6080 | CAPS |
| BaH24I06 | 6083 | 6084 | SNP |
| BaH57E12 | 6087 | 6088 | CAPS |
| BaSD25C22 | 6091 | 6092 | SNP |
| baal19m17 | 6095 | 6096 | CAPS |
| bah46p14 | 6099 | 6100 | SNP |
| bags18d19 | 6103 | 6104 | SNP |
| BaAK34J19 | 6107 | 6108 | SNP |
| bags6d01 | 6111 | 6112 | CAPS |
| bags3P11 | 6115 | 6116 | CAPS |
| BaAK14J21 | 6119 | 6120 | CAPS |
| baak2m05 | 6123 | 6124 | SNP |
| baak37g19 | 6127 | 6128 | CAPS |
| BaGS31B11 | 6131 | 6132 | SNP |
| BaAL35M08 | 6135 | 6136 | SNP |
| BaSD16G03 | 6139 | 6140 | CAPS |
| BaH58J20 | 6143 | 6144 | SNP |
| BaGS22B13 | 6147 | 6148 | SNP |
| BaAK43M01 | 6151 | 6152 | SNP |
| bah14i07 | 6155 | 6156 | SNP |
| BaH13F14 | 6159 | 6160 | CAPS |
| baal9i16 | 6163 | 6164 | CAPS |
| basd27b20 | 6167 | 6168 | CAPS |
| BaAK2O24 | 6171 | 6172 | SNP |
| basd18l16 | 6175 | 6176 | CAPS |
| BaAL19J14 | 6179 | 6180 | CAPS |
| bags22j15 | 6183 | 6164 | SNP |
| baak44a23 | 6187 | 6188 | SNP |

TABLE 8-3

| Name | Primers used (SEQ ID NO:) | | marker type |
|---|---|---|---|
| BaAK32N04 | 6191 | 6192 | SNP |
| basd21e22 | 6195 | 6196 | SNP |
| BaGS7K03 | 6199 | 6200 | size_poly (codominant) |
| baak42e22 | 6203 | 6204 | SNP |
| bast21D0808 | 6207 | 6208 | size_poly (codominant) |
| bast75E0610 | 6211 | 6212 | SNP |
| baet16A1002 | 6215 | 6216 | SNP |
| basd17m16 | 6219 | 6220 | CAPS |
| bags17g08 | 6223 | 6224 | size_poly (codominant) |
| baak21i01 | 6227 | 6228 | SNP |
| baak13n06 | 6231 | 6232 | CAPS |
| baak22o23 | 6235 | 6236 | SNP |
| baet42E0410 | 6239 | 6240 | size_poly (codominant) |
| BaGS27M04 | 6243 | 6244 | CAPS |
| BaH52H18 | 6247 | 6248 | SNP |
| baak33k20 | 6251 | 6252 | SNP |
| bags21f6 | 6255 | 6256 | SNP |
| bags34e05 | 6259 | 6260 | SNP |
| bags15d20 | 6263 | 6264 | CAPS |
| bags18g10 | 6267 | 6268 | size_poly (codominant) |
| bags19a02 | 6271 | 6272 | SNP |
| BaAK17J19 | 6275 | 6276 | size_poly (codominant) |
| bags35k02 | 6279 | 6280 | SNP |
| bah35a22 | 6283 | 6284 | SNP |
| BaGS17H13 | 6287 | 6288 | SNP |
| bah47n12 | 6291 | 6292 | SNP |
| baak12p11 | 6295 | 6296 | SNP |
| baet38B1004 | 6299 | 6300 | SNP |
| BaGS13K12 | 6303 | 6304 | SNP |
| BaAL25A05 | 6307 | 6308 | SNP |
| bah27k23 | 6311 | 6312 | size_poly (codominant) |
| BaAK24J12 | 6315 | 6316 | SNP |
| BaSD14M22 | 6319 | 6320 | SNP |
| bah17l24 | 6323 | 6324 | SNP |
| baal29j09 | 6327 | 6328 | SNP |
| bah16d09 | 6331 | 6332 | SNP |
| bah60d03 | 6335 | 6336 | SNP |
| bah45i13 | 6339 | 6340 | SNP |

TABLE 8-3-continued

| Name | Primers used (SEQ ID NO:) | | marker type |
|---|---|---|---|
| bah11h03 | 6343 | 6344 | SNP |
| bah47h17 | 6347 | 6348 | SNP |
| bags35d02 | 6351 | 6352 | SNP |
| bags37e17 | 6355 | 6356 | CAPS |
| baak14c12 | 6359 | 6360 | SNP |
| baak34c01 | 6363 | 6364 | SNP |
| BaH35A11 | 6367 | 6368 | SNP |
| BaAK30M16 | 6371 | 6372 | SNP |
| BaSD11P04 | 6375 | 6376 | CAPS |
| bah12j09 | 6379 | 6380 | CAPS |
| BaAL2G20 | 6383 | 6384 | SNP |
| bags14j09 | 6387 | 6388 | CAPS |
| kr26E0610 | 6391 | 6392 | CAPS |

TABLE 8-4

| Name | Primers used (SEQ ID NO:) | | marker type |
|---|---|---|---|
| bah37f01 | 6395 | 6396 | CAPS |
| bags29m05 | 6399 | 6400 | SNP |
| BaGS17A18 | 6403 | 6404 | CAPS |
| baet34A0501 | 6407 | 6408 | SNP |
| BaSD22O13 | 6411 | 6412 | CAPS |
| bags15a22 | 6415 | 6416 | CAPS |
| baet21H1016 | 6419 | 6420 | CAPS |
| BaH30E13 | 6423 | 6424 | SNP |
| bags4e23 | 6427 | 6428 | SNP |
| baak45b03 | 6431 | 6432 | SNP |
| bah12o12 | 6435 | 6436 | SNP |
| baak34k14 | 6439 | 6440 | CAPS |
| baal3e14 | 6443 | 6444 | SNP |
| bags22fl2 | 6447 | 6448 | CAPS |
| BaH45P03 | 6451 | 6452 | CAPS |
| basd11d13 | 6455 | 6456 | CAPS |
| Bmag211 | — | — | SSR |
| HVM20 | — | — | SSR |
| basd1j14 | 6459 | 6460 | SNP |
| bags35b18 | 6463 | 6464 | SNP |
| baal41i11 | 6467 | 6468 | SNP |
| bags13e23 | 6471 | 6472 | SNP |
| bah20d03 | 6475 | 6476 | SNP |
| baet19F0212 | 6479 | 6480 | SNP |
| bags12j05 | 6483 | 6484 | SNP |
| BaSD24D17 | 6487 | 6488 | SNP |
| BaGS24K10 | 6491 | 6492 | SNP |
| baal9e05 | 6495 | 6496 | SNP |
| BaGS33M23 | 6499 | 6500 | SNP |
| bah46g14 | 6503 | 6504 | SNP |
| bags33h05 | 6507 | 6508 | SNP |
| baak24h12 | 6511 | 6512 | SNP |
| BaH50N19 | 6515 | 6516 | SNP |
| BaAK31O05 | 6519 | 6520 | SNP |
| BaGS39L14 | 6523 | 6524 | SNP |
| BaGS27C22 | 6527 | 6528 | SNP |
| bags20o24 | 6531 | 6532 | SNP |
| bags34j05 | 6535 | 6536 | CAPS |
| bah56l03 | 6539 | 6540 | CAPS |
| basd12k03 | 6543 | 6544 | CAPS |
| BaAK39I18 | 6547 | 6548 | CAPS |
| bags21h06 | 6551 | 6552 | CAPS |
| bah56k04 | 6555 | 6556 | CAPS |
| bah60e11 | 6559 | 6560 | CAPS |
| baak22i05 | 6563 | 6564 | CAPS |
| baal5i02 | 6567 | 6568 | CAPS |
| BaAK2E05 | 6571 | 6572 | CAPS |
| baak33g12 | 6575 | 6576 | CAPS |
| bags4e05 | 6579 | 6580 | CAPS |
| bast42C0806 | 6583 | 6584 | SNP |
| baak26c05 | 6587 | 6588 | SNP |

TABLE 8-5

| Name | Primers used (SEQ ID NO:) | | marker type |
|---|---|---|---|
| bags19a16 | 6591 | 6592 | SNP |
| kr11F1212 | 6595 | 6596 | SNP |
| BaH28K13 | 6599 | 6600 | CAPS |
| baak20d06 | 6603 | 6604 | size_poly (codominant) |
| BaSD1I24 | 6607 | 6608 | CAPS |
| baak35l20 | 6611 | 6612 | SNP |
| bah57m07 | 6615 | 6616 | SNP |
| bah60k11 | 6619 | 6620 | SNP |
| basd20o09 | 6623 | 6624 | SNP |
| basd24i22 | 6627 | 6628 | SNP |
| bags30g20 | 6631 | 6632 | SNP |
| bags1m11 | 6635 | 6636 | SNP |
| bags23g20 | 6639 | 6640 | SNP |
| BaGS15B05 | 6643 | 6644 | SNP |
| BaGS24P05 | 6647 | 6648 | SNP |
| bags10g06 | 6651 | 6652 | SNP |
| bah32o04 | 6655 | 6656 | SNP |
| BaGS32P08 | 6659 | 6660 | SNP |
| bags4e02 | 6663 | 6664 | CAPS |
| bast04H0315 | 6667 | 6668 | CAPS |
| BaGS37L06 | 6671 | 6672 | CAPS |
| basd2b18 | 6675 | 6676 | CAPS |
| bags3h12 | 6679 | 6680 | SNP |
| bags1e21 | 6683 | 6684 | SNP |
| BaAK27M21 | 6687 | 6688 | SNP |
| BaSD18F05 | 6691 | 6692 | size_poly (codominant) |
| BaH35B05 | 6695 | 6696 | SNP |
| basd21h11 | 6699 | 6700 | SNP |
| BaH32E20 | 6703 | 6704 | SNP |
| BaGS22A20 | 6707 | 6708 | SNP |
| BaSD14B13 | 6711 | 6712 | CAPS |
| bags29l04 | 6715 | 6716 | SNP |
| bags22g16 | 6719 | 6720 | SNP |
| BaAL4B14 | 6723 | 6724 | size_poly (codominant) |
| bah61h20 | 6727 | 6728 | SNP |
| bah15p01 | 6731 | 6732 | SNP |
| baak41p03 | 6735 | 6736 | SNP |
| BaSD12L06 | 6739 | 6740 | SNP |
| BaSD23P07 | 6743 | 6744 | SNP |
| BaGS7J05 | 6747 | 6748 | SNP |
| bah29b06 | 6751 | 6752 | SNP |
| BaGS31N17 | 6755 | 6756 | SNP |
| BaGS13F08 | 6759 | 6760 | SNP |
| BaAK39G10 | 6763 | 6764 | CAPS |
| BaAK39G03 | 6767 | 6768 | CAPS |
| baak2a18 | 6771 | 6772 | CAPS |
| bags39d12 | 6775 | 6776 | SNP |
| basd17l04 | 6779 | 6780 | CAPS |
| BaAK20B19 | 6783 | 6784 | SNP |
| bags15j15 | 6787 | 6788 | SNP |
| BaAK30F02 | 6791 | 6792 | CAPS |

TABLE 8-6

| Name | Primers used (SEQ ID NO:) | | marker type |
|---|---|---|---|
| BaGS22A21 | 6795 | 6796 | SNP |
| baet45E0410 | 6799 | 6800 | SNP |
| BaGS22C14 | 6803 | 6804 | SNP |
| bah23k12 | 6807 | 6808 | SNP |
| BaH15O13 | 6811 | 6812 | SNP |
| kr24F0412 | 6815 | 6816 | SNP |
| BaGS28O21 | 6819 | 6820 | SNP |
| BaAL15N19 | 6823 | 6824 | SNP |
| bags10j15 | 6827 | 6828 | CAPS |
| bags32j03 | 6831 | 6832 | SNP |
| bags20e14 | 6835 | 6836 | SNP |
| bags3c15 | 6839 | 6840 | CAPS |
| basd27n01 | 6843 | 6844 | SNP |
| BaGS6M19 | 6847 | 6848 | SNP |
| baak13e03 | 6851 | 6852 | SNP |
| BaH15M10 | 6855 | 6856 | CAPS |
| bags14k12 | 6859 | 6860 | size_poly (codominant) |
| bast61E0509 | 6863 | 6864 | CAPS |
| BaGS31N04 | 6867 | 6868 | CAPS |

TABLE 8-6-continued

| Name | Primers used (SEQ ID NO:) | | marker type |
|---|---|---|---|
| BaAK27D22 | 6871 | 6872 | CAPS |
| baal5o19 | 6875 | 6876 | CAPS |
| bah55b18 | 6879 | 6880 | CAPS |
| bah23i02 | 6883 | 6884 | SNP |
| BaAK15H22 | 6887 | 6888 | SNP |
| bags32b03 | 6891 | 6892 | SNP |
| baak30c15 | 6895 | 6896 | SNP |
| BaGS22A05 | 6899 | 6900 | SNP |
| bah16m01 | 6903 | 6904 | SNP |
| bags15e08 | 6907 | 6908 | CAPS |
| BaGS37D12 | 6911 | 6912 | SNP |
| BaAL37N24 | 6915 | 6916 | SNP |
| BaH28B09 | 6919 | 6920 | SNP |
| bah47h08 | 6923 | 6924 | SNP |
| BaH57N07 | 6927 | 6928 | SNP |
| baak38o02 | 6931 | 6932 | SNP |
| baak20f16 | 6935 | 6936 | SNP |
| baak28n19 | 6939 | 6940 | SNP |
| bah59j07 | 6943 | 6944 | SNP |
| bah44j20 | 6947 | 6948 | SNP |
| BaH47J05 | 6951 | 6952 | CAPS |
| baet39B0303 | 6955 | 6956 | SNP |
| BaAK27D19 | 6959 | 6960 | SNP |
| basd25g01 | 6963 | 6964 | SNP |
| BaAL34K17 | 6967 | 6968 | SNP |
| basd21i17 | 6971 | 6972 | SNP |
| bags15o12 | 6975 | 6976 | SNP |
| baal2j10 | 6979 | 6980 | CAPS |
| baak44n10 | 6983 | 6984 | SNP |
| baak21e08 | 6987 | 6988 | SNP |
| BaGS37F14 | 6991 | 6992 | CAPS |
| BaAK41I21 | 6995 | 6996 | SNP |

TABLE 8-7

| Name | Primers used (SEQ ID NO:) | | marker type |
|---|---|---|---|
| BaGS19C07 | 6999 | 7000 | SNP |
| BaGS15O08 | 7003 | 7004 | SNP |
| baak40p22 | 7007 | 7008 | SNP |
| BaH21K05 | 7011 | 7012 | CAPS |
| baal40n03 | 7015 | 7016 | SNP |
| bags23b08 | 7019 | 7020 | SNP |
| BaGS39L18 | 7023 | 7024 | SNP |
| BaGS25K24 | 7027 | 7028 | CAPS |
| bags1a18 | 7031 | 7032 | CAPS |
| baal15k07 | 7035 | 7036 | size_poly (codominant) |
| bags14o13 | 7039 | 7040 | size_poly (dominant) |
| BaH18D15 | 7043 | 7044 | SNP |
| bastl04F0911 | 7047 | 7048 | SNP |
| BaGS31E03 | 7051 | 7052 | SNP |
| BaGS19J21 | 7055 | 7056 | SNP |
| BaGS39P08 | 7059 | 7060 | SNP |
| BaH56B06 | 7063 | 7064 | SNP |
| baal13m24 | 7067 | 7068 | SNP |
| bags15h14 | 7071 | 7072 | SNP |
| bags35j22 | 7075 | 7076 | CAPS |
| baak20h22 | 7079 | 7080 | CAPS |
| baal34b14 | 7083 | 7084 | SNP |
| bah16j04 | 7087 | 7088 | CAPS |
| BaH54J03 | 7091 | 7092 | CAPS |
| bast58C1206 | 7095 | 7096 | SNP |
| BaH26M05 | 7099 | 7100 | CAPS |
| bastl20B0404 | 7103 | 7104 | SNP |
| baak14e23 | 7107 | 7108 | CAPS |
| BaH15P22 | 7111 | 7112 | SNP |
| BaGS17I22 | 7115 | 7116 | SNP |
| bags15h01 | 7119 | 7120 | SNP |
| bags7p13 | 7123 | 7124 | SNP |
| BaGS29H13 | 7127 | 7128 | SNP |
| bah47b01 | 7131 | 7132 | SNP |
| bastl45E1109 | 7135 | 7136 | CAPS |
| bags32m15 | 7139 | 7140 | SNP |
| basd12c09 | 7143 | 7144 | size_poly (codominant) |
| baal27m11 | 7147 | 7148 | SNP |

TABLE 8-7-continued

| Name | Primers used (SEQ ID NO:) | | marker type |
|---|---|---|---|
| basd12k01 | 7151 | 7152 | CAPS |
| baak41n15 | 7155 | 7156 | size_poly (codominant) |
| bags1b01 | 7159 | 7160 | SNP |
| BaH56O11 | 7163 | 7164 | size_poly (codominant) |
| bah15k16 | 7167 | 7168 | CAPS |
| bags31a22 | 7171 | 7172 | CAPS |
| bags21e21 | 7175 | 7176 | SNP |
| baak32n05 | 7179 | 7180 | size_poly (codominant) |
| baet02B0503 | 7183 | 7184 | SNP |
| BaH29L05 | 7187 | 7188 | SNP |
| baet43H1016 | 7191 | 7192 | SNP |
| BaGS38N20 | 7195 | 7196 | CAPS |
| BaGS23O09 | 7199 | 7200 | CAPS |

TABLE 8-8

| Name | Primers used (SEQ ID NO:) | | marker type |
|---|---|---|---|
| bastl26E0410 | 7203 | 7204 | CAPS |
| BaH15N14 | 7207 | 7208 | CAPS |
| baak20b06 | 7211 | 7212 | SNP |
| BaH16I04 | 7215 | 7216 | SNP |
| bah22p07 | 7219 | 7220 | SNP |
| baak21j02 | 7223 | 7224 | SNP |
| bah30o13 | 7227 | 7228 | CAPS |
| bags38fl8 | 7231 | 7232 | CAPS |
| bah13o05 | 7235 | 7236 | CAPS |
| baak36b12 | 7239 | 7240 | CAPS |
| bags18o09 | 7243 | 7244 | CAPS |
| BaAK16L10 | 7247 | 7248 | CAPS |
| BaAK38E16 | 7251 | 7252 | size_poly (dominant) |
| bah13e15 | 7255 | 7256 | CAPS |
| bags1f22 | 7259 | 7260 | CAPS |
| bags21o12 | 7263 | 7264 | SNP |
| BaGS9B14 | 7267 | 7268 | SNP |
| BaAL1N23 | 7271 | 7272 | CAPS |
| baaK1a17 | 7275 | 7276 | SNP |
| BaH32B01 | 7279 | 7280 | CAPS |
| BaSD18L13 | 7283 | 7284 | CAPS |
| baak12p07 | 7287 | 7288 | size_poly (codominant) |
| BaH58A04 | 7291 | 7292 | CAPS |
| bags1p04 | 7295 | 7296 | SNP |
| BaAL17O03 | 7299 | 7300 | SNP |
| baal8e17 | 7303 | 7304 | SNP |
| BaH50I05 | 7307 | 7308 | CAPS |
| bastl28A0101 | 7311 | 7312 | CAPS |
| BaH39L18 | 7315 | 7316 | SNP |
| bags18e18 | 7319 | 7320 | SNP |
| WMCIE8 | — | — | SSR |

TABLE 9-1

| Name | Primers used (SEQ ID NO:) | | marker type |
|---|---|---|---|
| BaGS20L10 | 7323 | 7324 | SNP |
| BaSD15P22 | 7327 | 7328 | SNP |
| bags7b16 | 7331 | 7332 | SNP |
| BaAK34H02 | 7335 | 7336 | CAPS |
| BaAK22H13 | 7339 | 7340 | SNP |
| BaGS37P19 | 7343 | 7344 | CAPS |
| BaAL19P17 | 7347 | 7348 | CAPS |
| BaH41L14 | 7351 | 7352 | SNP |
| BaAK24H17 | 7355 | 7356 | SNP |
| bast21A0602 | 7359 | 7360 | SNP |
| BaAL27L20 | 7363 | 7364 | SNP |
| Bmac134 | — | — | SSR |
| cMWG682 | — | — | STS |
| bags34p10 | 7367 | 7368 | SNP |
| basd18b14 | 7371 | 7372 | size_poly (codominant) |
| bags38p20 | 7375 | 7376 | CAPS |
| BaAK41N22 | 7379 | 7380 | CAPS |
| BaAK21D17 | 7383 | 7384 | CAPS |
| BaAL29B07 | 7387 | 7388 | SNP |

TABLE 9-1-continued

| Name | Primers used (SEQ ID NO:) | | marker type |
|---|---|---|---|
| baak20o16 | 7391 | 7392 | SNP |
| bast42A0602 | 7395 | 7396 | CAPS |
| BaH36B07 | 7399 | 7400 | SNP |
| BaAK26L07 | 7403 | 7404 | CAPS |
| baal12a06 | 7407 | 7408 | CAPS |
| BaSD3C20 | 7411 | 7412 | SNP |
| bastl17G0113 | 7415 | 7416 | SNP |
| baak11h14 | 7419 | 7420 | SNP |
| baal12m14 | 7423 | 7424 | CAPS |
| baal33a18 | 7427 | 7428 | SNP |
| bah28a18 | 7431 | 7432 | SNP |
| bags39o04 | 7435 | 7436 | SNP |
| BaH48H04 | 7439 | 7440 | SNP |
| BaGS6B11 | 7443 | 7444 | size_poly (dominant) |
| bags4p16 | 7447 | 7448 | SNP |
| basd24j22 | 7451 | 7452 | SNP |
| basd16p15 | 7455 | 7456 | SNP |
| bags15k16 | 7459 | 7460 | SNP |
| bast23D1208 | 7463 | 7464 | SNP |
| BaAL32B22 | 7467 | 7468 | SNP |
| BaGS39D07 | 7471 | 7472 | size_poly (codominant) |
| BaH19L09 | 7475 | 7476 | SNP |
| bags38a17 | 7479 | 7480 | SNP |
| BaAK39I11 | 7483 | 7484 | SNP |
| BaSD3I24 | 7487 | 7488 | SNP |
| BaH35F01 | 7491 | 7492 | CAPS |
| BaAL30K02 | 7495 | 7496 | CAPS |
| bah13l23 | 7499 | 7500 | SNP |
| BaAL26H21 | 7503 | 7504 | SNP |
| BaGS22H22 | 7507 | 7508 | CAPS |
| bags13n11 | 7511 | 7512 | CAPS |
| bags1h03 | 7515 | 7516 | CAPS |

TABLE 9-2

| Name | Primers used (SEQ ID NO:) | | marker type |
|---|---|---|---|
| baak32l16 | 7519 | 7520 | SNP |
| baal19a12 | 7523 | 7524 | CAPS |
| BaAK45G16 | 7527 | 7528 | CAPS |
| BaGS37N19 | 7531 | 7532 | CAPS |
| baak3f03 | 7535 | 7536 | CAPS |
| bags5c02 | 7539 | 7540 | SNP |
| BaGS35P07 | 7543 | 7544 | SNP |
| HVM36 | — | — | SSR |
| bah45e07 | 7547 | 7548 | size_poly (codominant) |
| BaAK24B09 | 7551 | 7552 | SNP |
| bags33a11 | 7555 | 7556 | SNP |
| bah62i11 | 7559 | 7560 | CAPS |
| BaH56A24 | 7563 | 7564 | SNP |
| BaSD21D14 | 7567 | 7568 | SNP |
| basd1a17 | 7571 | 7572 | SNP |
| bah17n24 | 7575 | 7576 | CAPS |
| kr70G0113 | 7579 | 7580 | SNP |
| basd15f08 | 7583 | 7584 | SNP |
| BaGS4J04 | 7587 | 7588 | CAPS |
| baak33f06 | 7591 | 7592 | CAPS |
| basd14f16 | 7595 | 7596 | CAPS |
| BaH59K20 | 7599 | 7600 | CAPS |
| baal35h05 | 7603 | 7604 | SNP |
| BaGS20M01 | 7607 | 7608 | CAPS |
| BaH25N22 | 7611 | 7612 | size_poly (codominant) |
| baak14a24 | 7615 | 7616 | SNP |
| baak30d07 | 7619 | 7620 | SNP |
| bah11n18 | 7623 | 7624 | CAPS |
| kr14C0305 | 7627 | 7628 | SNP |
| baet18F0911 | 7631 | 7632 | CAPS |
| BaGS4J18 | 7635 | 7636 | CAPS |
| bast74C0705 | 7639 | 7640 | SNP |
| BaAL4G17 | 7643 | 7644 | SNP |
| bastl43H0515 | 7647 | 7648 | SNP |
| BaH58M22 | 7651 | 7652 | SNP |
| bags10i21 | 7655 | 7656 | SNP |
| bah20h16 | 7659 | 7660 | SNP |
| BaH17P13 | 7663 | 7664 | SNP |

TABLE 9-2-continued

| Name | Primers used (SEQ ID NO:) | | marker type |
|---|---|---|---|
| baak41d10 | 7667 | 7668 | CAPS |
| BaGS14F01 | 7671 | 7672 | CAPS |
| BaAK16E24 | 7675 | 7676 | SNP |
| BaSD18F09 | 7679 | 7680 | SNP |
| baet42A0501 | 7683 | 7684 | SNP |
| BaAK20L07 | 7687 | 7688 | SNP |
| baak16e20 | 7691 | 7692 | SNP |
| BaGS13N14 | 7695 | 7696 | size_poly (codominant) |
| basd13m14 | 7699 | 7700 | SNP |
| bags20g23 | 7703 | 7704 | SNP |
| basd1l17 | 1707 | 7708 | SNP |
| basd26l01 | 7711 | 7712 | SNP |
| BaAL37J18 | 7715 | 7716 | SNP |

TABLE 9-3

| Name | Primers used (SEQ ID NO:) | | marker type |
|---|---|---|---|
| bags7i05 | 7719 | 7720 | SNP |
| bah60m17 | 7723 | 7724 | SNP |
| bags21l01 | 7727 | 7728 | SNP |
| baet31E0109 | 7731 | 7732 | SNP |
| bags34m12 | 7735 | 7736 | SNP |
| bah50n02 | 7739 | 7740 | SNP |
| BaH50M11 | 7743 | 7744 | SNP |
| bast27E1010 | 7747 | 7748 | SNP |
| bags23c12 | 7751 | 7752 | SNP |
| bah51m11 | 7755 | 7756 | SNP |
| baak20d17 | 7759 | 7760 | SNP |
| bags23l21 | 7763 | 7764 | SNP |
| BaH52K04 | 7767 | 7768 | CAPS |
| BaAL37F24 | 7771 | 7772 | CAPS |
| bags23d01 | 7775 | 7776 | CAPS |
| BaSD11K22 | 7779 | 7780 | CAPS |
| baal29m02 | 7783 | 7784 | SNP |
| bah17e21 | 7787 | 7788 | SNP |
| bah56j18 | 7791 | 7792 | SNP |
| bags38n06 | 7795 | 7796 | CAPS |
| baet44D1208 | 7799 | 7800 | CAPS |
| BaAL34O13 | 7803 | 7804 | SNP |
| BaGS4N05 | 7807 | 7808 | SNP |
| BaSD15P20 | 7811 | 7812 | SNP |
| baal13d11 | 7815 | 7816 | CAPS |
| bah27g02 | 7819 | 7820 | SNP |
| basd27m10 | 7823 | 7824 | SNP |
| basd23f16 | 7827 | 7828 | SNP |
| bah16i19 | 7831 | 7832 | SNP |
| BaH50I20 | 7835 | 7836 | SNP |
| BaH34M23 | 7839 | 7840 | CAPS |
| bah28b24 | 7843 | 7844 | SNP |
| BaH50P13 | 7847 | 7848 | CAPS |
| basd11m16 | 7851 | 7852 | CAPS |
| bags10p15 | 7855 | 7856 | CAPS |
| bags4g01 | 7859 | 7860 | CAPS |
| bags10k08 | 7863 | 7864 | CAPS |
| bags5e16 | 7867 | 7868 | CAPS |
| bags18l02 | 7871 | 7872 | CAPS |
| baak44k02 | 7875 | 7876 | CAPS |
| bags35a20 | 7879 | 7880 | CAPS |
| BaGS26M11 | 7883 | 7884 | CAPS |
| basd14h21 | 7887 | 7888 | CAPS |
| BaSD13D12 | 7891 | 7892 | CAPS |
| bags38k23 | 7895 | 7896 | size_poly (codominant) |
| BaH42E05 | 7899 | 7900 | CAPS |
| bastl55A0701 | 7903 | 7904 | CAPS |
| bags13g18 | 7907 | 7908 | SNP |
| BaH15D23 | 7911 | 7912 | SNP |
| kr28B0604 | 7915 | 7916 | CAPS |
| bags10f01 | 7919 | 7920 | size_poly (codominant) |

TABLE 9-4

| Name | Primers used (SEQ ID NO:) | | marker type |
|---|---|---|---|
| BaGS33I07 | 7923 | 7924 | SNP |
| BaSD27B02 | 7927 | 7928 | SNP |
| BaGS30N12 | 7931 | 7932 | SNP |
| basd3h13 | 7935 | 7936 | SNP |
| BaGS37L19 | 7939 | 7940 | SNP |
| bah16g18 | 7943 | 7944 | CAPS |
| bags20i15 | 7947 | 7948 | SNP |
| bags35c23 | 7951 | 7952 | CAPS |
| bah56k07 | 7955 | 7956 | SNP |
| bags37d02 | 7959 | 7960 | SNP |
| BaAK19K05 | 7963 | 7964 | CAPS |
| bah11i16 | 7967 | 7968 | CAPS |
| bags22l23 | 7971 | 7972 | SNP |
| kr33A0901 | 7975 | 7976 | SNP |
| bastl38C0606 | 7979 | 7980 | SNP |
| baak11j13 | 7983 | 7984 | SNP |
| BaH58E19 | 7987 | 7988 | SNP |
| BaGS31G22 | 7991 | 7992 | SNP |
| bah37h01 | 7995 | 7996 | SNP |
| BaAL29P13 | 7999 | 8000 | SNP |
| bags39a22 | 8003 | 8004 | SNP |
| bah19g10 | 8007 | 8008 | SNP |
| BaAL31A14 | 8011 | 8012 | SNP |
| BaH50G15 | 8015 | 8016 | SNP |
| BaH51M12 | 8019 | 8020 | SNP |
| bags18k22 | 8023 | 8024 | SNP |
| BaGS20N21 | 8027 | 8028 | SNP |
| BaSD17O21 | 8031 | 8032 | SNP |
| BaH37G17 | 8035 | 8036 | SNP |
| bags30l22 | 8039 | 8040 | SNP |
| baak22b17 | 8043 | 8044 | CAPS |
| bags20f22 | 8047 | 8048 | CAPS |
| bast72G0113 | 8051 | 8052 | SNP |
| BaH30B05 | 8055 | 8056 | SNP |
| BaH60B14 | 8059 | 8060 | SNP |
| BaH17B16 | 8063 | 8064 | SNP |
| basd12n23 | 8067 | 8068 | SNP |
| BaH61A21 | 8071 | 8072 | SNP |
| BaAK19H17 | 8075 | 8076 | SNP |
| bah47l12 | 8079 | 8080 | SNP |
| baak18p11 | 8083 | 8084 | SNP |
| baet29H0715 | 8087 | 8088 | SNP |
| BaH13D11 | 8091 | 8092 | SNP |
| baet39D1107 | 8095 | 8096 | SNP |
| BaH53E15 | 8099 | 8100 | SNP |
| bags32o15 | 8103 | 8104 | SNP |
| bast48A0701 | 8107 | 8108 | SNP |
| bast62D0907 | 8111 | 8112 | SNP |
| BaH45P22 | 8115 | 8116 | SNP |
| BaGS32L16 | 8119 | 8120 | SNP |
| BaAK30J05 | 8123 | 8124 | SNP |

TABLE 9-5

| Name | Primers used (SEQ ID NO:) | | marker type |
|---|---|---|---|
| bah52a14 | 8127 | 8128 | SNP |
| bah58i22 | 8131 | 8132 | SNP |
| BaH56L16 | 8135 | 8136 | SNP |
| bah52a21 | 8139 | 8140 | SNP |
| BaSD14G11 | 8143 | 8144 | SNP |
| bags6a03 | 8147 | 8148 | SNP |
| bast72E0109 | 8151 | 8152 | SNP |
| bags21a21 | 8155 | 8156 | SNP |
| BaH58P13 | 8159 | 8160 | SNP |
| bah27n22 | 8163 | 8164 | SNP |
| bags20c13 | 8167 | 8168 | SNP |
| bags30i14 | 8171 | 8172 | SNP |
| BaAK17E11 | 8175 | 8176 | SNP |
| baal1d17 | 8179 | 8180 | CAPS |
| bags22f06 | 8183 | 8184 | CAPS |
| baal10l01 | 8187 | 8188 | SNP |
| baak26e17 | 8191 | 8192 | SNP |
| bah16a03 | 8195 | 8196 | CAPS |
| BaAL11F18 | 8199 | 8200 | CAPS |

TABLE 9-5-continued

| Name | Primers used (SEQ ID NO:) | | marker type |
|---|---|---|---|
| BaAK29E10 | 8203 | 8204 | CAPS |
| bags32d21 | 8207 | 8208 | SNP |
| bah54j22 | 8211 | 8212 | SNP |
| baak16f14 | 8215 | 8216 | CAPS |
| baak44c12 | 8219 | 8220 | CAPS |
| bah13f11 | 8223 | 8224 | SNP |
| baal39m19 | 8227 | 8228 | CAPS |
| baak4e02 | 8231 | 8232 | CAPS |
| baak46f04 | 8235 | 8236 | CAPS |
| BaAK13N23 | 8239 | 8240 | size_poly (codominant) |
| BaGS20E09 | 8243 | 8244 | size_poly (codominant) |
| baal4f01 | 8247 | 8248 | CAPS |
| BaSD19I17 | 8251 | 8252 | CAPS |
| baal4l21 | 8255 | 8256 | SNP |
| BaAK19P01 | 8259 | 8260 | CAPS |
| BaAK31O14 | 8263 | 8264 | SNP |
| BaH26P22 | 8267 | 8268 | CAPS |
| baal13d17 | 8271 | 8272 | SNP |
| bags22j12 | 8275 | 8276 | SNP |
| bags33p05 | 8279 | 8280 | SNP |
| bags38j07 | 8283 | 8284 | SNP |
| kr59F0311 | 8287 | 8288 | CAPS |
| baal13e10 | 8291 | 8292 | CAPS |
| bags15d19 | 8295 | 8296 | SNP |
| BaGS5K11 | 8299 | 8300 | CAPS |
| BaGS10J14 | 8303 | 8304 | CAPS |
| baak41m17 | 8307 | 8308 | CAPS |
| bah57o03 | 8311 | 8312 | SNP |
| baak41d22 | 8315 | 8316 | CAPS |
| bah61c16 | 8319 | 8320 | CAPS |
| BaAL7M13 | 8323 | 8324 | CAPS |
| BaAK31F11 | 8327 | 8328 | CAPS |

TABLE 9-6

| Name | Primers used (SEQ ID NO:) | | marker type |
|---|---|---|---|
| basd22k05 | 8331 | 8332 | Size_poly (codominant) |
| basd3p19 | 8335 | 8336 | Size_poly (dominant) |
| baak17o09 | 8339 | 8340 | CAPS |
| baal33d23 | 8343 | 8344 | CAPS |
| BaAK12F04 | 8347 | 8348 | SNP |
| bah53j16 | 8351 | 8352 | SNP |
| BaSD2E24 | 8355 | 8356 | SNP |
| bags39h08 | 8359 | 8360 | SNP |
| BaSD1N02 | 8363 | 8364 | SNP |
| bags20m21 | 8367 | 8368 | SNP |
| baal10h19 | 8371 | 8372 | SNP |
| basd12m11 | 8375 | 8376 | SNP |
| bah29d24 | 8379 | 8380 | SNP |
| BaGS39P09 | 8383 | 8384 | SNP |
| BaGS31F17 | 8387 | 8388 | SNP |
| BaGS23D08 | 8391 | 8392 | SNP |
| bags39d15 | 8395 | 8396 | SNP |
| BaGS34I17 | 8399 | 8400 | SNP |
| BaH32N02 | 8403 | 8404 | SNP |
| BaSD18H19 | 8407 | 8408 | SNP |
| bast63A0101 | 8411 | 8412 | SNP |
| BaH50N04 | 8415 | 8416 | SNP |
| baal4a13 | 8419 | 8420 | SNP |
| baal41l18 | 8423 | 8424 | SNP |
| BaH31A03 | 8427 | 8428 | CAPS |
| bastl39A0901 | 8431 | 8432 | CAPS |
| baet46D0507 | 8435 | 8436 | CAPS |
| baal27e20 | 8439 | 8440 | SNP |
| bags37l16 | 8443 | 8444 | SNP |
| baak34o06 | 8447 | 8448 | SNP |
| BaAL30I11 | 8451 | 8452 | SNP |
| BaH62C15 | 8455 | 8456 | SNP |
| basd12i15 | 8459 | 8460 | CAPS |
| BaAK40I03 | 8463 | 8464 | CAPS |
| BaAK23E14 | 8467 | 8468 | CAPS |
| BaAL21F11 | 8471 | 8472 | size_poly (codominant) |
| BaAK16L19 | 8475 | 8476 | SNP |
| baal27a24 | 8479 | 8480 | CAPS |

TABLE 9-6-continued

| Name | Primers used (SEQ ID NO:) | | marker type |
|---|---|---|---|
| kr41H0315 | 8483 | 8484 | SNP |
| BaH62I23 | 8487 | 8488 | SNP |
| bah52i24 | 8491 | 8492 | SNP |
| bastl33A0301 | 8495 | 8496 | SNP |
| BaH28J15 | 8499 | 8500 | CAPS |
| bastl56A0301 | 8503 | 8504 | SNP |
| baal39a03 | 8507 | 8508 | SNP |
| baal5b15 | 8511 | 8512 | CAPS |
| baak34l03 | 8515 | 8516 | SNP |
| BaSD20J15 | 8519 | 8520 | SNP |
| bastl30F0711 | 8523 | 8524 | SNP |
| baal11p07 | 8527 | 8528 | size_poly (codominant) |
| BaH28J10 | 8531 | 8532 | CAPS |

TABLE 9-7

| Name | Primers used (SEQ ID NO:) | | marker type |
|---|---|---|---|
| baak34p05 | 8535 | 8536 | CAPS |
| bast56G0713 | 8539 | 8540 | SNP |
| bah27d18 | 8543 | 8544 | CAPS |
| bastl02H0715 | 8547 | 8548 | SNP |
| bah37e07 | 8551 | 8552 | size_poly (codominant) |
| bags4d18 | 8555 | 8556 | size_poly (codominant) |
| bags8i05 | 8559 | 8560 | SNP |
| BaH50A15 | 8563 | 8564 | CAPS |
| kr06D0907 | 8567 | 8568 | size_poly (codominant) |
| basd18m04 | 8571 | 8572 | SNP |
| basd2f22 | 8575 | 8576 | CAPS |
| BaH47K06 | 8579 | 8580 | CAPS |
| BaH28G01 | 8583 | 8584 | SNP |
| BaSD1M13 | 8587 | 8588 | SNP |
| bags37h19 | 8591 | 8592 | SNP |
| bags29b01 | 8595 | 8596 | CAPS |
| BaH21A10 | 8599 | 8600 | SNP |
| bags23d06 | 8603 | 8604 | SNP |
| basd2a21 | 8607 | 8608 | CAPS |
| BaGS19G10 | 8611 | 8612 | SNP |
| cMWG699 | — | — | STS |
| bah11b24 | 8615 | 8616 | SNP |
| bast39D0408 | 8619 | 8620 | SNP |
| baak33e08 | 8623 | 8624 | SNP |
| bags33m15 | 8627 | 8628 | CAPS |
| BaAL33B08 | 8631 | 8632 | SNP |
| bags39e12 | 8635 | 8636 | SNP |
| baak41e24 | 8639 | 8640 | CAPS |
| bah63c08 | 8643 | 8644 | CAPS |
| bags33n09 | 8647 | 8648 | SNP |
| Bmag125 | — | — | SSR |
| baal32h09 | 8651 | 8652 | SNP |
| BaAK20O17 | 8655 | 8656 | SNP |
| BaGS32G10 | 8659 | 8660 | SNP |
| baet33E1210 | 8663 | 8664 | SNP |
| BaH50O08 | 8667 | 8668 | SNP |
| bast46F0711 | 8671 | 8672 | SNP |
| BaH16F05 | 8675 | 8676 | SNP |
| baal17e18 | 8679 | 8680 | CAPS |
| cMWG694 | — | — | STS |
| bah13o11 | 8683 | 8684 | SNP |
| basd11g04 | 8687 | 8688 | CAPS |
| bah32c06 | 8691 | 8692 | size_poly (codominant) |
| basd27i13 | 8695 | 8696 | SNP |
| kr14F0911 | 8699 | 8700 | size_poly (codominant) |
| BaGS36A04 | 8703 | 8704 | CAPS |
| bags13a16 | 8707 | 8708 | CAPS |
| bags26e20 | 8711 | 8712 | SNP |
| baet45G1214 | 8715 | 8716 | SNP |
| BaAK35F14 | 8719 | 8720 | CAPS |
| BaAK23N21 | 8723 | 8724 | size_poly (codominant) |

TABLE 9-8

| Name | Primers used (SEQ ID NO:) | | marker type |
|---|---|---|---|
| basd13j22 | 8727 | 8728 | SNP |
| BaAK46E10 | 8731 | 8732 | SNP |
| bastl55F0812 | 8735 | 8736 | SNP |
| baak46l06 | 8739 | 8740 | CAPS |
| BaAL2D11 | 8743 | 8744 | size_poly (codominant) |
| baak15p17 | 8747 | 8748 | CAPS |
| BaGS33J16 | 8751 | 8752 | CAPS |
| bags7p21 | 8755 | 8756 | CAPS |
| BaAK22E05 | 8759 | 8760 | CAPS |
| bah42m05 | 8763 | 8764 | CAPS |
| BaAK25L01 | 8767 | 8768 | CAPS |
| bags39e24 | 8771 | 8772 | CAPS |
| BaH56N24 | 8775 | 8776 | size_poly (codominant) |
| baak44i12 | 8779 | 8780 | SNP |
| bah21j03 | 8783 | 8784 | SNP |
| kr71B0103 | 8787 | 8788 | SNP |
| BaGS16D15 | 8791 | 8792 | CAPS |
| baak21p23 | 8795 | 8796 | SNP |
| BaGS6G09 | 8799 | 8800 | SNP |
| BaSD15M02 | 8803 | 8804 | SNP |
| basd13f02 | 8807 | 8808 | SNP |
| BaH19F21 | 8811 | 8812 | CAPS |
| bags20b10 | 8815 | 8816 | CAPS |
| bah26j10 | 8819 | 8820 | SNP |
| bast65G0113 | 8823 | 8824 | SNP |
| baak4k13 | 8827 | 8828 | SNP |
| baal19j23 | 8831 | 8832 | size_poly (codominant) |
| bags34h11 | 8835 | 8836 | SNP |
| bags37j03 | 8839 | 8840 | SNP |
| baal15e13 | 8843 | 8844 | size_poly (codominant) |
| BaAL5O10 | 8847 | 8848 | size_poly (dominant) |
| BaGS29J10 | 8851 | 8852 | CAPS |
| bah22o08 | 8855 | 8856 | SNP |
| bags6k13 | 8859 | 8860 | SNP |
| bastl43C0705 | 8863 | 8864 | SNP |
| BaAL4D10 | 8867 | 8868 | size_poly (codominant) |
| basd12n12 | 8871 | 8872 | CAPS |
| bags23h03 | 8875 | 8876 | SNP |
| bags6l02 | 8879 | 8880 | CAPS |
| bast63B0703 | 8883 | 8884 | SNP |
| BaSD13E02 | 8887 | 8888 | SNP |
| BaSD14P15 | 8891 | 8892 | CAPS |
| bah13a17 | 8895 | 8896 | SNP |
| BaH50L23 | 8899 | 8900 | SNP |
| bags19g04 | 8903 | 8904 | CAPS |
| bast73E0210 | 8907 | 8908 | SNP |
| BaH50O21 | 8911 | 8912 | SNP |
| basd21g05 | 8915 | 8916 | SNP |
| bah33p11 | 8919 | 8920 | CAPS |
| baal5i19 | 8923 | 8924 | SNP |
| bah16e04 | 8927 | 8928 | SNP |

TABLE 9-9

| Name | Primers used (SEQ ID NO:) | | marker type |
|---|---|---|---|
| baak32p24 | 8931 | 8932 | SNP |
| EBmac415 | — | — | SSR |
| bags38f12 | 8935 | 8936 | CAPS |
| basd26p18 | 8939 | 8940 | CAPS |
| baak45h16 | 8943 | 8944 | CAPS |
| bah28p12 | 8947 | 8948 | CAPS |
| bah19a10 | 8951 | 8952 | CAPS |
| baak13d11 | 8955 | 8956 | SNP |
| bah49p10 | 8959 | 8960 | SNP |
| baal32n15 | 8963 | 8964 | SNP |
| bast09C0305 | 8967 | 8968 | size_poly (codominant) |
| basd16l09 | 8971 | 8972 | CAPS |
| BaAK22H04 | 8975 | 8976 | SNP |
| BaGS15J13 | 8979 | 8980 | SNP |
| kr66G0414 | 8983 | 8984 | SNP |
| BaSD22C07 | 8987 | 8988 | SNP |
| kr71C1105 | 8991 | 8992 | SNP |
| bags34i11 | 8995 | 8996 | SNP |
| BaH23K17 | 8999 | 9000 | SNP |

TABLE 9-9-continued

| Name | Primers used (SEQ ID NO:) | | marker type |
|---|---|---|---|
| bast39D0107 | 9003 | 9004 | SNP |
| BaH44K24 | 9007 | 9008 | SNP |
| BaGS18N21 | 9011 | 9012 | CAPS |
| baak32k15 | 9015 | 9016 | SNP |
| bah61a13 | 9019 | 9020 | SNP |
| bags35n11 | 9023 | 9024 | SNP |
| BaAK24I03 | 9027 | 9028 | SNP |
| baal4h20 | 9031 | 9032 | size_poly (codominant) |
| BaH28N23 | 9035 | 9036 | SNP |
| bags10e13 | 9039 | 9040 | SNP |
| baak27i10 | 9043 | 9044 | size_poly (codominant) |
| bags19d13 | 9047 | 9048 | SNP |
| baak19d04 | 9051 | 9052 | SNP |
| BaAL34O19 | 9055 | 9056 | SNP |
| baal12l02 | 9059 | 9060 | CAPS |
| BaAK1P04 | 9063 | 9064 | SNP |
| baak35m13 | 9067 | 9068 | SNP |
| bags35a12 | 9071 | 9072 | CAPS |
| bah41n09 | 9075 | 9076 | SNP |
| BaGS23I12 | 9079 | 9080 | SNP |
| BaH16P20 | 9083 | 9084 | SNP |
| BaAK42L17 | 9087 | 9088 | CAPS |
| baak36d23 | 9091 | 9092 | CAPS |
| bast78C1006 | 9095 | 9096 | CAPS |
| BaH45O16 | 9099 | 9100 | SNP |
| bah21h09 | 9103 | 9104 | SNP |
| bah58p22 | 9107 | 9108 | SNP |
| bags20l19 | 9111 | 9112 | SNP |
| bah13i10 | 9115 | 9116 | SNP |
| BaAK36B07 | 9119 | 9120 | CAPS |
| baak26b05 | 9123 | 9124 | CAPS |
| baal7c15 | 9127 | 9128 | SNP |

TABLE 9-10

| Name | Primers used (SEQ ID NO:) | | marker type |
|---|---|---|---|
| bah63f05 | 9131 | 9132 | SNP |
| bags15l16 | 9135 | 9136 | SNP |
| BaGS6N10 | 9139 | 9140 | CAPS |
| bah41e10 | 9143 | 9144 | SNP |
| BaH54D08 | 9147 | 9148 | SNP |
| baak18c01 | 9151 | 9152 | SNP |
| basd21o07 | 9155 | 9156 | SNP |
| bah41b23 | 9159 | 9160 | CAPS |
| basd18g15 | 9163 | 9164 | size_poly (codominant) |
| baak43o03 | 9167 | 9168 | SNP |
| bastl30D0408 | 9171 | 9172 | CAPS |
| bah17p16 | 9175 | 9176 | CAPS |
| baal13f18 | 9179 | 9180 | SNP |
| bags18i22 | 9183 | 9184 | SNP |
| bags9b02 | 9187 | 9188 | SNP |
| bah11e22 | 9191 | 9192 | SNP |
| bah58h09 | 9195 | 9196 | SNP |
| basd16e16 | 9199 | 9200 | CAPS |
| BaAK4C12 | 9203 | 9204 | SNP |
| bags37a05 | 9207 | 9208 | SNP |
| bags9p10 | 9211 | 9212 | CAPS |
| baak24m01 | 9215 | 9216 | size_poly (codominant) |
| basd27d09 | 9219 | 9220 | CAPS |
| baak34a14 | 9223 | 9224 | size_poly (codominant) |
| baak36a20 | 9227 | 9228 | SNP |
| BaSD17P09 | 9231 | 9232 | CAPS |
| bags5m04 | 9235 | 9236 | CAPS |
| BaGS5E06 | 9239 | 9240 | CAPS |
| MWG2076 | — | — | STS |
| bags15f03 | 9243 | 9244 | size_poly (dominant) |
| bags18j23 | 9247 | 9248 | size_poly (dominant) |
| baal13m04 | 9251 | 9252 | SNP |
| bags9o24 | 9255 | 9256 | SNP |
| kr49E0610 | 9259 | 9260 | CAPS |
| bah12h16 | 9263 | 9264 | SNP |
| baak33n16 | 9267 | 9268 | SNP |
| BaGS22E05 | 9271 | 9272 | CAPS |
| bah26n01 | 9275 | 9276 | SNP |

TABLE 9-10-continued

| Name | Primers used (SEQ ID NO:) | | marker type |
|---|---|---|---|
| BaGS39E07 | 9279 | 9280 | SNP |
| BaH45O03 | 9283 | 9284 | CAPS |
| BaH38A09 | 9287 | 9288 | SNP |

TABLE 10-1

| Name | Primers used (SEQ ID NO:) | | marker type |
|---|---|---|---|
| BaAL15P01 | 9291 | 9292 | SNP |
| BaAK42D06 | 9295 | 9296 | size_poly (dominant) |
| bags12k16 | 9299 | 9300 | size_poly (codominant) |
| BaAL36H19 | 9303 | 9304 | size_poly (codominant) |
| bags1d06 | 9307 | 9308 | SNP |
| bast18A0602 | 9311 | 9312 | SNP |
| basd22i04 | 9315 | 9316 | CAPS |
| BaGS31M01 | 9319 | 9320 | CAPS |
| BaH63H24 | 9323 | 9324 | SNP |
| basd15n13 | 9327 | 9328 | CAPS |
| MWG848 | — | — | STS |
| BaAK13C16 | 9331 | 9332 | SNP |
| BaGS32C19 | 9335 | 9336 | SNP |
| baak36f08 | 9339 | 9340 | SNP |
| bastl04C0406 | 9343 | 9344 | CAPS |
| bastl42D1107 | 9347 | 9348 | SNP |
| BaGS31B20 | 9351 | 9352 | size_poly (codominant) |
| baak39l17 | 9355 | 9356 | CAPS |
| BaAL17J24 | 9359 | 9360 | CAPS |
| bah15p03 | 9363 | 9364 | CAPS |
| baak20g06 | 9367 | 9368 | SNP |
| baal22c16 | 9371 | 9372 | CAPS |
| baak46o05 | 9375 | 9376 | SNP |
| basd15h22 | 9379 | 9380 | SNP |
| BaSD19C07 | 9383 | 9384 | SNP |
| bags22i13 | 9387 | 9388 | CAPS |
| baak39a14 | 9391 | 9392 | SNP |
| bah31e12 | 9395 | 9396 | SNP |
| BaSD15L22 | 9399 | 9400 | SNP |
| BaGS20D21 | 9403 | 9404 | CAPS |
| bags39o21 | 9407 | 9408 | CAPS |
| basd21j11 | 9411 | 9412 | SNP |
| BaH48C10 | 9415 | 9416 | SNP |
| BaH54J07 | 9419 | 9420 | SNP |
| BaSD19H23 | 9423 | 9424 | CAPS |
| baak35n06 | 9427 | 9428 | CAPS |
| bags35b22 | 9431 | 9432 | CAPS |
| BaAK30H06 | 9435 | 9436 | CAPS |
| BaAL15M07 | 9439 | 9440 | CAPS |
| BaGS20N02 | 9443 | 9444 | CAPS |
| BaAL19L12 | 9447 | 9448 | CAPS |
| bags25b05 | 9451 | 9452 | CAPS |
| HvLTPPB | — | — | SSR |
| baal1h04 | 9455 | 9456 | CAPS |
| baet46B0903 | 9459 | 9460 | SNP |
| BaGS19F16 | 9463 | 9464 | SNP |
| baak13g18 | 9467 | 9468 | SNP |
| BaH45N12 | 9471 | 9472 | CAPS |
| bast74H0216 | 9475 | 9476 | SNP |
| bah24l06 | 9479 | 9480 | size_poly (dominant) |
| BaAK45C14 | 9483 | 9484 | SNP |

TABLE 10-2

| Name | Primers used (SEQ ID NO:) | | marker type |
|---|---|---|---|
| baal5k12 | 9487 | 9488 | CAPS |
| kr63F0111 | 9491 | 9492 | SNP |
| baak13h18 | 9495 | 9496 | SNP |
| baak12j16 | 9499 | 9500 | CAPS |
| BaAK28J20 | 9503 | 9504 | CAPS |
| BaH27G14 | 9507 | 9509 | CAPS |
| BaH49B13 | 9511 | 9512 | SNP |
| BaGS35A09 | 9515 | 9516 | CAPS |
| BaGS38L24 | 9519 | 9520 | size_poly (dominant) |

TABLE 10-2-continued

| Name | Primers used (SEQ ID NO:) | | marker type |
|---|---|---|---|
| BaAK43H20 | 9523 | 9524 | CAPS |
| bast16A0802 | 9527 | 9528 | SNP |
| basd18k01 | 9531 | 9532 | SNP |
| BaH58D17 | 9535 | 9536 | SNP |
| BaAK30M07 | 9539 | 9540 | CAPS |
| bags6a04 | 9543 | 9544 | CAPS |
| kr15H0915 | 9547 | 9548 | CAPS |
| bags26d01 | 9551 | 9552 | SNP |
| basd14k04 | 9555 | 9556 | SNP |
| BaSD24D11 | 9559 | 9560 | SNP |
| BaH53L10 | 9563 | 9564 | SNP |
| BaH60D22 | 9567 | 9568 | size_poly (codominant) |
| BaSD1G06 | 9571 | 9572 | size_poly (codominant) |
| BaAK21L13 | 9575 | 9576 | size_poly (codominant) |
| bah57m03 | 9579 | 9580 | SNP |
| baal30b10 | 9583 | 9584 | SNP |
| bah62n16 | 9587 | 9588 | SNP |
| BaGS22F15 | 9591 | 9592 | SNP |
| BaH50J14 | 9595 | 9596 | SNP |
| bah19d23 | 9599 | 9600 | SNP |
| bags38c06 | 9603 | 9604 | SNP |
| BaGS25N05 | 9607 | 9608 | SNP |
| bastl29B0503 | 9611 | 9612 | SNP |
| baak27d01 | 9615 | 9616 | CAPS |
| baak43n21 | 9619 | 9620 | SNP |
| BaAL4F05 | 9623 | 9624 | size_poly (codominant) |
| baal4a06 | 9627 | 9628 | SNP |
| bast17D1008 | 9631 | 9632 | SNP |
| BaGS16B17 | 9635 | 9636 | SNP |
| BaGS27P18 | 9639 | 9640 | CAPS |
| BaGS4J14 | 9643 | 9644 | CAPS |
| BaAK16B19 | 9647 | 9648 | SNP |
| baal40p07 | 9651 | 9652 | SNP |
| bah49c19 | 9655 | 9656 | SNP |
| bast58C0406 | 9659 | 9660 | SNP |
| BaAK35M24 | 9663 | 9664 | SNP |
| bags19h13 | 9667 | 9668 | SNP |
| bah57c21 | 9671 | 9672 | SNP |
| BaH53P15 | 9675 | 9676 | SNP |
| BaGS20A10 | 9679 | 9680 | SNP |
| bast02D0808 | 9683 | 9684 | SNP |
| bags31c04 | 9687 | 9688 | SNP |

TABLE 10-3

| Name | Primers used (SEQ ID NO:) | | marker type |
|---|---|---|---|
| BaH32J06 | 9691 | 9692 | CAPS |
| bah60o22 | 9695 | 9696 | SNP |
| BaH50C16 | 9699 | 9700 | SNP |
| BaH57K23 | 9703 | 9704 | CAPS |
| bags21g23 | 9707 | 9708 | size_poly (codominant) |
| HVM9 | — | — | SSR |
| Bmac67 | — | — | SSR |
| baak43e04 | 9711 | 9712 | SNP |
| kr17G1113 | 9715 | 9716 | SNP |
| bags19k19 | 9719 | 9720 | SNP |
| baak38b13 | 9723 | 9724 | SNP |
| baak1d12 | 9727 | 9728 | SNP |
| BaH28M14 | 9731 | 9732 | SNP |
| BaH48I15 | 9735 | 9736 | SNP |
| basd27h23 | 9739 | 9740 | SNP |
| BaAK21A11 | 9743 | 9744 | SNP |
| bast04B0804 | 9747 | 9748 | SNP |
| bah45f13 | 9751 | 9752 | SNP |
| BaAL8J18 | 9755 | 9756 | SNP |
| BaGS9D01 | 9759 | 9760 | SNP |
| baal12d12 | 9763 | 9764 | CAPS |
| baal4i06 | 9767 | 9768 | SNP |
| bah26i01 | 9771 | 9772 | SNP |
| BaGS15C17 | 9775 | 9776 | SNP |
| baak1k08 | 9779 | 9780 | SNP |
| bags9b03 | 9783 | 9784 | SNP |
| baet42G1214 | 9787 | 9788 | SNP |
| bah18d12 | 9791 | 9792 | SNP |

TABLE 10-3-continued

| Name | Primers used (SEQ ID NO:) | | marker type |
|---|---|---|---|
| BaSD14G02 | 9795 | 9796 | CAPS |
| bags22b22 | 9799 | 9800 | SNP |
| bah13f10 | 9803 | 9804 | size_poly (codominant) |
| baal36g05 | 9807 | 9808 | SNP |
| bags33j15 | 9811 | 9812 | SNP |
| BaAL12H04 | 9815 | 9816 | size_poly (codominant) |
| BaGS16I18 | 9819 | 9820 | CAPS |
| bast61D0707 | 9823 | 9824 | SNP |
| bah11k22 | 9827 | 9828 | CAPS |
| baak32p21 | 9831 | 9832 | CAPS |
| bah63l21 | 9835 | 9836 | CAPS |
| BaGS38D03 | 9839 | 9840 | CAPS |
| BaSD23A04 | 9843 | 9844 | SNP |
| BaSD14C15 | 9847 | 9848 | SNP |
| bast63C0105 | 9851 | 9852 | SNP |
| bast23C1105 | 9855 | 9856 | SNP |
| bags23b01 | 9859 | 9860 | CAPS |
| bags29c09 | 9863 | 9864 | CAPS |
| bags6b06 | 9867 | 9868 | CAPS |
| BaAK27G06 | 9871 | 9872 | CAPS |
| BaAK39D07 | 9875 | 9876 | CAPS |
| BaGS20G21 | 9879 | 9880 | CAPS |
| bastl22E0810 | 9883 | 9884 | size_poly (codominant) |

TABLE 10-4

| Name | Primers used (SEQ ID NO:) | | marker type |
|---|---|---|---|
| bah11m03 | 9887 | 9888 | CAPS |
| BaAL3C04 | 9891 | 9892 | CAPS |
| BaAL19H10 | 9895 | 9896 | SNP |
| bags24n16 | 9899 | 9900 | CAPS |
| BaSD24B15 | 9903 | 9904 | SNP |
| bah48n17 | 9907 | 9908 | SNP |
| bags9i05 | 9911 | 9912 | SNP |
| bags1l22 | 9915 | 9916 | SNP |
| bah62p18 | 9919 | 9920 | SNP |
| bah55n21 | 9923 | 9924 | SNP |
| bah44a05 | 9927 | 9928 | SNP |
| bah19c13 | 9931 | 9932 | SNP |
| baal12b04 | 9935 | 9936 | CAPS |
| Bmag136 | — | — | SSR |
| Bmac209 | — | — | SSR |
| BaAK28A10 | 9939 | 9940 | size_poly (dominant) |
| kr28B0703 | 9943 | 9944 | SNP |
| bastl50C0606 | 9947 | 9948 | SNP |
| BaGS36B01 | 9951 | 9952 | CAPS |
| BaH19A05 | 9955 | 9956 | SNP |
| baal10c06 | 9959 | 9960 | SNP |
| bags19p04 | 9963 | 9964 | SNP |
| BaAK21A17 | 9967 | 9968 | SNP |
| bah20j14 | 9971 | 9972 | SNP |
| BaAK19A03 | 9975 | 9976 | SNP |
| BaGS30E19 | 9979 | 9980 | SNP |
| BaAK28C21 | 9983 | 9984 | size_poly (codominant) |
| bags11o14 | 9987 | 9988 | SNP |
| BaGS13P22 | 9991 | 9992 | SNP |
| kr27A1101 | 9995 | 9996 | SNP |
| HVM27 | — | — | SSR |
| baal12i18 | 9999 | 10000 | CAPS |
| BaAL8G07 | 10003 | 10004 | CAPS |
| bast58F0412 | 10007 | 10008 | SNP |
| bags3f23 | 10011 | 10012 | CAPS |
| baal4m06 | 10015 | 10016 | CAPS |
| baal32p23 | 10019 | 10020 | SNP |
| basd23m17 | 10023 | 10024 | SNP |
| bastl30E0509 | 10027 | 10028 | SNP |
| bah44b0B | 10031 | 10032 | SNP |
| BaGS14N10 | 10035 | 10036 | SNP |
| BaGS32B13 | 10039 | 10040 | SNP |
| BaH30B03 | 10043 | 10044 | SNP |
| basd1l23 | 10047 | 10048 | CAPS |
| basd11o06 | 10051 | 10052 | SNP |
| bah17f24 | 10055 | 10056 | SNP |
| BaAK26L17 | 10059 | 10060 | SNP |

TABLE 10-4-continued

| Name | Primers used (SEQ ID NO:) | | marker type |
|---|---|---|---|
| bags23f03 | 10063 | 10064 | SNP |
| bags20o06 | 10067 | 10068 | SNP |
| bags19n12 | 10071 | 10072 | SNP |
| baal12a09 | 10075 | 10076 | size_poly (codominant) |

TABLE 10-5

| Name | Primers used (SEQ ID NO:) | | marker type |
|---|---|---|---|
| bast14F0612 | 10079 | 10080 | SNP |
| baak13p20 | 10083 | 10084 | CAPS |
| BaGS16K13 | 10087 | 10088 | SNP |
| baak22c16 | 10091 | 10092 | SNP |
| baal40m06 | 10095 | 10096 | SNP |
| BaH29I03 | 10099 | 10100 | CAPS |
| bah16h01 | 10103 | 10104 | CAPS |
| bah57a11 | 10107 | 10108 | SNP |
| BaH41E23 | 10111 | 10112 | SNP |
| baal11c11 | 10115 | 10116 | size_poly (dominant) |
| BaSD14L18 | 10119 | 10120 | SNP |
| bah14d17 | 10123 | 10124 | SNP |
| BaGS1N17 | 10127 | 10128 | SNP |
| bags27h17 | 10131 | 10132 | CAPS |
| bah47p22 | 10135 | 10136 | SNP |
| BaH50A16 | 10139 | 10140 | SNP |
| bags7b20 | 10143 | 10144 | SNP |
| bags22a02 | 10147 | 10148 | SNP |
| HvBRI1 | — | — | dCAPS |
| basd12g02 | 10151 | 10152 | SNP |
| basd15o18 | 10155 | 10156 | SNP |
| baal25d19 | 10159 | 10160 | SNP |
| bast52G0414 | 10163 | 10164 | SNP |
| baal11c20 | 10167 | 10168 | CAPS |
| bags37k06 | 10171 | 10172 | SNP |
| bags6e22 | 10175 | 10176 | SNP |
| basd15a02 | 10179 | 10180 | CAPS |
| bags7b06 | 10183 | 10184 | CAPS |
| bah15k11 | 10187 | 10188 | CAPS |
| bast46C0406 | 10191 | 10192 | SNP |
| bastl45E0509 | 10195 | 10196 | SNP |
| baal35p14 | 10199 | 10200 | CAPS |
| BaH41G07 | 10203 | 10204 | SNP |
| bast46H1016 | 10207 | 10208 | SNP |
| bah60d12 | 10211 | 10212 | SNP |
| baal39a19 | 10215 | 10216 | SNP |
| baak11n24 | 10219 | 10220 | CAPS |
| bast14E0909 | 10223 | 10224 | SNP |
| baet13G0713 | 10227 | 10228 | SNP |
| HVM33 | — | — | SSR |
| BaSD14L04 | 10231 | 10232 | CAPS |
| baak13c05 | 10235 | 10236 | SNP |
| bastl41G0513 | 10239 | 10240 | SNP |
| BaGS39M09 | 10243 | 10244 | CAPS |
| baal19b12 | 10247 | 10248 | SNP |
| BaAL39B05 | 10251 | 10252 | SNP |
| BaAL1J03 | 10255 | 10256 | SNP |
| basd11k09 | 10259 | 10260 | SNP |
| BaGS33N15 | 10263 | 10264 | SNP |
| baet43H0416 | 10267 | 10268 | SNP |
| bah11m06 | 10271 | 10272 | SNP |

TABLE 10-6

| Name | Primers used (SEQ ID NO:) | | marker type |
|---|---|---|---|
| baak31a24 | 10275 | 10276 | CAPS |
| bags27h20 | 10279 | 10280 | SNP |
| basd27c09 | 10283 | 10284 | SNP |
| BaAL25O01 | 10287 | 10288 | SNP |
| bags7f08 | 10291 | 10292 | CAPS |
| BaGS13O12 | 10295 | 10296 | size_poly (codominant) |
| bags38b06 | 10299 | 10300 | CAPS |
| BaAK19J09 | 10303 | 10304 | SNP |

TABLE 10-6-continued

| Name | Primers used (SEQ ID NO:) | | marker type |
|---|---|---|---|
| bags9e16 | 10307 | 10308 | size_poly (codominant) |
| bags20n14 | 10311 | 10312 | SNP |
| bah42o12 | 10315 | 10316 | SNP |
| baak31k16 | 10319 | 10320 | SNP |
| bags4p14 | 10323 | 10324 | SNP |
| bah27a22 | 10327 | 10328 | CAPS |
| bags21n02 | 10331 | 10332 | size_poly (codominant) |
| BaH62B09 | 10335 | 10336 | SNP |
| BaGS19J10 | 10339 | 10340 | SNP |
| bags15k18 | 10343 | 10344 | SNP |
| BaAK29G03 | 10347 | 10348 | CAPS |
| baak23e11 | 10351 | 10352 | CAPS |
| bags31k04 | 10355 | 10356 | CAPS |
| bast56C0305 | 10359 | 10360 | size_poly (dominant) |
| basd26o09 | 10363 | 10364 | SNP |
| BaSD20B11 | 10367 | 10368 | SNP |
| HVM60 | — | — | SSR |
| BaH46F11 | 10371 | 10372 | SNP |
| BaH30F03 | 10375 | 10376 | SNP |
| BaSD27G02 | 10379 | 10380 | CAPS |
| Bmag225 | — | — | SSR |
| BaAK33I12 | 10383 | 10384 | SNP |
| baak32m10 | 10387 | 10388 | CAPS |
| BaAL4L02 | 10391 | 10392 | CAPS |
| kr44F0911 | 10395 | 10396 | size_poly (codominant) |
| BaGS37A16 | 10399 | 10400 | SNP |
| bags39p06 | 10403 | 10404 | SNP |
| BaAL12N06 | 10407 | 10408 | SNP |
| bags22p05 | 10411 | 10412 | size_poly (codominant) |
| bags9a03 | 10415 | 10416 | SNP |
| baet24F1212 | 10419 | 10420 | SNP |
| baak29d10 | 10423 | 10424 | SNP |
| bags13i12 | 10427 | 10428 | SNP |
| BaAL16A23 | 10431 | 10432 | SNP |
| bastl16B1204 | 10435 | 10436 | SNP |
| bastl29F0711 | 10439 | 10440 | SNP |
| BaGS32M17 | 10443 | 10444 | CAPS |
| baal15e10 | 10447 | 10448 | SNP |
| basd3g08 | 10451 | 10452 | CAPS |
| baal33m18 | 10455 | 10456 | SNP |
| baak24e23 | 10459 | 10460 | SNP |
| baak46j13 | 10463 | 10464 | SNP |
| bah49o05 | 10467 | 10468 | SNP |

TABLE 10-7

| Name | Primers used (SEQ ID NO:) | | marker type |
|---|---|---|---|
| baal15e05 | 10471 | 10472 | SNP |
| BaAK1O08 | 10475 | 10476 | SNP |
| BaGS30P02 | 10479 | 10480 | SNP |
| BaSD15D05 | 10483 | 10484 | SNP |
| BaAL7B16 | 10487 | 10488 | CAPS |
| bags38n23 | 10491 | 10492 | SNP |
| baak36a14 | 10495 | 10496 | SNP |
| baak34g01 | 10499 | 10500 | CAPS |
| baak12f01 | 10503 | 10504 | CAPS |
| BaGS30I18 | 10507 | 10508 | CAPS |
| bags35n24 | 10511 | 10512 | SNP |
| bah37j21 | 10515 | 10516 | SNP |
| bah31e13 | 10519 | 10520 | SNP |
| bags22g10 | 10523 | 10524 | size_poly (dominant) |
| bags22f17 | 10527 | 10528 | size_poly (codominant) |
| baal30l05 | 10531 | 10532 | SNP |
| bags38o10 | 10535 | 10536 | SNP |
| baak40o04 | 10539 | 10540 | CAPS |
| BaH49L21 | 10543 | 10544 | SNP |
| bastl30A0701 | 10547 | 10548 | SNP |
| bags19l03 | 10551 | 10552 | SNP |
| bah18m13 | 10555 | 10556 | SNP |
| baak44p03 | 10559 | 10560 | SNP |
| kr10H0216 | 10563 | 10564 | SNP |
| bags11i04 | 10567 | 10568 | CAPS |
| bah52o06 | 10571 | 10572 | CAPS |
| bah35c14 | 10575 | 10576 | size_poly (codominant) |

TABLE 10-7-continued

| Name | Primers used (SEQ ID NO:) | | marker type |
|---|---|---|---|
| BaAL30C02 | 10579 | 10580 | size_poly (dominant) |
| bah11i21 | 10583 | 10584 | SNP |
| BaAK36B11 | 10587 | 10588 | size_poly (codominant) |
| BaAK20K23 | 10591 | 10592 | SNP |
| basd14n22 | 10595 | 10596 | SNP |
| BaAL25p17 | 10599 | 10600 | CAPS |
| BaH49A01 | 10603 | 10604 | size_poly (codominant) |
| basd13p12 | 10607 | 10608 | size_poly (codominant) |
| bags39m17 | 10611 | 10612 | size_poly (codominant) |
| baet44D0707 | 10615 | 10616 | SNP |
| BaH16P10 | 10619 | 10620 | SNP |
| BaAK42J01 | 10623 | 10624 | SNP |
| kr24E0709 | 10627 | 10628 | CAPS |
| BaAK38O08 | 10631 | 10632 | SNP |
| BaAL13N01 | 10635 | 10636 | CAPS |
| baak12c12 | 10639 | 10640 | size_poly (codominant) |
| BaGS31N06 | 10643 | 10644 | CAPS |
| baal15f24 | 10647 | 10648 | CAPS |
| BaSD18B21 | 10651 | 10652 | SNP |
| BaSD17G23 | 10655 | 10656 | SNP |
| baak41k22 | 10659 | 10660 | SNP |
| baak21o03 | 10663 | 10664 | SNP |
| BaSD16B18 | 10667 | 10668 | SNP |
| bast79C1105 | 10671 | 10672 | SNP |

TABLE 10-8

| Name | Primers used (SEQ ID NO:) | | marker type |
|---|---|---|---|
| BaAK4J17 | 10675 | 10676 | SNP |
| BaAL37H08 | 10679 | 10680 | SNP |
| BaH36L17 | 10683 | 10684 | CAPS |
| BaH46A12 | 10687 | 10688 | size_poly (codominant) |
| bags11i15 | 10691 | 10692 | SNP |
| baak20g24 | 10695 | 10696 | CAPS |
| baak20h23 | 10699 | 10700 | size_poly (codominant) |
| baak35b18 | 10703 | 10704 | SNP |
| Bmag13 | — | — | SSR |
| baak41o03 | 10707 | 10708 | SNP |
| baet46C0206 | 10711 | 10712 | CAPS |
| bags10i20 | 10715 | 10716 | size_poly (dominant) |
| baal1b16 | 10719 | 10720 | SNP |
| baal5i05 | 10723 | 10724 | CAPS |
| BaH27B05 | 10727 | 10728 | size_poly (codominant) |
| bah14a11 | 10731 | 10732 | CAPS |
| basd19k10 | 10735 | 10736 | size_poly (codominant) |
| bags30n17 | 10739 | 10740 | CAPS |
| bags31e24 | 10743 | 10744 | CAPS |
| BaGS5B16 | 10747 | 10748 | SNP |
| BaAL5F06 | 10751 | 10752 | SNP |
| bags34a11 | 10755 | 10756 | CAPS |
| bags6c16 | 10759 | 10760 | CAPS |
| bah42g19 | 10763 | 10764 | SNP |
| BaH47O14 | 10767 | 10768 | SNP |
| BaH12L06 | 10771 | 10772 | SNP |
| basd11a10 | 10775 | 10776 | CAPS |
| BaH50I12 | 10779 | 10780 | CAPS |
| BaH51A21 | 10783 | 10784 | SNP |
| baak45p02 | 10787 | 10788 | CAPS |
| BaSD12P12 | 10791 | 10792 | SNP |
| bags9l16 | 10795 | 10796 | CAPS |
| BaSD26O20 | 10799 | 10800 | CAPS |
| bags5d10 | 10803 | 10804 | CAPS |
| baal0e07 | 10807 | 10808 | CAPS |
| baak14e02 | 10811 | 10812 | CAPS |
| BaH63F14 | 10815 | 10816 | size_poly (codominant) |
| bah33f19 | 10819 | 10820 | CAPS |
| bags19l10 | 10823 | 10824 | SNP |
| BaH56J21 | 10827 | 10828 | SNP |
| baal40i22 | 10831 | 10832 | CAPS |
| kr42C0105 | 10835 | 10836 | size_poly (codominant) |
| bags16i19 | 10839 | 10840 | SNP |
| BaH54H01 | 10843 | 10844 | SNP |
| kr69E0810 | 10847 | 10848 | CAPS |
| bags17i14 | 10851 | 10852 | CAPS |

TABLE 10-8-continued

| Name | Primers used (SEQ ID NO:) | | marker type |
|---|---|---|---|
| bags20e19 | 10855 | 10856 | SNP |
| bast74C0206 | 10859 | 10860 | SNP |
| BaAK13L10 | 10863 | 10864 | SNP |
| bags20i01 | 10867 | 10868 | SNP |
| basd19n14 | 10871 | 10872 | SNP |

TABLE 10-9

| Name | Primers used (SEQ ID NO:) | | marker type |
|---|---|---|---|
| baak42g21 | 10875 | 10876 | SNP |
| BaAK39A15 | 10879 | 10880 | CAPS |
| basd18o21 | 10883 | 10884 | CAPS |
| BaAK22K17 | 10887 | 10888 | SNP |
| baal6o24 | 10891 | 10892 | SNP |
| BaH22C09 | 10895 | 10896 | SNP |
| HVM62 | — | — | SSR |
| bags23k14 | 10899 | 10900 | CAPS |
| baal24n12 | 10903 | 10904 | SNP |
| BaGS21H17 | 10907 | 10908 | CAPS |
| BaSD16D09 | 10911 | 10912 | SNP |
| BaAL13B22 | 10915 | 10916 | SNP |
| bah41l03 | 10919 | 10920 | CAPS |
| bastl30F0111 | 10923 | 10924 | SNP |
| BaH15L04 | 10927 | 10928 | SNP |
| baak40c12 | 10931 | 10932 | SNP |
| kr23D0408 | 10935 | 10936 | CAPS |
| bah57d15 | 10939 | 10940 | SNP |
| baak31e03 | 10943 | 10944 | SNP |
| BaAL13O01 | 10947 | 10948 | SNP |
| BaSD26P04 | 10951 | 10952 | SNP |
| bags20f18 | 10955 | 10956 | SNP |
| BaH42J22 | 10959 | 10960 | SNP |
| BaAL3K03 | 10963 | 10964 | size_poly (codominant) |
| kr30B1103 | 10967 | 10968 | SNP |
| baak14i02 | 10971 | 10972 | CAPS |
| bags28c17 | 10975 | 10976 | CAPS |
| baal4e21 | 10979 | 10980 | SNP |
| BaGS29D05 | 10983 | 10984 | SNP |
| bah54d24 | 10987 | 10988 | SNP |
| basd22g20 | 10991 | 10992 | CAPS |
| BaH62H20 | 10995 | 10996 | CAPS |
| bags38h17 | 10999 | 11000 | SNP |
| BaAK30B23 | 11003 | 11004 | SNP |
| BaAK24P09 | 11007 | 11008 | SNP |
| baak23i12 | 11011 | 11012 | CAPS |
| BaGS22D06 | 11015 | 11016 | SNP |
| BaAL34P18 | 11019 | 11020 | SNP |
| BaAL39F24 | 11023 | 11024 | CAPS |
| BaGS4L04 | 11027 | 11028 | CAPS |
| bah12e02 | 11031 | 11032 | CAPS |
| BaAL15F23 | 11035 | 11036 | SNP |
| BaGS25O15 | 11039 | 11040 | SNP |
| BaGS7G14 | 11043 | 11044 | CAPS |
| basd24i11 | 11047 | 11048 | CAPS |
| baak20l21 | 11051 | 11052 | size_poly (dominant) |
| bags33m02 | 11055 | 11056 | SNP |
| BaH48G21 | 11059 | 11060 | SNP |
| bags27p13 | 11063 | 11064 | SNP |

TABLE 11-1

| Name | Primers used (SEQ ID NO:) | | marker type |
|---|---|---|---|
| BaGS10N17 | 11067 | 11068 | size_poly (dominant) |
| BaAK38K23 | 11071 | 11072 | size_poly (codominant) |
| bah14a22 | 11075 | 11076 | SNP |
| BaAL19O06 | 11079 | 11080 | CAPS |
| BaGS32P17 | 11083 | 11084 | SNP |
| bah11j04 | 11087 | 11088 | CAPS |
| baak35b06 | 11091 | 11092 | SNP |
| basd21f17 | 11095 | 11096 | SNP |
| BaAK44O11 | 11099 | 11100 | size_poly (dominant) |

TABLE 11-1-continued

| Name | Primers used (SEQ ID NO:) | | marker type |
|---|---|---|---|
| bastl14D0408 | 11103 | 11104 | size_poly (codominant) |
| BaAK42C15 | 11107 | 11108 | CAPS |
| baak40n12 | 11111 | 11112 | CAPS |
| basd2j05 | 11115 | 11116 | CAPS |
| baak46n05 | 11119 | 11120 | size_poly (codominant) |
| baak24g04 | 11123 | 11124 | CAPS |
| BaAL22H02 | 11127 | 11128 | SNP |
| bah56g24 | 11131 | 11132 | SNP |
| BaAL2I22 | 11135 | 11136 | CAPS |
| bags20c22 | 11139 | 11140 | CAPS |
| BaH50O22 | 11143 | 11144 | CAPS |
| baak32f06 | 11147 | 11148 | SNP |
| bags35i24 | 11151 | 11152 | CAPS |
| BaSD21D13 | 11155 | 11156 | SNP |
| bast46D0408 | 11159 | 11160 | SNP |
| bast55B1204 | 11163 | 11164 | SNP |
| BaGS39M07 | 11167 | 11168 | size_poly (dominant) |
| bags39b15 | 11171 | 11172 | SNP |
| baak37p11 | 11175 | 11176 | CAPS |
| bah29o22 | 11179 | 11180 | SNP |
| baak12k14 | 11183 | 11184 | size_poly (codominant) |
| baet31E1010 | 11187 | 11188 | SNP |
| HVM40 | — | — | SSR |
| baal39h14 | 11191 | 11192 | SNP |
| bags14g22 | 11195 | 11196 | size_poly (codominant) |
| baal18m18 | 11199 | 11200 | SNP |
| BaSD24E02 | 11203 | 11204 | SNP |
| BaH50N14 | 11207 | 11208 | CAPS |
| kr70A0202 | 11211 | 11212 | CAPS |
| baak11d04 | 11215 | 11216 | SNP |
| MWG2033 | — | — | STS |
| bags20h01 | 11219 | 11220 | CAPS |
| BaH39P15 | 11223 | 11224 | CAPS |
| BaAK46O20 | 11227 | 11228 | CAPS |
| baal33m06 | 11231 | 11232 | SNP |
| bastl50E0309 | 11235 | 11236 | SNP |
| bags20i17 | 11239 | 11240 | SNP |
| BaGS22A07 | 11243 | 11244 | SNP |
| bah41b09 | 11247 | 11248 | SNP |
| kr18G0913 | 11251 | 11252 | CAPS |
| BaGS19O23 | 11255 | 11256 | SNP |
| bags15e12 | 11259 | 11260 | CAPS |

TABLE 11-2

| Name | Primers used (SEQ ID NO:) | | marker type |
|---|---|---|---|
| bags29i09 | 11263 | 11264 | CAPS |
| baak19m23 | 11267 | 11268 | CAPS |
| bags14h12 | 11271 | 11272 | SNP |
| bah32e15 | 11275 | 11276 | SNP |
| bah11l02 | 11279 | 11280 | CAPS |
| bags39e16 | 11283 | 11284 | SNP |
| bags10l12 | 11287 | 11288 | CAPS |
| BaGS31M13 | 11291 | 11292 | CAPS |
| baal32m10 | 11295 | 11296 | SNP |
| basd12b23 | 11299 | 11300 | SNP |
| baal39e15 | 11303 | 11304 | SNP |
| baal16l11 | 11307 | 11308 | CAPS |
| BaGS31B01 | 11311 | 11312 | SNP |
| BaSD17F09 | 11315 | 11316 | CAPS |
| BaH48L11 | 11319 | 11320 | SNP |
| BaSD14M08 | 11323 | 11324 | CAPS |
| bah56c09 | 11327 | 11328 | SNP |
| baak17g07 | 11331 | 11332 | size_poly (codominant) |
| bags20k09 | 11335 | 11336 | SNP |
| BaSD25B08 | 11339 | 11340 | SNP |
| bast27E0309 | 11343 | 11344 | SNP |
| baet20D0107 | 11347 | 11348 | SNP |
| BaAL17L08 | 11351 | 11352 | CAPS |
| bah61p18 | 11355 | 11356 | CAPS |
| bah63d12 | 11359 | 11360 | CAPS |
| BaAK26A03 | 11363 | 11364 | CAPS |
| baak26n10 | 11367 | 11368 | SNP |
| bast22B0204 | 11371 | 11372 | SNP |

TABLE 11-2-continued

| Name | Primers used (SEQ ID NO:) | | marker type |
|---|---|---|---|
| BaAL3C05 | 11375 | 11376 | SNP |
| BaGS38H14 | 11379 | 11380 | size_poly (codominant) |
| BaAL4D19 | 11383 | 11384 | CAPS |
| BaAK20B09 | 11387 | 11388 | SNP |
| BaAK37H01 | 11391 | 11392 | SNP |
| BaGS33P13 | 11395 | 11396 | SNP |
| basd13l12 | 11399 | 11400 | CAPS |
| bags11m01 | 11403 | 11404 | CAPS |
| BaGS18H09 | 11407 | 11408 | SNP |
| basd3d13 | 11411 | 11412 | CAPS |
| baal9m23 | 11415 | 11416 | CAPS |
| bags23f08 | 11419 | 11420 | CAPS |
| BaGS15L23 | 11423 | 11424 | CAPS |
| baak2k13 | 11427 | 11428 | CAPS |
| baak17d18 | 11431 | 11432 | SNP |
| bags13a12 | 11435 | 11436 | SNP |
| baak44g22 | 11439 | 11440 | CAPS |
| kr34F0212 | 11443 | 11444 | SNP |
| baal16d11 | 11447 | 11448 | SNP |
| bah22d04 | 11451 | 11452 | SNP |
| bah48m23 | 11455 | 11456 | size_poly (codominant) |
| basd15p13 | 11459 | 11460 | CAPS |
| BaGS6O07 | 11463 | 11464 | SNP |

TABLE 11-3

| Name | Primers used (SEQ ID NO:) | | marker type |
|---|---|---|---|
| BaH37O10 | 11467 | 11468 | SNP |
| bags21k10 | 11471 | 11472 | CAPS |
| bah56n18 | 11475 | 11476 | CAPS |
| baal9i11 | 11479 | 11480 | SNP |
| BaAL39N06 | 11483 | 11484 | SNP |
| bags9d05 | 11487 | 11488 | size_poly (codominant) |
| BaAL19I19 | 11491 | 11492 | SNP |
| basd12l11 | 11495 | 11496 | SNP |
| bastl46D1008 | 11499 | 11500 | SNP |
| BaH50H16 | 11503 | 11504 | SNP |
| bags9n05 | 11507 | 11508 | SNP |
| kr61B1103 | 11511 | 11512 | SNP |
| kr27B0103 | 11515 | 11516 | SNP |
| kr33H1115 | 11519 | 11520 | SNP |
| baak30l02 | 11523 | 11524 | SNP |
| bah55a12 | 11527 | 11528 | SNP |
| BaH26K14 | 11531 | 11532 | SNP |
| HVM3 | — | — | SSR |
| BaAK33K19 | 11535 | 11536 | CAPS |
| basd18m17 | 11539 | 11540 | SNP |
| BaH50G09 | 11543 | 11544 | CAPS |
| BaH53B03 | 11547 | 11548 | SNP |
| BaH54L11 | 11551 | 11552 | CAPS |
| basd13i14 | 11555 | 11556 | CAPS |
| bah56g09 | 11559 | 11560 | CAPS |
| bah41b06 | 11563 | 11564 | CAPS |
| bags14d19 | 11567 | 11568 | SNP |
| baal20f05 | 11571 | 11572 | SNP |
| BaH18H12 | 11575 | 11576 | SNP |
| baal9o21 | 11579 | 11580 | SNP |
| bags21a02 | 11583 | 11584 | SNP |
| BaAL3G19 | 11587 | 11588 | SNP |
| baal7a09 | 11591 | 11592 | SNP |
| BaAL29I16 | 11595 | 11596 | size_poly (codominant) |
| bast70B0804 | 11599 | 11600 | SNP |
| bags14n08 | 11603 | 11604 | CAPS |
| bastl14F0412 | 11607 | 11608 | SNP |
| BaAK36I12 | 11611 | 11612 | CAPS |
| baal3f19 | 11615 | 11616 | SNP |
| baal1e10 | 11619 | 11620 | SNP |
| bags6k02 | 11623 | 11624 | SNP |
| kr42H0315 | 11627 | 11628 | SNP |
| bah39p02 | 11631 | 11632 | SNP |
| BaGS9L14 | 11635 | 11636 | SNP |
| baal35l03 | 11639 | 11640 | SNP |
| basd12m15 | 11643 | 11644 | SNP |
| BaAK35P01 | 11647 | 11648 | SNP |

TABLE 11-3-continued

| Name | Primers used (SEQ ID NO:) | | marker type |
|---|---|---|---|
| basd11d18 | 11651 | 11652 | SNP |
| BaH38E07 | 11655 | 11656 | SNP |
| BaGS18H13 | 11659 | 11660 | SNP |
| bags18g16 | 11663 | 11664 | SNP |

TABLE 11-4

| Name | Primers used (SEQ ID NO:) | | marker type |
|---|---|---|---|
| bags27f21 | 11667 | 11668 | SNP |
| BaGS7M13 | 11671 | 11672 | CAPS |
| baal39c19 | 11675 | 11676 | SNP |
| baak46j05 | 11679 | 11680 | SNP |
| BaAK32D20 | 11683 | 11684 | CAPS |
| MWG058 | — | — | STS |
| BaGS18M02 | 11687 | 11688 | SNP |
| bags9c05 | 11691 | 11692 | size_poly (dominant) |
| baak46m13 | 11695 | 11696 | CAPS |
| bags35n16 | 11699 | 11700 | CAPS |
| bags39g08 | 11703 | 11704 | SNP |
| baal33a06 | 11707 | 11708 | CAPS |
| BaSD17F20 | 11711 | 11712 | CAPS |
| bags22i21 | 11715 | 11716 | CAPS |
| bah32g18 | 11719 | 11720 | SNP |
| BaAL37O23 | 11723 | 11724 | CAPS |
| bags22p03 | 11727 | 11728 | CAPS |
| bags38l18 | 11731 | 11732 | SNP |
| BaGS35C13 | 11735 | 11736 | SNP |
| bah47h04 | 11739 | 11740 | SNP |
| bags30m11 | 11743 | 11744 | SNP |
| BaH22L15 | 11747 | 11748 | SNP |
| bags39e15 | 11751 | 11752 | SNP |
| kr65H0816 | 11755 | 11756 | CAPS |
| basd11h11 | 11759 | 11760 | SNP |
| baak2b06 | 11763 | 11764 | SNP |
| Bmag353 | — | — | SSR |
| bags37j11 | 11767 | 11768 | CAPS |
| BaAK46L15 | 11771 | 11772 | CAPS |
| BaSD14A23 | 11775 | 11776 | SNP |
| bast25C0705 | 11779 | 11780 | SNP |
| bast21B1204 | 11783 | 11784 | SNP |
| bags1l16 | 11787 | 11788 | CAPS |
| BaAK21G02 | 11791 | 11792 | SNP |
| bastl26E1109 | 11795 | 11796 | SNP |
| basd13k24 | 11799 | 11800 | SNP |
| BaAL13F02 | 11803 | 11804 | SNP |
| bags13c10 | 11807 | 11808 | SNP |
| bags11o11 | 11811 | 11812 | SNP |
| BaAK36P01 | 11815 | 11816 | SNP |
| bah52d09 | 11819 | 11820 | SNP |
| BaGS26D18 | 11823 | 11824 | SNP |
| baak33c22 | 11827 | 11828 | SNP |
| basd1d10 | 11831 | 11832 | CAPS |
| baak11c22 | 11835 | 11836 | CAPS |
| bags34l06 | 11839 | 11840 | SNP |
| baak33j06 | 11843 | 11844 | CAPS |
| bags23a11 | 11847 | 11848 | CAPS |
| bags34f02 | 11851 | 11852 | CAPS |
| bags20p21 | 11855 | 11856 | SNP |
| bah52m01 | 11859 | 11860 | SNP |

TABLE 11-5

| Name | Primers used (SEQ ID NO:) | marker type |
|---|---|---|
| basd15d07 | 11863 11864 | SNP |
| BaAL20A14 | 11867 11868 | CAPS |
| BaGS21B04 | 11871 11872 | CAPS |
| HVM68 | — — | SSR |
| BaAL30B07 | 11875 11876 | SNP |
| basd11p10 | 11879 11880 | CAPS |
| BaGS33E17 | 11883 11884 | CAPS |

TABLE 11-5-continued

| Name | Primers used (SEQ ID NO:) | | marker type |
|---|---|---|---|
| kr67C0206 | 11887 | 11888 | SNP |
| bags15j20 | 11891 | 11892 | SNP |
| BaH15E05 | 11895 | 11896 | SNP |
| BaH58K02 | 11899 | 11900 | SNP |
| basd13d17 | 11903 | 11904 | SNP |
| BaGS17A15 | 11907 | 11908 | CAPS |
| BaAK30F13 | 11911 | 11912 | SNP |
| baal17m22 | 11915 | 11916 | CAPS |
| baak42f04 | 11919 | 11920 | CAPS |
| baal2n22 | 11923 | 11924 | SNP |
| kr30C0705 | 11927 | 11928 | SNP |
| BaSD19J21 | 11931 | 11932 | SNP |
| BaH34N22 | 11935 | 11936 | SNP |
| BaAK2I20 | 11939 | 11940 | CAPS |
| BaGS1E22 | 11943 | 11944 | SNP |
| baak34b17 | 11947 | 11948 | SNP |
| BaSD11L18 | 11951 | 11952 | CAPS |
| kr32A0202 | 11955 | 11956 | SNP |
| bags27h21 | 11959 | 11960 | SNP |
| bah62d17 | 11963 | 11964 | SNP |
| bah43e22 | 11967 | 11968 | SNP |
| BaAL30I23 | 11971 | 11972 | SNP |
| BaSD13H20 | 11975 | 11976 | CAPS |
| BaSD14O04 | 11979 | 11980 | CAPS |
| baak34p06 | 11983 | 11984 | SNP |
| bah63b08 | 11987 | 11988 | SNP |
| bastl03F0812 | 11991 | 11992 | SNP |
| basd14m17 | 11995 | 11996 | SNP |
| BaSD2J03 | 11999 | 12000 | SNP |
| bah13b17 | 12003 | 12004 | size_poly (codominant) |
| baal32b23 | 12007 | 12008 | SNP |
| bastl50D1208 | 12011 | 12012 | size_poly (codominant) |
| BaGS9H13 | 12015 | 12016 | CAPS |
| baal33e04 | 12019 | 12020 | CAPS |
| BaAL40L16 | 12023 | 12024 | CAPS |
| bah44n03 | 12027 | 12028 | SNP |
| bags20h05 | 12031 | 12032 | SNP |
| bags20l15 | 12035 | 12036 | SNP |
| BaGS7E03 | 12039 | 12040 | SNP |
| bags9k13 | 12043 | 12044 | CAPS |
| bast55E0709 | 12047 | 12048 | SNP |
| bags8a14 | 12051 | 12052 | CAPS |
| baak38k04 | 12055 | 12056 | SNP |
| BaH33B15 | 12059 | 12060 | CAPS |

TABLE 11-6

| Name | Primers used (SEQ ID ND:) | | marker type |
|---|---|---|---|
| bags29m17 | 12063 | 12064 | size_poly (codominant) |
| BaSD23P08 | 12067 | 12068 | CAPS |
| BaH42L12 | 12071 | 12072 | SNP |
| bast79G0313 | 12075 | 12076 | CAPS |
| baet46C0905 | 12079 | 12080 | SNP |
| baal4o09 | 12083 | 12084 | CAPS |
| bah26e10 | 12087 | 12088 | SNP |
| BaH32J04 | 12091 | 12092 | SNP |
| bags20l07 | 12095 | 12096 | SNP |
| kr18C0505 | 12099 | 12100 | SNP |
| basd11m24 | 12103 | 12104 | SNP |
| basd1i15 | 12107 | 12108 | SNP |
| bah45b02 | 12111 | 12112 | size_poly (codominant) |
| bast40C0206 | 12115 | 12116 | CAPS |
| baal40g05 | 12119 | 12120 | CAPS |
| bah13i21 | 12123 | 12124 | SNP |
| basd27o20 | 12127 | 12128 | SNP |
| BaAK12L24 | 12131 | 12132 | CAPS |
| BaAL12F24 | 12135 | 12136 | CAPS |
| baak45l08 | 12139 | 12140 | SNP |
| BaAL36N04 | 12143 | 12144 | SNP |
| baak41d17 | 12147 | 12148 | SNP |
| kr39E0810 | 12151 | 12152 | CAPS |
| BaGS32G16 | 12155 | 12156 | CAPS |

TABLE 11-6-continued

| Name | Primers used (SEQ ID ND:) | | marker type |
|---|---|---|---|
| BaGS25M06 | 12159 | 12160 | SNP |
| BaH36F21 | 12163 | 12164 | SNP |
| BaAK13B12 | 12167 | 12168 | SNP |
| baal29j18 | 12171 | 12172 | size_poly (codominant) |
| bast63B0604 | 12175 | 12176 | SNP |
| baak11n06 | 12179 | 12180 | SNP |
| kr13F1012 | 12183 | 12184 | SNP |
| bags20k06 | 12187 | 12188 | SNP |
| baak15p20 | 12191 | 12192 | SNP |
| bah18n11 | 12195 | 12196 | size_poly (codominant) |
| BaH23J08 | 12199 | 12200 | SNP |
| baet30B1004 | 12203 | 12204 | SNP |
| bags34p06 | 12207 | 12208 | size_poly (codominant) |
| bastl33H0816 | 12211 | 12212 | SNP |
| BaSD17I17 | 12215 | 12216 | size_poly (codominant) |
| basd19p22 | 12219 | 12220 | CAPS |
| bags4e03 | 12223 | 12224 | CAPS |
| BaAK36A13 | 12227 | 12228 | CAPS |
| bags33i03 | 12231 | 12232 | CAPS |
| BaAK14F03 | 12235 | 12236 | CAPS |
| BaAK42K19 | 12239 | 12240 | SNP |
| bast60A1101 | 12243 | 12244 | SNP |
| bah52l06 | 12247 | 12248 | SNP |
| bah23h10 | 12251 | 12252 | SNP |
| BaGS15O23 | 12255 | 12256 | SNP |
| BaAK20E08 | 12259 | 12260 | SNP |
| kr61A1202 | 12263 | 12264 | SNP |

TABLE 11-7

| Name | Primers used (SEQ ID NO:) | | marker type |
|---|---|---|---|
| bast03F0212 | 12267 | 12268 | SNP |
| bags39m22 | 12271 | 12272 | CAPS |
| BaAK30O17 | 12275 | 12276 | SNP |
| baak29a01 | 12279 | 12280 | CAPS |
| basd1e04 | 12283 | 12284 | CAPS |
| BaGS23K09 | 12287 | 12288 | CAPS |
| BaAL2N04 | 12291 | 12292 | SNP |
| BaH42C12 | 12295 | 12296 | CAPS |
| bah39o14 | 12299 | 12300 | size_poly (codominant) |
| bast26A1202 | 12303 | 12304 | size_poly (codominant) |
| BaGS30N15 | 12307 | 12308 | SNP |
| BaAL34D18 | 12311 | 12312 | SNP |
| baak15k23 | 12315 | 12316 | CAPS |
| bags37i06 | 12319 | 12320 | SNP |
| BaGS19N09 | 12323 | 12324 | SNP |
| BaSD13H09 | 12327 | 12328 | SNP |
| bags3h19 | 12331 | 12332 | CAPS |
| baak28o08 | 12335 | 12336 | SNP |
| BaH15K08 | 12339 | 12340 | SNP |
| HVM67 | — | — | SSR |
| bah17h20 | 12343 | 12344 | CAPS |
| BaAL5L13 | 12347 | 12348 | CAPS |
| BaGS31P13 | 12351 | 12352 | size_poly (dominant) |
| BaH28A11 | 12355 | 12356 | SNP |
| BaSD25E01 | 12359 | 12360 | SNP |
| sh | — | — | Trait |
| baet23F0111 | 12363 | 12364 | SNP |
| VRN2 | — | — | size_poly |
| bastl41C0806 | 12367 | 12368 | CAPS |
| basd11o04 | 12371 | 12372 | SNP |
| bags22kl7 | 12375 | 12376 | SNP |
| bastl27A1101 | 12379 | 12380 | size_poly (dominant) |
| bags22a16 | 12383 | 12384 | CAPS |
| BaAL5E04 | 12387 | 12388 | CAPS |
| baal39f20 | 12391 | 12392 | CAPS |
| baak43d13 | 12395 | 12396 | CAPS |
| baak41l23 | 12399 | 12400 | CAPS |
| baet23B0604 | 12403 | 12404 | CAPS |
| BaAK28I08 | 12407 | 12408 | CAPS |
| bastl26C1206 | 12411 | 12412 | SNP |
| bah27p20 | 12415 | 12416 | SNP |

TABLE 11-7-continued

| Name | Primers used (SEQ ID NO:) | | marker type |
|---|---|---|---|
| baal12d24 | 12419 | 12420 | SNP |
| bastl41F0511 | 12423 | 12424 | SNP |
| BaGS17E03 | 12427 | 12428 | CAPS |

TABLE 12-1

| Name | Primers used (SEQ ID NO:) | | marker type |
|---|---|---|---|
| baal10j04 | 12431 | 12432 | SNP |
| BaAK33J17 | 12435 | 12436 | SNP |
| BaAL21J19 | 12439 | 12440 | CAPS |
| bast17H0515 | 12443 | 12444 | SNP |
| bags22c02 | 12447 | 12448 | size_poly (codominant) |
| BaAK35A06 | 12451 | 12452 | SNP |
| BaGS11K08 | 12455 | 12456 | CAPS |
| bastl30A0602 | 12459 | 12460 | size_poly (codominant) |
| BaGS39H16 | 12463 | 12464 | CAPS |
| MWG502 | — | — | STS |
| BaAK18M22 | 12467 | 12468 | SNP |
| bast26G0614 | 12471 | 12472 | SNP |
| BaSD22F13 | 12475 | 12476 | SNP |
| BaAK28L16 | 12479 | 12480 | CAPS |
| bags35o06 | 12483 | 12484 | CAPS |
| bags13d07 | 12487 | 12488 | CAPS |
| BaAL24F18 | 12491 | 12492 | size_poly (codominant) |
| bah63l18 | 12495 | 12496 | SNP |
| BaGS9H22 | 12499 | 12500 | SNP |
| BaAK18A05 | 12503 | 12504 | CAPS |
| BaH38D03 | 12507 | 12508 | CAPS |
| BaH17N17 | 12511 | 12512 | SNP |
| bah18d08 | 12515 | 12516 | SNP |
| bags34a05 | 12519 | 12520 | SNP |
| bags1m23 | 12523 | 12524 | SNP |
| BaH50B05 | 12527 | 12528 | SNP |
| bags1h11 | 12531 | 12532 | SNP |
| BaH47G19 | 12535 | 12536 | CAPS |
| BaAK38H10 | 12539 | 12540 | CAPS |
| bah47e01 | 12543 | 12544 | SNP |
| bast52E0109 | 12547 | 12548 | SNP |
| bags1o08 | 12551 | 12552 | SNP |
| BaH31H16 | 12555 | 12556 | CAPS |
| baaK32l14 | 12559 | 12560 | SNP |
| BaH50O06 | 12563 | 12564 | SNP |
| BaSD26I01 | 12567 | 12568 | SNP |
| bags1h24 | 12571 | 12572 | SNP |
| basd27g16 | 12575 | 12576 | SNP |
| BaGS16G24 | 12579 | 12580 | CAPS |
| BaGS34C19 | 12583 | 12584 | SNP |
| bah20k17 | 12587 | 12588 | SNP |
| bah54e13 | 12591 | 12592 | size_poly (codominant) |
| bags35i06 | 12595 | 12596 | CAPS |
| bah29g09 | 12599 | 12600 | size_poly (codominant) |
| BaAK29C12 | 12603 | 12604 | SNP |
| bah56c06 | 12607 | 12608 | CAPS |
| baal6a09 | 12611 | 12612 | SNP |
| bags6j06 | 12615 | 12616 | CAPS |
| BaH30P15 | 12619 | 12620 | SNP |
| baak30k04 | 12623 | 12624 | CAPS |
| basd25d22 | 12627 | 12628 | SNP |

TABLE 12-2

| Name | Primers used (SEQ ID NO:) | | marker type |
|---|---|---|---|
| BaGS39M02 | 12631 | 12632 | CAPS |
| baak13n10 | 12635 | 12636 | SNP |
| BaGS18J21 | 12639 | 12640 | SNP |
| BaSD22G22 | 12643 | 12644 | size_poly (codominant) |
| bags18b17 | 12647 | 12648 | size_poly (codominant) |
| bags33j02 | 12651 | 12652 | SNP |

TABLE 12-2-continued

| Name | Primers used (SEQ ID NO:) | | marker type |
|---|---|---|---|
| baak36b16 | 12655 | 12656 | CAPS |
| bags37f05 | 12659 | 12660 | SNP |
| BaAL17L15 | 12663 | 12664 | SNP |
| BaGS20H12 | 12667 | 12668 | SNP |
| kr65A0802 | 12671 | 12672 | SNP |
| BaGS13E12 | 12675 | 12676 | size_poly (dominant) |
| basd3h06 | 12679 | 12680 | size_poly (codominant) |
| basd22j16 | 12683 | 12684 | SNP |
| bah39n18 | 12687 | 12688 | SNP |
| bags20d19 | 12691 | 12692 | SNP |
| BaGS34H19 | 12695 | 12696 | SNP |
| baak42n10 | 12699 | 12700 | SNP |
| BaSD24F03 | 12703 | 12704 | SNP |
| BaGS23N21 | 12707 | 12708 | SNP |
| BaAK45E04 | 12711 | 12712 | SNP |
| bags5n23 | 12715 | 12716 | SNP |
| bast52H1216 | 12719 | 12720 | SNP |
| bags22f23 | 12723 | 12724 | SNP |
| BaH38E02 | 12727 | 12728 | SNP |
| BaH50O07 | 12731 | 12732 | SNP |
| kr07C1006 | 12735 | 12736 | SNP |
| baak26a02 | 12739 | 12740 | SNP |
| BaAK2J22 | 12743 | 12744 | SNP |
| bah45h23 | 12747 | 12748 | SNP |
| bah11h09 | 12751 | 12752 | size_poly (dominant) |
| BaAK46M16 | 12755 | 12756 | SNP |
| bah55m23 | 12759 | 12760 | SNP |
| bah59c05 | 12763 | 12764 | SNP |
| basd11l17 | 12767 | 12768 | SNP |
| bah19e08 | 12771 | 12772 | SNP |
| BaAK21N24 | 12775 | 12776 | SNP |
| BaH50E09 | 12779 | 12780 | SNP |
| BaAK17P18 | 12783 | 12784 | SNP |
| BaAL7A04 | 12787 | 12788 | SNP |
| bast47B0303 | 12791 | 12792 | SNP |
| bah28o17 | 12795 | 12796 | SNP |
| bah37k03 | 12799 | 12800 | SNP |
| bastl38A0501 | 12803 | 12804 | SNP |
| bags23c03 | 12807 | 12808 | SNP |
| basd13j01 | 12811 | 12812 | SNP |
| bags21c02 | 12815 | 12816 | SNP |
| bah28l03 | 12819 | 12820 | CAPS |
| BaAK36B17 | 12823 | 12824 | CAPS |
| bags6k10 | 12827 | 12828 | SNP |
| BaAK32J23 | 12831 | 12832 | size_poly (codominant) |

TABLE 12-3

| Name | Primers used (SEQ ID NO:) | | marker type |
|---|---|---|---|
| bags9k18 | 12835 | 12836 | SNP |
| baal18c19 | 12839 | 12840 | CAPS |
| baak27p14 | 12843 | 12844 | SNP |
| BaGS30N21 | 12847 | 12848 | SNP |
| bah55p23 | 12851 | 12852 | SNP |
| bah54p22 | 12855 | 12856 | SNP |
| bags34f05 | 12859 | 12860 | SNP |
| Bmac113 | — | — | SSR |
| bags15i11 | 12863 | 12864 | CAPS |
| BaH26I21 | 12867 | 12868 | size_poly (codominant) |
| BaSD20M22 | 12871 | 12872 | CAPS |
| bah14a24 | 12875 | 12876 | SNP |
| BaH50J11 | 12879 | 12880 | SNP |
| bags7a20 | 12883 | 12884 | CAPS |
| bah25l12 | 12887 | 12888 | CAPS |
| bags6k09 | 12891 | 12892 | CAPS |
| BaGS29P21 | 12895 | 12896 | CAPS |
| bah58f18 | 12899 | 12900 | CAPS |
| bags39i18 | 12903 | 12904 | CAPS |
| basd22l21 | 12907 | 12908 | SNP |
| bags4o22 | 12911 | 12912 | CAPS |
| kr27E0909 | 12915 | 12916 | SNP |
| bastl41H0216 | 12919 | 12920 | SNP |

TABLE 12-3-continued

| Name | Primers used (SEQ ID NO:) | | marker type |
|---|---|---|---|
| baak36o17 | 12923 | 12924 | SNP |
| BaH31P15 | 12927 | 12928 | SNP |
| kr07D0208 | 12931 | 12932 | CAPS |
| bags9h03 | 12935 | 12936 | SNP |
| BaGS38M11 | 12939 | 12940 | CAPS |
| kr26C0705 | 12943 | 12944 | size_poly (dominant) |
| bags3k24 | 12947 | 12948 | CAPS |
| bah53e16 | 12951 | 12952 | CAPS |
| bags21n10 | 12955 | 12956 | CAPS |
| BaGS25E06 | 12959 | 12960 | CAPS |
| bah38n03 | 12963 | 12964 | CAPS |
| BaAK38G14 | 12967 | 12968 | CAPS |
| baal5a06 | 12971 | 12972 | CAPS |
| basd26d19 | 12975 | 12976 | CAPS |
| BaSD26D07 | 12979 | 12980 | SNP |
| BaH50G14 | 12983 | 12984 | CAPS |
| bah21h17 | 12987 | 12988 | SNP |
| bags5d21 | 12991 | 12992 | SNP |
| BaAK34D14 | 12995 | 12996 | SNP |
| baak18a16 | 12999 | 13000 | SNP |
| bags4b01 | 13003 | 13004 | SNP |
| bags38c19 | 13007 | 13008 | SNP |
| BaGS38J23 | 13011 | 13012 | CAPS |
| kr42D0208 | 13015 | 13016 | SNP |
| BaH33A16 | 13019 | 13020 | CAPS |
| bags10e03 | 13023 | 13024 | CAPS |
| bags14f17 | 13027 | 13028 | CAPS |
| BaAK35N11 | 13031 | 13032 | SNP |

TABLE 12-4

| Name | Primers used (SEQ ID NO:) | | marker type |
|---|---|---|---|
| bags26n10 | 13035 | 13036 | SNP |
| bags37n02 | 13039 | 13040 | SNP |
| baal39l05 | 13043 | 13044 | size_poly (dominant) |
| BaAK26L11 | 13047 | 13048 | SNP |
| BaH57C19 | 13051 | 13052 | SNP |
| bags7a01 | 13055 | 13056 | SNP |
| bah19l15 | 13059 | 13060 | SNP |
| baal4o02 | 13063 | 13064 | SNP |
| bah58a12 | 13067 | 13068 | SNP |
| HVM30 | — | — | SSR |
| bah11b08 | 13071 | 13072 | SNP |
| bags14m15 | 13075 | 13076 | SNP |
| baak1e17 | 13079 | 13080 | CAPS |
| bags14i11 | 13083 | 13084 | size_poly (codominant) |
| bastl04B1103 | 13087 | 13088 | SNP |
| bags13g08 | 13091 | 13092 | SNP |
| basd27p03 | 13095 | 13096 | SNP |
| bast38D0707 | 13099 | 13100 | SNP |
| baak35j18 | 13103 | 13104 | CAPS |
| baal19k05 | 13107 | 13108 | SNP |
| BaH19C21 | 13111 | 13112 | SNP |
| bah49g10 | 13115 | 13116 | SNP |
| bags14h08 | 13119 | 13120 | CAPS |
| bags23g18 | 13123 | 13124 | SNP |
| bags22o22 | 13127 | 13128 | SNP |
| BaAL20A03 | 13131 | 13132 | SNP |
| bags5e24 | 13135 | 13136 | SNP |
| bags5f11 | 13139 | 13140 | SNP |
| BaAK33B10 | 13143 | 13144 | SNP |
| BaSD15J20 | 13147 | 13148 | CAPS |
| bags38b22 | 13151 | 13152 | size_poly (codominant) |
| bah39b06 | 13155 | 13156 | CAPS |
| bags19j08 | 13159 | 13160 | CAPS |
| BaGS1G09 | 13163 | 13164 | CAPS |
| bah63j06 | 13167 | 13168 | CAPS |
| BaAL39J02 | 13171 | 13172 | SNP |
| BaSD27H14 | 13175 | 13176 | SNP |
| BaH50M01 | 13179 | 13180 | SNP |
| BaSD24E13 | 13183 | 13184 | SNP |
| baal5j24 | 13187 | 13188 | CAPS |

TABLE 12-4-continued

| Name | Primers used (SEQ ID NO:) | | marker type |
|---|---|---|---|
| bah15h18 | 13191 | 13192 | CAPS |
| bast62E0610 | 13195 | 13196 | CAPS |
| bah28k24 | 13199 | 13200 | SNP |
| bah47c11 | 13203 | 13204 | SNP |
| BaSD26M15 | 13207 | 13208 | SNP |
| bah60o02 | 13211 | 13212 | SNP |
| BaH50G06 | 13215 | 13216 | SNP |
| bast15G0913 | 13219 | 13220 | SNP |
| bah62n12 | 13223 | 13224 | size_poly (codominant) |
| baal10n23 | 13227 | 13228 | CAPS |
| bags20c12 | 13231 | 13232 | SNP |

TABLE 12-5

| Name | Primers used (SEQ ID NO:) | | marker type |
|---|---|---|---|
| basd16f13 | 13235 | 13236 | SNP |
| baak21h06 | 13239 | 13240 | CAPS |
| bags3b05 | 13243 | 13244 | CAPS |
| bags22p08 | 13247 | 13248 | SNP |
| BaH23N06 | 13251 | 13252 | SNP |
| bags29c08 | 13255 | 13256 | SNP |
| BaGS11O23 | 13259 | 13260 | SNP |
| baak16a11 | 13263 | 13264 | CAPS |
| baak15n22 | 13267 | 13268 | CAPS |
| BaAL18J13 | 13271 | 13272 | SNP |
| bah15m02 | 13275 | 13276 | SNP |
| baak38d20 | 13279 | 13280 | CAPS |
| BaSD12L21 | 13283 | 13284 | CAPS |
| kr68B1103 | 13287 | 13288 | SNP |
| BaAK28L22 | 13291 | 13292 | CAPS |
| bags15b10 | 13295 | 13296 | SNP |
| bags20h21 | 13299 | 13300 | SNP |
| BaAK29K06 | 13303 | 13304 | SNP |
| bags21l05 | 13307 | 13308 | CAPS |
| bah56j14 | 13311 | 13312 | SNP |
| basd15e02 | 13315 | 13316 | CAPS |
| bags3j24 | 13319 | 13320 | SNP |
| bags38m08 | 13323 | 13324 | SNP |
| bah11m18 | 13327 | 13328 | CAPS |
| bags35g06 | 13331 | 13332 | SNP |
| bags37b01 | 13335 | 13336 | SNP |
| BaAL19F02 | 13339 | 13340 | SNP |
| BaAL4D09 | 13343 | 13344 | SNP |
| BaAK30H10 | 13347 | 13348 | CAPS |
| bags38b16 | 13351 | 13352 | CAPS |
| bags27f15 | 13355 | 13356 | SNP |
| bags10k14 | 13359 | 13360 | SNP |
| bags22f10 | 13363 | 13364 | CAPS |
| baak38n21 | 13367 | 13368 | SNP |
| baak30e05 | 13371 | 13372 | SNP |
| bastl04A0101 | 13375 | 13376 | SNP |
| BaAK28P18 | 13379 | 13380 | SNP |
| BaGS34E01 | 13383 | 13384 | SNP |
| BaH54H04 | 13387 | 13388 | SNP |
| bah13o19 | 13391 | 13392 | SNP |
| BaAK29B22 | 13395 | 13396 | CAPS |
| BaAK27C16 | 13399 | 13400 | CAPS |
| BaGS22H13 | 13403 | 13404 | CAPS |
| BaSD27A15 | 13407 | 13408 | SNP |
| BaAK27E07 | 13411 | 13412 | CAPS |
| BaGS9N02 | 13415 | 13416 | SNP |
| Bmag223 | — | — | SSR |
| bags28o18 | 13419 | 13420 | CAPS |
| baal25b05 | 13423 | 13424 | CAPS |
| bastl30A0202 | 13427 | 13428 | SNP |
| bags37d20 | 13431 | 13432 | CAPS |

TABLE 12-6

| Name | Primers used (SEQ ID NO:) | | marker type |
|---|---|---|---|
| BaGS22K12 | 13435 | 13436 | SNP |
| BaAK13G12 | 13439 | 13440 | SNP |
| basd2a02 | 13443 | 13444 | CAPS |
| BaGS31L06 | 13447 | 13448 | CAPS |
| bags17j17 | 13451 | 13452 | CAPS |
| baal12j15 | 13455 | 13456 | SNP |
| BaAK19H14 | 13459 | 13460 | CAPS |
| BaH34J11 | 13463 | 13464 | SNP |
| BaGS30I11 | 13467 | 13468 | SNP |
| BaH49L06 | 13471 | 13472 | CAPS |
| baal18m24 | 13475 | 13476 | CAPS |
| baak15l06 | 13479 | 13480 | SNP |
| basd18o14 | 13483 | 13484 | SNP |
| bags24p22 | 13487 | 13488 | SNP |
| BaAL37A09 | 13491 | 13492 | SNP |
| bags5l01 | 13495 | 13496 | SNP |
| BaAK12P03 | 13499 | 13500 | SNP |
| baak21f10 | 13503 | 13504 | SNP |
| bastl30E0410 | 13507 | 13508 | SNP |
| kr25C0206 | 13511 | 13512 | SNP |
| baak4j01 | 13515 | 13516 | CAPS |
| BaAK27E01 | 13519 | 13520 | CAPS |
| bah54n06 | 13523 | 13524 | SNP |
| bags19p05 | 13527 | 13528 | CAPS |
| bast22F0311 | 13531 | 13532 | SNP |
| basd1m04 | 13535 | 13536 | SNP |
| bags35i04 | 13539 | 13540 | CAPS |
| baak41d01 | 13543 | 13544 | SNP |
| baal19m08 | 13547 | 13548 | CAPS |
| baak13j10 | 13551 | 13552 | SNP |
| baak44h11 | 13555 | 13556 | SNP |
| baal19j09 | 13559 | 13560 | SNP |
| baet37C1105 | 13563 | 13564 | SNP |
| baak12d06 | 13567 | 13568 | CAPS |
| basd23f10 | 13571 | 13572 | SNP |
| BaH41P07 | 13575 | 13576 | SNP |
| baak1g13 | 13579 | 13580 | SNP |
| basd14b04 | 13583 | 13584 | CAPS |
| bags22l14 | 13587 | 13588 | SNP |
| bast26E1210 | 13591 | 13592 | SNP |
| baet25F0911 | 13595 | 13596 | SNP |
| BaAK32N13 | 13599 | 13600 | SNP |
| BaSD2C09 | 13603 | 13604 | size_poly (codominant) |
| BaGS31P01 | 13607 | 13608 | SNP |
| baak30m11 | 13611 | 13612 | SNP |
| BaAK4N16 | 13615 | 13616 | size_poly (codominant) |
| bastl46F1012 | 13619 | 13620 | SNP |
| bags3e06 | 13623 | 13624 | SNP |
| bags31o10 | 13627 | 13628 | CAPS |
| bags33j12 | 13631 | 13632 | CAPS |
| BaGS30N07 | 13635 | 13636 | CAPS |

TABLE 12-7

| Name | Primers used (SEQ ID NO:) | | marker type |
|---|---|---|---|
| BaH37I18 | 13639 | 13640 | CAPS |
| baak46p24 | 13643 | 13644 | CAPS |
| baak46o19 | 13647 | 13648 | SNP |
| basd3c19 | 13651 | 13652 | SNP |
| bags30f01 | 13655 | 13656 | SNP |
| BaGS20F10 | 13659 | 13660 | CAPS |
| BaGS32D08 | 13663 | 13664 | SNP |
| BaAK23M23 | 13667 | 13668 | SNP |
| bah21a16 | 13671 | 13672 | SNP |
| BaAL3M08 | 13675 | 13676 | SNP |
| BaAK21I09 | 13679 | 13680 | SNP |
| baet33A0301 | 13683 | 13684 | SNP |
| baak24k02 | 13687 | 13688 | SNP |
| bah33p03 | 13691 | 13692 | CAPS |
| bast75D1208 | 13695 | 13696 | SNP |
| BaSD12K20 | 13699 | 13700 | size_poly (codominant) |
| bags34f06 | 13703 | 13704 | SNP |
| bags6f09 | 13707 | 13708 | SNP |
| bags7b10 | 13711 | 13712 | SNP |
| BaGS25H01 | 13715 | 13716 | CAPS |
| baak33m08 | 13719 | 13720 | CAPS |
| bags37e01 | 13723 | 13724 | SNP |
| bags32n20 | 13727 | 13728 | CAPS |
| BaH47A11 | 13731 | 13732 | CAPS |
| BaGS24M06 | 13735 | 13736 | SNP |
| bags22m23 | 13739 | 13740 | SNP |
| basd18d18 | 13743 | 13744 | SNP |
| bastl06F0212 | 13747 | 13748 | SNP |
| BaH49O16 | 13751 | 13752 | SNP |
| bags39e22 | 13755 | 13756 | CAPS |
| BaH38N06 | 13759 | 13760 | SNP |
| BaH56P16 | 13763 | 13764 | SNP |
| BaSD13O13 | 13767 | 13768 | SNP |
| bags19i06 | 13771 | 13772 | CAPS |
| bah34f11 | 13775 | 13776 | SNP |
| bags37g04 | 13779 | 13780 | SNP |
| basd11k21 | 13783 | 13784 | CAPS |
| HvLOX | — | — | SSR |
| baak43o03 | 13787 | 13788 | SNP |
| BaAL4J21 | 13791 | 13792 | SNP |
| BaH51J22 | 13795 | 13796 | SNP |
| bah58l03 | 13799 | 13800 | SNP |
| BaGS21M18 | 13803 | 13804 | SNP |
| BaGS31K06 | 13807 | 13808 | SNP |
| baal4o01* VRN2(sh2) | 13811 | 13812 | SNP |
| BaAK24H19 | 13815 | 13816 | size_poly (codominant) |
| BaGS17D21 | 13819 | 13820 | size_poly (codominant) |
| bah39o04 | 13823 | 13824 | SNP |
| baak46e06 | 13827 | 13828 | size_poly (codominant) |
| basd13j03 | 13831 | 13832 | CAPS |

TABLE 12-8

| Name | Primers used (SEQ ID NO:) | | marker type |
|---|---|---|---|
| bast14H0416 | 13835 | 13836 | SNP |
| BaSD18I03 | 13839 | 13840 | CAPS |
| bastl44H1115 | 13843 | 13844 | SNP |
| bast34D0608 | 13847 | 13848 | CAPS |
| BaGS30F06 | 13851 | 13852 | CAPS |
| bags21k16 | 13855 | 13856 | CAPS |
| BaH48G01 | 13859 | 13860 | CAPS |
| bags39a24 | 13863 | 13864 | CAPS |
| bags15i03 | 13867 | 13868 | size_poly (dominant) |
| bags23f02 | 13871 | 13872 | SNP |
| bastl40E1010 | 13875 | 13876 | SNP |
| bags17p10 | 13879 | 13880 | CAPS |
| BaH57L13 | 13883 | 13884 | CAPS |
| bags10e22 | 13887 | 13888 | size_poly (codominant) |
| bags4p07 | 13891 | 13892 | CAPS |
| bah63a08 | 13895 | 13896 | CAPS |
| baak12f13 | 13899 | 13900 | size_poly (dominant) |
| bah56j15 | 13903 | 13904 | CAPS |
| bah15e16 | 13907 | 13908 | SNP |
| BaH50F21 | 13911 | 13912 | CAPS |
| basd27o16 | 13915 | 13916 | SNP |
| kr66G0713 | 13919 | 13920 | SNP |
| baak46c17 | 13923 | 13924 | SNP |
| baet19C1206 | 13927 | 13928 | SNP |
| bags34e15 | 13931 | 13932 | CAPS |
| baal4d18 | 13935 | 13936 | size_poly (dominant) |
| bah13b13 | 13939 | 13940 | CAPS |
| BaGS26G20 | 13943 | 13944 | SNP |
| BaGS28C14 | 13947 | 13948 | SNP |
| kr61G1214 | 13951 | 13952 | SNP |
| bags9g08 | 13955 | 13956 | SNP |
| bags5p01 | 13959 | 13960 | SNP |
| BaAL4D04 | 13963 | 13964 | SNP |
| bah26p09 | 13967 | 13968 | CAPS |

TABLE 12-8-continued

| Name | Primers used (SEQ ID NO:) | | marker type |
|---|---|---|---|
| bah11e02 | 13971 | 13972 | SNP |
| MWG2077 | — | — | STS |
| bast41F0311 | 13975 | 13976 | SNP |
| bastl54D0307 | 13979 | 13980 | SNP |
| BaSD3F21 | 13983 | 13984 | size_poly (codominant) |
| bah56f18 | 13987 | 13988 | size_poly (codominant) |
| BaH41C21 | 13991 | 13992 | CAPS |
| basd19g21 | 13995 | 13996 | CAPS |
| kr33H0816 | 13999 | 14000 | SNP |
| BaH38F16 | 14003 | 14004 | SNP |
| BaGS21P09 | 14007 | 14008 | SNP |
| BaGS36M20 | 14011 | 14012 | CAPS |
| bags21m10 | 14015 | 14016 | CAPS |
| BaAK14G11 | 14019 | 14020 | CAPS |
| BaGS30L20 | 14023 | 14024 | CAPS |
| basd21g02 | 14027 | 14028 | SNP |
| bah22m17 | 14031 | 14032 | SNP |

TABLE 12-9

| Name | Primers used (SEQ ID NO:) | | marker type |
|---|---|---|---|
| BaGS9H19 | 14035 | 14036 | SNP |
| bah26m24 | 14039 | 14040 | SNP |
| BaH56D01 | 14043 | 14044 | SNP |
| bah53j08 | 14047 | 14048 | CAPS |
| bags21d10 | 14051 | 14052 | CAPS |
| bags9a01 | 14055 | 14056 | CAPS |
| baal9m13 | 14059 | 14060 | SNP |
| baak20m05 | 14063 | 14064 | size_poly (codominant) |
| baak21k16 | 14067 | 14068 | SNP |
| bags34d17 | 14071 | 14072 | CAPS |
| baal40k24 | 14075 | 14076 | CAPS |
| BaGS19O14 | 14079 | 14080 | SNP |
| baak35m03 | 14083 | 14084 | SNP |
| baak33o23 | 14087 | 14088 | SNP |
| kr57F1012 | 14091 | 14092 | SNP |
| bah53i05 | 14095 | 14096 | size_poly (codominant) |
| bags22l16 | 14099 | 14100 | SNP |
| baet43C0505 | 14103 | 14104 | SNP |
| BaH33H02 | 14107 | 14108 | CAPS |
| bastl22E1010 | 14111 | 14112 | SNP |
| BaH53N24 | 14115 | 14116 | SNP |
| baal8e24 | 14119 | 14120 | SNP |
| BaH62H21 | 14123 | 14124 | SNP |
| BaH42K01 | 14127 | 14128 | SNP |
| basd26p09 | 14131 | 14132 | SNP |
| bags4p18 | 14135 | 14136 | SNP |
| BaH60H14 | 14139 | 14140 | size_poly (codominant) |
| bast70D1107 | 14143 | 14144 | SNP |
| bah26i23 | 14147 | 14148 | SNP |
| baal39g02 | 14151 | 14152 | SNP |
| bags10e02 | 14155 | 14156 | CAPS |
| bags22c13 | 14159 | 14160 | SNP |
| bags35n03 | 14163 | 14164 | CAPS |
| BaAL16H03 | 14167 | 14168 | SNP |
| BaAL15N07 | 14171 | 14172 | CAPS |
| bags18o20 | 14175 | 14176 | SNP |
| bags37g12 | 14179 | 14180 | CAPS |
| bags22l12 | 14183 | 14184 | CAPS |
| BaAK44K01 | 14187 | 14188 | CAPS |
| BaAK31G07 | 14191 | 14192 | CAPS |
| bah53n21 | 14195 | 14196 | CAPS |
| BaGS19C02 | 14199 | 14200 | SNP |
| BaH52E20 | 14203 | 14204 | SNP |
| BaAL4N05 | 14207 | 14208 | SNP |
| bags7p06 | 14211 | 14212 | SNP |
| bast70C0905 | 14215 | 14216 | SNP |
| BaSD15J01 | 14219 | 14220 | SNP |
| BaH56H18 | 14223 | 14224 | SNP |
| BaGS4N04 | 14227 | 14228 | SNP |
| bags31o13 | 14231 | 14232 | SNP |
| kr29D0107 | 14235 | 14236 | CAPS |

TABLE 12-10

| Name | Primers used (SEQ ID NO:) | | marker type |
|---|---|---|---|
| BaAK21A15 | 14239 | 14240 | size_poly (codominant) |
| bags7h14 | 14243 | 14244 | SNP |
| basd26b20 | 14247 | 14248 | size_poly (codominant) |
| baal1g06 | 14251 | 14252 | size_poly (codominant) |
| bags5n14 | 14255 | 14256 | SNP |
| BaAK34H17 | 14259 | 14260 | size_poly (dominant) |
| bastl32H0816 | 14263 | 14264 | SNP |
| basd18m12 | 14267 | 14268 | size_poly (codominant) |
| baak31p06 | 14271 | 14272 | SNP |
| bah52i03 | 14275 | 14276 | CAPS |
| BaAK33K05 | 14279 | 14280 | CAPS |
| BaAK44J08 | 14283 | 14284 | SNP |
| baak18g16 | 14287 | 14288 | SNP |
| baak11a11 | 14291 | 14292 | SNP |
| BaH25B20 | 14295 | 14296 | size_poly (codominant) |
| bastl12G0113 | 14299 | 14300 | CAPS |
| baal9n02 | 14303 | 14304 | SNP |
| bags20f08 | 14307 | 14308 | SNP |
| BaGS9C24 | 14311 | 14312 | SNP |
| BaGS22O02 | 14315 | 14316 | SNP |
| baak13k16 | 14319 | 14320 | CAPS |
| MWG2249 | — | — | STS |
| bah41b17 | 14323 | 14324 | SNP |
| bah63m11 | 14327 | 14328 | SNP |
| BaGS28P07 | 14331 | 14332 | SNP |
| bags1h15 | 14335 | 14336 | CAPS |
| kr26H0515 | 14339 | 14340 | CAPS |
| bags6n05 | 14343 | 14344 | size_poly (codominant) |
| BaH24P17 | 14347 | 14348 | CAPS |
| bast03D0408 | 14351 | 14352 | SNP |
| BaAL17G06 | 14355 | 14356 | SNP |
| BaH32G11 | 14359 | 14360 | CAPS |
| BaGS4P17 | 14363 | 14364 | SNP |
| baal31o21 | 14367 | 14368 | SNP |
| BaGS36A16 | 14371 | 14372 | CAPS |
| bags4d11 | 14375 | 14376 | SNP |
| basd13n18 | 14379 | 14380 | SNP |
| basd0a08 | 14383 | 14384 | SNP |
| BaGS32P24 | 14387 | 14388 | SNP |
| baak12i02 | 14391 | 14392 | CAPS |
| kr06H0315 | 14395 | 14396 | SNP |
| BaAL26B09 | 14399 | 14400 | SNP |
| kr32C1105 | 14403 | 14404 | SNP |
| BaH53B15 | 14407 | 14408 | SNP |
| bags13h04 | 14411 | 14412 | SNP |
| baal15i11 | 14415 | 14416 | SNP |
| bags1m19 | 14419 | 14420 | CAPS |
| HVM6 | — | — | SSR |

TABLE 13-1

| Name | Primers used (SEQ ID NO:) | | marker type |
|---|---|---|---|
| MWG620 | — | — | STS |
| basd14f03 | 14423 | 14424 | CAPS |
| BaH30P12 | 14427 | 14428 | SNP |
| BaH59J05 | 14431 | 14432 | SNP |
| BaAL39O22 | 14435 | 14436 | SNP |
| baal16i24 | 14439 | 14440 | CAPS |
| BaAL30P12 | 14443 | 14444 | CAPS |
| BaGS21H12 | 14447 | 14448 | CAPS |
| BaAK15J05 | 14451 | 14452 | size_poly (codominant) |
| BaGS9G15 | 14455 | 14456 | CAPS |
| BaAK41J04 | 14459 | 14460 | CAPS |
| baak43j24 | 14463 | 14464 | SNP |
| bah26n19 | 14467 | 14468 | size_poly (dominant) |
| Bmac316 | — | — | SSR |
| bags38a05 | 14471 | 14472 | CAPS |
| BaH43I06 | 14475 | 14476 | CAPS |
| bags9j07 | 14479 | 14480 | CAPS |
| baak31p11 | 14483 | 14484 | CAPS |
| BaGS17P19 | 14487 | 14488 | CAPS |
| baal32j05 | 14491 | 14492 | CAPS |

TABLE 13-1-continued

| Name | Primers used (SEQ ID NO:) | | marker type |
|---|---|---|---|
| baal16l16 | 14495 | 14496 | CAPS |
| baal6a11 | 14499 | 14500 | CAPS |
| bah55p06 | 14503 | 14504 | CAPS |
| bags8f03 | 14507 | 14508 | CAPS |
| bags3m02 | 14511 | 14512 | SNP |
| BaAL36L08 | 14515 | 14516 | SNP |
| baet19E0309 | 14519 | 14520 | SNP |
| BaSD18J06 | 14523 | 14524 | size_poly (codominant) |
| bast48D0307 | 14527 | 14528 | SNP |
| kr55D0707 | 14531 | 14532 | SNP |
| BaAL4B09 | 14535 | 14536 | CAPS |
| bags32f21 | 14539 | 14540 | CAPS |
| BaGS24F04 | 14543 | 14544 | SNP |
| BaGS10G07 | 14547 | 14548 | CAPS |
| BaGS26P07 | 14551 | 14552 | SNP |
| bags12f11 | 14555 | 14556 | SNP |
| MWG2218 | — | — | STS |
| BaH63O04 | 14559 | 14560 | CAPS |
| BaGS26D21 | 14563 | 14564 | CAPS |
| bags20o14 | 14567 | 14568 | SNP |
| baak36d08 | 14571 | 14572 | SNP |
| bast75H0616 | 14575 | 14576 | SNP |
| basd16g17 | 14579 | 14580 | SNP |
| baal4k16 | 14583 | 14584 | CAPS |
| bags32b14 | 14587 | 14588 | CAPS |
| baal4d01 | 14591 | 14592 | CAPS |
| baal7d23 | 14595 | 14596 | CAPS |
| BaH62C20 | 14599 | 14600 | size_poly (codominant) |
| BaH21K13 | 14603 | 14604 | SNP |
| BaAK14J02 | 14607 | 14608 | SNP |
| bah22c08 | 14611 | 14612 | SNP |

TABLE 13-2

| Name | Primers used (SEQ ID NO:) | | marker type |
|---|---|---|---|
| baak25d07 | 14615 | 14616 | CAPS |
| BaAK29M05 | 14619 | 14620 | CAPS |
| BaGS31I08 | 14623 | 14624 | CAPS |
| bah12n12 | 14627 | 14628 | SNP |
| baal30o06 | 14631 | 14632 | CAPS |
| baak13n14 | 14635 | 14636 | CAPS |
| bags7a09 | 14639 | 14640 | CAPS |
| baak32l04 | 14643 | 14644 | SNP |
| bah31o16 | 14647 | 14648 | CAPS |
| BaAL7C19 | 14651 | 14652 | SNP |
| BaAK23F04 | 14655 | 14656 | SNP |
| kr40D0707 | 14659 | 14660 | CAPS |
| basd0g08 | 14663 | 14664 | SNP |
| BaAL30H03 | 14667 | 14668 | CAPS |
| BaAL21B21 | 14671 | 14672 | SNP |
| BaGS30E05 | 14675 | 14676 | SNP |
| BaAK13G04 | 14679 | 14680 | SNP |
| BaGS27N11 | 14683 | 14684 | size_poly (dominant) |
| BaGS9A04 | 14687 | 14688 | SNP |
| BaAK23M11 | 14691 | 14692 | SNP |
| basd3f22 | 14695 | 14696 | CAPS |
| baak41p21 | 14699 | 14700 | SNP |
| BaAK41K07 | 14703 | 14704 | CAPS |
| BaH53I11 | 14707 | 14708 | CAPS |
| baak26j14 | 14711 | 14712 | SNP |
| BaAL18N03 | 14715 | 14716 | CAPS |
| baak40c08 | 14719 | 14720 | CAPS |
| bags17l19 | 14723 | 14724 | CAPS |
| BaSD25N02 | 14727 | 14728 | size_poly (codominant) |
| BaAK37E04 | 14731 | 14732 | SNP |
| baal33h17 | 14735 | 14736 | CAPS |
| bags20d08 | 14739 | 14740 | CAPS |
| BaGS4J01 | 14743 | 14744 | CAPS |
| bah48o03 | 14747 | 14748 | SNP |
| bastl31A0901 | 14751 | 14752 | SNP |
| bah20k22 | 14755 | 14756 | SNP |
| BaGS15J17 | 14759 | 14760 | size_poly (dominant) |

TABLE 13-2-continued

| Name | Primers used (SEQ ID NO:) | | marker type |
|---|---|---|---|
| BaAK17I01 | 14763 | 14764 | CAPS |
| BaAK30F08 | 14767 | 14768 | CAPS |
| bah47a17 | 14771 | 14772 | SNP |
| basd15e10 | 14775 | 14776 | SNP |
| BaH56C11 | 14779 | 14780 | SNP |
| BaH18C17 | 14783 | 14784 | SNP |
| BaGS20G24 | 14787 | 14788 | SNP |
| bags19g17 | 14791 | 14792 | CAPS |
| BaAK21L02 | 14795 | 14796 | CAPS |
| BaH52H21 | 14799 | 14800 | SNP |
| bags9l13 | 14803 | 14804 | CAPS |
| BaSD18C12 | 14807 | 14808 | SNP |
| baak23k07 | 14811 | 14812 | SNP |
| bags16j16 | 14815 | 14816 | SNP |

TABLE 13-3

| Name | Primers used (SEQ ID NO:) | | marker type |
|---|---|---|---|
| BaSD15O17 | 14819 | 14820 | SNP |
| baak12i20 | 14823 | 14824 | CAPS |
| BaAK3M04 | 14827 | 14828 | CAPS |
| BaGS4N23 | 14831 | 14832 | SNP |
| baak34k24 | 14835 | 14836 | CAPS |
| bah15n23 | 14839 | 14840 | CAPS |
| baak45i02 | 14843 | 14844 | CAPS |
| basd13i08 | 14847 | 14848 | SNP |
| BaSD17P01 | 14851 | 14852 | SNP |
| HVM31 | — | — | SSR |
| baak13d19 | 14855 | 14856 | SNP |
| baal3h14 | 14859 | 14860 | SNP |
| bags33j18 | 14863 | 14864 | SNP |
| BaH45B01 | 14867 | 14868 | CAPS |
| baak21n07 | 14871 | 14872 | SNP |
| BaH36H18 | 14875 | 14876 | size_poly (codominant) |
| BaAL23O14 | 14879 | 14880 | CAPS |
| bah53f05 | 14883 | 14884 | SNP |
| baak12d02 | 14887 | 14888 | SNP |
| bags11h12 | 14891 | 14892 | SNP |
| baet01F1212 | 14895 | 14896 | SNP |
| baak17l11 | 14899 | 14900 | SNP |
| basd20e17 | 14903 | 14904 | SNP |
| bah29p24 | 14907 | 14908 | SNP |
| bags30o05 | 14911 | 14912 | SNP |
| kr68D0208 | 14915 | 14916 | SNP |
| bags37l11 | 14919 | 14920 | SNP |
| baal4d14 | 14923 | 14924 | CAPS |
| BaH58I23 | 14927 | 14928 | SNP |
| bags39l04 | 14931 | 14932 | SNP |
| baak29j13 | 14935 | 14936 | CAPS |
| bags20p18 | 14939 | 14940 | CAPS |
| BaAK12J13 | 14943 | 14944 | CAPS |
| BaH13K17 | 14947 | 14948 | size_poly (codominant) |
| bah60p09 | 14951 | 14952 | SNP |
| BaH27N11 | 14955 | 14956 | CAPS |
| BaGS34D11 | 14959 | 14960 | CAPS |
| BaGS39G07 | 14963 | 14964 | CAPS |
| bah22o14 | 14967 | 14968 | SNP |
| bah14l20 | 14971 | 14972 | SNP |
| bah42p22 | 14975 | 14976 | SNP |
| BaAK21G03 | 14979 | 14980 | SNP |
| BaAL35D24 | 14983 | 14984 | SNP |
| baak45h14 | 14987 | 14988 | SNP |
| bags28o05 | 14991 | 14992 | SNP |
| BaAK31P07 | 14995 | 14996 | SNP |
| bah36c06 | 14999 | 15000 | SNP |
| BaGS37H24 | 15003 | 15004 | SNP |
| bast65B0303 | 15007 | 15008 | SNP |
| BaH51A22 | 15011 | 15012 | SNP |
| BaGS39K23 | 15015 | 15016 | SNP |

TABLE 13-4

| Name | Primers used (SEQ ID NO:) | | marker type |
|---|---|---|---|
| BaSD14O12 | 15019 | 15020 | SNP |
| BaH57F12 | 15023 | 15024 | SNP |
| BaGS32G02 | 15027 | 15028 | CAPS |
| BaAL40N06 | 15031 | 15032 | SNP |
| bah11b14 | 15035 | 15036 | SNP |
| bah15j14 | 15039 | 15040 | SNP |
| bast21C1105 | 15043 | 15044 | CAPS |
| bags29f03 | 15047 | 15048 | CAPS |
| BaAK46B16 | 15051 | 15052 | CAPS |
| basd11p22 | 15055 | 15056 | CAPS |
| baal16h16 | 15059 | 15060 | CAPS |
| BaSD21L07 | 15063 | 15064 | SNP |
| BaH42D07 | 15067 | 15068 | SNP |
| BaGS23K24 | 15071 | 15072 | SNP |
| BaAK24L01 | 15075 | 15076 | SNP |
| BaAL11H22 | 15079 | 15080 | SNP |
| BaAL13O24 | 15083 | 15084 | CAPS |
| BaAL6M22 | 15087 | 15088 | SNP |
| BaH56I06 | 15091 | 15092 | size_poly (codominant) |
| BaSD19A18 | 15095 | 15096 | size_poly (dominant) |
| BaSD20P03 | 15099 | 15100 | SNP |
| BaH19B13 | 15103 | 15104 | SNP |
| kr59H0416 | 15107 | 15108 | SNP |
| BaGS14A02 | 15111 | 15112 | SNP |
| BaH34P05 | 15115 | 15116 | SNP |
| bah61o16 | 15119 | 15120 | SNP |
| BaH24N07 | 15123 | 15124 | SNP |
| BaAL20M22 | 15127 | 15128 | CAPS |
| BaAL11H20 | 15131 | 15132 | SNP |
| bah54b04 | 15135 | 15136 | SNP |
| BaAK14H23 | 15139 | 15140 | size_poly (dominant) |
| BaSD20M23 | 15143 | 15144 | SNP |
| BaAL15B12 | 15147 | 15148 | CAPS |
| baal15d09 | 15151 | 15152 | SNP |
| baak39n20 | 15155 | 15156 | SNP |
| BaH43N16 | 15159 | 15160 | SNP |
| bags39h18 | 15163 | 15164 | CAPS |
| BaAL3L23 | 15167 | 15168 | CAPS |
| basd22c03 | 15171 | 15172 | SNP |
| bast55G0913 | 15175 | 15176 | CAPS |
| kr47F0511 | 15179 | 15180 | SNP |
| bah15l24 | 15183 | 15184 | size_poly (codominant) |
| bast77A0402 | 15187 | 15188 | SNP |
| BaH58F04 | 15191 | 15192 | SNP |
| BaAK30L09 | 15195 | 15196 | SNP |
| kr39G1113 | 15199 | 15200 | SNP |
| baak1c16 | 15203 | 15204 | SNP |
| basd20e05 | 15207 | 15208 | SNP |
| BaAK12F18 | 15211 | 15212 | SNP |
| BaH50L11 | 15215 | 15216 | CAPS |
| bast50G0814 | 15219 | 15220 | CAPS |

TABLE 13-5

| Name | Primers used (SEQ ID NO:) | | marker type |
|---|---|---|---|
| bast70D0107 | 15223 | 15224 | SNP |
| baal17d05 | 15227 | 15228 | SNP |
| baak46g03 | 15231 | 15232 | SNP |
| bah63m17 | 15235 | 15236 | SNP |
| BaH15L15 | 15239 | 15240 | SNP |
| BaGS19N01 | 15243 | 15244 | SNP |
| BaAK32P07 | 15247 | 15248 | SNP |
| bags14l13 | 15251 | 15252 | SNP |
| bags37o24 | 15255 | 15256 | SNP |
| baal5e24 | 15259 | 15260 | CAPS |
| BaH46B06 | 15263 | 15264 | CAPS |
| bags11a16 | 15267 | 15268 | CAPS |
| baal27m03 | 15271 | 15272 | SNP |
| BaAK1C18 | 15275 | 15276 | SNP |
| BaAK38H16 | 15279 | 15280 | size_poly (codominant) |
| BaGS37K02 | 15283 | 15284 | CAPS |
| bah28a10 | 15287 | 15288 | CAPS |

TABLE 13-5-continued

| Name | Primers used (SEQ ID NO:) | | marker type |
|---|---|---|---|
| bah27c03 | 15291 | 15292 | CAPS |
| BaH52B11 | 15295 | 15296 | SNP |
| bah27f05 | 15299 | 15300 | SNP |
| bags37g15 | 15303 | 15304 | CAPS |
| bah59c10 | 15307 | 15308 | SNP |
| bags38j06 | 15311 | 15312 | SNP |
| basd14e01 | 15315 | 15316 | SNP |
| BaGS24L06 | 15319 | 15320 | size_poly (codominant) |
| bags17b02 | 15323 | 15324 | CAPS |
| BaH54L03 | 15327 | 15328 | CAPS |
| BaAK21J17 | 15331 | 15332 | CAPS |
| BaGS23G08 | 15335 | 15336 | CAPS |
| basd18e06 | 15339 | 15340 | SNP |
| baak19o02 | 15343 | 15344 | size_poly (codominant) |
| basd2o16 | 15347 | 15348 | SNP |
| baak16e08 | 15351 | 15352 | SNP |
| bags18h01 | 15355 | 15356 | SNP |
| BaGS4L20 | 15359 | 15360 | SNP |
| BaAL2M19 | 15363 | 15364 | CAPS |
| BaH36F15 | 15367 | 15368 | CAPS |
| bah58l07 | 15371 | 15372 | CAPS |
| baet29C0406 | 15375 | 15376 | CAPS |
| BaAK35B04 | 15379 | 15380 | CAPS |
| bags34k13 | 15383 | 15384 | CAPS |
| baal29i08 | 15387 | 15388 | CAPS |
| baak11p10 | 15391 | 15392 | CAPS |
| BaH30J08 | 15395 | 15396 | SNP |
| bags4e12 | 15399 | 15400 | CAPS |
| bastl05C1206 | 15403 | 15404 | size_poly (codominant) |
| bast22G0313 | 15407 | 15408 | SNP |
| basd24b08 | 15411 | 15412 | CAPS |
| bastl16C0206 | 15415 | 15416 | size_poly (codominant) |
| bags33n21 | 15419 | 15420 | SNP |
| baak33c11 | 15423 | 15424 | SNP |

TABLE 13-6

| Name | Primers used (SEQ ID NO:) | | marker type |
|---|---|---|---|
| baal13o10 | 15427 | 15428 | CAPS |
| BaH36P06 | 15431 | 15432 | SNP |
| basd12l01 | 15435 | 15436 | SNP |
| baet25H0115 | 15439 | 15440 | SNP |
| bags15d14 | 15443 | 15444 | CAPS |
| BaGS37E09 | 15447 | 15448 | CAPS |
| BaAK29I15 | 15451 | 15452 | SNP |
| BaAK18I01 | 15455 | 15456 | SNP |
| bast62B0404 | 15459 | 15460 | SNP |
| bah25l03 | 15463 | 15464 | SNP |
| BaGS19I11 | 15467 | 15468 | CAPS |
| baal1n11 | 15471 | 15472 | SNP |
| baak16l07 | 15475 | 15476 | SNP |
| BaGS18P04 | 15479 | 15480 | CAPS |
| bags19e06 | 15483 | 15484 | CAPS |
| baak35n07 | 15487 | 15488 | CAPS |
| BaAK29K23 | 15491 | 15492 | SNP |
| baal13c18 | 15495 | 15496 | SNP |
| bags7d17 | 15499 | 15500 | SNP |
| bags20j08 | 15503 | 15504 | SNP |
| baal9c20 | 15507 | 15508 | SNP |
| bags20l05 | 15511 | 15512 | SNP |
| bah63k05 | 15515 | 15516 | size_poly (codominant) |
| BaAK14C17 | 15519 | 15520 | CAPS |
| Bmac40 | — | — | SSR |
| baal15j23 | 15523 | 15524 | SNP |
| BaAK1N06 | 15527 | 15528 | CAPS |
| bags38d10 | 15531 | 15532 | CAPS |
| BaAK19J15 | 15535 | 15536 | CAPS |
| BaH50L14 | 15539 | 15540 | SNP |
| BaGS37E11 | 15543 | 15544 | SNP |
| BaSD27E20 | 15547 | 15548 | SNP |
| basd17f18 | 15551 | 15552 | SNP |
| baal32m04 | 15555 | 15556 | SNP |

TABLE 13-6-continued

| Name | Primers used (SEQ ID NO:) | | marker type |
|---|---|---|---|
| BaSD12L12 | 15559 | 15560 | CAPS |
| BaGS37D24 | 15563 | 15564 | CAPS |
| BaGS9K15 | 15567 | 15568 | CAPS |
| BaGS33L03 | 15571 | 15572 | CAPS |
| BaAK24G10 | 15575 | 15576 | SNP |
| kr58F0511 | 15579 | 15580 | CAPS |
| BaH50F16 | 15583 | 15584 | SNP |
| basd17d11 | 15587 | 15588 | SNP |
| BaH37P24 | 15591 | 15592 | SNP |
| bah47l21 | 15595 | 15596 | SNP |
| baet45C1105 | 15599 | 15600 | SNP |
| baak39o18 | 15603 | 15604 | CAPS |
| bags20p12 | 15607 | 15608 | CAPS |
| bags38f23 | 15611 | 15612 | CAPS |
| baak14b08 | 15615 | 15616 | SNP |
| bah54n10 | 15619 | 15620 | SNP |
| bags3k09 | 15623 | 15624 | CAPS |

TABLE 13-7

| Name | Primers used (SEQ ID NO:) | | marker type |
|---|---|---|---|
| bags34p08 | 15627 | 15628 | SNP |
| baal1e06 | 15631 | 15632 | SNP |
| baak34p14 | 15635 | 15636 | CAPS |
| baak14k12 | 15639 | 15640 | CAPS |
| BaSD13G17 | 15643 | 15644 | size_poly (codominant) |
| MWG897 | — | — | STS |
| bags27h05 | 15647 | 15648 | size_poly (codominant) |
| basd15m11 | 15651 | 15652 | CAPS |
| BaH28G09 | 15655 | 15656 | CAPS |
| bags21b06 | 15659 | 15660 | CAPS |
| basd12g17 | 15663 | 15664 | size_poly (codominant) |
| BaH18F07 | 15667 | 15668 | CAPS |
| BaH44A23 | 15671 | 15672 | CAPS |
| bags3d07 | 15675 | 15676 | CAPS |
| BaAL6A21 | 15679 | 15680 | SNP |
| BaAK24E07 | 15683 | 15684 | CAPS |
| BaAL29L09 | 15687 | 15688 | SNP |
| kr66D1107 | 15691 | 15692 | SNP |
| bastl47C0606 | 15695 | 15696 | SNP |
| BaH50M03 | 15699 | 15700 | SNP |
| basd27k17 | 15703 | 15704 | SNP |

TABLE 14-1

| Name | Primers used (SEQ ID NO:) | | marker type |
|---|---|---|---|
| basd2p19 | 15707 | 15708 | SNP |
| BaAK38B18 | 15711 | 15712 | size_poly (dominant) |
| bah42i06 | 15715 | 15716 | CAPS |
| bags6f02 | 15719 | 15720 | SNP |
| BaAK39J07 | 15723 | 15724 | SNP |
| BaAK1L23 | 15727 | 15728 | CAPS |
| baak17e10 | 15731 | 15732 | SNP |
| BaH50H08 | 15735 | 15736 | SNP |
| baal17e10 | 15739 | 15740 | SNP |
| BaSD17C05 | 15743 | 15744 | SNP |
| BaGS14P02 | 15747 | 15748 | SNP |
| bastl42H0115 | 15751 | 15752 | SNP |
| BaAK19C08 | 15755 | 15756 | SNP |
| bastl40H1115 | 15759 | 15760 | SNP |
| bags12l21 | 15763 | 15764 | CAPS |
| baak12j24 | 15767 | 15768 | CAPS |
| bags14d22 | 15771 | 15772 | CAPS |
| BaAK21P12 | 15775 | 15776 | SNP |
| baal6b02 | 15779 | 15780 | CAPS |
| baak29f13 | 15783 | 15784 | CAPS |
| bast79C0406 | 15787 | 15788 | SNP |
| BaH45M08 | 15791 | 15792 | SNP |

TABLE 14-1-continued

| Name | Primers used (SEQ ID NO:) | | marker type |
|---|---|---|---|
| kr28A0301 | 15795 | 15796 | SNP |
| bags19e04 | 15799 | 15800 | CAPS |
| BaH28L07 | 15803 | 15804 | CAPS |
| baak21m18 | 15807 | 15808 | CAPS |
| baak21l22 | 15811 | 15812 | SNP |
| basd15h01 | 15815 | 15816 | SNP |
| BaH19O11 | 15819 | 15820 | SNP |
| BaH59A20 | 15823 | 15824 | CAPS |
| bags39l05 | 15827 | 15828 | SNP |
| BaAK31N06 | 15831 | 15832 | CAPS |
| BaH58P03 | 15835 | 15836 | SNP |
| bags29c18 | 15839 | 15840 | CAPS |
| BaAL4O04 | 15843 | 15844 | SNP |
| bags37n23 | 15847 | 15848 | CAPS |
| BaAL39N03 | 15851 | 15852 | size_poly (codominant) |
| BaAK14C23 | 15855 | 15856 | SNP |
| kr61A1101 | 15859 | 15860 | SNP |
| BaH42J17 | 15863 | 15864 | SNP |
| BaH58H08 | 15867 | 15868 | SNP |
| bast78A0202 | 15871 | 15872 | SNP |
| BaGS21E20 | 15875 | 15876 | CAPS |
| bags22k18 | 15879 | 15880 | size_poly (codominant) |
| BaGS33H15 | 15883 | 15884 | size_poly (codominant) |
| HVM4 | — | — | SSR |
| BaSD18O16 | 15887 | 15888 | SNP |
| baak22j11 | 15891 | 15892 | SNP |
| BaAK20K04 | 15895 | 15896 | SNP |
| bags29l11 | 15899 | 15900 | SNP |
| BaAK17G18 | 15903 | 15904 | size_poly (dominant) |

TABLE 14-2

| Name | Primers used (SEQ ID NO:) | | marker type |
|---|---|---|---|
| baak14o13 | 15907 | 15908 | SNP |
| baal8d17 | 15911 | 15912 | size_poly (codominant) |
| BaAK37P20 | 15915 | 15916 | CAPS |
| bags28k04 | 15919 | 15920 | SNP |
| bah34b22 | 15923 | 15924 | CAPS |
| BaGS37M03 | 15927 | 15928 | SNP |
| BaGS18C14 | 15931 | 15932 | SNP |
| bast23G0214 | 15935 | 15936 | SNP |
| bah47p02 | 15939 | 15940 | SNP |
| baak42a24 | 15943 | 15944 | CAPS |
| baak16f06 | 15947 | 15948 | CAPS |
| bah11m12 | 15951 | 15952 | CAPS |
| kr66H0216 | 15955 | 15956 | SNP |
| BaGS23D15 | 15959 | 15960 | SNP |
| baal22c17 | 15963 | 15964 | SNP |
| baak33d06 | 15967 | 15968 | CAPS |
| bags34l17 | 15971 | 15972 | SNP |
| BaGS25G03 | 15975 | 15976 | CAPS |
| bah14j16 | 15979 | 15980 | CAPS |
| bah34a23 | 15983 | 15984 | size_poly (codominant) |
| BaAK21B17 | 15987 | 15988 | SNP |
| bast42C0406 | 15991 | 15992 | CAPS |
| baak21m13 | 15995 | 15996 | SNP |
| baet45H0115 | 15999 | 16000 | size_poly (codominant) |
| BaH38E01 | 16003 | 16004 | SNP |
| bast03G0313 | 16007 | 16008 | SNP |
| baak38p18 | 16011 | 16012 | size_poly (codominant) |
| basd18g06 | 16015 | 16016 | SNP |
| baak40i22 | 16019 | 16020 | SNP |
| baal2n12 | 16023 | 16024 | SNP |
| BaSD3C24 | 16027 | 16028 | SNP |
| BaAK46M07 | 16031 | 16032 | SNP |
| BaGS17N04 | 16035 | 16036 | SNP |
| bags12d09 | 16039 | 16040 | SNP |
| basd20c08 | 16043 | 16044 | SNP |
| bags17i04 | 16047 | 16048 | CAPS |
| baak15p03 | 16051 | 16052 | CAPS |
| baak24b20 | 16055 | 16056 | size_poly (codominant) |
| baal18g11 | 16059 | 16060 | SNP |

TABLE 14-2-continued

| Name | Primers used (SEQ ID NO:) | | marker type |
|---|---|---|---|
| baal40b06 | 16063 | 16064 | CAPS |
| baak40g02 | 16067 | 16068 | SNP |
| baal1m11 | 16071 | 16072 | size_poly (codominant) |
| BaH26B16 | 16075 | 16076 | SNP |
| baal5n08 | 16079 | 16080 | SNP |
| BaSD27F05 | 16083 | 16084 | size_poly (codominant) |
| bags9c08 | 16087 | 16088 | SNP |
| baak3c01 | 16091 | 16092 | CAPS |
| basd1j22 | 16095 | 16096 | SNP |
| BaH23N03 | 16099 | 16100 | SNP |
| bast46D0808 | 16103 | 16104 | SNP |
| bast22A0802 | 16107 | 16108 | SNP |

TABLE 14-3

| Name | Primers used (SEQ ID NO:) | | marker type |
|---|---|---|---|
| bast34D0808 | 16111 | 16112 | SNP |
| bast48E0509 | 16115 | 16116 | SNP |
| bast26F1012 | 16119 | 16120 | SNP |
| baal30e07 | 16123 | 16124 | SNP |
| bags23n06 | 16127 | 16128 | CAPS |
| BaGS18I05 | 16131 | 16132 | SNP |
| BaH52L11 | 16135 | 16136 | CAPS |
| baal18b16 | 16139 | 16140 | CAPS |
| bags1a17 | 16143 | 16144 | size_poly (dominant) |
| HVCMA | — | — | SSR |
| bags8o06 | 16147 | 16148 | SNP |
| baak46e14 | 16151 | 16152 | SNP |
| BaGS38N08 | 16155 | 16156 | SNP |
| BaH49P17 | 16159 | 16160 | SNP |
| bah60l22 | 16163 | 16164 | CAPS |
| bags21m22 | 16167 | 16168 | CAPS |
| BaH54E07 | 16171 | 16172 | CAPS |
| BaAK39A20 | 16175 | 16176 | CAPS |
| bags21d11 | 16179 | 16180 | SNP |
| kr39H0816 | 16183 | 16184 | SNP |
| baet32B1103 | 16187 | 16188 | CAPS |
| BaAK31O16 | 16191 | 16192 | CAPS |
| bags39l20 | 16195 | 16196 | CAPS |
| BaGS15L12 | 16199 | 16200 | CAPS |
| kr67D0208 | 16203 | 16204 | SNP |
| BaAK1H16 | 16207 | 16208 | SNP |
| BaH26F10 | 16211 | 16212 | SNP |
| bags14n02 | 16215 | 16216 | SNP |
| bah36f01 | 16219 | 16220 | CAPS |
| bast79F0711 | 16223 | 16224 | size_poly (codominant) |
| BaGS29G21 | 16227 | 16228 | size_poly (codominant) |
| bast79D1107 | 16231 | 16232 | SNP |
| BaGS26O20 | 16235 | 16236 | SNP |
| bags11h08 | 16239 | 16240 | CAPS |
| bags22h11 | 16243 | 16244 | SNP |
| baet19D0608 | 16247 | 16248 | SNP |
| bags23a14 | 16251 | 16252 | CAPS |
| cMWG704 | — | — | STS |
| bah62d14 | 16255 | 16256 | size_poly (codominant) |
| BaGS37C09 | 16259 | 16260 | SNP |
| bags20a01 | 16263 | 16264 | SNP |
| bah53m11 | 16267 | 16268 | SNP |
| BaGS26L01 | 16271 | 16272 | SNP |
| bags21p23 | 16275 | 16276 | SNP |
| BaAK24B01 | 16279 | 16280 | SNP |
| BaAK13L03 | 16283 | 16284 | CAPS |
| MWG511 | — | — | CAPS |
| bastl56C0105 | 16287 | 16238 | SNP |
| basd20j22 | 16291 | 16292 | CAPS |
| bags28d11 | 16295 | 16296 | SNP |
| BaGS4I11 | 16299 | 16300 | size_poly (codominant) |

TABLE 14-4

| Name | Primers used (SEQ ID NO:) | | marker type |
|---|---|---|---|
| BaH52G15 | 16303 | 16304 | size_poly (codominant) |
| baak11d12 | 16307 | 16308 | SNP |
| BaH42A07 | 16311 | 16312 | SNP |
| BaGS38F01 | 16315 | 16316 | CAPS |
| BaAK32I05 | 16319 | 16320 | CAPS |
| bah60f18 | 16323 | 16324 | SNP |
| baal2n10 | 16327 | 16328 | CAPS |
| BaAK14F01 | 16331 | 16332 | CAPS |
| bah57o01 | 16335 | 16336 | CAPS |
| basd12f05 | 16339 | 16340 | CAPS |
| bah58e21 | 16343 | 16344 | CAPS |
| bags1d07 | 16347 | 16348 | CAPS |
| BaH23J15 | 16351 | 16352 | CAPS |
| baak1p09 | 16355 | 16356 | CAPS |
| BaAK32C23 | 16359 | 16360 | SNP |
| baal9e06 | 16363 | 16364 | SNP |
| baal18g23 | 16367 | 16368 | CAPS |
| bastl47E0309 | 16371 | 16372 | SNP |
| baak30o08 | 16375 | 16376 | SNP |
| baet44C0606 | 16379 | 16380 | SNP |
| bags39g18 | 16383 | 16384 | SNP |
| BaH50P14 | 16387 | 16388 | CAPS |
| bags38m06 | 16391 | 16392 | SNP |
| baal33e12 | 16395 | 16396 | size_poly (codominant) |
| bags3i04 | 16399 | 16400 | SNP |
| BaAL1A11 | 16403 | 16404 | SNP |
| BaSD2M23 | 16407 | 16408 | SNP |
| Bmag359 | — | — | SSR |
| BaAK23L23 | 16411 | 16412 | CAPS |
| bags7a23 | 16415 | 16416 | CAPS |
| bah56l04 | 16419 | 16420 | CAPS |
| basd12k23 | 16423 | 16424 | SNP |
| bast22C0105 | 16427 | 16428 | SNP |
| BaGS38H20 | 16431 | 16432 | SNP |
| bah61p21 | 16435 | 16436 | SNP |
| basd11h13 | 16439 | 16440 | SNP |
| BaAL41J12 | 16443 | 16444 | size_poly (codominant) |
| baal0f04 | 16447 | 16448 | SNP |
| kr18E0810 | 16451 | 16452 | SNP |
| BaH15J07 | 16455 | 16456 | size_poly (codominant) |
| BaAL6G08 | 16459 | 16460 | CAPS |
| BaGS24F02 | 16463 | 16464 | SNP |
| baal19m12 | 16467 | 16468 | CAPS |
| bah34h16 | 16471 | 16472 | size_poly (codominant) |
| baak2e06 | 16475 | 16476 | SNP |
| bast10C0406 | 16479 | 16480 | CAPS |
| baak12l16 | 16483 | 16484 | SNP |
| baak29d01 | 16487 | 16488 | SNP |
| BaAK19N06 | 16491 | 16492 | SNP |
| BaAK4I02 | 16495 | 16496 | SNP |
| BaH49K10 | 16499 | 16500 | SNP |

TABLE 14-5

| Name | Primers used (SEQ ID NO:) | | marker type |
|---|---|---|---|
| baal2o03 | 16503 | 16504 | SNP |
| baak28g14 | 16507 | 16508 | SNP |
| bah62n05 | 16511 | 16512 | CAPS |
| bags16e11 | 16515 | 16516 | SNP |
| bags23g13 | 16519 | 16520 | SNP |
| BaSD23C05 | 16523 | 16524 | SNP |
| BaH19F17 | 16527 | 16528 | SNP |
| BaH15J02 | 16531 | 16532 | size_poly (codominant) |
| baak20d11 | 16535 | 16536 | CAPS |
| BaAL6D19 | 16539 | 16540 | CAPS |
| baak43e16 | 16543 | 16544 | CAPS |
| baak40b02 | 16547 | 16548 | CAPS |
| bah62m03 | 16551 | 16552 | CAPS |
| BaGS26G17 | 16555 | 16556 | SNP |
| baal6j16 | 16559 | 16560 | SNP |
| bags29b09 | 16563 | 16564 | SNP |
| baal20e03 | 16567 | 16568 | SNP |

TABLE 14-5-continued

| Name | Primers used (SEQ ID NO:) | | marker type |
|---|---|---|---|
| BaGS9L23 | 16571 | 16572 | SNP |
| bah32e22 | 16575 | 16576 | SNP |
| BaAK17O14 | 16579 | 16580 | SNP |
| bah56g23 | 16583 | 16584 | CAPS |
| basd22f14 | 16587 | 16588 | CAPS |
| BaH42O04 | 16591 | 16592 | SNP |
| bast74F0111 | 16595 | 16596 | SNP |
| BaSD21F13 | 16599 | 16600 | SNP |
| BaAK26G13 | 16603 | 16604 | CAPS |
| BaAK44D07 | 16607 | 16608 | CAPS |
| bast61C0206 | 16611 | 16612 | size_poly (codominant) |
| BaAL29L08 | 16615 | 16616 | SNP |
| BaH34B20 | 16619 | 16620 | CAPS |
| baak21a04 | 16623 | 16624 | SNP |
| BaGS37F18 | 16627 | 16628 | SNP |
| baal12h12 | 16631 | 16632 | SNP |
| BaAK42B16 | 16635 | 16636 | CAPS |
| BaAK26F12 | 16639 | 16640 | SNP |
| BaH27B21 | 16643 | 16644 | size_poly (codominant) |
| BaGS12B05 | 16647 | 16648 | SNP |
| baal12h24 | 16651 | 16652 | SNP |
| baal35j16 | 16655 | 16656 | SNP |
| BaGS37C07 | 16659 | 16660 | SNP |
| BaAK45D23 | 16663 | 16664 | SNP |
| BaH42G09 | 16667 | 16668 | SNP |
| BaAL40P01 | 16671 | 16672 | SNP |
| kr61A0901 | 16675 | 16676 | SNP |
| baal4d05 | 16679 | 16680 | CAPS |
| basd20l03 | 16683 | 16684 | CAPS |
| baal31b03 | 16687 | 16688 | CAPS |
| bags27k21 | 16691 | 16692 | CAPS |
| bah55n15 | 16695 | 16696 | CAPS |
| BaH44B17 | 16699 | 16700 | SNP |
| BaSD2K11 | 16703 | 16704 | SNP |

TABLE 14-6

| Name | Primers used (SEQ ID NO:) | | marker type |
|---|---|---|---|
| BaAK20B23 | 16707 | 16708 | CAPS |
| BaGS23E20 | 16711 | 16712 | SNP |
| bags33i10 | 16715 | 16716 | SNP |
| bags35k06 | 16719 | 16720 | SNP |
| bags22c18 | 16723 | 16724 | CAPS |
| MWG2031 | — | — | STS |
| BaGS22M17 | 16727 | 16728 | SNP |
| baak21j24 | 16731 | 16732 | SNP |
| BaH29D20 | 16735 | 16736 | CAPS |
| bah44f20 | 16739 | 16740 | CAPS |
| BaAL16O08 | 16743 | 16744 | SNP |
| BaAL27L17 | 16747 | 16748 | SNP |
| sKT3 | — | — | size_poly |
| sKT9 | — | — | size_poly |
| baet31B1103 | 16751 | 16752 | SNP |
| MWG975 | — | — | STS |
| BaAL4A11 | 16755 | 16756 | CAPS |
| BaGS22I18 | 16759 | 16760 | CAPS |
| BaGS24K08 | 16763 | 16764 | SNP |
| bah16c17 | 16767 | 16768 | SNP |
| bah42m04 | 16771 | 16772 | size_poly (codominant) |
| bags28l21 | 16775 | 16776 | SNP |
| basd12f23 | 16779 | 16780 | size_poly (codominant) |
| bah31m22 | 16783 | 16784 | SNP |
| BaAL30C17 | 16787 | 16788 | SNP |
| BaAK40P18 | 16791 | 16792 | CAPS |
| baak37n01 | 16795 | 16796 | SNP |
| BaGS24O11 | 16799 | 16800 | SNP |
| BaH27K19 | 16803 | 16804 | CAPS |
| BaGS15J07 | 16807 | 16808 | CAPS |
| bah19a07 | 16811 | 16812 | CAPS |
| BaH50I23 | 16815 | 16816 | SNP |
| BaH56D06 | 16819 | 16820 | SNP |
| BaAK39M05 | 16823 | 16824 | SNP |

TABLE 14-6-continued

| Name | Primers used (SEQ ID NO:) | | marker type |
|---|---|---|---|
| bah11m16 | 16827 | 16828 | SNP |
| bah49d03 | 16831 | 16832 | SNP |
| bah62l23 | 16835 | 16836 | SNP |
| BaAK38J13 | 16839 | 16840 | SNP |
| BaH37N04 | 16843 | 16844 | SNP |
| basd27c06 | 16847 | 16848 | SNP |
| bah39g10 | 16851 | 16852 | SNP |
| BaSD18P05 | 16855 | 16856 | size_poly (codominant) |
| BaGS20A13 | 16859 | 16860 | SNP |
| bah44n05 | 16863 | 16864 | CAPS |
| EBmac764 | — | — | SSR |
| BaH27L15 | 16867 | 16868 | SNP |
| BaAK21I02 | 16871 | 16872 | size_poly (codominant) |
| Bmac0064 | — | — | SSR |
| BaH59F07 | 16875 | 16876 | SNP |
| bags9l05 | 16879 | 16880 | SNP |
| BaGS13H12 | 16883 | 16884 | CAPS |

TABLE 14-7

| Name | Primers used (SEQ ID NO:) | | marker type |
|---|---|---|---|
| BaAL19B06 | 16887 | 16888 | CAPS |
| BaSD15P23 | 16891 | 16892 | CAPS |
| bah53j21 | 16895 | 16896 | SNP |
| bah21f16 | 16899 | 16900 | SNP |
| baet39E0309 | 16903 | 16904 | SNP |
| bags5l04 | 16907 | 16908 | SNP |
| bags7g10 | 16911 | 16912 | SNP |
| BaGS9D22 | 16915 | 16916 | SNP |
| kr27H1216 | 16919 | 16920 | CAPS |
| BaAK25O11 | 16923 | 16924 | CAPS |
| bah18j14 | 16927 | 16928 | SNP |
| bags37k14 | 16931 | 16932 | SNP |
| baak26n19 | 16935 | 16936 | size_poly (codominant) |
| bah42k03 | 16939 | 16940 | SNP |
| BaH36N15 | 16943 | 16944 | CAPS |
| Bmag120 | — | — | SSR |
| bags12i02 | 16947 | 16948 | SNP |
| BaAK38E05 | 16951 | 16952 | CAPS |
| baet25B0604 | 16955 | 16956 | SNP |
| BaAK46E21 | 16959 | 16960 | SNP |
| BaGS37J12 | 16963 | 16964 | SNP |
| bast60C0105 | 16967 | 16968 | CAPS |
| baak30b08 | 16971 | 16972 | SNP |
| BaAL29N13 | 16975 | 16976 | size_poly (codominant) |
| BaAL24O04 | 16979 | 16980 | CAPS |
| baak20o12 | 16983 | 16984 | SNP |
| basd14k23 | 16987 | 16988 | SNP |
| BaAK23L05 | 16991 | 16992 | SNP |
| BaGS31G02 | 16995 | 16996 | CAPS |
| bags33o01 | 16999 | 17000 | SNP |
| basd18g14 | 17003 | 17004 | CAPS |
| bah24d24 | 17007 | 17008 | SNP |
| BaGS12F09 | 17011 | 17012 | SNP |
| BaAK33H23 | 17015 | 17016 | SNP |
| bah47p03 | 17019 | 17020 | SNP |
| BaSD14F09 | 17023 | 17024 | SNP |
| bah11k13 | 17027 | 17028 | CAPS |
| BaSD22F10 | 17031 | 17032 | SNP |
| bags32a01 | 17035 | 17036 | CAPS |
| bags27o20 | 17039 | 17040 | SNP |
| baak31o10 | 17043 | 17044 | SNP |
| bags10f16 | 17047 | 17048 | SNP |
| baal37j12 | 17051 | 17052 | CAPS |
| BaGS9H02 | 17055 | 17056 | SNP |
| BaAK40H10 | 17059 | 17060 | CAPS |
| bah56m09 | 17063 | 17064 | size_poly (codominant) |
| kr66C0705 | 17067 | 17068 | SNP |
| BaGS33M05 | 17071 | 17072 | SNP |
| bast60B0204 | 17075 | 17076 | size_poly (codominant) |
| bah56p08 | 17079 | 17080 | CAPS |
| baak12e19 | 17083 | 17084 | CAPS |

TABLE 14-8

| Name | Primers used (SEQ ID NO:) | | marker type |
|---|---|---|---|
| BaGS1D05 | 17087 | 17088 | CAPS |
| BaH29M21 | 17091 | 17092 | CAPS |
| bags21c04 | 17095 | 17096 | CAPS |
| baak32p09 | 17099 | 17100 | CAPS |
| BaAL24B02 | 17103 | 17104 | SNP |
| BaGS34F08 | 17107 | 17108 | SNP |
| bast36D1208 | 17111 | 17112 | SNP |
| kr25B1103 | 17115 | 17116 | SNP |
| kr08D0303 | 17119 | 17120 | size_poly (dominant) |
| baal19g05 | 17123 | 17124 | SNP |
| BaH22B15 | 17127 | 17128 | CAPS |
| bags19c10 | 17131 | 17132 | SNP |
| bags29k01 | 17135 | 17136 | SNP |
| bastl54G0414 | 17139 | 17140 | SNP |
| BaGS23J01 | 17143 | 17144 | CAPS |
| bags34b15 | 17147 | 17148 | SNP |
| baak46i07 | 17151 | 17152 | CAPS |
| BaAL6J13 | 17155 | 17156 | CAPS |
| bah31l17 | 17159 | 17160 | SNP |
| BaAK32A05 | 17163 | 17164 | SNP |
| BaGS30N22 | 17167 | 17168 | SNP |
| BaH54J20 | 17171 | 17172 | CAPS |
| BaGS7F20 | 17175 | 17176 | CAPS |
| bah63p18 | 17179 | 17180 | size_poly (codominant) |
| bags11p11 | 17183 | 17184 | CAPS |
| BaH27L17 | 17187 | 17188 | SNP |
| basd17e11 | 17191 | 17192 | SNP |
| bags15i06 | 17195 | 17196 | SNP |
| BaAK36F09 | 17199 | 17200 | SNP |
| bast57A0101 | 17203 | 17204 | SNP |
| baak26h17 | 17207 | 17208 | CAPS |
| basd13b15 | 17211 | 17212 | SNP |
| bags9d11 | 17215 | 17216 | SNP |
| BaH20K03 | 17219 | 17220 | size_poly (codominant) |
| BaSD27N21 | 17223 | 17224 | size_poly (codominant) |
| baal13a10 | 17227 | 17228 | size_poly (dominant) |
| kr30F1212 | 17231 | 17232 | SNP |
| bastl45B0903 | 17235 | 17236 | SNP |
| Bmac156 | — | — | SSR |
| bah60k06 | 17239 | 17240 | size_poly (codominant) |
| BaGS32I12 | 17243 | 17244 | SNP |
| BaGS4H02 | 17247 | 17248 | CAPS |
| bah44k12 | 17251 | 17252 | size_poly (codominant) |
| baak27p06 | 17255 | 17256 | SNP |
| bags21m21 | 17259 | 17260 | SNP |
| BaSD14J15 | 17263 | 17264 | CAPS |
| HVM49 | — | — | SSR |
| basd16e11 | 17267 | 17268 | SNP |
| BaAK21N09 | 17271 | 17272 | SNP |
| baal0e10 | 17275 | 17276 | size_poly (codominant) |
| baak1g17 | 17279 | 17280 | SNP |

TABLE 14-9

| Name | Primers used (SEQ ID NO:) | | marker type |
|---|---|---|---|
| BaH14K12 | 17283 | 17284 | size_poly (codominant) |
| BaAK31G05 | 17287 | 17288 | size_poly (codominant) |
| MWG2062 | — | — | STS |
| BaH50G17 | 17291 | 17292 | size_poly (codominant) |
| HVM5 | — | — | SSR |
| bags38n21 | 17295 | 17296 | CAPS |
| bastl04B0303 | 17299 | 17300 | size_poly (codominant) |
| baal35f12 | 17303 | 17304 | SNP |
| BaH49M02 | 17307 | 17308 | CAPS |
| baak38f04 | 17311 | 17312 | CAPS |
| bah29b02 | 17315 | 17316 | SNP |
| basd15d20 | 17319 | 17320 | CAPS |
| kr61C0305 | 17323 | 17324 | CAPS |
| BaH23B08 | 17327 | 17328 | SNP |
| kr40H1115 | 17331 | 17332 | CAPS |
| bah51g17 | 17335 | 17336 | SNP |
| BaSD22E19 | 17339 | 17340 | SNP |

Table 8-1 through Table 14-9 show 7 kinds of polymorphisms: CAPS, SNP, size_poly, SSR (simple sequence repeat), STS, dCAPS, and trait. SSR, STS, dCAPS, and trait are known genetic markers. The polymorphisms specified by the inventors of the present invention are classified into 3 categories: CAPS, SNP, and size_poly. The third category, size_poly, is a polymorphism based on differences in the length of amplified fragments, and it includes polymorphisms that are detected based on whether the primer sets have successfully amplified the fragments. In any case, the polymorphism can be detected by running electrophoresis for the amplified DNA fragments, and detecting differences in band positions, or the presence or absence of bands.

CAPS is a polymorphism based on the presence or absence of a restriction enzyme recognition sequence. Most CAPS are based on single nucleotide polymorphism in the restriction enzyme recognition sequence; however, CAPS also includes those based on insertion/deletion of one or more bases. In Table 8-1 through Table 14-9, the marker type designated as SNP is the marker that does not have single nucleotide polymorphism or insertion/deletion in the restriction enzyme recognition sequence. CAPS can be detected by running electrophoresis for the amplified DNA fragments after restriction enzyme treatment and then detecting the number of bands, or band positions. Non-CAPS SNPs can be detected by typing, i.e., by actually confirming the base at the site of SNP or insertion/deletion. CAPS can also be detected by SNP typing.

Table 15-1 through Table 21-6 show base sequences in the vicinity of SNP or insertion/deletion that occurs between Haruna Nijo and H602. Names of restriction enzymes and recognition sequences of the restriction enzymes are also shown. Tables 15-1 through 15-5 are for 1H chromosome, Tables 16-1 through 16-7 for 2H chromosomes, Tables 17-1 through 17-6 for 3H chromosomes, Tables 18-1 through 18-5 for 4H chromosome, Tables 19-1 through 19-6 for 5H chromosome, Tables 20-1 through 20-5 for 6H chromosome, and Tables 21-1 through 21-6 for 7H chromosome. Table 22-1 through Table 28-25 show base sequences in the vicinity of SNPs of the SNP markers (non-CAPS). Tables 22-1 through 22-20 show polymorphisms in 1H chromosome, Tables 23-1 through 23-30 in 2H chromosome, Tables 24-1 through 24-27 in 3H chromosome, Tables 25-1 through 25-18 in 4H chromosome, Tables 26-1 through 26-28 in 5H chromosome, Tables 27-1 through 27-16 in 6H chromosome, and Tables 28-1 through 28-25 in 7H chromosome. Some of these polymorphisms occur at more than one location in one fragment.

In Table 15-1 through Table 28-25, bases that represent SNP or insertion/deletion are indicated by underline. Note that, in the sequence listing, bases at SNP sites are indicated by "universal codes." Where applicable, the universal codes are also used for bases in the restriction enzyme recognition sequence.

In Table 15-1 through Table 28-25, bases with SNPs are indicated by N in cases where the base is identified only for one of Haruna Nijo and H602 but not for the other. In this case, the unidentified base is one of the remaining three bases.

Universal codes are defined as follows.
m: A or C
r: G or A
w: A or T
s: G or C
y: T or C
k: G or T
v: A, G or C
h: A, C, or T
d: A, G, or T
b: G, C, or T
n: (A, C, G, or T) or (unidentified other bases)

[Table 15-1]

| Clones | Haruna Nijo H602 | SEQ ID NO: | Restriction enzyme | Recognition sequence |
|---|---|---|---|---|
| baak2l03 | AGCTTACATCCTGGAATCTTC<br>AGCTTACATCGTGGAATCTTC | 17342 | MvaI | CCWGG |
| BaGS32E23 | TGATTGCATCAAAATGGCATG<br>TGATTGCATCGAAATGGCATG | 17353 | TaqI | TCGA |
| basd13k20 | CCAGGTGCCGCGGITGTTGCA<br>CCAGGTGCCGGGGITGTTGCA | 17354 | HapII | CCGG |
| baak24o11 | GGAAGTTCTCGTCCTTGA-GC<br>GGAANGTCTCATCCTTGAAGG | 17355<br>17356 | FokI | NNNNNNNNNNNNNCATCC |
| BaSD2D08 | GGGAGCTGCATCAGCAGCCCC<br>GGGAGCTGCAGCAGCAGCCCC | 17359 | PstI | CTGCAG |
| bah11b15 | CGGCGCACCCAGCCCTCTCGT<br>CGGCGCACCCGGCCCTCTCGT | 17361 | BCnI | CCSGG |
| BaGS17B21 | AGCAGCATGCACATGTGATGG<br>AGCAGCATGCGCATGTGATGG | 17375 | HhaI | GCGC |
| BaAK21D02 | CAATGAGGCCATACAGGGCAA<br>CAATGAGGCCGTACAGGGCAA | 17382 | AfaI | GTAC |
| baal4f12 | CGAGACCGGCGCTCGATTAAG<br>CGAGACCGGCCCTCGATTAAG | 17385 | HaeIII | GGCC |
| BaGS11I03 | GGGCGACCCGGTATGAACAAC<br>GGGCGACCCGATATGAACAAC | 17386 | HapII | CCGG |
| bah19f01 | CGAAGTTCCAGGCGTCATTGA<br>CGAAGTTCCAAGCGTCATTGA | 17387 | MvaI | GCMG |
| BaAK27F07 | GGAGCGATCGATCGACGGGAC<br>GGAGCGATCGGTCGACGGGAC | 17388 | ClaI | ATCGAT |
| BaH36O18 | AGACGAGGGCACTGCTGAGGA<br>AGACGAGGGCGCTGCTGAGGA | 17403 | HhaI | GCGC |
| BaAK20A06 | ACAGTAATATCGATTATGAAT<br>ACAGTAATATTGATTATGAAT | 17404 | ClaI | ATCGAT |
| bah25n06 | AATCCCTTGACCCAAACAAAG<br>AATCCCTTGATCCAAACAAAG | 17405 | MboI | GATC |
| BaGS11J13 | GCACGACACCGGCGTCCTTGC<br>GCACGACACCCGCGTCCTTGC | 17413 | HapII | CCGG |
| baa138123 | TGGGTGAGCCTGAGCCGCGAA<br>TGGGTGAGCCAGAGCCGCGAA | 17414 | DdeI | CTNAG |
| BaAL36B15 | AGCCTCCATGGCCGCCCATCA<br>AGCCTCCATGTCCGCCCATCA | 17415 | HaeIII | GGCC |
| bast60D0610 | CGTCCCAGCTCACAAACTTTG<br>CGTCCCAGCTGACAAACTTTG | 17416 | PvuII | CAGCTG |
| kr22D0808 | ATTTGGGGCTGGGTGTCTTTT<br>ATTTGGGGCTAGGTGTCTTTT | 17417 | XspI | CTAG |
| basd23o02 | GACCGGATCTGGACGCCAGGA<br>GACCGGATCTAGACGCCAGGA | 17422 | XspI | CTAG |
| baak1j14 | ATCTTCTGCAGGCACTTGTCG<br>ATCTTCTGCAACCACTTGICG | 17423 | PstI | CTGCAG |
| baak24k18 | CCCCCTGTGGCCACCTCTGGC<br>CCCCCTGTGGTCACCTCTGGC | 17424 | HphI | NNNNNNNTCACC |
| BaH38H09 | ATCTTCTGCAAGCACTTGTCG<br>ATCTTCTGCAGGCACTTGTCG | 17426 | PstI | CTGCAG |
| basd17m22 | AAGACCCTGTACACCTTGTCC<br>AAGACCCTGTCCACCTTGTCC | 17450 | AfaI | GTAC |

[Table 15-2]

| Clones | Harunz Nijo H602 | SED ID NO: | Restriction enzyme | Recognition sequence |
|---|---|---|---|---|
| bags15g01 | TGATCCGAGATATGCAAAGAG<br>TGATCCGAGACATGCAAAGAG | 17451 | BsmAI | NNNNNGAGAC |
| BaH57E12 | AATGCCTCGACTTAGTTATGA<br>AATGCCTCGAATTAGTTATGA | 17453 | DdeI | CTNAG |
| baal19m17 | ATCTCTCATC-TATCTCGA-A<br>TTCTCTCATCCTATCTCGAAA | 17461<br>17462 | FokI | NNNNNNNNNNNNNNCATCC |
| bags3p11 | ATATGGTCAGTGAAGCCAGGG<br>ATATGGTCAGCGAAGCCAGGG | 17472 | TspRI | CASTGNN |
| bags3p11 | TTGAAGGGTCGGTGTTATGGT<br>TTGAAGGGTCAGTGTTATGGT | 17473 | TspRI | CASTGNN |
| BaAK14J21 | GCCGCCGCCCGCTGGCAGGAT<br>GCCGCCGCCCACTGGCAGGAT | 17474 | TspRI | CASTGNN |
| baak37g19 | AGGAGCAGATGAGGGAGCCGA<br>AGGAGCAGATGAGGGAGCCGA | 17478 | MboI | GATC |
| BaSD16G03 | AAATATTGCTCAGCTTTAAA<br>AAATATTGCGCAGCTTTAAA | 17482 | HhaI | GCGC |
| BaH13F14 | TTTTGTCGTCAACAGATGAAA<br>TTTTGTCGTCGACAGATGAAA | 17491 | TaqI | TCG A |
| basd18l16 | CTGCTGAGCACATAGTGGGGC<br>CTGCTGAGCACATAGTGGGGC | 17496 | Bsp1286I | GDGCHC |
| BaAL19J14 | AGTCATAGTCAACTACACAAT<br>AGTCATAGTCGACTACACAAT | 17497 | TaqI | TCGA |
| basd17m16 | CGATGATGGATGGCTGGAAGA<br>CGATGATGGAAGGCTGGAAGA | 17507 | FokI | GGATGNNNNNNNNN |
| baak13n06 | ACCATGTCGCTGGGAAGAGCC<br>ACCATGTCGCTGGGAAGAGCC | 17509 | HapII | CCGG |
| BaGS27M04 | CTTGCGTACAGAATCTTGTTG<br>CTTGCGTACAAAATCTTGTTG | 17511 | HinfI | GANTC |
| bags15d20 | TATGGACAGTCTAGACAAGCA<br>TATGGACAGTTTAGACAAGCA | 17522 | XbaI | TCTAGA |
| bags37e17 | GCTTTGCTTACGAACGGATCT<br>GCTTTGCTTAGGAACGGATCT | 17563 | DdeI | CTNAG |
| BaSD11P04 | TAAGGATAATAGACCATTCCA<br>TAAGGATAATGGACCATTCCA | 17569 | AvaII | GGWCC |
| bah12j09 | TCTCATGCCGGTATCTTATAG<br>TCTCATGCCGATATCTTATAG | 17570 | EcoRV | GATATC |
| bags14j09 | ATGGTATAATTATTCTGTGAG<br>ATGGTATAATGATTCTGTGAG | 17573 | HinfI | GANTC |
| bags14j09 | TCGGCGACCGACTCCCAACCA<br>TCGGCGACCGTCTCCCAACCA | 17574 | HinfI | GANTC |
| kr26E0610 | GCAAGATGTACCCTGACTTGG<br>GCAAGATGTATCCTGACTTGG | 17575 | AfaI | GTAC |
| BaGS17A18 | GGGGGTTGTCACGGCTTTGGT<br>GGGGGTTGTCGCGGCTTTGGT | 17579 | BstUI | CGCG |
| BaSD22O13 | GGCAGAGGACCGCCAGAAACG<br>GGCAGAGGACTGCCAGAAACG | 17581 | AvaII | GGWCC |
| bags15a22 | TCCAGTGGAGACCCTCGTGGA<br>TCCAGTGGAGGCCCTCGTGGA | 17582 | HaeIII | GGCC |
| baet21H1016 | GCTGTTGAGCCACTCCTTTGC<br>GCTGTTGAGCTACTCCTTTGC | 17583 | AluI | AGCT |

[Table 15-3]

| Clones | Haruna Nijo H602 | SEQ ID NO: | Restriction enzyme | Recognition sequence |
|---|---|---|---|---|
| baak34k14 | CCGGCACGCCGTCGACCTTCA<br>CCGGCACGCCATCGACCTTCA | 17593 | SalI | GTCGAC |
| bags22f12 | CGCCGGATTCCATGCTGCTGC<br>CGCCGGATTCGATGCTGCTGC | 17595 | TaqI | TCGA |
| BaH45P03 | CGGCAACGGGATCTTCAGGCC<br>CGGCAACGGGATCTTCAGGCC | 17596 | MboI | GATC |
| basd11d13 | CTTGACGCTGAACTCCACGAA<br>CTTGACGCTGTACTCCACGAA | 17597 | AfaI | GTAC |
| bags34j05 | CTCAGCCAAGCTCTCCCTAAC<br>CTCAGCCAAGTTCTCCCTAAC | 17639 | AluI | AGCT |
| bah56l03 | CTGCTCCTCGAACTCATTGAC<br>CTGCTCCTCGCACTCATTGAC | 17640 | TaqI | TCGA |
| basd12k03 | TTCCTAGGACGTTCTTCAAAT<br>TTCCTAGGACCTTCTTCAAAT | 17641 | Cfr13I | GGNCC |
| BaAK39I18 | CGGCAACGGGATCTTCAGGCC<br>CGGCAACGGGGTCTTCAGGCC | 17642 | MflI | RGATCY |
| bags21h06 | GGAGCTTTTTAAAGCTCCGCG<br>GGAGCTTTTTGAAGCTCCGCG | 17643 | DraI | TTTAAA |
| bah56k04 | ACACTAACAAAATTCAGCAAG<br>ACACTAACAAGATTCAGCAAG | 17644 | HinfI | GANTG |
| bah60e11 | AGTACAGGTCAAGAAGTTAAA<br>AGTACAGGTCCAGAAGTTAAA | 17645 | Cfr13I | GGNCC |
| baak22i05 | TCGGGATAGGCCCAAAACCCA<br>TCGGGATAGGTCCAAAACCCA | 17646 | HaeIII | GGCC |
| baal5i02 | TTCATGACCATGGCCUCTGC<br>TTCATGACCACGGCCCTCTGC | 17647 | NcoI | CCATGG |
| BaAK2E05 | GCTGCCAACCTAGTACTCTTT<br>GCTGCCAACCAAGTACTCTTT | 17648 | XspI | CTAG |
| baak33g12 | CGACCTCGTAGGGCCCGACGA<br>CGACCTCGTAAGGCCCGACGA | 17649 | BanII | GRGCYC |
| bags4e05 | ACTAAGTTAGCACATATATCA<br>ACTAAGTTAGTACATATATCA | 17650 | AfaI | GTAC |
| BaH28K13 | GGCCGTGGCCGTGAGAGTCGT<br>GGCCGTGGCCCTGAGAGTCGT | 17658 | Cfr13I | GGNCC |
| BaSD1I24 | GGCCGTCGAGGGCCATGAACT<br>GGCCGTCGAGAGCCATGAACT | 17659 | Cfr13I | GGNCC |
| bags4e02 | TATGAGACTACACTGTGTCCT<br>T-TGAGA-TAAACTGG---TT | 17682<br>17683 | TspRI | CASTGNN |
| bast04H0315 | CCGTCGACTCGGGCGGATTTA<br>CCGTCGACTCCGGCGGATTTA | 17684 | AvaI | CYCGRG |
| basd2b18 | CGAAATATGGCCGCACCTGTG<br>CGAAATATGGTCGCACCTGTG | 17688 | Hae111 | GGCC |
| BaSD14B13 | GCCCTGCCCGCCGGCTCCGCA<br>GCCCTGCCCGTCGGCTCCGCA | 17700 | HapII | CCGG |
| BaAK39G10 | CAGATGGAGCTGGCGCCTTCA<br>CAGATGGAGCCGGCGCCTTCA | 17724 | HapII | CCGG |
| BaAK39G03 | GTACTCCCTCTTGGTGTCGAA<br>GTACTCCCTCCTGGTGTCGAA | 17725 | MvaI | CCWGG |
| baak2a18 | TAGACATTACCGGGAGAATCC<br>TAGACATTACTGGGAGAATCC | 17726 | HapII | CCGG |

[Table 15-4]

| Clones | Harunz Nijo H602 | SEQ ID NO: | Restriction enzyme | Recognition sequence |
|---|---|---|---|---|
| basd17104 | CTCCATGGTGCGCCGACGGTG<br>CTCCATGGTGAGCCGACGGTG | 17730 | HhaI | GCGC |
| BaAK30F02 | GACTAATAGAGGCCTATATGA<br>GACTAATAGAAGCCTATATGA | 17735 | HaeIII | GGCC |
| bags10j15 | GGGTAGTTTCCAAGCTGAAGT<br>GGGTAGTTTCGAAGCTGAAGT | 17754 | BspT104I | TTCGAA |
| bags3c15 | ACGGCGTCACATACAGCACGA<br>ACGGCGTCACGTACAGCACGA | 17759 | AfaI | GTAC |
| BaH15M10 | TCTCACATTCAAAGATTGTAG<br>TCTCACATTCGAAGATTGTAG | 17767 | BspT104I | TTCGAA |
| bast61E0509 | TTTGICTGAGCGCATGAGCTT<br>TTTGICTGAGTGCATGAGCTT | 17768 | HhaI | GCGC |
| BaGS31N04 | CAAGTGAGTACACTGACTGTT<br>CAAGTGAGTAAACTGACTGTT | 17769 | TspRI | CASTGNN |
| BaAK27D22 | CGATTGACGTTGCACCCTCTG<br>CGATTGACGTGGCACCCTCTG | 17770 | BanI | GGYRCC |
| baa15o19 | AGGAATTTTGCATGATAAACT<br>AGGAATTTTGGATGATAAACT | 17771 | FokI | GGATGNNNNNNNNN |
| bah55b18 | AT--CCGCAGTGG-ACGCATT<br>GTTTCTGCAGGGGCACGCATC | 17772<br>17773 | TspRI | CASTGNN |
| bags15e08 | CATTTGTCTCTTGTTTTCTC<br>CATTTTGTCTTTTGTTTTCTC | 17786 | BsmAI | GTCTCN |
| BaH47J05 | TAGTAAAACTCTAAAAAGACT<br>TAGTAAAACTTTAAAAAGACT | 17814 | DraI | TTTAAA |
| baa12j10 | TTACATGTCCACTGTGTCTGC<br>TTACATGTCCTCTGTGTCTGC | 17827 | TspRI | CASTGNN |
| BaGS37F14 | ACAAACAGCTGCAATTTCCAT<br>ACAAACAGCTTCAATTTCCAT | 17831 | PvuII | CAGCTG |
| BaH21K05 | GCCAACAACATTGCACGTACT<br>GCCAACAACAGTGCACGTACT | 17842 | Bsp1286I | GDGCHC |
| BaGS25K24 | TTGTTTTGTAGAGCTGCAAAG<br>TTGTTTTGTACAGCTGCAAAG | 17851 | AfaI | GTAC |
| bags1a18 | TGGAGTTGGATATCATGCACA<br>TGGAGTTGGAGATCATGCACA | 17852 | EcoRV | GATATC |
| bags35j22 | TATTGTTGGGAACCATCTAGT<br>TATTGTTGGGGACCATCTAGT | 17866 | Cfr13I | GGNCC |
| baak20h22 | AGTCAACGAGCTCGCCCCACT<br>AGTCAACGAGATCGCCCCACT | 17867 | SacI | GAGCTC |
| bah16j04 | CCCTCAGGAAGGCCAATGTGA<br>CCCTCAGGAAAGCCAATGTGA | 17872 | HaeIII | GGCC |
| BaH54J03 | ATCTCCTCAACTTGTTCAC<br>ATCTCCTCCTCGACTTGTTCAC | 17873 | TaqI | TCGA |
| BaH26M05 | GTGCTGTCGCAAGCATGACCG<br>GTGCTGTCGCGAGCATGACCG | 17876 | BstUI | CGCG |
| baak14e23 | TTAGGGATGCCGGATCAAGTA<br>TTAGGGATGCTGGATCAAGTA | 17880 | HapII | CCGG |
| bast145e1109 | ATCCGAGGATTCACCAGGCTG<br>ATCCGAGGATCCAGC AGGCTG | 17892 | MboI | GATC |
| bah15k16 | CCATTGCATTGAACGATTCCA<br>CCATTGCATTTAACGATTCCA | 17902 | MseI | TTAA |

[Table 15-5]

| Clones | Haruna Nijo H602 | SEQ ID NO: | Restriction enzyme | Recognition sequence |
|---|---|---|---|---|
| bags31a22 | AAATAACTTGTGICATGTTCA<br>AAATAACTTGAGTCATGTTCA | 17903 | HinfI | GANTC |
| BaGS38N20 | GACGGGGTCGGCGATGTGGTC<br>GACGGGGTCGACGATGIGGTC | 17917 | TaqI | TCGA |
| BaGS23O09 | AGCCAAACATCGAGAACATGG<br>AGCCAAACATTGAGAACATGG | 17918 | TaqI | TCGA |
| bastl26E0410 | AGAGTGCGGGGGGCTCAGTAG<br>AGAGTOCGGGCGGCTCAGTAG | 17919 | BanII | GRGCYC |
| BaH15N14 | CTGCGCAATGGCCAACGGTAA<br>CTGCGCAATGACCAACGGTAA | 17920 | HaeIII | GGCC |
| bah30o13 | CAAGCCCAGCTCCAAACTACC<br>CAAGCCCAGC-CCAAACTACC | 17927<br>17928 | AluI | AGCT |
| bags38f18 | GGACAATGGGGATGTTCTCAC<br>GGACAATGGGAATGTTCTCAC | 17929 | FokI | GGATGNNNNNNNNN |
| bah13o05 | CTTGTGGACTTGAGTCATCAC<br>CTTGTGGACTCGAGTCATCAC | 17930 | XhoI | CTCGAG |
| baak36b12 | GGAGCTCCGGGCGCACGAAGT<br>GGAGCTCCGGACGCACGAAGT | 17931 | BcnI | CCSGG |
| bags18o09 | CGTGCTGGCGTTCCAGTAGCC<br>CGTGCTGGCGCTCCAGTAGCC | 17932 | HhaI | GCGC |
| BaAK16L10 | CAGCTTAAGCACATTCATAAC<br>CAGCTTAAGCGCATTCATAAC | 17933 | HhaI | GCGC |
| bah13e15 | CTTATGTGATCATAATACTGC<br>CTTATGTGATAATAATACTGC | 17934 | MboI | GATC |
| bags1f22 | AGCCTTCCACTGGTATCATTT<br>AGCCTTCCACCGGTATCATTT | 17935 | HapII | CCGG |
| BaAL1N23 | CGTAGACATGATCGCCATCGC<br>CGTAGACATGGTCGCCATCGC | 17945 | MboI | GATC |
| BaH32B01 | ATCACAACTGCGCTACTTTTT<br>ATCACAACTGTGCTACTTTTT | 17948 | HhaI | GCGC |
| BaSD18L13 | CCGCTCCTCCATACGATGATG<br>CCGCTCCTCCGTACGATGATG | 17949 | AfaI | GTAC |
| BaH58A04 | GGAATGACTCGATCAGGTCGC<br>GGAATGACTCAATCAGGTCGC | 17950 | MboI | GATC |
| bah50l05 | ATTTTGACTTAGGTCGCACCT<br>ATTTTGACTTCGGTCGCACCT | 17956 | DdeI | CTNAG |
| bastl28a0101 | AAAACAGGATGTACACGGCAC<br>AAAACAGGATATACACGGCAC | 17957 | FokI | GGATGNNNNNNNNN |

TABLE 16-1

| Clones | Haruna Nijo H602 | SEQ ID NO: | Restriction enzyme | Recognition sequence |
|---|---|---|---|---|
| BaAK34H02 | ACTTGTGAGACGGTACGTACC<br>ACTTGTGAGATGGTACGTACC | 17968 | BsmAI | NNNNNGAGAC |
| BaGS37P19 | CTTCCTCCGATCGATTGCCGC<br>CTTCCTCCGACCGATTGCCGC | 17971 | ClaI | ATCGAT |
| BaAL19P17 | TTCCGCTGTAACTCGTGGAGC<br>TTCCGCTGTACCTCGTGGAGC | 17972 | AfaI | GTAC |
| bags38p20 | ATTGCTTGAAGGCCTCGAGGT<br>ATTGCTTGAAAGCCTCGAGGT | 17983 | HaeIII | GGCC |

TABLE 16-1-continued

| Clones | Haruna Nijo H602 | SEQ ID NO: | Restriction enzyme | Recognition sequence |
|---|---|---|---|---|
| BaAK41N22 | AGTATCCGCCATACGTCCACA<br>AGTATCCGCCGTACGTCCACA | 17984 | AfaI | GTAC |
| BaAK21D17 | AGGCGTCCTCTAGGGCGCGCT<br>AGGCGTCCTCCAGGGCGCGCT | 17985 | XspI | CTAG |
| bast42A0602 | GCACCACCCGCCGGCCGTCGA<br>GCACCACCCGTCGGCCGTCGA | 17989 | HapII | CCGG |
| bast42A0602 | GGCAGCAGCCTGTGCGGCACC<br>GGCAGCAGCCGGTGCGGCACC | 17990 | HapII | CCGG |
| BaAK26L07 | ACCTTCTACAGGTGCCAAGGC<br>ACCTTCTACAAGTGCCAAGGC | 17995 | BanI | GGYRCC |
| baal12a06 | GCAGATATGTTCACATCCCGT<br>GCAGATATGTACACATCCCGT | 17996 | AfaI | GTAC |
| baal12m14 | TTCGTCCACTACCTCGATGAA<br>TTCGTCCACTGCCTCGATGAA | 18003 | TspRI | CASTGNN |
| BaH35F01 | CGGCGTAGGCGAGCTTGTCGT<br>CGGCGTAGGCCAGCTTGTCGT | 18044 | HaeIII | GGCC |
| BaAL30K02 | CAAGGACATCCCTTTGCATTT<br>CAAGGACATCTCTTTGCATTT | 18045 | FokI | NNNNNNNNNNNNNCATCC |
| bags22h22 | TACGCAGACAGTGAGATTTTA<br>TACGCAGACAATGAGATTTTA | 18057 | TspRI | CASTGNN |
| bags13n11 | CCTGCAGAATCGACAAACTAT<br>CCTGCAGAATGGACAAACTAT | 18058 | HinfI | GANTC |
| bags1h03 | GTGGCAAGGCTTGTAGATCTG<br>GTGGCAAGGCCTGTAGATCTG | 18059 | HaeIIE | GGCC |
| baal19a12 | GGTCGCCTACGGGTGAGCATT<br>GGTCGCCTACCGGTGAGCATT | 18069 | HapII | CCGG |
| BaAK45G16 | TGCTGAACTCCAGGCAGGGCA<br>TGCTGAACTCGAGGCAGGGCA | 18070 | MvaI | CCWGG |
| BaGS37N19 | ACAGCAGGATGCACAATGGAA<br>ACAGCAGGATCCACAATGGAA | 18071 | MflI | RGATCY |
| baak3f03 | GAAGGCCTGGAGCCTGGGGGT<br>GAAGGCCTGGCGCCTGGGGGT | 18072 | HhaI | GCGC |
| bah62i11 | CTGCGGAGGCTGAACGGCTTG<br>CTGCGGAGGCCGAACGGCTTG | 18081 | HaeII | GGCC |
| bah17n24 | ACAAAGAAGGTCGTTCATGAT<br>ACAAAGAAGGCCGTTCATGAT | 18091 | HaeIII | GGCC |
| BaGS4J04 | GGAAACAGCAAATCAAGTACA<br>GGAAACAGCAGATCAAGTACA | 18096 | MboI | GATC |
| baak33f06 | ACGTCAAGGGATTCCATTCTT<br>ACGTCAAGGGGTTCCATTCTT | 18097 | HinfI | GANTC |

TABLE 16-2

| Clones | Haruna Nijo H602 | SEQ ID No: | Restriction enzyme | Recognition sequence |
|---|---|---|---|---|
| basd14f16 | GGATGCCCTAGCATAAACTGA<br>GGATGCCCTACCATAAACTGA | 18098 | XspI | CTAG |
| BaH59K20 | CTAGCGCCGGCCCGCAGGCAG<br>CTAGCGCCGGACCGCAGGCAG | 18099 | HaeIII | GGCC |
| BaH59K20 | TTGTCGGTGGTCTCGTCGCCG<br>TTGTCGGTGGCCTCGTCGCCG | 18100 | HaeIII | GGCC |

TABLE 16-2-continued

| Clones | Haruna Nijo H602 | SEQ ID No: | Restriction enzyme | Recognition sequence |
|---|---|---|---|---|
| BaGS20M01 | CATCAGATATGGAATGATGCA<br>CATCAGATATCGAATGATGCA | 18107 | EcoRV | GATATC |
| bah11n18 | TCGGAGCACGGTTCGGCGCTC<br>TCGGAGCACGATTCGGCGCTC | 18111 | HinfI | GANTC |
| baet18F0911 | GCGAGATTTGACCTCACGATA<br>GCGAGATTTGGCCTCACGATA | 18113 | HaeIII | GGCC |
| BaGS4J18 | AGTCATAGTCCGCGTCCATGT<br>AGTCATAGTCAGCGTCCATGT | 18114 | BstUI | CGCG |
| baak41d10 | GGCAAAATCATTGTAGCAAGG<br>GGCAAAATCAGTGTAGCAAGG | 18127 | TspRI | CASTGNN |
| BaGS14F01 | GCAGGTGGTCGACACTGTTAA<br>GCAGGTGGTCAACACTGTTAA | 18128 | TaqI | TCGA |
| BaH52K04 | GCAACCAAAATATATTAGCAA<br>GCAACCAAAAAATATTAGCAA | 18202 | SspI | AATATT |
| BaAL37F24 | GCAACCAAAATATATTAGCAA<br>GCAACCAAAAAATATTAGCAA | 18203 | SspI | AATATT |
| BaSD11K22 | GTTACTTCGGTTCGTCGCCAG<br>GTTACTTCGGATCGTCGCCAG | 18206 | MboI | GATC |
| bags38n06 | GATAGGCAACCAGACCAGATT<br>GATAGGCAACTAGACCAGATT | 18213 | XspI | CTAG |
| baet44D1208 | AATACAACGCGAATTAATTTA<br>AATACAACGCCAATTAATTTA | 18214 | BstUI | CGCG |
| baal13d11 | GCGACGATCCCTGCAGAGCCC<br>GCGACGATCCTTGCAGAGCCC | 18220 | PstI | CTGCAG |
| bah34m23 | AAACTTTGTCGGATGCGTCGA<br>AAACTTTGTCAGATGCGTCGA | 18240 | FokI | GGATGNNNNNNNNN |
| BaH50P13 | CGACTGCAGCAGCCATGAAGA<br>CGACTGCAGCTGCCATGAAGA | 18242 | AluI | AGCT |
| basd11m16 | CTTTCGTGTATAAAGCTGGAG<br>CTTTCGTGTACAAAGCTGGAG | 18243 | AfaI | GTAC |
| bags10p15 | AACGAGCATTGAAGATTATTT<br>AACGAGCATTAAAGATTATTT | 18244 | MseI | TTAA |
| bags4g01 | GTCGATCAGTGCACGTTTCGC<br>GTCGATCAGTACACGTTTCGC | 18245 | ApaLI | GTGCAC |
| bags10k08 | CACATACACTCAATGCCCCGT<br>CACATAGACTTAATGCCCCGT | 18246 | MseI | TTAA |
| bags5e16 | ACTTCTTCTCAAGCTCAATCT<br>ACTTCTTCTCGAGCTCAATCT | 18247 | BanII | GRGCYC |
| bags18l02 | TGTAGAATACTTCAGTGTCCA<br>TGTAGAATACCTCAGTGTCCA | 18248 | DdeI | CTNAG |
| baak44k02 | TGCTTGAACGCGCAGTGAGCC<br>TGCTTGAACGTGCAGTGAGCC | 18249 | HhaI | GCGC |

TABLE 16-3

| Clones | Haruna Nijo H602 | SEQ ID NO: | Restriction enzyme | Recognition sequence |
|---|---|---|---|---|
| bags35a20 | CTCATTGTTCCGGTTTCACAG<br>CTCATTGTTCTGGTTTCACAG | 18250 | HapII | CCGG |
| BaGS26M11 | TAAACAAGTGCGCCCTGAGCC<br>TAAACAAGTGTGCCCTGAGCC | 18251 | HhaI | GCGC |

TABLE 16-3-continued

| Clones | Haruna Nijo H602 | SEQ ID NO: | Restriction enzyme | Recognition sequence |
|---|---|---|---|---|
| BaSD13D12 | CGTGCTGCTCCGCGAACCGGA<br>CGTGCTGCTCTGCGAACCGGA | 18259 | BstUI | CGCG |
| BaH42E05 | TTCGCATGATTGCATCTACAG<br>TTCGCATGATCGCATCTACAG | 18260 | MboI | GATC |
| bast155A0701 | ACCCCGTATGATACAACAGCG<br>ACCCCGTATGGTACAACAGCG | 18261 | AfaI | GTAC |
| kr28B0604 | CCGCGTTTCTTGGGGGGTGCT<br>CCGCGTTTCTCGGGGGGTGCT | 18265 | AvaI | CYCGRG |
| bah16g18 | AAGTGCTACACCCTIGGCTGT<br>AAGTGCTACATCCTTGGCTGT | 18278 | FokI | NNNNNNNNNNNNNCATCC |
| bags35c23 | CAACCATCAGCTGGCTACCAA<br>CAACCATCAGTTGCCTACCAA | 18284 | A luI | AGCT |
| BaAK19K05 | AAAGGAGTACTGACTTGATA<br>AAAGGACTATTGACTTGATA | 18293 | AfaI | GTAC |
| bah11i16 | CTTGTGCTGGGGACGGCTGAG<br>CTTGTGCTGGTGACGGCTGAG | 18294 | HphI | GGTGANNNNNNN |
| baak22b17 | GAGCTCGACGGGTCCTTTAGC<br>GAGCTCGACGAGTCCTTTAGC | 18325 | Eco0109I | RGGNCCY |
| bags20f22 | AACTACTACCNGGTNNGCGAC<br>AACTACTACCGGGTNNGCGAC | 18326 | BcnI | CCSGG |
| baal1d17 | CAAACATCCGGAAATGCACAG<br>CAAACATCCGAAAATGCACAG | 18397 | HapII | CCGG |
| bags22f06 | ATTAAGAGATCGCCCGAACAA<br>ATCAAGAGATTGCCCGAACAA | 18398 | MboI | GATC |
| bah16a03 | TTCCCAGCGGTCGCTGCTGCC<br>TTCCCAGCGGCCGCTGCTGCC | 18404 | HaeIII | GGCC |
| BaAL11F18 | AACTTAAGAGATCTACAGCTT<br>AACTTAAGAGGTCTACAGCTT | 18405 | BglII | AGATCT |
| BaAK29E10 | CCGCGTTGCGCTGGAACTCGA<br>CCGCGTTGCGTTGGAACTCGA | 18406 | HhaI | GCGC |
| baak16f14 | AAGAAGTAGATCAATCCTCAG<br>AAGAAGTAGACCAATCCTCAG | 18415 | MboI | GATC |
| baak44c12 | TATAAGAGCATTTGGGTCACT<br>TATAAGAGCACTTGGGTCACT | 18416 | Bsp1286I | GDGCHC |
| baal39m19 | AACTATGAATATTAGACCCTT<br>AACTATGAATCTTAGACCCTT | 18418 | SspI | AATATT |
| baak4e02 | TTACAAAATCAAGAAACAAGT<br>TTACAAAATCGAGAAACAAGT | 18419 | TaqI | TCGA |
| baak46f04 | TCGATATAGATCAAATAAGAA<br>TCGATATAGACCAAATAAGAA | 18420 | MboI | GATC |
| BaSD19I17 | GGTGCGAATCGATGGICCTIC<br>GGTGCGAATCCATGGICCTIC | 18425 | ClaI | ATCGAT |
| BaAK19P01 | CAAAAGAGTCTAGTAAATTTG<br>CAAAAGAGTCCAGTAAATTTG | 18427 | XspI | CTAG |

TABLE 16-4

| Clones | Haruna Nijo H602 | SEQ ID NO: | Restriction enzyme | Recognition sequence |
|---|---|---|---|---|
| BaH26P22 | AGAAGCATTGGTCAGATGACC<br>ACAAGCATTGATCAGATGACC | 18429 | MboI | GATC |

TABLE 16-4-continued

| Clones | Haruna Nijo H602 | SEQ ID NO: | Restriction enzyme | Recognition sequence |
|---|---|---|---|---|
| kr59F0311 | TTTAGTGAAT<u>CC</u>GTATTTTGT<br>TTTAGTGAATTCGTATTTTGT | 18439 | E co RI | GAATTC |
| baal13e10 | TTGCTTACAG<u>C</u>TATGGTTCCC<br>TTGCTTACAG<u>T</u>TATGGTTCCC | 18440 | AluI | AGCT |
| BaGS5K11 | TCTAGGCCG<u>CC</u>AAGCTCACGA<br>TCTAGGCCGCTAAGCTCACGA | 18442 | DdeI | CTNAG |
| BaGS10J14 | TCCCAGCTGA<u>C</u>CCAACCATTA<br>TCCCAGCTGATCCAACCATTA | 18443 | MboI | GATC |
| BaGS10J14 | ACTCTACAAGATCTTGAA-TT<br>ACTCTACAAG<u>TT</u>CTTGAAATT | 18444<br>18445 | MboI | GATC |
| baak41m17 | TGATGTGCCG<u>A</u>TGAAATCCCT<br>TGATGTGCCGGTGAAATCCCT | 18446 | HapII | CCGG |
| baak41d22 | CACGTCTCTA<u>A</u>GACAAGAAAC<br>CACGTCTCTA<u>G</u>GACAAGAAAC | 18449 | XspI | CTAG |
| bah61c16 | GGTCGCTCCCAGGTCC<u>I</u>TCGC<br>GGTCGCTCCCGGGTCCTTCGC | 18450 | HapII | CCGG |
| BaAL7M13 | GGACCGTGTG<u>C</u>CCCTTTGGGT<br>GGACCGTGTGGCCCTTTGGGT | 18451 | HaeIII | GGCC |
| BaAK31F11 | GGTCGCTCCCAGGTCCTTCGC<br>GGTCGCTCCC<u>GGG</u>TCCTTCGC | 18452 | AvaI | CYCGRG |
| baal33d23 | TGGTGGTGAC<u>G</u>GCGGCCTGCA<br>TGGTGGTGACCGCGGCCIGCA | 18453 | S ac If | CCGCGG |
| BaH31A03 | GCTTGGCATG<u>A</u>ATGGCGCACA<br>GCTTGGCATG<u>G</u>ATGGCGCACA | 18495 | FokI | GGATGNNNNNNNNN |
| bast139A0901 | CAAAATAAAAGGCTATCAACT<br>CAAAATAAAAGCTATCAACT | 18496 | AluI | AGCT |
| basd12i15 | CTCTAGGCGA<u>T</u>AATCACCATC<br>CTCTAGGCGAGAATCACCATC | 18509 | HinfI | GANTC |
| BaAK40I03 | CACAATGATTCTATTTTAAAA<br>CACAATGATT<u>TT</u>TATTTTAAAA | 18510 | H hfI | GANTC |
| BaAK23E14 | GATTCTTCTC<u>A</u>ATCTGACGGA<br>GATTCTTCTCGATCTGACGGA | 18511 | TaqI | TOGA |
| baal27a24 | TCATCTTGGC<u>A</u>GTTTCACCAC<br>TCATCTTGGC<u>C</u>GTTTCACCAC | 18513 | HaeIII | GGCC |
| BaH28J15 | CCTTGGTGTCGAAATGAGACG<br>CCTTGGTGTC<u>A</u>AAATGAGACG | 18518 | TaqI | TOGA |
| baal5b15 | CTGGAGACTC<u>A</u>AGCAGATGCA<br>CTGGAGACTCGAGCAGATGCA | 18526 | XhoI | CTCGAG |
| BaH28J10 | GCATCGTGCGCGGTGCTCACC<br>GCATCGTGCG<u>T</u>GGTGCTCACC | 18537 | HhaI | GCGC |
| baak34p05 | GACACTCAAGTAGTGCGTCGA<br>GACACTCAAGCAGTGCGTCGA | 18538 | TspRI | CASTGNN |
| bah27d18 | TCAGTCTGAG<u>T</u>ACTAATCAAA<br>TCAGTCTGAG-ACTAATCAAA | 18541<br>18542 | AfaI | GTAC |
| BaH50A15 | ATAAAAAAAATTCGATCTITA<br>ATAAAAAAA<u>A</u>TCGATCTITA | 18546 | ClaI | ATCGAT |

TABLE 16-5

| Clones | Haruna Nijo H602 | SEQ ID NO: | Restriction enzyme | Recognition sequence |
|---|---|---|---|---|
| basd2f22 | CATGCCTCCACGCCAATCTCC<br>CATGCCTCCAGGCCAATCTCC | 18548 | HaeIII | GGCC |
| BaH47K06 | TCCTTCTTTTAAAAAAAAAAA<br>TCCTTCTTTTCAAAAAAAAAA | 18549 | DraI | TTTAAA |
| bags29b01 | TTTTTTTAAAAATCCTGGGGG<br>TTCTTTTCAACATCCTCGCGC | 18555 | FokI | NNNNNNNNNNNNNCATCC |
| basd2a21 | ACCAAGCAACGCGCATCAACT<br>ACCAAGCAACTCGCATCAACT | 18559 | HhaI | GCGC |
| bags33m15 | TACACCTTGTGGATTAATATA<br>TACACCTTGTCGATTAATATA | 18574 | DraIII | CACNNNGTG |
| baak41e24 | GCCACTTGTCAATGCAGGCGC<br>GCCACTTGTCGATGCAGGCGC | 18584 | TaqI | TCGA |
| bah63c08 | AAGGTCTCATTAAAAAGGTGA<br>AAGGTCTCATCAAAAAGGTGA | 18585 | MseI | TTAA |
| baal17e18 | GCTAAGATCCAGAGAAAAGGA<br>GCTAAGATCCGGAGAAAAGGA | 18606 | HapII | CCGG |
| basd11g04 | TTTGGATGGTGCCCCAACACT<br>TTTGGATGGTCCCCCAACACT | 18608 | BanI | GGYRCC |
| BaGS36A04 | GTTCAGTCTTGAAATGCCCGA<br>GTTCAGTCTTTAAATGCCCGA | 18611 | DraI | TTTAAA |
| bags13a16 | GCATCCTTGTCAAGGTACCCT<br>GCATCCTTGTTAAGGTACCCT | 18612 | MseI | TTAA |
| BaAK35F14 | TGCACCCTCATGCATCCATAC<br>TGCACCCTCAGGCATCCATAC | 18618 | DdeI | CTNAG |
| baak46l06 | GGCCGAGAGGTGTCCGGTAAA<br>GGCCGAGAGGGGTCCGGTAAA | 18624 | AvaII | GGWCC |
| baak15p17 | GACTTTGGCCGGGGATCGCT<br>GACTTTGGCCAGGGGATCGCT | 18625 | HapII | CCGG |
| BaGS33J16 | CTATGCTCTGTGCTATAACCA<br>CTATGCTCTGCGCTATAACCA | 18626 | HhaI | GCGC |
| bags7p21 | AGAGCAGTGCACACACTTGTG<br>AGAGCAGTGCGCACACTTGTG | 18627 | ApaLI | GTGCAC |
| BaAK22E05 | TGAGATAGGGCCCCCAGGAAT<br>TGAGATAGGGACCCCAGGAAT | 18628 | HaeIII | GGCC |
| bah42m05 | TGTACTGGTGCTAAGCATGCC<br>TGTACTGGTGATAAGCATGCC | 18629 | HphI | GGTGANNNNNNNN |
| BaAK25L01 | CGGCACCGGCGCCGTGTGCCG<br>CGGCACCGGCACCGTGTGCCG | 18630 | HaeII | RGCGCY |
| bags39e24 | AAGAAGATGCACGAGGATAGC<br>AAGAAGATGCGCGAGGATAGC | 18631 | BstUI | CGCG |
| bags16d15 | GAAGAAACAACTACCCCACTG<br>GAAGAAACAAGTACCCCACTG | 18638 | AfaI | GTAC |
| bah19f21 | TTTACAGCCGAGAGATGAGCA<br>TTTACAGCCGGGAGATGAGCA | 18648 | HapII | CCGG |
| bags20b10 | TACCTGCATGTTAACACAAGG<br>TACCTGCATGATAACACAAGG | 18649 | MseI | TTAA |
| BaGS29J10 | CCATGGTGGTTCATTTTTGCT<br>CCATGGTGGTCCATTTTTGCT | 18660 | Cfr13I | GGNCC |

TABLE 16-6

| Clones | Haruna Nijo H602 | SEQ ID NO: | Restriction enzyme | Recognition sequence |
|---|---|---|---|---|
| basd12n12 | CCCTGTTCCTGGAAAATGGAA<br>CCCTGTTCCTAGAAAATGGAA | 18675 | MvaI | CCWGG |
| bags6l02 | ATTAGGGTATCAATCCTATAC<br>ATTAGGTCATTAATGCTATAC | 18677 | AseI | ATTAAT |
| basd14p15 | AAACACAAATATTCCTACAAT<br>AGACACAAATCTTCCTACAAT | 18680 | SspI | AATATT |
| bags19g04 | ATCATCCTTCGAACAACATCC<br>ATCATCCTTCAAACAACATCC | 18685 | BspT104I | TTCGAA |
| bah33p11 | AGGTAACCAGCTTTAGCCATT<br>AGGTAACCAGTTTTAGCCATT | 18693 | AluI | AGCT |
| bags38f12 | TTTACAGTCCGGTAGATTTGG<br>TTTACAGTCCAGTAGATTTGG | 18704 | HapII | CCGG |
| basd26p18 | CCTTTGAATTATTTGTAATTT<br>CCTTTGAATTCTTTGTAATTT | 18705 | EcoRI | GAATTC |
| baak45h16 | CAGATTGACCGTACCTGGTTA<br>CAGATTGACCATACCTGGTTA | 18706 | AfaI | GTAC |
| bah28p12 | AAGGCATGTACGTATGTCATC<br>AAGGCATGTAAGTATGTCATC | 18707 | Afal | GTAC |
| bah19a10 | CATGCGCAGCACAGAGAAGTG<br>CATGCGCAGCTGAGAGAAGTG | 18708 | AluI | AGCT |
| basd16l09 | CTTCTGAAAGATTACTTTTCG<br>CTTCTGAGAGCTTACTTTTCG | 18717 | AluI | AGCT |
| BaGS18N21 | CAATGGCTTCAACAATCCGGA<br>CAATGGCTTCGACAATCCGGA | 18742 | TaqI | TCGA |
| baal12l02 | ATTTTATCTAACTAGTCTGTA<br>ATTTTATCTAGCTAGTCTGTA | 18768 | AluI | AGCT |
| bags35a12 | GCATGGAACCAGTGTCGGCTT<br>GCATGGAACCGGTGTCGGCTT | 18775 | HapII | CCGG |
| baak42l17 | CCCTGTGGCGCGTCTCCTGCT<br>CCCTGTGGCGGGTCTCCTGCT | 18785 | HhaI | GCGC |
| baak36d23 | CTTGTCTTCGAGCTGCAAAGA<br>CTTGTCTTCGGGCTGCAAAGA | 18786 | AluI | AGCT |
| bast78C1006 | GCACCCAGGGTCGTCTGCCAC<br>GCACCCAGGGCCGTCTGCCAC | 18787 | HaeIII | GGCC |
| BaAK36B07 | GGCCATGCAGGATCAGTCCAG<br>GGCCATGCAGTATCACTCCAG | 18799 | MboI | GATC |
| baak26b05 | AAGGCTGGCGTCGGCTTGGAC<br>AAGGCTGGCGCCGGCTTGGAC | 18800 | HapII | CCGG |
| bags6n10 | ACCACAATTAATACCTGGAGC<br>ACCACAATTAGTACCTGGAGC | 18809 | AseI | ATTAAT |
| bah41b23 | TGGCATCCTCAATTGAGTCAA<br>TGGCATCCTCGATTGAGTCAA | 18820 | TaqI | TCGA |
| bast130D0408 | GCCTTTTTCGATAAACAAGAA<br>GCCTTTTTCGGTAAACAAGAA | 18822 | TaqI | TCGA |
| bah17p16 | CTGGATTTCCGGCTGCCCGAT<br>CTGGATTTCCTGCTGCCCGAT | 18823 | HapII | CCGG |
| basd16e16 | TCATTCAAGCTGGCAATAGCA<br>TCATTCAAGCCGGCAATAGCA | 18835 | HapII | CCGG |

TABLE 16-7

| Clones | Haruna Nijo H602 | SEQ ID NO: | Restriction enzyme | Recognition sequence |
|---|---|---|---|---|
| bags9p10 | CTCACAGAGCGCGGCACGCAG<br>CTCACAGAGCACGGCACGCAG | 18838 | Bsp1286I | GDGCHC |
| basd27d09 | AGTTTTTAACTAAGTGCTTCC<br>AGTTTTTAACAAAGTGCTTCC | 18839 | DdeI | CTNAG |
| basd17p09 | CCTGTGAAGAGCCCGGATGCT<br>CCTGTGAAGATCCCGGATGCT | 18844 | BanII | GRGCYC |
| bags5m04 | AGCCTGCAATTGATATCACTC<br>AGCCTGCAATCGATATCACTC | 18845 | ClaI | ATCGAT |
| BaGS5E06 | GGTCATCCGCCGCGCCGTGGT<br>GGTCATCCGCGGCGCCGTGGT | 18846 | SacII | CCGCGG |
| kr49E0610 | AGGGATACCATGGAAACAAAA<br>AGGGATACCACGGAAACAAAA | 18850 | NcoI | CCATGG |
| BaGS22E05 | AATCATCTGCACTAGCATTTC<br>AATCATCTGCGCTAGCATTTC | 18859 | HhaI | GCGC |
| BaH45O03 | CTGCTCAAGCGCTGTGTGAAA<br>CTGCTCAAGCACTGTGTGAAA | 18862 | HhaI | GCGC |

TABLE 17-1

| Clones | Haruna Nijo H602 | SEQ ID NO: | Restriction enzyme | Recognition sequence |
|---|---|---|---|---|
| basd22i04 | TCCTGTACTCAGGTTTCACCA<br>TCCTGTACTCGGGTTTCACCA | 18870 | AvaI | CYCGRG |
| BaGS31M01 | ACACGTGCCATGGGTTGGCGG<br>ACACGTGCCACGGGTTGGCGG | 18871 | NcoI | CCATGG |
| basd15n13 | AGCTGCCCGGGGAAAAACCCA<br>AGCTGCCCGGCGAAAAACCCA | 18873 | AvaI | CYCGRG |
| bast104C0406 | GACGTGACGGTTCGGGTTGAT<br>GACGTGACGGCTCGGGTTGAT | 18883 | AvaI | CYCGRG |
| baak39117 | CGAGAGCTGGACCATAATGGA<br>CGAGAGCTGGGCCATAATGGA | 18886 | HaeIII | GGCC |
| BaAL17J24 | CGACGTACTGATCCTGGCAGA<br>CGACGTACTGGTCCTGGCAGA | 18887 | AvaII | GGWCC |
| bah15p03 | GTAAAACCGGATGACAGTTAT<br>GTAAAACCGGCTGACAGTTAT | 18888 | FokI | GGATGNNNNNNNNN |
| baal22c16 | ATAGATAATTCGATATGTGAA<br>ATAGATAATTAGATATGTGAA | 18890 | TaqI | TCGA |
| bags22i13 | TGAAGACATCGAGTGATCCCA<br>TGAAGACATCAAGTGATCCCA | 18902 | TaqI | TCGA |
| BaGS20D21 | CCACCTTGGCATCCTCCGGCA<br>CCACCTTGGCGTCCTCCGGCA | 18906 | FokI | NNNNNNNNNNNNNCATCC |
| bags39o21 | ATCTGCTATAACTATATGAAA<br>ATCTGCTATAGCTATATGAAA | 18907 | AluI | AGCT |
| BaSD19H23 | TTCCAGATTCGAAATCATTTC<br>TTCCAGATTCCAAATCATTTC | 18914 | BspT104I | TTCGAA |
| baak35n06 | ACGGCACGGTCAGTGTCAGGT<br>ACGGCACGGTTAGTGTCAGGT | 18915 | TspRI | CASTGNN |
| baak35n06 | ATTTTAGACATTGTTTGGATC<br>ATTTTAGACAGTGTATGGATC | 18916 | TspRI | CASTGNN |
| bags35b22 | AACACTGGTACCTTGTTAGCT<br>AACACTGGTAACTTGTTAGCT | 18917 | AfaI | GTAC |

TABLE 17-1-continued

| Clones | Haruna Nijo H602 | SEQ ID NO: | Restriction enzyme | Recognition sequence |
|---|---|---|---|---|
| BaAK30H06 | CTAAACTCGTGGTCCGTCAAC<br>CTAAACTCGTCGTCCGTCAAC | 18918 | Cfr13I | GGNCC |
| BaAL15M07 | AACACTGGTACCTTGTTAGCT<br>AACACTGGTAACTTGTTAGCT | 18919 | KpnI | GGTACC |
| BaGS20N02 | GATCGCTGGG-GCTATAGGCA<br>GATCGCTGGGCGCTATAGGCA | 18920<br>18921 | HhaI | GCGC |
| BaAL19L12 | TCTGCACAGCGCCTGGTTGCT<br>TCTGCACAGCACCTGGTTGCT | 18922 | HhaI | GCGC |
| baal1h04 | CAGTCGACACTGGCGCTGATC<br>CAGTCGACACCGGCGCTGATC | 18923 | HapII | CCGG |
| bah45n12 | GTTGCCCGCGAATCTGCACCG<br>GTTGCCCGCGGATCTGCACCG | 18933 | SacII | CCGCGG |
| baal5k12 | CGACCACACGTGTCCCAGCAG<br>CGACCACACGCGTCCCAGCAG | 18936 | BstUI | CGCG |
| baak12j16 | AGGTGAACTCGAGGTTTGGGC<br>AGGTGAACTCAAGGTTTGGGC | 18939 | XhoI | CTCGAG |
| BaAK28J20 | TCATGGTAAGCTTGCAATGTG<br>TCATGGTAAGTTTGCAATGTG | 18940 | HindIII | AAGCTT |

TABLE 17-2

| Clones | Haruna Nijo H602 | SEQ ID NO: | Restriction enzyme | Recognition sequence |
|---|---|---|---|---|
| BaH27G14 | TCATGGTAAGCTTGCAATGTG<br>TCATGGTAAGTTTGCAATGTG | 18941 | HindIII | AAGCTT |
| baak43h20 | TCTGACCATCTTCAGCAGTCT<br>TCTGACCATCCTCAGCAGTCT | 18947 | FokI | NNNNNNNNNNNNNCATCC |
| BaAK30M07 | CTGTAGTGCTTCTTCGTCAGG<br>CTGTACTGCTCCTTCGTCAGG | 18951 | Bsp1286 | GDGCHC |
| bags6a04 | AATAATTCATCGATTAACAAA<br>AATAATTCATTGATTAACAAA | 18952 | ClaI | ATCGAT |
| baak27d01 | TCTAGACGTACTTAGTGCTAC<br>TCTAGACGTATTTAGTGCTAC | 19001 | AfaI | GTAC |
| BaGS27P18 | ATGGAGATTTTTAAACTTCCA<br>ATGGAGATTTATAAACTTCCA | 19016 | DraI | TTTAAA |
| BaGS4J14 | GGACTTCATGCCGCCACTCCAG<br>GGACTTCATGTGCCACTCCAG | 19017 | HhaI | GCGC |
| BaH32J06 | ACCAAATGAGTTCATGGAATC<br>ACCAAATGAGCTCATGGAATC | 19034 | BanII | GRGCYC |
| BaH57K23 | GTATATGTTTGGCGCCAGGAG<br>GTATATGTTTCGCGCCAGGAG | 19040 | HaeII | RGCGCY |
| baal12d12 | TGGCCCAAGATCCCTAGCTGG<br>TGGCCCAAGAACCCTAGCTGG | 19057 | MflI | RGATCY |
| BaSD14G02 | ACATGCGAATATTTTTTTAAT<br>ACATGCGAATCTTTTTTTAAT | 19070 | SspI | AATATT |
| BaGS16I18 | CAAAAGAGATGAGGCGAGGC<br>CAAAAGAGACGAGGCGAGGC | 19081 | BsmAI | NNNNNGAGAC |
| bah11k22 | TTATCTTTCCTGGGGTAACCA<br>TTATCTTTCCGGGGGTAACCA | 19083 | BcnI | CCSGG |
| baak32p21 | TGTCCCACGCACTGTTGATCG<br>TGTCCCACGCGCTGTTGATCG | 19084 | HhaI | GCGC |

TABLE 17-2-continued

| Clones | Haruna Nijo H602 | SEQ ID NO: | Restriction enzyme | Recognition sequence |
|---|---|---|---|---|
| bah63121 | GAAAAAACTGTGCCTCTACAA<br>GAAAAAACTGCGCCTCTACAA | 19085 | HhaI | GCGC |
| BaGS38D03 | CGAGCTTCACTCGGTCACCAT<br>CGAGCTTCACCCGGTCACCAT | 19086 | HapII | CCGG |
| bags23b01 | AGTCAAACTCAAGTGAGGAAC<br>AGTCAAACTCCAGTGAGGAAC | 19093 | TspRI | CASTGNN |
| bags29c09 | GATGATTGGGGATCTGTTGAT<br>GATGATTGGGCATCTGTTGAT | 19094 | MflI | RGATCY |
| bags6b06 | ACAGATTTTGTGCAGCATGTT<br>ACAGATTTTGCGCAGCATGTT | 19095 | HhaI | GCGC |
| BaAK27G06 | AGGCCTTGGCAAGCACGTCGT<br>AGGCCTTGGCGAGCACGTCGT | 19096 | Bsp1286I | GDGCHC |
| BaAK39I07 | TTGTGCTACCAGGCTTGAATA<br>TTGTGCTACCGGGCTTGAATA | 19097 | BcnI | CCSGG |
| BaGS20G21 | AGCTGAGCGCAATTCCTTGTG<br>AGCTGAGCGCGATTCCTTGTG | 19098 | HinfI | GANTC |
| bah11m03 | CAGGTGTAGCTCCATATCTGG<br>CAGGTGTAGCCCCATATCTGG | 19099 | AluI | AGCT |
| BaAL3C04 | TTCCGGGGATCCTTCCAGCTA<br>TTCCGGGGATTCTTCCAGCTA | 19100 | HinfI | GANTC |

TABLE 17-3

| Clones | Haruna Nijo H602 | SEQ ID NO: | Restriction enzyme | Recognition sequence |
|---|---|---|---|---|
| bags24n16 | CATGGTGAACCGGGGAGTCTT<br>CATGGTGAACAGGTGAGTCTT | 19103 | HapII | CCGG |
| baal12b04 | AATATTCATAGTTAATACACA<br>AATATTCATAATTAATACACA | 19124 | AseI | ATTAAT |
| BaGS36B01 | AAAACGATTCACGGTTCAGCT<br>AAAACGATTCGCGGTTCAGCT | 19131 | BstUI | CGCG |
| baal12i18 | AGAACTGTGGAGCATACTACT<br>AGAACTGTGGCGCATACTACT | 19150 | HhaI | GCGC |
| BaAL8G07 | ACCAGCTGCAGGTTATACCCT<br>ACCAGCTGCACCTTATACCCT | 19151 | PstI | CTGCAG |
| bags3f23 | CATTGTGTCTCGAGTCAATGG<br>CATTGTGTCTTGAGTCAATGG | 19157 | XhoI | CTCGAG |
| baal4m06 | GGAGAACAAGATCTGCCTCGA<br>GGAGAACAAGGTCTGCCTCGA | 19158 | MflI | RGATCY |
| basd1123 | TTCATTTACTAGATACTCCAT<br>TTCATTTACTGGATACTCCAT | 19177 | XspI | CTAG |
| baak13p20 | TATCGTCGGCGTGAATCTGAT<br>TATCGTCGGCCTGAATCTGAT | 19196 | HaeIII | GGCC |
| BaH29I03 | TGCAAGGTACCATCCCAGGAT<br>TGCAAGGTACTATCCCAGGAT | 19211 | KpnI | GGTACC |
| bah16h01 | CAGCACCGCCAGGAGTTTTGCT<br>CAGCACCGCCGGGAGTTTTGCT | 19212 | MvaI | CCWGG |
| baal11c20 | TTGCTACGAATCCAAGAGAAA<br>TTGCTACGAAACCAAGAGAAA | 19249 | HinfI | GANTC |
| basd15a02 | CAGCGGAGCCGGTCATAGGTT<br>CAGCGGAGCCAGTCATAGGTT | 19254 | HapII | CCGG |

TABLE 17-3-continued

| Clones | Haruna Nijo H602 | SEQ ID NO: | Restriction enzyme | Recognition sequence |
|---|---|---|---|---|
| bah15k11 | CACAAACGAAAGCGCGTCTTG<br>CACAAACGAANGCGCGTCTTG | 19259 | HhaI | GCGC |
| bah15k11 | GCCACGCATGCCGCACAAGAAA<br>GCCACGCATGTGCACAAGAAA | 19260 | HhaI | GCGC |
| baal35p14 | AGACGACTTCAGCTCTTGATG<br>AGACGACTTCTGCTCTTGATG | 19266 | AluI | AGCT |
| baak11n24 | AGTCAAAGGGTTTAGAAACCA<br>AGTCAAAGGGCTTAGAAACCA | 19286 | DdeI | CTNAG |
| BaGS39M09 | TGGCAATAAGCATCCCGATGC<br>TGGCAATAAGAATCCCGATGC | 19291 | HinfI | GANTC |
| baak31a24 | GTCTTAATAAACTAATGATAG<br>GTCTTAATAAGCTAATGATAG | 19307 | AluI | AGCT |
| baak31a24 | TTAAATCTGAGCTTATGAAGA<br>TTAAATCTGACCTTATGAAGA | 19308 | AluI | AGCT |
| baak31a24 | TGGAATGCAGCTTCATATGCG<br>TGGAATGCAGTTTCATATGCG | 19309 | AluI | AGCT |
| bags7f08 | GGTAAGCGTCGAACAGAGATG<br>GGTAAGCGTCAAACAGAGATG | 19314 | TaqI | TCGA |
| bags38b06 | TTGCGACGTTTAAGATATTCG<br>TTGCGACGTTGAAGATATTCG | 19318 | MseI | TTAA |
| bah27a22 | AACACCAAGCTTCGTGAGAAT<br>AACACCAAGCCTCGTGAGAAT | 19330 | AluI | AGCT |

TABLE 17-4

| Clones | Haruna Nijo H602 | SEQ ID NO: | Restriction enzyme | Recognition sequence |
|---|---|---|---|---|
| BaAK29G03 | CCATGGAGGGCCGATCAGCAG<br>CCATGGAGGGACGATCAGCAG | 19335 | Cfr13I | GGNCC |
| baak23e11 | CTGATGATACTAGAGCAGCCA<br>CTGATGATACCAGAGCAGCCA | 19340 | XspI | CTAG |
| bags31k04 | TTGTAGAGCTTGCACAATCTT<br>TTGTAGAGCTCGCACAATCTT | 19341 | BanII | GRGCYC |
| BaSD27G02 | GCTGCTGTGGACCGAAGGTCG<br>CCTGCTGTGGGCCGAAGGTCG | 19350 | HaeIII | GGCC |
| baak32m10 | CCTCGAGGCCAGACTTGAGGC<br>CCTCGAGGCCGGACTTGAGGC | 19352 | HapII | CCGG |
| baak32m10 | TGTTGGCCACCCGGATCATGT<br>TGTTGGCCACACGGATCATGT | 19353 | HapII | CCGG |
| BaAL4L02 | GCTCGTACTCCCGGCGCGGTGT<br>GCTCGTACTCTGGCGCGGTGT | 19355 | HapII | CCGG |
| BaGS32M17 | ATACTCCATCCGTCCCGAATT<br>ATACTCCATCGGTCCCGAATT | 19375 | AvaII | GGWCC |
| basd3g08 | AGGACTTTGGAATATTATTAA<br>AGGACTTTGGTATATTATTAA | 19377 | SspI | AATATT |
| BaAL7816 | CATCAAACATCCATTCCTTCT<br>CATCAAACATACATTCCTTCT | 19398 | FokI | NNNNNNNNNNNNNCATCC |
| baak34g01 | TAGATGAAGATACATCCATTT<br>TAGATGAAGAGACATCCATTT | 19406 | BsmAI | NNNNNGAGAC |
| baak12f01 | AGAAGGTGGGATGATTATCAG<br>AGAAGGTGGGGTGATTATCAG | 19407 | FokI | GGATGNNNNNNNNN |

TABLE 17-4-continued

| Clones | Haruna Nijo H602 | SEQ ID NO: | Restriction enzyme | Recognition sequence |
|---|---|---|---|---|
| BaGS30I18 | CAAATATTTCAATGAAAATAC<br>CAAAT-TTTCGATGAAAATAC | 19408<br>19409 | TaqI | TCGA |
| baak40o04 | TTGGCGGATTCTTGACGCGGC<br>TTGCCGGATTGTTGACGCGGC | 19424 | HinfI | GANTC |
| bags11i04 | GATCATCAACGTACTCAAACT<br>GATCATCAACATACTCAAACT | 19432 | AfaI | GTAC |
| bah52o06 | AGAATGGCACCGGAGACTAGA<br>AGAATGGCACGGGAGACTAGA | 19435 | HapII | CCGG |
| BaAL25P17 | TGGCGAAGTGACAACTGATCT<br>TGGCGAAGTGGCAACTGATCT | 19441 | MboI | GATC |
| BaAL25P17 | TGGGTGCTGACCAACGACACA<br>TGGGTGCTGATCAACGACACA | 19442 | MboI | GATC |
| kr24E0709 | TACCTTGAATTATCCATCATA<br>TACCTTGAATGATCCATCATA | 19454 | MboI | GATC |
| BaAL13N01 | TCTTGGTCGC-CCCGGGCGA<br>TCTTGGTCGCGCCCGGGCGA | 19458<br>19459 | HhaI | GCGC |
| BaGS31N06 | AATGAGTGGTACACGGTCGTG<br>AATGAGTGGTGCACGGTCGTG | 19460 | ApaLI | GTGCAC |
| BaH36L17 | GGGTGAACTCAAAAATGCTAA<br>GGGTGAACTCGAAAATGCTAA | 19490 | TaqI | TCGA |
| baak20g24 | CCAGGCCATAGCGGGTGCTGT<br>CCAGGCCATACCGGGTGCTGT | 19494 | HapII | CCGG |
| baet46C0206 | TGTTGAAGTCTCGGGTGTTGT<br>TGTTGAAGTCCCGGGTGTTGT | 19503 | BcnI | CCSGG |

TABLE 17-5

| Clones | Haruna Nijo H602 | SEQ ID NO: | Restriction enzyme | Recognition sequence |
|---|---|---|---|---|
| baal5i05 | TGAGCTTGTCTCGCTTGGACC<br>TGAGCTTGTCGCGCTTGGACC | 19509 | HhaI | GCGC |
| bah14a11 | CTGCGTCTATAGCCCCGATGT<br>CTGCGTCTATGGCCCCGATGT | 19510 | HaeIII | GGCC |
| bags31e24 | AGGAAGGGCTTTCGACTCGGA<br>AGGAAGGGCTCTCGACTCGGA | 19513 | BanII | GRGCYC |
| basd11a10 | AGGCGTCCCCGGCCTGCGCGG<br>AGGCGTCCCCAGCCTGCGCGG | 19526 | HapII | CCGG |
| bah50i12 | CGGCGGCGGCACTGTTTGTTG<br>CGGCGGCGGCGCTGTTTGTTG | 19527 | HhaI | GCGC |
| baak45p02 | TTTATTACAGTGACTTTCCAA<br>TTTATTACAGCGACTTTCCAA | 19530 | TspRI | CASTGNN |
| bags9l16 | TGTTGCAGCAGTCGACGGCAT<br>TGTTGCAGCACTCGACGGCAT | 19531 | SalI | GTCGAC |
| BaSD26o20 | TTTCAGTGTCGAACTAAGGGC<br>TTTCAGTGTCCAACTAAGGGC | 19533 | TaqI | TOGA |
| bags5d10 | TACCCAGTGAAGCTATAACAA<br>TACCCAGTGACGCTATAACAA | 19534 | AluI | AGCT |
| baal0e07 | AGTTTCTTGGCCTGGCAGGGA<br>AGTTTCTTGGACTGGCAGGGA | 19535 | MvaI | CCWGG |
| baak14e02 | AAATAGTAAGCTCATGTCCAG<br>AAATAGTAAGTTCATGTCCAG | 19536 | AluI | AGCT |

TABLE 17-5-continued

| Clones | Haruna Nijo H602 | SEQ ID NO: | Restriction enzyme | Recognition sequence |
|---|---|---|---|---|
| bah33f19 | GTGCAATTGGNTACAAATGCC<br>GTGCAATTGGGTACAAATGCC | 19537 | AfaI | GTAC |
| baal40i22 | GTCATCAGCGGCCCCCCGCAA<br>GTCATCAGCGCCCCCCCGCAA | 19543 | HhaI | GCGC |
| kr69E0810 | GATTGTTGATCTATGCAGCAA<br>GATTGTTGATGTATGCAGCAA | 19547 | MboI | GATC |
| BaAK39A15 | ACAGTGCCGGCCAGACTGTTC<br>ACAGTGCCGGACAGACTGTTC | 19568 | HaeIII | GGCC |
| basd18o21 | TGTCTCTCACTGGGAGCTCCC<br>TGTCTCTCACCGGGAGCTCCC | 19569 | BcnI | CCSGG |
| bags23k14 | ACATGTGGACTCCAGATATAA<br>ACATGTGGACCCCAGATATAA | 19575 | AvaII | GGWCC |
| BaGS21H17 | GATCACTGGATGACCAACCTC<br>GATCACTGGAGGACCAACCTC | 19576 | FokI | GGATGNNNNNNNNN |
| bah41l03 | TGCCGTGGCCGTGCACGATGA<br>TGCCGTGGCCATGCACGATGA | 19585 | ApaLI | GTGCAC |
| kr23D0408 | TGTACAGACTCAGCTGAGAGA<br>TGAACAGACTGAGCTGAGAGA | 19592 | HinfI | GANTC |
| baak14i02 | ATTACTCAGCTACACACCTAT<br>ATTACTCAGCCACACACCTAT | 19617 | AluI | AGCT |
| bags28c17 | TCAACTCCGCGAACGACACTT<br>TCAACTCCGCANACGACACTT | 19622 | BstUI | CGCG |
| bags28c17 | TCGATTCCTCGCGCATCTATA<br>TCGATTCCTCCCGCATCTATA | 19623 | BstUI | CGCG |
| basd22g20 | TCTTCCCCTCCGGGTACTTCA<br>TCTTCCCCTCTGGGTACTTCA | 19633 | HapII | CCGG |

TABLE 17-6

| Clones | Haruna Nijo H602 | SEQ ID NO: | Restriction enzyme | Recognition sequence |
|---|---|---|---|---|
| BaH62H20 | CTCAAAAGTTTGAAGGATTGA<br>CTCAAAAGTTCGAAGGATTGA | 19634 | TaqI | TCGA |
| baak23i12 | AGCATGCTGAGTTTTGTTTAC<br>AGCATGCTGATTTTTGITTAC | 19639 | DdeI | CTNAG |
| BaAL39F24 | CCGTTCTCCGCCGCCATCTCC<br>CCGTTCTCCGGCGCCATCTCC | 19648 | HapII | CCGG |
| BaGS4L04 | CTAACAATCTTAAACCCAAAA<br>CTAACAATCTCAAACCCAAAA | 19649 | MseI | TTAA |
| BaGS7G14 | TTTATGTGCCTGTAGCGGTTG<br>TTTATGTGCCGGTAGCGCTTG | 19655 | HapII | CCGG |
| basd24i11 | CTCTGCACCGGCGGCCTGGCC<br>CTCTGCACCGCCGGCCTGGCC | 19656 | AciI | CCGC |

TABLE 18-1

| Clones | Haruna Nijo H602 | SEQ ID NO: | Restriction enzyme | Recognition sequence |
|---|---|---|---|---|
| BaAL19006 | TACCAAGCGCGTGTCTAGTGA<br>TACCAAGCGCATGTCTAGTGA | 19666 | BstUI | CGCG |

TABLE 18-1 -continued

| Clones | Haruna Nijo H602 | SEQ ID NO: | Restriction enzyme | Recognition sequence |
|---|---|---|---|---|
| baak42c15 | TAAATCTCGAGGCCAGTATGA<br>TAAATCTCGAAGCCAGTATGA | 19675 | XhoI | CTCGAG |
| baak40n12 | GGAGATATGCTGAGATCCTGC<br>GGAGATATGCGGAGATCCTGC | 19676 | DdeI | CTNAG |
| basd2j05 | ACCAACACTCGCCACCATAAG<br>ACCAACACTCACCACCATAAG | 19677 | HphI | NNNNNNNTCACC |
| baak24g04 | AACAAGACGCGGCCGTCCTTG<br>AACAAGACGCTGCCGTCCTTG | 19678 | HaeIII | GGCC |
| baal2i22 | CGGAAGCAGCACAAAAAAAAA<br>CGGAAGCAGCGCAAAAAAAA- | 19684<br>19685 | HhaI | GCGC |
| bags20c22 | TTAGTAAGCAATGATGAAGAG<br>TTAGTAAGCAGTGATGAAGAG | 19686 | TspRI | CASTGNN |
| BaH50O22 | ATAACTGGACTCAATTCCTTG<br>ATAACTGGACACAATTCCTTG | 19687 | HinfI | GANTC |
| bags35i24 | AGAATTTGCCAGTCTCTCCAT<br>AGAATTTGCCGGTCTCTCCAT | 19689 | HapII | CCGG |
| baak37p11 | GCTGCCAGCCGATCTGTGCGA<br>GCTGCCAGCCAATCTG-GCGA | 19699<br>19700 | MboI | GATC |
| BaH50N14 | CTTCAAGGACTTTGCTGTTCC<br>CTTCAAGGACCTTGCTGTTCC | 19712 | AvaII | GGWCC |
| kr70A0202 | ACCTGCAGATCAGCCTCGCCG<br>ACCTGCAGATTAGCCTCGCCG | 19713 | MboI | GATC |
| bags20h01 | TTAAAATATAAATTCATTGAA<br>TTAAAATATAGATTCATTGAA | 19716 | HinfI | GANTC |
| BaH39P15 | GATCAACGGACGATATCGAGA<br>GATCAACGGATGATATCGAGA | 19717 | FokI | GGATGNNNNNNNNN |
| BaAK46020 | TATACCTCATGCGCTTCTCTG<br>TATACCTCATACGCTTCTCTG | 19718 | HhaI | GCGC |
| kr18G0913 | GGGCTTAGTTTCGGCCAGGTT<br>GGGCTTAGTTCCGGCCAGGTT | 19734 | HapII | CCGG |
| bags15e12 | AGCTGACCCGCGCGCATCAGT<br>AGCTGACCCGAGCGCATCAGT | 19737 | AvaI | CYCGRG |
| bags29i09 | CGCGCGTGAGGCCCCCCGGCT<br>CGCGCGTGAGCCCCCCCGGCT | 19738 | HaeIII | GGCC |
| baak19m23 | GTGCTGAATTTATGTTTCAGC<br>GTGCTGAATTCATGTTTCAGC | 19739 | EcoRI | GAATTC |
| bah11l02 | GAATCGCTTCGACAAAAAGTT<br>GAATCGCTTCCACAAAAAGTT | 19746 | TaqI | TCGA |
| bags10l12 | GGCTGGATTTTACCTCTCTAA<br>GGCTGGATTTCACCTCTCTAA | 19750 | HphI | NNNNNNNTCACC |
| bags31m13 | GCACCCACCTTGGCAGGTCGA<br>GCACCCACCTGGGCAGGTCGA | 19751 | MvaI | CCWGG |
| baal16l11 | CATTTTGTAGATTCTTCTATA<br>CATTTTGTAGCTTCTTCTATA | 19762 | HinfI | GANTC |
| BaSD17F09 | TGTCAATCTTCATCCTCACCG<br>ACTGATAACTGATCCT-ACAG | 19765<br>19766 | FokI | NNNNNNNNNNNNNCATCC |
| BaSD14M08 | CGTGCTTGGCGAGCTCGCCGG<br>CGTGCTTGGCAAGCTCGCCGG | 19769 | BanII | GRGCYC |

TABLE 18-2

| Clones | Haruna Nijo H602 | SEQ ID NO: | Restriction enzyme | Recognition sequence |
|---|---|---|---|---|
| BaAL17L08 | GTTCAGTCAGTGTTTCTCCCA<br>GTTCAGTCAGAGTTTCTCCCA | 19785 | TspRI | CASTGNN |
| bah61p18 | TCAGCTCGGCGGAAGTCAGGT<br>TCAGCTCGGCAGAAGTCAGGT | 19786 | AciI | GCGG |
| bah61p18 | TTGTTACCACCGCTGTCTCCG<br>TTGTTACCACTGCTGTCTCCG | 19787 | AciI | CCGC |
| bah63d12 | GCGAGGGGCACACGCCGCGGC<br>GCGAGGGGCAGACGCCGCGGC | 19788 | Bsp1286I | GDGCHC |
| BaAK26A03 | AAAGAATGAACCAGTTTTTCC<br>AAAGAATGAATCAGTTTTTCC | 19789 | HinfI | GANTC |
| BaAL4D19 | TGTTTCTCGGAGCACACCTTG<br>TGTTTCTCGGGGCACACCTTG | 19797 | AvaI | CYCGRG |
| basd13l12 | GATATTCCATTGAAGTGAAGA<br>GATATTCCATCGAAGTGAAGA | 19804 | TaqI | TCGA |
| bags11m01 | ATAATTTCACTGATCAGAAGT<br>ATAATTTCACAGATCAGAAGT | 19805 | TspRI | CASTGNN |
| basd3d13 | GATCGAAGGGCGTATCATATA<br>GATCGAAGGGAGTCTCATATA | 19807 | HinfI | GANTC |
| bags23f08 | CTCGTCCATGGTCTGCATCGG<br>CTCGTCCATGCTCTGCATCGG | 19809 | NcoI | CCATGG |
| BaGS15L23 | CTGCAC-ACTCGATTGCTTAA<br>CTGCACGACTTGACTGCTTGA | 19810<br>19811 | TaqI | TCGA |
| BaGS15L23 | TACAGTTGTCGAACAATTACA<br>TACAGTTGTCAAACAATTACA | 19812 | TaqI | TCGA |
| baak2k13 | ACCCACGAGTACCGTCTGGCA<br>ACCCACGAGTGCCGTCTGGCA | 19813 | AfaI | GTAC |
| baak44g22 | TTGTCAACTATGCGAGGATAT<br>TTGTCAACTACGCGAGGATAT | 19817 | BstUI | CGCG |
| basd15p13 | CTATGTCTAATTAATGTCTAA<br>CTATGTCTAACTAATGTCTAA | 19829 | AseI | ATTAAT |
| bags21k10 | CTAAATCAGTTGACAGCAAAA<br>CTAAATCAGTCGACAGCAAAA | 19832 | TaqI | TCGA |
| bah56n18 | TGATGTAGTCAACGATCTCGT<br>TGATGTAGTCGACGATCTCGT | 19833 | TaqI | TCGA |
| baak33k19 | GGACGTACGGTTAGACCTCGA<br>GGACGTACGGCTAGACCTCGA | 19856 | XspI | CTAG |
| bah50g09 | GCCGCCCGCCCCGATTTGTTT<br>GCCGCCCGCCTCGATTTGTTT | 19858 | TaqI | TOGA |
| bah54l11 | CAAAACGCAGGTCCTCAGCCC<br>CAAAACGCAGATCCTCAGCCC | 19860 | AvaII | GGWCC |
| basd13i14 | TCGGCGGGATCACTTGGCCAT<br>TCGGCGGGATTACTTGGCCAT | 19861 | MboI | GATC |
| bah56g09 | ATAGGAGAGTCCGGCCTGGAG<br>ATAGGAGAGTTCGGCCTGGAG | 19862 | HinfI | GANTC |
| bah41b06 | GCCCCTCCCTCGAGTTGACGA<br>GCCCCTCCCTGGAGTTGACGA | 19863 | MvaI | CCWGG |
| bags14n08 | TGAACGATCCGGATAAAGAAC<br>TGAACGATCCAGATAAAGAAC | 19880 | HapII | CCGG |
| BaAK36I12 | TTAAGTGGACGAGTGATTGCA<br>TTAAGTGGACTAGTGATTGCA | 19882 | XspI | CTAG |

TABLE 18-3

| Clones | Haruna Nijo H602 | SEQ ID NO: | Restriction enzyme | Recognition sequence |
|---|---|---|---|---|
| BaGS7M13 | ATGATCCTGAGGCTGAACATG<br>ATGATCCTGATGCTGAACATG | 19908 | DdeI | CTNAG |
| BaAK32D20 | TCCTTGGGTACTATATCAGGT<br>TCCTTGGGTATTATATCAGGT | 19914 | AfaI | GTAC |
| baak46m13 | ATGCCCGGAAACTGGGATGTT<br>ATGCCCGGAATCTGGGATGTT | 19916 | HinfI | GANTC |
| bags35n16 | GGAAAATTCTCGATTCATAAA<br>GGAAAATTCTTGATTCATAAA | 19917 | TaqI | TCGA |
| baal33a06 | CCGCGGCCTGAGCGGTTTGCG<br>CCGCGGCCTGTGCGGTTTGCG | 19920 | DdeI | CTNAG |
| BaSD17F20 | AGAGCAACACGATCATCTATT<br>AGAGCAACACAATCATCTATT | 19921 | MboI | GATC |
| bags22i21 | AGTTGTGCGCATTGAAACAAA<br>AGTTGTGCGCGTTGAAACAAA | 19922 | BstUI | CGCG |
| BaAL37O23 | GGACGAGCCGAGCATCGACTC<br>GGACGAGCCGGGCATCGACTC | 19925 | BcnI | CCSGG |
| bags22p03 | CTGCCTTGCGTATCAAGGGGA<br>CTGCCTTGCGGATCAAGGGGA | 19926 | MboI | GATC |
| kr65H0816 | CCATGATGGACCTATATACAA<br>CCATGATGGATCTATATACAA | 19946 | Cfr13I | GGNCC |
| bags37j11 | ATCGCCCTCCGGATTCCTTTT<br>ATCGCCCTCCTGATTCCTTTT | 19956 | HapII | CCGG |
| bags37j11 | TTTGGTCTACAGGGTTACCGC<br>TTTGGTCTACCGGGTTACCGC | 19957 | HapII | CCGG |
| BaAK46L15 | GATTATAGTACAGCGGCGACC<br>GATTATAGTATAGCGGCGACC | 19958 | AfaI | GTAC |
| bags1l16 | AGTGCACTGGCGCTAAGTATG<br>AGTGCACTGGTGCTAAGTATG | 19967 | HhaI | GCGC |
| basd1d10 | AGAGATTTCGGGACGTACCAG<br>AGAGATTTCGCGACGTACCAG | 19998 | BstUI | CGCG |
| baak33j06 | GGGCTTGAGCGCAAGTGACAG<br>GGGCTTGAGCACAAGTGACAG | 20002 | HhaI | GCGC |
| bags23a11 | CCCAGTAAAGCATGTTGGAAG<br>CCCAGTAAAGGATGTTGGAAG | 20003 | FokI | GGATGNNNNNNNNN |
| bags34f02 | TACGACTCGAGCATTGGGCCT<br>TACGACTCGAACATTGGGCCT | 20004 | XhoI | CTCGAG |
| baal20a14 | TAGCACAAATATTCAAGAATC<br>TAGCACAAATGTTCAAGAATC | 20009 | SspI | AATATT |
| BaGS21B04 | ACCCTGTATTAAGAAGAGTAA<br>ACCCTGTATTCAGAAGAGTAA | 20010 | MseI | TTAA |
| basd11p10 | ATTAGAATTCCAGTACACAAG<br>ATTAGAATTCTAGTACACAAG | 20013 | XspI | CTAG |
| BaG333E17 | CTGGGGCGCCCCGAGCCGACGC<br>CTGGGGCGCCGGAGCCGACGC | 20014 | AvaI | CYCGRG |
| BaGS17A15 | AGTGGGCAGCCCTGATCTCAG<br>AGTGGGCAGCTCTGATCTCAG | 20029 | AluI | AGCT |
| baal17m22 | TCAGGTTGGAGCCATGGAGGT<br>TCAGGTTGGATCCATGGAGGT | 20031 | MboI | GATC |
| baak42f04 | AGTGGGCAGCCCTGATCTCAG<br>AGTGGGCAGCTCTGATCTCAG | 20032 | AlUI | AGCT |

TABLE 18-4

| Clones | Haruna Nijo H602 | SEQ ID NO: | Restriction enzyme | Recognition sequence |
|---|---|---|---|---|
| BaAK2I20 | CCGGAGGGACGCCCCACAGCA<br>CCGGAGGGACTCCCCACAGCA | 20045 | HinfI | GANTC |
| basd11l18 | TCAGGACTCAAGACCACATAG<br>TCAGGACTCAGGACCATATAG | 20050 | AvaII | GGWCC |
| BaSD13H20 | CTCCGGGCAAGAATCTTCAGG<br>CTCCGGGCAACAATCTTCAGG | 20057 | HinfI | GANTC |
| BaSD14O04 | TTGGCGGCCTGGCCGGCGAGC<br>TTGGCGGCCTCGCCGGCGAGC | 20058 | MvaI | CCWGG |
| BaGS9H13 | ATACTCTGGTGGAACTGGAGG<br>ATACTCTGGTCGAACTGGAGG | 20071 | TaqI | TCGA |
| baal33e04 | GAAGACATGTCAACCACACCA<br>GAAGACATGTTAACCACACCA | 20072 | MseI | TTAA |
| BaAL40L16 | TATACTCCGGATCTTCATGCT<br>TATACTCCGGTTCTTCATGCT | 20073 | MboI | GATC |
| bags9k13 | AGGAGCAGGCACGAGAACGTT<br>AGGAGCAGGCGCGAGAACGTT | 20079 | HhaI | GCGC |
| bags8a14 | CTGCGAGCTCCGAAGATGTTG<br>CTGCGAGCTCAGAAGATGTTG | 20081 | DdeI | CTNAG |
| BaH33B15 | TGCACCCATTCGACACCATGT<br>TGCACCCATTTGACACCATGT | 20084 | TaqI | TCGA |
| BaSD23P08 | TCGTCATGTTGGCCCTCTGCA<br>TCGTCATGTTAGCCCTCTGCA | 20085 | HaeIII | GGCC |
| bast79G0313 | CGTTCTGCGGTGCCTCGGCCA<br>CGTTCTGCGGCGCCTCGGCCA | 20088 | HhaI | GCGC |
| baal4o09 | TGCCTCTGAATCTCTGCTTGC<br>TGCCTCTGAACCTCTGCTTGC | 20091 | HinfI | GANTC |
| bast40C0206 | CTCCACTCCCGCGCCTTCTTC<br>CTCCACTCCCTCGCCTTCTTC | 20117 | BstUI | CGCG |
| baal40g05 | GGAACGTGTCGAATTCCTCAT<br>GGAACGTGTCAAATTCCTCAT | 20118 | EcoRI | GAATTC |
| BaAK12L24 | TGAACCCACCAGGTTCGCAGC<br>TGAACCCACCGGGTTCGCAGC | 20121 | MvaI | CCWGG |
| BaAL12F24 | GAAATCCTCGATCGGTCCTGG<br>GAAATCCTCGGTCGGTCCTGG | 20122 | MboI | GATC |
| BaGS32G16 | ACTCGTCGCCAGCGAGGTACT<br>ACTCGTCGCCGGCGAGGTACT | 20138 | HapII | CCGG |
| basd19p22 | CTTTACCCACGACTCGAGCGT<br>CTTTACCCACAACTCGAGCGT | 20157 | HinfI | GANTC |
| bags4e03 | TTTCATCTACGTACTACCTGC<br>TTTCATCTACTTACTACCTGC | 20158 | AfaI | GTAC |
| BaAK36A13 | ATCCTCACGCGAGCTTGCAAG<br>ATCCTCACGCAAGCTTGCAAG | 20159 | HindIII | AAGCTT |
| bags33i03 | ATTTGAGTGCTCAGCCTATAT<br>ATTTGAGTGCGCAGCCTATAT | 20160 | HhaI | GCGC |
| BaAK14F03 | ATATATGAAACTGAGACGACC<br>ATATATGAAATTGAGACCACC | 20161 | DdeI | CTNAG |
| bags39m22 | CGGACGATATCAGCTAGCTAG<br>CGGACGATATGAGCTAGCTAG | 20180 | EcoRV | GATATC |
| baak29a01 | CCTCACCGGCCCTTGCAACGG<br>CCTCACCGGCGCTTGCAACGG | 20183 | Cfr13I | GGNCC |

TABLE 18-5

| Clones | Haruna Nijo H602 | SEQ ID NO: | Restriction enzyme | Recognition sequence |
|---|---|---|---|---|
| basd1e04 | GAAAACATGCCGGTGAACTCA<br>GAAAACATGCAGGTGAACTCA | 20184 | HapII | CCGG |
| BaGS23K09 | TGGCGGCCGCGTCGCCTTTCA<br>TGGCGGCCGCATCGCCTTTCA | 20185 | BstUI | CGCG |
| BaH42C12 | TCACAAAACATTAAACCCCCA<br>TCACAAAACAATAAACCCCCA | 20187 | MseI | TTAA |
| baak15k23 | GTCACCCAAATCATGGTCATT<br>GTCACCCAAACCATGGTCATT | 20190 | NcoI | CCATGG |
| bags3h19 | GCGGGCGCCGTGGGTCGAGCG<br>GCGGGCGCCGCGGGTCGAGCG | 20196 | SacII | CCGCGG |
| bah17h20 | GCACCTTGGGAGCCTTACCTT<br>GCACCTTGGGGGCCTTACCTT | 20199 | HaeIII | GGCC |
| BaAL5L13 | TTGAGATCGTGTACTCGAGAA<br>TTGAGATCGTATACTCGAGAA | 20200 | AfaI | GTAC |
| bast141C0806 | GCGTGCGGGCGCCCTTCTGGC<br>GCGTGCGGCCACCCTTCTGGC | 20207 | HhaI | GCGC |
| BaAL5E04 | ATTCAGTTGGTGCAGTTCTTA<br>ATTCACTTGGCGCAGTTCTTA | 20216 | HhaI | GCGC |
| baal39f20 | ACCGGCACCATGGCTAAGATC<br>ACCGGCACCACGGCTAAGATC | 20217 | NcoI | CCATGG |
| baak43d13 | CAGTCTCCCCAGCAATTGCAG<br>CAGTCTCCCCGGCAATTGCAG | 20218 | HapII | CCGG |
| baet23B0604 | GCTCCCGCCGGCAGCAGGTTC<br>GCTCCCGCCGCCAGCAGGTTC | 20221 | HapII | CCGG |
| BaAK28I08 | ACAATGAGTTCGAAAACACGT<br>ACAATGAGTTTGAAAACACGT | 20222 | BspT104I | TTCGAA |
| BaGS17E03 | AAAGAACACAATGGTTGTTTT<br>AAAGAACACACTGGTTGTTTT | 20229 | TspRI | CASTGNN |

TABLE 19-1

| Clones | Haruna Nijo H602 | SEQ ID NO: | Restriction enzyme | Recognition sequence |
|---|---|---|---|---|
| BaAL21J19 | GTGTCGACGCAGAACTCGCCG<br>GTGTCGACGCGGAACTCGCCG | 20232 | BstUI | CGCG |
| BaGS11K08 | CCTTGAATCACTGAATTTCCT<br>CCTTGAATCATTGAATTTCCT | 20236 | TspRI | CASTGNN |
| BaGS11K08 | TACTCCTACAGTGCTGCCAAG<br>TACTCCTACAATGCTGCCAAG | 20237 | TspRI | CASTGNN |
| BaGS39H16 | CATTGTCCGCCGGGCGTTCT<br>CATTGTCCGCTGGGCGTTCT | 20238 | HapIII | CCGG |
| BaAK28L16 | AGAAGGTTTTTGCCACCGAAG<br>AGAAGGTTTTGGCCACCGAAG | 20246 | HaeIII | GGCC |
| bags35o06 | GAGGGAAGTCAAAAAATAGGA<br>GAGGGAAGTCGAAAAATAGGA | 20247 | TaqI | TCGA |
| bags13d07 | TTCTGTTTGTGCTCCTGCTGC<br>TTCTGTTTGTCCTCCTGCTGC | 20248 | Bsp1286I | GDGCHC |
| BaAK18A05 | TTTGCGCGCTTGAGGAGTCTC<br>TTTGCGCGCTCGAGGAGTCTC | 20257 | TaqI | TCGA |
| BaH38D03 | TTTGCGCGCTTGAGGAGTCTC<br>TTTGCGCGCTCGAGGAGTCTC | 20258 | XhoI | CTCGAG |

TABLE 19-1-continued

| Clones | Haruna Nijo H602 | SEQ ID NO: | Restriction enzyme | Recognition sequence |
|---|---|---|---|---|
| BaH47G19 | TGGCGGCCTCGACCATGTTGG<br>TGGCGGCCTCAACCATGTTGG | 20272 | TaqI | TCGA |
| BaAK38H10 | TCTAATGAATGGCCGCGACGA<br>TCTAATGAATCGCCGCGACGA | 20273 | HaeIII | GGCC |
| BaH31H16 | GTGGTCTGTCAAGTCTCAAAT<br>GTGGTCTGTCGAGTCTCAAAT | 20278 | HinfI | GANTC |
| bags16g24 | GATGATGGACCCCCGGGCGGT<br>GATGATGGACACCCGGGCGGT | 20293 | AvaII | GGWCC |
| bags35i06 | TCTTGGGGCATTAAAATATAT<br>TCTTGGGGCAATAAAATATAT | 20298 | MseI | TTAA |
| bah56c06 | TCCTAGCCTCGAGGAGTGAAT<br>TCCTAGCCTCAAGGAGTGAAT | 20303 | XhoI | CTCGAG |
| bags6j06 | GTGGGTATGCGCTTCCCAGCT<br>GTGGGTATGCACTTCCCAGCT | 20305 | HhaI | GCGC |
| baak30k04 | AAGTGCTCCATCCTGGTCTTT<br>AAGTGCTCCAGCCTGGTCTTT | 20307 | FokI | NNNNNNNNNNNNNCATCC |
| bags39m02 | AGACGTCGCCGTCGATGAAGG<br>AGACGTCGCCATCGATGAAGG | 20309 | ClaI | ATCGAT |
| baak36b16 | ACACGTAGTAATGCACGTCAA<br>ACACGTAGTAGTGCACGTCAA | 20315 | ApaLI | GTGCAC |
| bah28l03 | CACGTACCAGTTCATTAGCAC<br>CACGTACCAGCTCATTAGCAC | 20392 | AluI | AGCT |
| BaAK36B17 | ACTTACAATCTGCGACATAAA<br>ACTTACAATCGGCGACATAAA | 20393 | BstUI | CGCG |
| bags15i11 | CGGTGGCCGCACTCCCTGTAC<br>CGGTGGCCGCGCTCCCTGTAC | 20414 | HhaI | GCGC |
| BaSD20M22 | TCACCACCTTTTGAAAATGCT<br>TCACCACCTTGTGAAAATGCT | 20415 | DraIII | CACNNNGTG |
| bags7a20 | TATGAACTGCACCATCTAGTG<br>TATGAACTGCGCCATCTAGTG | 20418 | HhaI | GCGC |
| bah25l12 | CTGCTGATTTCACCCAATCCC<br>CTGCTGATTTGACCCAATCCC | 20419 | HphI | NNNNNNNTCACC |

TABLE 19-2

| Clones | Haruna Nijo H602 | SEQ ID NO: | Restriction enzyme | Recognition sequence |
|---|---|---|---|---|
| bags6k09 | TAACCACCGTACCTGTGGGCC<br>TAACCACCGTGCCTGTGGGCC | 20420 | AfaI | GTAC |
| BaGS29P21 | AGCATATATTCGAAAGATGAC<br>AGCATATATTTGAAAGATGAC | 20421 | BspT104I | TTCGAA |
| bah58f18 | TGCACCGGCGCCACCGACAAC<br>TGCACCGGCGGCACCGACAAC | 20422 | HhaI | GCGC |
| bags39i18 | CGGGAATTTTCAATTTTATAA<br>CGGGAATTTTAAATTTTATAA | 20423 | DraI | TTTAAA |
| kr07D0208 | CCTTGTCATGGTCCTGAATTC<br>CCTTGTCATGATCCTGAATTC | 20430 | MboI | GATC |
| BaGS38M11 | CAAAGACATCTGGACGAACCA<br>CAAAGACATCCGGACGAACCA | 20432 | HapII | CCGG |
| bags3k24 | GGTGCCCGCGACAAATGCAAA<br>GGTGCCCGCGGCAAATGCAAA | 20433 | SacII | CCGCGG |

TABLE 19-2 -continued

| Clones | Haruna Nijo H602 | SEQ ID NO: | Restriction enzyme | Recognition sequence |
|---|---|---|---|---|
| bah53e16 | CACAAGCTGAGGCTACTAAAA<br>CACAAGCTGAAGCTACTAAAA | 20434 | DdeI | CTNAG |
| bags21n10 | CCCATGACCGATACGACTGGG<br>CCCATGACCGGTACGACTGGG | 20435 | HapII | CCGG |
| bags21n10 | TGGTGCTCGCCGGGCGGTAGT<br>TGGTGCTCGCNGGGCGGTAGT | 20436 | HapII | CCGG |
| BaGS25E06 | ACAGATGGGGACGCAATGCAA<br>ACAGATGGGGCGCAATGCAA | 20437 | HhaI | GCGC |
| bah38n03 | CTCTGTAGGGGTGCTGTGGAG<br>CTCTGTAGGGATGCTGTGGAG | 20438 | FokI | GGATGNNNNNNNNN |
| BaAK38G14 | GGTGCCCGCGACAAATGCAAA<br>GGTGCCCGCGGCAAATGCAAA | 20439 | SacII | CCGCGG |
| baa5a06 | CAACAGGGAGCAGCTTTTGGC<br>CAACAGGGAGAAGCTTTTGGC | 20440 | HindIII | AAGCTT |
| basd26d19 | AAGAATACTGGACCTCGAGAC<br>AAGAATACTGCACCTCGAGAC | 20441 | Cfr13I | GGNCC |
| BaH50G14 | GCAACAAGATCGAGAAATTTG<br>GCAACAAGATTGAGAAATTTG | 20443 | MboI | GATC |
| BaGS38J23 | GAGCGCGCTCGATATGCTTAG<br>GAGCGCGCTCAATATGCTTAG | 20455 | TaqI | TCGA |
| BaH33A16 | ATGCAACTCTAAACACAAAAT<br>ATGCAACTCTTAACACAAAAT | 20457 | MseI | TTAA |
| bags10e03 | ATAATCAGTCAACCAAAATTG<br>ATAATCAGTCGACCAAAATTG | 20458 | TaqI | TCGA |
| bags14f17 | GAAGCAGGCGCTTCGACAAAA<br>GAAGCAGGCGTTTCGACAAAA | 20459 | HhaI | GCGC |
| baak1e17 | CTGCCCCATCAACCAAGCACT<br>CTGCCCCATCGACCAAGCACT | 20485 | TaqI | TCGA |
| baak35j18 | CTTGGCACCAATGTGACCTGT<br>CTTGGCACCAGTGTGACCTGT | 20495 | TspRI | CASTGNN |
| bags14h08 | TCATCAACTAGCTAAGCTACG<br>TCATCAACTAACTAAGCTACG | 20508 | XspI | CTAG |
| BaSD15J20 | ATCAACCGTGATCTCCAGGTG<br>ATCAACCGTGCTCTCCAGGTG | 20532 | MboI | GATC |
| bah39b06 | AACATTCTCCAGGACAATCCT<br>AACATTCTCCGGGACAATCCT | 20533 | BcnI | CCSGG |

TABLE 19-3

| Clones | Haruna Nijo H602 | SEQ ID NO: | Restriction enzyme | Recognition sequence |
|---|---|---|---|---|
| bags19j08 | AGGGAGGGCTCGGTAGCTGTG<br>AGGGAGGGCTTGGTAGCTGTG | 20534 | BanII | GRGCYC |
| BaGS1009 | ACCGCATGCGCGTCTACGTCT<br>ACCGCATGCGTGTCTACGTCT | 20535 | HhaI | GCGC |
| bah63j06 | GGTGCATAACATCCATCTCGA<br>GGTGCATAACTTCCATCTCGA | 20536 | FokI | NNNNNNNNNNNNNCATCC |
| baa5j24 | CATGAGTGCGCTGTGTCCTGA<br>CATGAGTGCGTTGTGTCCTGA | 20542 | HhaI | GCGC |
| bah15h18 | TCATCGCCACAAATCACATGA<br>TCATCGCCACGAATCACATGA | 20543 | HinfI | GANTC |

TABLE 19-3-continued

| Clones | Haruna Nijo H602 | SEQ ID NO: | Restriction enzyme | Recognition sequence |
|---|---|---|---|---|
| bast62E0610 | CATGAGTGCGTTGTGTCCTGA<br>CATGAGTGCGCTGTGTCCTGA | 20544 | HhaI | GCGC |
| bast62E0610 | TCANGACACAACGCACCNNAG<br>NCANGACACAGCGCANNGGGG | 20545 | HhaI | GCGC |
| baak21h06 | TCCAGTTGCGGTTGAGGGTGG<br>TCCAGTTGCGCTTGAGGGTGG | 20562 | HhaI | GCGC |
| bags3b05 | AGAAAAGAGTCGACAGATTAT<br>AGAAAAGAGTTGACAGATTAT | 20563 | HinfI | GANTC |
| baak16a11 | CTCTGTGAACCGGGCTCCTAA<br>CTCTGTGAACTGGGCTCCTAA | 20569 | HapII | CCGG |
| baak15n22 | CGCCTTTGGCTCCCTTGAGAG<br>CGCCTTTGGCGCCCTTGAGAG | 20570 | HhaI | GCGC |
| baak38d20 | AGGCTCAAACACGAATTTTAA<br>AGGCTCAAACGCGAATTTTAA | 20578 | BstUI | CGCG |
| BaSD12L21 | GGCCGCACGGTGCCGAGAACC<br>GGCCGCACGGCGCCGAGAACC | 20579 | HhaI | GCGC |
| BaAK28L22 | TGTAATTGTACACAAGATTGG<br>TGTAATTGTAGACAAGATTGG | 20582 | AfaI | GTPC |
| bags21l05 | CTTCACCGGGTCTCAGTGCAC<br>CTTCACCGGGCCTCAGTGCAC | 20590 | Cfr13I | GGNCC |
| basd15e02 | ATTTGGGTGTTGAAAGCTCAG<br>ATTTGGGTGTCGAAAGCTCAG | 20594 | TaqI | TCGA |
| bah11m18 | TGGCACTATTTATCTCTCAGG<br>TGGCACTATTAATCTCTCAGG | 20597 | AseI | ATTAAT |
| BaAK30H10 | CACAGATGAAGAATCGTTCTT<br>CACAGATGAATAATCGTTCTT | 20608 | HinfI | GANTC |
| bags38b16 | ATTCTCGGTGTGCCGAAGCTT<br>ATTCTCGGTGCGCCGAAGCTT | 20609 | HhaI | GCGC |
| bags22f10 | TACGACGACGGGCAGCCTTGG<br>TACGACGACGCGCAGCCTTGG | 20614 | BstUI | CGCG |
| BaAK29B22 | CCTACTCGGCTATGCAGGGGT<br>CCTACTCGGCCATGCAGGGGT | 20628 | HaeIII | GGCC |
| BaAK27C16 | CCATACGTGTAAATTCGAATG<br>CCATACGTGTGAATTCGAATG | 20629 | EcoRI | GAATTC |
| BaGS22H13 | CCTGGCTATACTACTCATCTT<br>CCTGGCTATAGTACTCATCTT | 20630 | AfaI | GTAC |
| BaAK27E07 | CTACATGGGCTAGCCAAGAAG<br>CTACATGGGCCAGCCAAGAAG | 20638 | Cfr13I | GGNCC |
| bags28o18 | GGCATCTTCGTGGGGGAGTTC<br>GGCATCTTCGCGGGGGAGTTC | 20640 | BstUI | CGCG |

TABLE 19-4

| Clones | Haruna Nijo H602 | SEQ ID NO: | Restriction enzyme | Recognition sequence |
|---|---|---|---|---|
| baal25b05 | CCGCAGAACTCCGGACGTAGA<br>CCGCAGAACTGCGGACGTAGA | 20641 | HapII | CCGG |
| bags37d20 | CAGGTGAGTACAGAAGCACCA<br>CAGGTGAGTAAAGAAGCACCA | 20645 | AfaI | GTAC |
| basd2a02 | CCTTGATGTCCACTCCGGTCG<br>CCTTGATGTCGACTCCGGTCG | 20652 | HinfI | GANTC |

TABLE 19-4-continued

| Clones | Haruna Nijo H602 | SEQ ID NO: | Restriction enzyme | Recognition sequence |
|---|---|---|---|---|
| BaGS31L06 | TGCTTATGTCAAAGTACTTGG<br>TGCTTATGTCGAAGTACTTCG | 20653 | TaqI | TCGA |
| BaAK19H14 | TGATTGATTCAGCTGAAAGTA<br>TGATTGATTCGGCTGAAAGTA | 20661 | PvuII | CAGCTG |
| BaH49L06 | TTAGGATCGACGAGCACCGGG<br>TTAGGATCGATGAGCACCGGG | 20667 | ClaI | ATCGAT |
| baak4j01 | TGTTGGCTTGTTGCAGCATAG<br>TGTTGGCTTGCTGCAGCATAG | 20688 | PstI | CTGCAG |
| BaAK27E01 | ATACCATGTCTATTTGGAAGC<br>ATACCATGTCGATTTGGAAGC | 20689 | TaqI | TCGA |
| bags19p05 | TGTCACATTCATAGCTTGTAC<br>TGTCACATTCGTAGCTTGTAC | 20691 | AfaI | GTAC |
| bags35i04 | TCCCCATAAGCATCATCCTCC<br>TCCCCATAAGAATCATCCTCC | 20698 | HinfI | GANTC |
| baal19m08 | TCAAGTGGATGAATAACTGGG<br>TCAAGTGGATAAATAACTGGG | 20703 | FokI | GGATGNNNNNNNNN |
| baak12d06 | CACCAAATCGACGCAGCAAGG<br>CACCAAATCGGCGCAGCAAGG | 20711 | HhaI | GCGC |
| basd14b04 | CATAACCATTAGAAATGTTTC<br>CATAACCATTCGAAATGTTTC | 20722 | BspT104I | TTCGAA |
| bags33j12 | CCAGAGGGAGCTCCTATACCC<br>CCAGAGGGAGTTCCTATACCC | 20745 | BanII | GRGCYC |
| BaGS30N07 | TGAGCACGCCGCGGGTCTCCT<br>TGAGCACGCCCCGGGTCTCCT | 20746 | BcnI | CCSGG |
| BaH37I18 | TTCTGAATGGCCCTTTGACTA<br>TTCTGAATGGTCCTTTGACTA | 20747 | HaeIII | GGCC |
| baak46p24 | TTCTGAATGGCCCTTTGACTA<br>TTCTGAATGGTCCTTTGACTA | 20748 | HaeIII | GGCC |
| BaGS20F10 | GACGGTTAACTCAGCAAAGGA<br>GACGGTTAACCCAGCAAAGGA | 20757 | DdeI | CTNAG |
| bah33p03 | TTTATCCCAGCTGGTGCGCAT<br>TTTATCCCAGTTGGTGCGCAT | 20774 | PvUII | CAGCTG |
| bags25h01 | AATCCACATCAAGGATGCCTC<br>AATCCACATCTAGGATGCCTC | 20789 | XspI | CTAG |
| baak33m08 | TTCTTTTAAGTTAAAAGTGGG<br>TTCTTTTAAGCTAAAAGTGGG | 20790 | AluI | AGCT |
| BaH47A11 | GAACGGCCTCAAGAGCCTTGC<br>GAACGGCCTCGAGAGCCTTGC | 20793 | XhoI | CTCGAG |
| bags39e22 | CGAATGGCTTTAACGACCTTA<br>CGAATGGCTTCAACGACCTTA | 20810 | MseI | TTAA |
| bags19i06 | CCTAGTAGTACGCAAAAACAC<br>CCTAGTAGTATGCAAAAACAC | 20815 | AfaI | GTAC |
| basd11k21 | AACGGGGCGCAAGAGTGAAGT<br>AACGGGGCGCGAGAGTGAAGT | 20819 | BstUI | CGCG |

TABLE 19-5

| Clones | Haruna Nijo H602 | SEQ ID NO: | Restriction enzyme | Recognition sequence |
|---|---|---|---|---|
| basd13j03 | AATCCTGGAGTCGACTGATGT<br>AATCCTGGAGGCGACTGATGT | 20840 | SaII | GTCGAC |

TABLE 19-5-continued

| Clones | Haruna Nijo H602 | SEQ ID NO: | Restriction enzyme | Recognition sequence |
|---|---|---|---|---|
| BaSD18I03 | GACAGATTTATAAGAAGTTTT<br>GACAGATTTAAAAGAAGTTTT | 20842 | DraI | TTTAAA |
| bast34D0608 | GTAACACAGAACGAGTACCCC<br>GTAACACAGATCGAGTACCCC | 20844 | MboI | GATC |
| BaGS30F06 | CATCGGTGTTTGACTTACCAT<br>CATCGGTGTTCGACTTACCAT | 20845 | TaqI | TCGA |
| bags21k16 | GAATTGTTTCAGCCTTCTTTT<br>GAATTGTTTCGGCCTTCTTTT | 20846 | HaeIII | GGCC |
| BaH48GC1 | CCAGGTTCGGCGCCGACCCGG<br>CCAGGTTCGGGGCCGACCCGG | 20847 | HaeIII | GGCC |
| bags39a24 | AGAGAACATCGGTGATGCTCT<br>AGAGAACATCAGTGATGCTCT | 20848 | TspRI | CASTGNN |
| bags17p10 | CATCAGGCATGTGCAGATAGT<br>CATCAGGCATCTGCAGATAGT | 20851 | PstI | CTGCAG |
| BaH57L13 | TCGGACGGTAATACTTGTTGG<br>TCGGACGGTAGTACTTGTTGG | 20852 | AfaI | GTAC |
| bags4p07 | CTTCTTTTGCGCTGCATCTCA<br>CTTCTTTTGCACTGCATCTCA | 20853 | HhaI | GCGC |
| bah63a08 | ACTTCAAGTGCAATCGTGCTA<br>ACTTCAAGTGGAATCGTGCTA | 20854 | HinfI | GANTC |
| bah56j15 | CGCCCTTGATGACACCAACAG<br>CGCCCTTGATCACACCAACAG | 20855 | MboI | GATC |
| BaH50F21 | TGTGGAAGTTTGAGACCACCA<br>TGTGGAAGTTCGAGACCACCA | 20857 | TaqI | TCGA |
| bags34e15 | TCCATCGGTCAAGCATTCCTG<br>TCCATCGGTCGAGCATTCCTG | 20868 | TaqI | TCGA |
| bah13b13 | CAGTTGGACTTGCGCAGAAAT<br>CAGTTGGACTCGCGCAGAAAT | 20869 | HinfI | GANTC |
| bah26p09 | TATAGATAGCTGAACAATTGC<br>TATAGATAGCCGAACAATTGC | 20889 | AluI | AGCT |
| BaH41C21 | CATTGTCTTCCGCAGCAGATT<br>CATTGTCTTCTGCAGCAGATT | 20897 | PstI | CTGCAG |
| basd19g21 | ATCCTGTTGCACCCGCCTTCT<br>ATCCTGTTGCGCCCGCCTTCT | 20898 | HhaI | GCGC |
| BaGS36M20 | AGGCATAAGATATCGCTCACA<br>AGGCATAAGAAATCGCTCACA | 20905 | EcoRV | GATATC |
| bags21m10 | ATTTGCTCGGCGCTCTTTTTG<br>ATTTGCTCGGTGCTCTTTTTG | 20906 | Bsp1286I | GDGCHC |
| BaAK14G11 | TACATTCGTTCAAAAATTCTT<br>TACATTCGTTTAAAAATTCTT | 20907 | DraI | TTTAAA |
| BaGS30L20 | ATACAAGACCCGAGATAAACC<br>ATACAAGACCTGAGATAAACC | 20908 | AvaI | CYCGRG |
| bah53j08 | AGCGTTTAGACCGGGTTGCCG<br>AGCGTTTAGATCGGGTTGCCG | 20923 | BcnI | CCSGG |
| bags21d10 | AACAAGAATAGATTCAACCTG<br>AACAAGAATACATTCAACCTG | 20924 | HinfI | GANTC |
| bags9a01 | CGAGCCCGGCGTACTGCACGA<br>CGAGCCCGGCATACTGCACGA | 20925 | AfaI | GTAC |

TABLE 19-6

| Clones | Haruna Nijo H602 | SEQ ID NO: | Restriction enzyme | Recognition sequence |
|---|---|---|---|---|
| bags34d17 | AACTAATCAGCTTAACAATTG<br>AACTAATCAGATTAACAATTG | 20933 | AluI | AGCT |
| baal40k24 | AAGTTCCCATTTGAGTGTCTG<br>AAGTTCCCATCTGAGTGTCTG | 20934 | DdeI | CTNAG |
| BaH33H02 | ACTCAGCAAGGTATCAAATAA<br>ACTCAGCAAGATATCAAATAA | 20948 | EcoRV | GATATC |
| bags10e02 | CGTTGGTGCTCGCGTACGTCA<br>CGTTGGTGCTTGCGTACGTCA | 20976 | BstUI | CGCG |
| bags35n03 | TGAATATCAGTTGGCATTTCC<br>TGAATATCAGCTGGCATTTCC | 20980 | AluI | AGCT |
| BaAL15N07 | AGGCGACAAAGATCCACACCA<br>AGGCGACAAAAATCCACACCA | 20982 | MboI | GATC |
| BaAL15N07 | AGACTGGTGATCTGGAGCCGG<br>AGACTGGTGACCTGGAGCCGG | 20983 | MboI | GATC |
| bags37g12 | CAGAATAACCACGCATGTACC<br>CAGAATAACCGCGCATGTACC | 20986 | HhaI | GCGC |
| bags22l12 | GGCCCACGAAGCTTAGAGGAT<br>GGCCCACGAAACTTAGAGGAT | 20987 | AluI | AGCT |
| BaAK44K01 | GGTTTTGAGTACTTGTGTTTG<br>GGTTTTGAGTGCTTGTGTTTG | 20988 | AfaI | GTAC |
| BaAK31G07 | CATCAGAGATTGCAGGAACCT<br>CATCAGAGATCGCAGGAACCT | 20989 | MboI | GATC |
| bah53n21 | TTGAGTGATTTGATGATGCTT<br>TTGAGTGATTCGATGATGCTT | 20990 | HinfI | GANTC |
| kr29d0107 | TGCTCGAGCTCTAGGGTATTT<br>TGCTCGAGCTGTAGGCTATTT | 21005 | XspI | CTAG |
| bah52iC3 | CGTCGGAGAGTCCAAGGCCCC<br>CGTCGGAGAGCCCAAGGCCCC | 21019 | BanII | GRGCYC |
| BaAK33K05 | TGTTGCTCCCGGTCACAACAT<br>TGTTGCTCCCTGTCACAACAT | 21020 | BcnI | CCSGG |
| bast12G0113 | TTCAGCTGGTGCTAAGGGTAT<br>TTCAGCTCGTACTAAGGGTAT | 21028 | AfaI | GTAC |
| baak13k16 | AGCCACTCGAGAAGCAGGACT<br>AGCCACTCGAAAAGCAGGACT | 21041 | XhoI | CTCGAG |
| bags1h15 | CTGGATAGCGCGAGGGAGCTA<br>CTGGATAGCGTGAGGGAGCTA | 21047 | HhaI | GCGC |
| kr26H0515 | CCACAGGGCTGGAGCTCAACA<br>CCACAGGGCTAGAGCTCAACA | 21048 | XspI | CTAG |
| BaH32G11 | GTCAGATGTGGTCCACCACGT<br>GTCAGATCTGATCCACCACGT | 21054 | Cfr13I | GGNCC |
| BaGS36A16 | GGTGGTCCGCGGTGGCTGGCT<br>GGTGGTCCGCAGTGGCTGGCT | 21065 | SacII | CCGCGG |
| baak1202 | TAAGCATTCCGGTGCAAATCC<br>TAAGCATTCCAGTGCAAATCC | 21073 | HapII | CCGG |
| bags1m19 | ATATGTTCATAGATGTCAATC<br>ATATGTTCATGGATGTCAATC | 21082 | FokI | GGATGNNNNNNNNN |

TABLE 20-1

| Clones | Haruna Nijo H602 | SEQ ID NO: | Restriction enzyme | Recognition sequence |
|---|---|---|---|---|
| basd14f03 | ATCATTCAGGATGTAAAATGT<br>ATCATTCAGGGTGTAAAATGT | 21083 | FokI | GGATGNNNNNNNNN |
| BaAL30P12 | CCTCCTCCTCGGGTGTAAAGT<br>CCTCCTCCTCAGGTGTAAAGT | 21093 | AvaI | CYCGRG |
| BaGS21H12 | AGTAATTTGATCCACAAGTAT<br>AGTAATTTGAACCACAAGTAT | 21094 | MboI | GATC |
| BaGS9G15 | TAGGACCTGACCTTTCAAGCT<br>TAGGACCTGATCTTTCAAGCT | 21095 | MboI | GATC |
| baak41j04 | CCCGGCACCTGTCAGACACGC<br>CCCGGCACCTCTCAGACACGC | 21096 | DdeI | CTNAG |
| bags38a05 | TTCCTACTCAGATCTGCCAGG<br>TTCCTACTCAAATCTGCCAGG | 21099 | MboI | GATC |
| BaH43I06 | CGCGGCCGCGCGCCTGCCACA<br>CGCGGCCGCGTGCCTGCCACA | 21100 | HhaI | GCGC |
| bags9j07 | TTCACACTTAAAAGGCACACA<br>TTCACACTTAGAAGGCACACA | 21101 | DdeI | CTNAG |
| baak31p11 | TTGCGCCTTCGAACAATGAAT<br>TTGCGCCTTCAAACAATGAAT | 21102 | BspT104I | TTCGAA |
| BaGS17P19 | GATGGTCCTCAATTTCACTTG<br>GATGGTCCTCGATTTCACTTG | 21103 | TaqI | TCGA |
| baal32j05 | CGAGGCCTCTTGCGACGTAGA<br>CGAGGCCTCTCGCGACGTAGA | 21104 | BstUI | CGCG |
| baal16l16 | ACTGACTCGCGATTTATTTTA<br>ACTGACTCGCAATTTATTTTA | 21105 | BstUI | CGCG |
| baal6a11 | TCACCGTGGATCTCCCGCCCA<br>TCACCGTGGACCTCCCGCCCA | 21106 | MflI | RGATCY |
| bah55p06 | ACGGTCTCTCATCGATGCGCT<br>ACGGTCTCTCGTCGATGCGCT | 21107 | ClaI | ATCGAT |
| bags8f03 | TTCAGGGCCAAAGTCTCCACC<br>TTCAGGGCCAGAGTCTCCACC | 21108 | HinfI | GANTC |
| BaAL4B09 | CAACACCAATATAGAAATCAG<br>CAACACCAATCTAGAAATCAG | 21117 | XbaI | TCTAGA |
| bags32f21 | AAGTGAAGATCTCAGTAATGA<br>AAGTGAAGATTTCAGTAATGA | 21118 | MflI | RGATCY |
| BaGS10G07 | TGTTGGGGATGACGCCGCCGT<br>TGTTGGGGATCACGCCGCCGT | 21121 | FokI | GGATGNNNNNNNNN |
| BaH63O04 | GTAAGTCCGCAACACATGGCG<br>GTAAGTCCGCGACACATGGCG | 21125 | BstUI | CGCG |
| BaG326D21 | AGGTATTGAGTTCAAGTGAGA<br>AGGTATTGAGATCAAGTGAGA | 21126 | MboI | GATC |
| baal4k16 | GTAAATCCATTGATTCATGCA<br>GTAAATCCATCGATTCATGCA | 21138 | ClaI | ATCGAT |
| bags32b14 | GTCACGGCCGGCCTCTTCCGC<br>GTTACGGCCGCCCTCTTCCGC | 21139 | HapII | CCGG |
| baal4d01 | AGTTTAAGGCCCCGAAGGTTC<br>AGTTTAAGGCTCCGAAGGTTC | 21140 | HaeIII | GGCC |
| baal4d01 | TGCT--AAGGTCCTTGGATGA<br>TGCTATAAGGGCCTTGGATGA | 21141<br>21142 | HaeIII | GGCC |
| baak25d07 | CATCGTGAGGGGCGGTGGAGT<br>CATCGTGAGGCGCGGTGGAGT | 21154 | HhaI | GCGC |

TABLE 20-2

| Clones | Haruna Nijo H602 | SEQ ID NO: | Restriction enzyme | Recognition sequence |
|---|---|---|---|---|
| BaAK29M05 | AGACGCAGGATCTGTCGAAGT<br>AGACGCAGGACCTGTCGAAGT | 21155 | AvaII | GGWCC |
| BaGS31I08 | CTCAAGCATGCGCTTCTTTGC<br>CTCAAGCATGTGCTTCTTTGC | 21156 | HhaI | GCGC |
| baal30o06 | CCTTCTTCTCACCGGCGGCGC<br>CCTTCTTCTCTCCGGCGGCGC | 21158 | HphI | NNNNNNNTCACC |
| baak13n14 | GCGAGCACCGCCGGATAAACT<br>GCGAGCACCGTCGGATAAACT | 21159 | HapII | CCGG |
| bags7a09 | TAAAAGACAGCTTGCTAACTC<br>TAAAAGACAGTTTGCTAACTC | 21160 | AluI | AGCT |
| bah31o16 | GTGCTTCAACACGATTTAGCA<br>GTGCTTCAACGCGATTTAGCA | 21166 | BstUI | CGCG |
| kr40D0707 | GTCTTCCGGACGTTGAGGAAA<br>GTCTTCCGGATGTTGAGGAAA | 21170 | FokI | GCATGNNNNNNNNN |
| BaAL30H03 | AGAAACTGGGAAATTCTGGGT<br>AGAAACTGGGGAATTCTGGGT | 21175 | EcoRI | GAATTC |
| basd3f22 | TAGTCCAAGGGCACATCACAC<br>TAGTCCAAGGACACATCACAC | 21192 | Bsp1286I | GDGCHC |
| BaAK41K07 | GCTGGTCCGGNGGGATGCCTT<br>GCTGGTCCGGGGGGATGCCTT | 21196 | HapII | CCGG |
| BaAK41K07 | TGGTCTTGCCGGTGAGGGTCT<br>TGGTCTTGCCTGTGAGGGTCT | 21197 | HapII | CCGG |
| BaH53I11 | ATCATCTCCTTGAGCACCAGC<br>ATCATCTCCTGGAGCACCAGC | 21198 | MvaI | CCWGG |
| BaAL18N03 | TCGGAACTCCGGACGGGCTCG<br>TCGGAACTCCAGACGGGCTCG | 21201 | HapII | CCGG |
| baak40c08 | ATATATAACANGAAGAGAGCT<br>ATATATAACAAGAAGAGAGCT | 21202 | AluI | AGCT |
| baak40c08 | CTGCATTGCAGCTCTGTGTTA<br>CTGCATTGCAACTCTGTGTTA | 21203 | AluI | AGCT |
| baal33h17 | TAGACCGATAGATCCTACTTA<br>TAGACCGATAAATCCTACTTA | 21207 | MfII | RGATCY |
| bags20d08 | TCAGGACGGCCTTGTCAACCT<br>TCAGGACGGCTTTGTCAACCT | 21208 | HaeIII | GGCC |
| BaGS4J01 | TCGCGCCGTAAGCCTCGGTGC<br>TCGCGCCGTAGGCCTCGGTGC | 21209 | HaeIII | GGCC |
| BaAK17I01 | GTGGGTCCACAATCTCACCGA<br>GTGGGTCCACGATCTCACCGA | 21215 | MboI | GATC |
| BaAK30F08 | TTGCTCAGAGCCTGGGCCGCG<br>TTGCTCAGAGTCTGGGCCGCG | 21216 | HinfI | GANTC |
| bags19g17 | TGACAGCAGCCGATGTCGTGC<br>TGACAGCAGCTGATGTCGTGC | 21225 | AluI | AGCT |
| baak21I02 | CGTCCCATTCGAGGGTATCGG<br>CGTCCCATTCAAGGGTATCGG | 21226 | TaqI | TCGA |
| bags9I13 | ATATGTCCGCAAAAGGCGTTC<br>ATATGTCCGCGAAAGGCGTTC | 21232 | BstUI | CGCG |
| baak12i20 | CAAGAGACGCGGAGGATGACA<br>CAAGAGACGCAGAGGATGACA | 21241 | BstUI | CGCG |
| BaAK3M04 | AGCAAGGTACATCCAATACTT<br>AGCAAGGTACCTCCAATACTT | 21242 | BanI | GGYRCC |

TABLE 20-3

| Clones | Haruna Nijo H602 | SEQ ID NO: | Restriction enzyme | Recognition sequence |
|---|---|---|---|---|
| bah15n23 | GGCAGGGCAGATTTCCCACAA<br>GGCAGGGCAGCTTTCCCACAA | 21244 | AluI | AGCT |
| baak45i02 | CCGCAAGGGTGCGACCATCCT<br>CCGCAAGGGTCCGACCATCCT | 21245 | AvaII | GGWCC |
| BaH45B01 | AACCAAGCACAGTACCAGGAC<br>AACCAAGCACGGTACCAGGAC | 21253 | KpnI | GGTACC |
| baal23o14 | CCGCAAGGGTGCGACCATCCT<br>CCGCAAGGGTCCGACCATCCT | 21255 | AvaII | GGWCC |
| baal4d14 | AAGACTGAAAAAGCACCCCCT<br>AAGACTGAAAGAGCACCCCCT | 21271 | Bsp1286I | GDGCHC |
| baak29j13 | AGCAACCTTACAAACTGAAAG<br>AGCAACCTTAAAAACTGAAAG | 21280 | MseI | TTAA |
| bags20p18 | GTTTCGACTCGGATGCCGCTC<br>GTTTCGACTCAGATGCCGCTC | 21281 | FokI | GGATGNNNNNNNNN |
| BaAK12J13 | TGGTGACTCCGGTGATGCTGA<br>TGGTGACTCCCGTGATGCTGA | 21282 | HapII | CCGG |
| BaH27N11 | ACTAACCATGGAAAAGGCTTA<br>ACTAACCATGTAAAAGGCTTA | 21286 | NcoI | CCATGG |
| BaGS34D11 | CTATCTGCCAGATCCTGTCAC<br>CTATCTGCCATATCCTGTCAC | 21287 | MflI | RGATCY |
| BaGS39G07 | ATTTTGTCATTCAGATAATTT<br>ATTTTGTCATCCAGATAATTT | 21288 | FokI | NNNNNNNNNNNNNCATCC |
| BaGS32G02 | ATGCTGAAAGGACTCTTCTAG<br>ATGCTGAAAGAACTCTTCTAG | 21320 | HinfI | GANTC |
| bast21C1105 | TATATCCGTCAATATGTGGTA<br>TATATCCGTCGATATGTGGTA | 21326 | TaqI | TCGA |
| bags29f03 | CGCCATTAGGTGCTATGGAGG<br>CGCCATTAGGAGCTATGGAGG | 21327 | AluI | AGCT |
| BaAK46B16 | TCTGAACTGTCGATATGCCTA<br>TCTGAACTGTGGATATGCCTA | 21328 | TaqI | TCGA |
| baal16h16 | TTTCTTTCTGACGCAAGCAAA<br>TTTCTTTCTGGCGCAAGCAAA | 21329 | HhaI | GCGC |
| BsAL13O24 | CGCAGTTTTCCACTTGATTCT<br>CGCAGTTTTCGACTTGATTCT | 21338 | TaqI | TCGA |
| BaAL20M22 | GCGTCCTTGAACGCCGCTCTC<br>GCGTCCTTGAGCGCCGCTCTC | 21347 | HaeII | RGCGCY |
| BaAL151B12 | TCAAGAAGCATCCCTGAATAT<br>TCAAGAAGCAGCCCTGAATAT | 21353 | FokI | NNNNNNNNNNNNNCATCC |
| bags39h18 | TTTACCTGTTTGAATTTGCAA<br>TTTACCTGTTCGAATTTGCAA | 21360 | BspT104I | TTCGAA |
| BaAL3L23 | TCCACCTCACCAAGGAATTCA<br>TCCACCTCACTAAGGAATTCA | 21362 | DdeI | CTNPCT |
| BaH50L11 | ATCATAAAATCTTTTGAATCA<br>ATCATAAAATATTTTGAATCA | 21380 | SspI | AATATT |
| bast50G0814 | CTACAGCACAGTACTCTGCCG<br>CTACAGCACACTACTCTGCCG | 21381 | ScaI | AGTACT |
| BaH46B06 | AGACTCTGTCCCGGACTCCAG<br>AGACTCTGTCACGGACTCCAG | 21403 | HapII | CCGG |
| baal5e24 | TGAAGCGGATCGATCTAATGG<br>TGAAGCGGATTGATCTAATGG | 21404 | ClaI | ATCGAT |

TABLE 20-4

| Clones | Haruna Nijo H602 | SEQ ID NO: | Restriction enzyme | Recognition sequence |
|---|---|---|---|---|
| bags11a16 | GTTGTCCTGCCTAGGGTCGCC<br>GTTGTCCTGCTTAGGGTCGCC | 21405 | EcoT14lI | CCWWGG |
| BaGS37K02 | TCTTTGTCACGCGAACTGCCG<br>TCTTTGTCACACGAACTGCCG | 21413 | BstUI | CGCG |
| bah28a10 | ACTATCAGAGTCACACTATGA<br>ACTATCAGAGCCACACTATGA | 21414 | HinfI | GANTC |
| bah27c03 | GGCTGCCATCGGATGCAAACG<br>GGCTGCCATCCGATGCAAACG | 21415 | FokI | NNNNNNNNNNNNNCATCC |
| bags37g15 | GAGCTTTCGCGCTAAGTGACA<br>GAGCTTTCGCACTAAGTGACA | 21418 | BstUI | CGCG |
| BaH54L03 | CACACGGCGATCGGAGCTTCA<br>CACACGGCGACCGGAGCTTCA | 21426 | MboI | GATC |
| BaAK21J17 | GTGCATCGTAAATCATCAGGG<br>GTGCATCGTACATCATCAGGG | 21427 | AfaI | GTAC |
| bags23g08 | ATGATGCAGGCGCTCAGTGGA<br>ATGATGCAGGGGCTCAGTGGA | 21428 | HhaI | GCGC |
| BaAL2M19 | CCTAGTGGGCATCCTCCTCCT<br>CCTAGTGGGCGTCCTCCTCCT | 21440 | FokI | NNNNNNNNNNNNNCATCC |
| BaH36F15 | CGAGGCCCTGGGCGACGTACC<br>CGAGGCCCTGCGCGACGTACC | 21442 | MvaI | CCWGG |
| bah58l07 | GCTCAAACTGTGCTGACAGGC<br>GCTCAAACTGCGCTGACAGGC | 21443 | HhaI | GCGC |
| baet29C0406 | ACGGGAGCGACCGGCACCCAC<br>ACGGGAGCGAGCGGCACCCAC | 21444 | HapII | CCGG |
| BaAK35804 | ATCCCCTGCCCCGCCTTGAGG<br>ATCCCCTGCCGCGCCTTGAGG | 21445 | HhaI | GCGC |
| bags34k13 | ACAATTCTGACCGAACATAGC<br>ACAATTCTGATCGAACATAGC | 21446 | TaqI | TCGA |
| baal29i08 | CCTGTTGCTGCAGCTATATCT<br>CCTGTTGCTGTAGCTATATCT | 21447 | PstI | CTGCAG |
| baak11p10 | AAACGAGATGTGCTGTCTAGT<br>AAACGAGATGCGCTGTCTAGT | 21448 | HhaI | GCGC |
| bags4e12 | GGAACTTGCGGAGTTTCAGGA<br>GGAACTTGCGCAGTTTCAGGA | 21449 | HhaI | GCGC |
| basd24b08 | TAAAGATTGGCCTGATTTGTT<br>TAAAGATTGGTCTGATTTGTT | 21457 | HaeIII | GGCC |
| baalf3o10 | GTCGATCTCCGGCTGCGCCAC<br>GTCGATCTCCAGCTGCGCCAC | 21463 | AluI | AGCT |
| bags15d14 | CTATTTTTANAGGATGGGAC<br>CTATTTTTTAAAGGATGGGAC | 21471 | FokI | GGATGNNNNNNNNN |
| bags15d14 | CTTTGTCATCCGTATTTCTTA<br>CTTTGTCATCTGTATTTCTTA | 21472 | FokI | NNNNNNNNNNNNNCATCC |
| BaGS37E09 | GGGCAGAGTCTCGCCAGTAGC<br>GGGCAGAGTCGCGCCAGTAGC | 21473 | HhaI | GCGC |
| BaGS19I11 | ATGCTGTTAATGCTTGACGAT<br>ATGCTGTTAAAGCTTGACGAT | 21481 | HindIII | AAGCTT |
| BaGS18P04 | ATTCACTGGTACAGACGATGA<br>ATTCACTGGTGCAGACGATGA | 21491 | AfaI | GTAC |
| bags19e06 | GCGAGTAGATCATTAAGAATT<br>GCGAGTAGATTATTAAGAATT | 21492 | MboI | GATC |

TABLE 20-5

| Clones | Haruna Nijo H602 | SEQ ID NO: | Restriction enzyme | Recognition sequence |
|---|---|---|---|---|
| baak35n07 | TTCCGCTCTCACCAACCGAGG<br>TTCCGCTCTCCCCAACCGAGG | 21493 | HphI | NNNNNNNTCACC |
| BaAK14C17 | GTGCAGGCCGACGAACAATGG<br>GTGCAGGCCGTCGAACAATGG | 21519 | TaqI | TCGA |
| BaAK1N06 | CAATTGCATCCTAGTTAGCCG<br>CAATTGCATCTTAGTTAGCCG | 21525 | XspI | CTAG |
| bags38d10 | ATACCTCAGCTAATCTCTGGC<br>ATACCTCAGCCAATCTCTGGC | 21526 | AluI | AGCT |
| BaAK19J15 | GGAAGGTGGGTACCTCCACGA<br>GGAAGGTGGGCACCTCCACGA | 21527 | AfaI | GTAC |
| BaGS37D24 | TCGTTCAGGGACAAGGAGTTG<br>TCGTTCAGGGCCAAGGAGTTG | 21544 | HaeIII | GGCC |
| BaGS9K15 | GAAACTTCCACGGAAGGACTG<br>GAAACTTCCAGGGAAGGACTG | 21545 | MvaI | CCWGG |
| BaGS33L03 | ACACACGCCGTCGGAAGGCCC<br>ACACACGCCGCCGGGAAGGCCC | 21546 | SacII | CCGCGG |
| kr58F0511 | GCTTCGTTGTGTACTGGGTCT<br>GCTTCGTTGTTTACTGGGTCT | 21548 | AfaI | GTAC |
| baak39o18 | AGCCAACATGATACTCTCTAT<br>AGCCAACATGGTACTCTCTAT | 21566 | AfaI | GTAC |
| bags20p12 | GCACCCGGGCTCCGACCACGT<br>GCACCCGGGCGCCGACCACGT | 21567 | BanII | GRGCYC |
| bags38f23 | TCAATGATAGCTACTTTCAAG<br>TCAATGATAGTTACTTTCAAG | 21568 | AluI | AGCT |
| bags3k09 | TGAACATACAATGAGAGAGCT<br>TGAACATACAGTGAGAGAGCT | 21575 | TspRI | CASTGNN |
| baak34p14 | CAATGTCCCGGAGGATACGGA<br>CAATGTCCCGAAGGATACGGA | 21580 | BcnI | CCSGG |
| basd15m11 | CAGCACAGGTCCATAGATGGA<br>CAGCACAGGTTCATAGATGGA | 21583 | AvaII | GGWCC |
| bags21b06 | AAGAACAGCTAAAACATATAT<br>AAGAACAGCTGAAACATATAT | 21584 | PvuII | CAGCTG |
| BaH18F07 | TGGGGGCGGCGCCCAGCACTC<br>TGGGGGCGGCTCCCAGCACTC | 21585 | HhaI | GCGC |
| BaH44A23 | CAGCATCTTCGAATGCTGAGA<br>CAGCATCTTCAAATGCTGAGA | 21586 | BspT104I | TTTCGAA |
| bags3d07 | AGACACCGACCGCAGTTGACG<br>AGACACCGACTGCAGTTGACG | 21587 | PstI | CTGCAG |
| baak24e07 | CGGTAGGCACCCAAGAGCTCC<br>CGGTAGGCACGCAAGAGCTCC | 21589 | BanI | GGYRCC |

TABLE 21-1

| Clones | Haruna Nijo H602 | SEQ ID NO: | Restriction enzyme | Recognition sequence |
|---|---|---|---|---|
| bah42i06 | CTTGCTTGCTCACATGGTGAG<br>CTTGCTTGCTGACATGGTGAG | 21600 | DraIII | CACNNNGTG |
| bagsl2l21 | TCCTTGCATCTGTCTCACCAT<br>TCCTTGCATCCGTCTCACCAT | 21629 | FokI | NNNNNNNNNNNNNCATCC |
| baak12j24 | GTTCGGCCCGTGGAAAGGCAG<br>GTTCGGCCCGCGGAAAGGCAG | 21630 | SacII | CCGCGG |

TABLE 21-1-continued

| Clones | Haruna Nijo H602 | SEQ ID NO: | Restriction enzyme | Recognition sequence |
|---|---|---|---|---|
| bags14d22 | TTAGGAAGAGGGCGAGATAGG<br>TTAGGAAGAGCGCGAGATAGG | 21631 | BstUI | CGCG |
| baa16b02 | AGTGTTCCGGGAGAAGCTCCG<br>AGTGTTCCGGCAGAAGCTCCG | 21633 | BcnI | CCSGG |
| baak29f13 | AGATCCACTAACATCTCCGTA<br>AGATCCACTAGCATCTCCGTA | 21634 | XspI | CTAG |
| bags19e04 | TTATAAGGCCGTAAATCTAAA<br>TTATAAGGCCCTAAATCTAAA | 21643 | Cfr13I | GGNCC |
| BaH28L07 | CCATGCTTCCCAGGACAGAGC<br>CCATGCTTCCGAGGACAGAGC | 21644 | MvaI | CCWGG |
| baak21m18 | TGATGATCCGCGGGGAAGGT<br>TGATGATCCGTGGGGAAGGT | 21645 | SacII | CCGCGG |
| BaH59A20 | AGTTCTGGGATGGCGGGTTGA<br>AGTTCTGGGACGGCGGGTTGA | 21657 | FokI | GGATGNNNNNNNNN |
| BaAK31N06 | AGATTTTGTTGACTGACCGAC<br>AGATTTTGTTCACTGACCGAC | 21662 | TspRI | CASTGNN |
| bags29c18 | ATACTACTGAAACACGATATC<br>ATACTACTGAGACACGATATC | 21666 | DdeI | CTNAG |
| bags37n23 | GCCGGCGTTAACAGAGCCAGC<br>GCCGGCGTTAGCAGAGCCAGG | 21670 | MseI | TTAA |
| BaGS21E20 | AAACAACACGACCGAGACGGT<br>AAACAACACGGCCGAGACCGT | 21681 | HaeIII | GGCC |
| BaAK37P20 | ATTGCTTCTCAGA-TCAAACC<br>ATTGCTTCTCGGAGTCAAACC | 21694<br>21695 | DdeI | CTNAG |
| bah34b22 | TACCGTCGCTTAAATACCATC<br>TACCGTCGCTNAAATACCATC | 21699 | MseI | TTAA |
| bah34b22 | TCTTCACTTAAACAAATCCAG<br>TCTTCACTTACACAAATCCAG | 21700 | MseI | TTAA |
| baak42a24 | ATGACTCCGGAGCTTTACCAA<br>ATGACTCCGGCGCTTTACCAA | 21708 | HhaI | GCGC |
| baak16f06 | AAGCAGCACAGCGCCGTGAAC<br>AAGCAGCACAACGCCGTGAAC | 21709 | HhaI | GCGC |
| baak16f06 | TGGGGGTCTCCGCTGCGCCTT<br>TGGGGGTCTCTGCTGCGCCTT | 21710 | HhaI | GCGC |
| bah11m12 | GTGCTAGCTAGTAATATGCAG<br>GTGCTAGCTATTAATATGCAG | 21711 | AsaI | ATTAAT |
| baak33d06 | TTCAGACACTAATGCTCCGTA<br>TTCAGACACTGATGCTCCGTA | 21719 | TspRI | CASTGNN |
| BaGS25G03 | ACAGCTCTGGACTGTGGTGGC<br>ACAGCTCTGGCCTGTGGTGGC | 21725 | HaeIII | GGCC |
| bast42C0406 | AGTGCCTCCTCGCCAGCGACA<br>AGTGCCTCCTAGCCAGCGACA | 21728 | XspI | CTAG |

TABLE 21-2

| Clones | Haruna Nijo H602 | SEQ ID NO: | Restriction enzyme | Recognition sequence |
|---|---|---|---|---|
| bags17i04 | TGCAACAGATGCGTCTAACTT<br>TGCAACAGATCCGTCTAACTT | 21758 | MboI | GATC |
| baa140b06 | AGACTCCGTCAACTTCCAGCA<br>AGACTCCGTCGACTTCCAGCA | 21762 | TaqI | TCGA |

TABLE 21-2-continued

| Clones | Haruna Nijo H602 | SEQ ID NO: | Restriction enzyme | Recognition sequence |
|---|---|---|---|---|
| baal40b06 | TCCATCTGCAATTTCAGTAAA<br>TCGATCTGCATTTTCAGTAAA | 21763 | TaqI | TCGA |
| baak3c01 | CGGGCCGTAGCTGGCCTGGTT<br>CGGGCCGTAGGTGGCCTGGTT | 21770 | AluI | AGCT |
| baak3c01 | CTCCTTGAGCTTGAACGGTCC<br>CTCCTTGAGCCTGAACGGTCC | 21771 | AluI | AGCT |
| BaH52L11 | GACATGACTTGGAACTATCCT<br>AACATGACTTAGAACTATCCT | 21788 | DdeI | CTNAG |
| BaH52L11 | GTGTACCTGAGCATT-CAGAA<br>GTGTACCTGACCATTTCAGAA | 21789<br>21790 | DdeI | CTNAG |
| BaH52L11 | TCAGCCTCTCTGAGTAGAGCT<br>TCAGCCTCTCCGAGTAGAGCT | 21791 | DdeI | CTNAG |
| baaI8b16 | TTGCTCCCCTCATCAGAGGTA<br>TTGCTCCCCTGATCAGAGGAA | 21792 | MboI | GATC |
| bah60l22 | CGCCAAACTAGTAGGACAAAA<br>CGCCAAACTAATAGGACAAAA | 21801 | XspI | CTAG |
| bags21m22 | TAAAAGAAGCACAATATGAT<br>TAAAAGAAGTACAATATGAT | 21802 | AfaI | GTAC |
| BaH54E07 | GGCAGTACACGAGCTTCCGAG<br>GGCAGTACACAAGCTTCCGAG | 21803 | HindIII | AAGCTT |
| BaAK39A20 | AGTCTTTTTAAAGATTCCACT<br>AGTCTTTTTAGAGATTCCACT | 21804 | DraI | TTTAAA |
| baet32B1103 | CAGTTCCTCTAGAACAGAGCT<br>CAGTTCCTCTGGAACAGAGCT | 21810 | XbaI | TCTAGA |
| BaAK31O16 | TATATGAAGCGCTCCAGCACG<br>TATATGAAGCACTCCAGCACG | 21811 | HhaI | GCGC |
| bags39l20 | TGTCCTGAGTTGCAGCCCTTG<br>TGTCCTGAGTCGCAGCCCTTG | 21812 | HinfI | GANTC |
| BaGS15L12 | ATCTCTTCCTCGGGAACCGCT<br>ATCTCTTCCTTGGGAACCGCT | 21813 | AvaI | CYCGRG |
| bags11h08 | CAATGCGGTACCCCTCGACGG<br>CAATGCGGTATCCCTCGACGG | 21831 | AfaI | GTAC |
| BaAK13L03 | CAAGAAAGTACTTTTGGAAAA<br>CAAGAAAGTAATTTTGGAAAA | 21851 | AfaI | GTAC |
| basd20j22 | ACAGCAGGTACTGTGATTAAG<br>ACAGCAGGTATTGTGATTAAG | 21854 | AfaI | GTAC |
| BaGS38F01 | TGAGACATCTTAAACCTTCAC<br>TGAGACATCTCAAACCTTCAC | 21861 | MseI | TTAA |
| BaAK32I05 | CCCCAAACTAATAGATGAAAA<br>CCCCAAACTAGTAGATGAAAA | 21862 | XspI | CTAG |
| BaAK14F01 | TTCAAACATCGGCGGAAGATT<br>TTCAAACATCCGCGGAAGATT | 21870 | SacII | CCGCGG |
| bah57o01 | TCTCGCCGGCATCCTCCTCCA<br>TCTCGCCGGCGTCCTCCTCCA | 21871 | FokI | NNNNNNNNNNNNNCATCC |

TABLE 21-3

| Clones | Haruna Nijo H602 | SEQ ID NO: | Restriction enzyme | Recognition sequence |
|---|---|---|---|---|
| basd12f05 | GCACCGGGAGCTCTTGGCTCC<br>GCACCGGGAGTTCTTGGCTCC | 21872 | SacI | GAGCTC |

TABLE 21-3-continued

| Clones | Haruna Nijo H602 | SEQ ID NO: | Restriction enzyme | Recognition sequence |
|---|---|---|---|---|
| bah58e21 | TAAACTTGGTGCTCCTGTAAC<br>TAAACTTGGTTCTCCTGTAAC | 21873 | Bsp1286I | GDGCHC |
| bags1d07 | CAATGAGGATTCTATGTGGTG<br>CAATGAGGATCCTATGTGGTG | 21874 | MboI | GATC |
| BaH23J15 | TTCAAACATCGGCGGAAGATT<br>TTCAAACATCCGCGGAAGATT | 21875 | SKII | CCGCGG |
| baal18g23 | TCTCGCCGGCATCCTCCTCCA<br>TCTCGCCGGCGTCCTCCTCCA | 21882 | FokI | NNNNNNNNNNNNNCATCC |
| BaH50P14 | TCAGCGTGGACGTGGTGGAGT<br>TCAGCGTGGATGTGGTGGAGT | 21892 | FokI | GGATGNNNNNNNNN |
| BaAK23L23 | TCGGATATCCCGGGTAACCAA<br>TCGGATATCCTGGGTAACCAA | 21902 | AvaI | CYCGRG |
| bags7a23 | CCGGCTCATATTGCAGCATTT<br>CCGGCTCATACTGCAGCATTT | 21903 | PstI | CTGCAG |
| bah56l04 | AGCAACTCTAACCTACCTCGA<br>AGCAACTCTAGCCTACCTCGA | 21904 | XspI | CTAG |
| BaAL6G08 | ATCAAAAACGCGATGCCACCA<br>ATCAAAAACGAGATGCCACCA | 21923 | BstUI | CGCG |
| bast10C0406 | TGCTAGGTTCCATCATCCTGC<br>TGCTAGGTTCGATCATCCTGC | 21931 | TaqI | TCGA |
| bah62n05 | GAAAAAACGCATGAGTCTAAC<br>GAAAAAACGCGTGAGTCTAAC | 21945 | BstUI | CGCG |
| baak20d11 | GTGGCAGTGCGCCGCCAATGG<br>GTGGCAGTGCTCCGCCAATGG | 21958 | HhaI | GCGC |
| BaAL6D19 | GTAACTTGGCCTTTCATCGAC<br>GTAACTTGGCTTTTCATCGAC | 21959 | HaeIII | GGCC |
| baak43e16 | ACATGTTGTATAGGTCTTCGA<br>ACATGTTGTACAGGTCTTCGA | 21960 | AfaI | GTAC |
| baak40b02 | GCAATTTCAGTGCTAGATTGG<br>GCAATTTCAGAGCTAGATTGG | 21961 | AkAI | AGCT |
| bah62m03 | AGCTTCGCGGAGCTATGACCT<br>AGCTTCGCGGCGCTATGACCT | 21962 | HhaI | GCGC |
| bah56g23 | ACTGTTCCTG_ATGTCGAGAA<br>ACTGTTCCTGGATGTCGAGAA | 21977<br>21978 | MvaI | CCWGG |
| bah56g23 | GAGAAACCTGGCGAAACCGCA<br>GAGAAACCTGACGAAACCGCA | 21979 | MvaI | CCWGG |
| basd22f14 | TTCATTCACAGGCCAGCTTGG<br>TTCATTCACACGCCAGCTTGG | 21980 | HaeIII | GGCC |
| BaAK26G13 | CAAGACCGAACTAATCTTGCT<br>CAAGACCGAATTAATCTTGCT | 21984 | AseI | ATTAAT |
| BaAK44D07 | CCTCCTCTGGGCCGTCGACGT<br>CCTCCTCTGGTCCGTCGACGT | 21985 | HaeII | GGCC |
| bah34b20 | AGATGGTCTCCGATCGGTGGG<br>AGATGGTCTCAGATCGGTGGG | 21987 | DdeI | CTNAG |
| BaAK42B16 | AATGCTTTCGAAATCAGTNNT<br>AATGCTTTGGGAATCAGTTTA | 21992 | TaqI | TCGA |

TABLE 21-4

| Clones | Haruna Nijo H602 | SEQ ID NO: | Restriction enzyme | Recognition sequence |
|---|---|---|---|---|
| BaAK42816 | GGAAATCTCGGTTTTGAATAC<br>GGAAATCTCGATTTTGAATAC | 21993 | TaqI | TCGA |
| baal4d05 | TGCCGGAATCACCAGGTTGGC<br>TGCCGGAATCCCCACCTTCGC | 22022 | HphI | NNNNNNNTCACC |
| basd20103 | AGCGCCAGAGCCCCATCTTGA<br>AGCGCCAGAGGCCCATCTTGA | 22023 | Cfr13I | GGNCC |
| baal31b03 | ACTTTCTAGCGCGTGCTTCTG<br>ACTTTCTAGCCCGTGCTTCTG | 22024 | HhaI | GCGC |
| bags27k21 | TCCTGGCAGCTGTCAACTATG<br>TCCTGGCAGCCGTCAACTATG | 22025 | AluI | AGCT |
| bah55n15 | CAGCAAACTTTAAATGTTTTT<br>CAGCAAACTTCAAATGTTTTT | 22026 | DraI | TTTAAA |
| BaAK20B23 | ATCAATACTCAGAAGGCGTTA<br>ATCAATACTCGGAAGGCGTTA | 22031 | DdeI | CTNAG |
| bags22c18 | ATGACATTTCGAAATTTTGCT<br>ATGACATTTCAAAATTTTGCT | 22036 | BspT104I | TTCGAA |
| bah29d20 | ACCCAAAAGCTCTATCCTACG<br>ACCCAAAAGCCCTATCCTACG | 22040 | AluI | AGCT |
| bah44f20 | CCTACACCCGAGCGTAATGGA<br>CCTACACCCGCGCGTAATGGA | 22041 | BstUI | CGCG |
| BaAL4A11 | GCTGAGGTACACGCGCTGGAG<br>GCTGAGGTACCCGCGCTGGAG | 22049 | KpnI | GGTACC |
| BaGS22I18 | CCAATTTATACTCAGCCATTC<br>CCAATTTATAGTCACCCATTC | 22050 | DdeI | CTNAG |
| BaAK40P18 | CCCTTTGGTCAAGGCTCAGAC<br>CCCTTTGGTCGAGGCTCAGAC | 22065 | TaqI | TCGA |
| BaH27K19 | TCTAAGAAGGGGACTCGTGTC<br>TCTAAGAAGGAGACTCGTGTC | 22070 | BsmAI | NNNNNGAGAC |
| bags15j07 | CATTTTGCCACACATAGTGAG<br>CATTTTGCCAGACATAGTGAG | 22071 | DraIII | CACNNNGTG |
| bah19a07 | GGTCTTGGTCGCGTCGTCGAG<br>GGTCTTGGTCACGTCGTCGAG | 22072 | BstUI | CGCG |
| bah44n05 | AGATGAAGCGCCATCGACATA<br>AGATGAAGCGTCATCGACATA | 22103 | HhaI | GCGC |
| BaGS13H12 | GACAAAGTTAATCAGTAATTG<br>GACAAACTTATTCACTAATTG | 22113 | MseI | TTAA |
| BaAL19B06 | ATATGTTCTCGACAGCCCGCA<br>ATATGTTCTCCACAGCCCGCA | 22114 | TaqI | TCGA |
| BaSD15P23 | GTGTCCCTCCGGTGCCTTCTC<br>GTGTCCCTCCTGTGCCTTCTC | 22115 | BanI | GGYRCC |
| kr27H1216 | CTGCGTCGTCAACTATCTGAA<br>CTGCGTCGTCGACTATCTGAA | 22130 | SaII | GTCGAC |
| BaAK25O11 | GGGCTACTGTCTCTGCATGCT<br>GGGCTACTGTATCTGCATGCT | 22131 | BsmAI | GTCTCN |
| BaH36N15 | CACTTCCGGCGCTGGATTTGC<br>CACTTCCGGCCCTGGATTTGC | 22138 | HaeIII | GGCC |
| BaAK38E05 | CTTGTATGTCGAGCGACAACG<br>CTTGTATGTCAAGCGACAACG | 22144 | TaqI | TCGA |

TABLE 21-5

| Clones | Haruna Nijo H602 | SEQ ID NO: | Restriction enzyme | Recognition sequence |
|---|---|---|---|---|
| bast60C0105 | CAGCCGCCTCATCCAGCGCCC<br>CAGCCGCCTCGTCCAGCGCCC | 22152 | FokI | NNNNNNNNNNNNNCATCC |
| BaAL24O04 | CCTGCAACGCGAAGTTCTGGC<br>CCTGCAACGCAAAGTTCTGGC | 22154 | BstUI | CGCG |
| BaGS31G02 | CCACAGAAGAGAGCTGGTGAT<br>CCACAGAAGACAGCTGGTGAT | 22164 | PvuII | CAGCTG |
| basd18g14 | TGGCATTGGACGTCTCGAACA<br>TGGCATTGGATGTCTCGAACA | 22167 | FokI | GGATGNNNNNNNNN |
| bah11k13 | GGCCATCCTCAAGCTGCTTGC<br>GGCCATCCTCGAGCTGCTTGC | 22178 | XhoI | CTCGAG |
| bags32a01 | GCGCTTTCCCAGATCCCTTAG<br>GCGCTTCCCCGGATCCCTTAG | 22184 | HapII | CCGG |
| bags32a01 | GAGTAACCGCTGCCATTGTTG<br>GAGTAACCGCCGGCATTGTTG | 22185 | HapII | CCGG |
| baal37j12 | CATAGCCTTCCACGCTAGCAT<br>CATAGCCTTCGACGCTAGCAT | 22193 | TaqI | TCGA |
| BaAK40H10 | TATTGAGCATTGAGCCCTCTC<br>TATTGAGCATCGAGCCCTCTC | 22195 | TaqI | TCGA |
| BaAK40H10 | TTAAGAACTTCGAATCATCAC<br>TCAAGAACTTTGAATCATCAC | 22196 | TaqI | TCGA |
| bah56p08 | GCTTATCATCCCGGTCGTATC<br>GCTTATCATCACGGTCGTATC | 22203 | HapII | CCGG |
| bags1i05 | ACAGAGACTACGGCATCACTG<br>ACAGACACTAGGGCATCACTG | 22204 | XspI | CTAG |
| BaH29M21 | CCAGCAGCTCTAGGCTTGCGC<br>CCAGCAGCTCCAGGCTTGCGC | 22205 | MvaI | CCWGG |
| bags21c04 | AGCATGAGCCTGCTTACATCC<br>ACCATGAGCCAGCTTACATCC | 22206 | AluI | AGCT |
| baak32p09 | CGCCTTCTGCAGGGTCTTCGA<br>CGCCTTCTGCGGGGTCTTCGA | 22207 | PstI | CTGCAG |
| BaH22B15 | ACACAAACTCCGGTGAAGCAA<br>ACACAAACTCTGCTCAAGCAA | 22221 | HapII | CCGG |
| BaGS23J01 | TGCCGATGTCGGGGTGCACCT<br>TGCCGATGTCCGGGTGCACCT | 22239 | HapII | CCGG |
| baak46i07 | GCCACCCTCGCGATGATGTCT<br>GCCACCCTCGTGATGATGTCT | 22242 | BstUI | CGCG |
| BaAL6J13 | GATCTCACTGTACCGCGAGCC<br>GATCTCACTGCACCGCGAGCC | 22243 | AfaI | GTAC |
| BaH54J20 | ATTTCAGCCAGGGTCATCATC<br>ATTTCAGCCATGGTCATCATC | 22254 | NcoI | CCATGG |
| BaGS7F20 | AGTCAATCACGATTCAAGGCG<br>ACTCAATCACAATTCAAGGCG | 22255 | HinfI | GANTC |
| bags11p11 | CCTTTGTTTCGACAACATGTC<br>CCTTTGTTTCAACAACATGTC | 22256 | TaqI | TCGA |
| bags11p11 | CTTCTCATCGTGCAGAACAAG<br>CTTCTCATCGAGCAGAACAAG | 22257 | TaqI | TCGA |
| baak26h17 | TTTCCTGGTCCGGATTGGACT<br>TTTCCTGGTCTGGATTGGACT | 22277 | HapII | CCGG |

TABLE 21-6

| Clones | Haruna Nijo H602 | SEQ ID NO: | Restriction enzyme | Recognition sequence |
|---|---|---|---|---|
| BaGS4H02 | CGGCGAGGTACCCTCCTCCAC<br>CGGCGAGGTATCCTCCTCCAC | 22295 | KpnI | GGTACC |
| BaSD14J15 | CAAACATGACTGGTCCTAATG<br>CAAACATGACAGGTCCTAATG | 22302 | Cfr13I | GGNCC |
| BaSD14J15 | GTTGACGGCCTCTCGTGAACA<br>GTTGACGGCCCCTCGTGAACA | 22303 | Cfr13I | GGNCC |
| bags38n21 | AGAGCCCGCTCGAGTTTACAC<br>AGAGCCCGCTTGAGTTTACAC | 22314 | XhoI | CTCGAG |
| BaH49M02 | CAGCACGTTCCAAACAATAGG<br>CAGCACGTTCGAAACAATAGG | 22318 | BspT104I | TTCGAA |
| baak38f04 | CCCCCTCGCCTGCTCTTCTCC<br>CCCCCTCGCCGGCTCTTCTCC | 22319 | HapII | CCGG |
| basd15d20 | TCATGGAGTCGTACCTCATGA<br>TCATGGAGTCATACCTCATGA | 22324 | AfaI | GTAC |
| kr40H1115 | AAGTAAATTAAATTCAGAGTA<br>AAGTAAATTAGATTCAGAGTA | 22329 | HinfI | GANTC |

TABLE 22-1

| Clones | Haruna Nijo H602 | SEQ ID NO: |
|---|---|---|
| bags30b07 | GCAACCACGACGTACATCGTT<br>GCAACCACGAGGTACATCGTT | 17341 |
| BaAK17D13 | AGCTCGCGGCACCGTTCACCT<br>AGCTCGCGGCGCCGTTCACCT | 17343 |
| basd26l20 | CCTCCACGACCGCCCCGGGCT<br>CCTCCACGACGGCCCCGGGCT | 17344 |
| bah61p17 | ATAATGTATCCACATTCTCGC<br>ATAATGTATCGACATTCTCGC | 17345 |
| bah61p17 | TTTTCTGAAACGCAAACAATA<br>TTTTCTGAAATGCAAACAATA | 17346 |
| bah61p17 | CGCTTGCCCACGTGTGCAACA<br>CGCTTGCCCAAGTGTGCAACA | 17347 |
| kr12h0216 | TCCTCGGCGCAACCGCCTACA<br>TCCTCGGCGCGACCGCCTACA | 17348 |
| kr12h0216 | CACTTGTATGTAGTTCACCAA<br>CACTTGTATGCAGTTCACCAA | 17349 |
| kr12h0216 | ACCAGAGCAACTGACTCACTG<br>ACCAGAGCAAATGACTCACTG | 17350 |
| kr12h0216 | ACTTCACCCTTGTCCAGCACA<br>ACTTCACCCTCGTCCAGCACA | 17351 |
| kr12h0216 | GCGGCATCTTCCTATGGTACT<br>GCGGCATCTTTCTATGGTACT | 17352 |
| kr26d0507 | TGCTAACATGTTTGTACGACC<br>TGCTAACATGCTTGTACGACC | 17357 |
| kr26d0507 | TCCACTCCATACTCCAGTGGT<br>TCCACTCCATGCTCCAGTGGT | 17358 |
| baak41n21 | ACCAGACGGGAGACTACGAGG<br>ACCAGACGGGCGACTACGAGG | 17360 |
| kr24b0903 | ACGCGTAAACTCCAAGTGCAT<br>ACGCGTAAACGCCAAGTGCAT | 17362 |
| kr24b0903 | TATTCAAGAACAAACACATG<br>TATTCAAGAAGAAACACATG | 17363 |
| kr24b0903 | AGTGCATTGATAGACTCCCCA<br>AGTGCATTGACAGAGTCCCGA | 17364 |
| kr24b0903 | CTGGAACCTGACTGCTAAAAG<br>CTGGAACCTGGCTGCTAAAAG | 17365 |
| kr24b0903 | TGCTGGAAACGAAAGTGGGGC<br>TGCTGGAAACTAAAGTGGGGC | 17366 |
| baal17o01 | CAAACATTAGCCAGTTACTTC<br>CAAACATTAGTCAGTTACTTC | 17367 |
| baak41a04 | GCTCTCAAGCGTCTGTTCATC<br>GCTCTCAAGCATCTGTTCATC | 17368 |
| baak41a04 | AAATAAACAGGAGGAAAGGA<br>AAATAAACAAGAGGAAAGGA | 17369 |
| baak41a04 | ATATGTCAGACATGCGTGGCA<br>ATATGTCAGAAATGCGTGGCA | 17370 |
| bags16g18 | CTCGCGGACGTACCCACCATT<br>CTCGCGGACGCACCCACCATT | 17371 |
| bags16g18 | CAGGTCTGGGTTTGCCAGGAA<br>CAGGTCTGGGATTGCCAGGAA | 17372 |

TABLE 22-2

| Clones | Haruna Nijo H602 | SEQ ID NO: |
|---|---|---|
| BaSD3C22 | AGCGTCCCTTGCCGGGATGGC<br>AGCGTCCCTTACCGGGATGGC | 17373 |
| BaSD3C22 | TGACGCAGTACCTTGATGCAA<br>TGACGCAGTATCTTGATGCAA | 17374 |
| basd27b10 | GGAGCGACGACCTTGATCTTC<br>GGAGCGACGAACTTGATCTTC | 17376 |

TABLE 22-2-continued

| Clones | Haruna Nijo H602 | SEQ ID NO: |
|---|---|---|
| basd27b10 | GGCGTATCCCAAGAGTACCCA<br>GGCGTATCCCGAGAGTACCCA | 17377 |
| bah47d23 | TGTCACCGGCATCAGCATAGT<br>TGTCACCGGCGTCAGCATAGT | 17378 |
| bah47d23 | GGTTTGGCGCAATGTCACCGG<br>GGTTTGGCGCAATGTCACCGG | 17379 |
| bah47d23 | GGGCCCTGTGCGCTTGGTTTG<br>GGGCCCTGTGTGCTTGGTTTG | 17380 |
| bah47d23 | CTGGTTCTTCGCACCACTGGT<br>CTGGTTCTTCACACCACTGGT | 17381 |
| BaH17D02 | CATGACCACCATCTCGTGCCG<br>CATGACCACCGTCTCGTGCCG | 17383 |
| BaH17D02 | TGCATCATCCCTGACTACTTC<br>TGCATCATCCGTGACTACTTC | 17384 |
| BaAK12I12 | TCCCATCATGGTATGTTCAAC<br>TCCCATCATGTTATGTTCAAC | 17389 |
| BaAK12I12 | GTTCTAAGGCACTTTAATAAT<br>GTTCTAAGGCTCTTTAATAAT | 17390 |
| BaAK12I12 | TGAACCGATTTGATACACTGC<br>TGAACCGATTCGATACACTGC | 17391 |
| baal6n04 | CCGTTGGAACGCACGGGTCT<br>CCGTTGGAACACACGGGTCT | 17392 |
| baal6n04 | CTTTGGAGTAGCCAAGCTCTC<br>CTTTGGAGTATCCAAGCTCTC | 17393 |
| baal6n04 | CCACGGTGGCAAACTTGTCGT<br>CCACGGTGGCGAACTTGTCGT | 17394 |
| baal6n04 | ACCTCCAGACGGCGGTTGTCT<br>ACCTCCAGACAGCGGTTGTCT | 17395 |
| baal6n04 | CCGTGTCCGAAGCTCGCCTCA<br>CCGTGTCCGAGGCTCGCCTCA | 17396 |
| baal6n04 | GGCACCCTGCAACTCATCTGT<br>GGCACCCTGCGACTCATCTGT | 17397 |
| baal16l05 | GAAGGGATTGGAGAGTATGTC<br>GAAGGGATTGCAGAGTATGTC | 17398 |
| baal16l05 | CTATCACTCTTATCAGTGAAG<br>CTATCACTCTGATCAGTGAAG | 17399 |
| BaSD3J13 | AGTGACGCTGCCTTCTGGGCC<br>AGTGACGCTGTCTTCTGGGCC | 17400 |
| BaSD3J13 | CGCCCAGACGAGGGTCCAGCA<br>CGCCCAGACGGGGGTCCAGCA | 17401 |
| BaSD3J13 | CCTTGGCGTCATGGAGCTGCT<br>CCTTGGCGTCGTGGAGCTGCT | 17402 |
| BaAK16M07 | GCTTCGCCCTCGCTGTAGACG<br>GCTTCGCCCTTGCTGTAGACG | 17406 |

TABLE 22-3

| Clones | Haruna Nijo H602 | SEQ ID NO: |
|---|---|---|
| BaAK16M07 | TCATTGCTTCCTGCACACCAT<br>TCATTGCTTCATGCACACCAT | 17407 |

TABLE 22-3-continued

| Clones | Haruna Nijo H602 | SEQ ID NO: |
|---|---|---|
| BaH36M15 | CTGACCATGCAACGAAGAATA<br>CTGACCATGCGACGAAGAATA | 17408 |
| baal39c22 | AGCACACAGCCGAGGCTCGCT<br>AGCACACAGCAGAGGCTCGCT | 17409 |
| kr68b0303 | CCTCGTCCTCCTCGCCGGAGA<br>CCTCGTCCTCGTCGCCGGAGA | 17410 |
| baak24d09 | GGCGAGGTACCGCACGACCTG<br>GGCGAGGTACGGCACGACCTG | 17411 |
| baak24d09 | GCACGACCTGGCTCCTCTTCC<br>GCACGACCTGCCTCCTCTTCC | 17412 |
| baal19i12 | GGCTTACAGTCGACAGTAATC<br>GGCTTACAGTTGACAGTAATC | 17418 |
| baal19i12 | GAATCTGGGTTGGATGATGGC<br>GAATCTGGGTCGGATGATGGC | 17419 |
| baal19i12 | ATGGCACACCTTTGTTCAATG<br>ATGGCACACCCTTGTTCAATG | 17420 |
| baal19i12 | GAAACATCTATTAGGCTTACA<br>GAAACATCTACTAGGCTTACA | 17421 |
| kr18g0814 | GTGAAATTGGCGGGTGGGAT<br>GTGAAATTGGTGGGTGGGGAT | 17425 |
| BaGS8B13 | TGGTGCCAGCACCGTCGACGG<br>TGGTGCCAGCGCCGTCGACGG | 17427 |
| BaGS8B13 | TACCGATCCCAATAAGCGCCT<br>TACCGATCCCGATAAGCGCCT | 17428 |
| BaGS8B13 | AAGCGGACGAGCGCCTCTTCA<br>AAGCGGACGAACGCCTCTTCA | 17429 |
| BaGS8B13 | TTGGTGAGCAGATTCTTACCG<br>TTGGTGAGCACATTCTTACCG | 17430 |
| BaGS8B13 | GGTTGGTTTGGCGCAGCTTGC<br>GGTTGGTTTGACGCAGCTTGC | 17431 |
| BaH25J08 | AAGATGCACAGGAACATATTT<br>AAGATGCACAAGAACATATTT | 17432 |
| BaH25J08 | TGTAAGTAAAGAGATCGATAG<br>TGTAAGTAAACAGATCGATAG | 17433 |
| baak3d11 | ACATGCGAAACCACAAGAGAT<br>ACATGCGAAATCACAAGAGAT | 17434 |
| baak3d11 | ATACTATTAGAGTCTTCGGTA<br>ATACTATTAGGGTCTTCGGTA | 17435 |
| baak3d11 | CTTTGTAGCATTGCTGCCTAA<br>CTTTGTAGCAATGCTGCCTAA | 17436 |
| baak3d11 | ATGCAGATGAACAATTATAGT<br>ATGCAGATGAGCAATTATAGT | 17437 |
| baak3d11 | CTGCCTAACACATTAAAATTT<br>CTGCCTAACAAATTAAAATTT | 17438 |
| baal12p08 | AGTCTCAGAANGATGGGATGA<br>AGTCTCAGAAGGATGGGATGA | 17439 |
| baal12p08 | AGTGAGCTTTCATGTATCAGG<br>AGTGAGCTTTNATGTATCAGG | 17440 |

TABLE 22-4

| Clones | Haruna Nijo / H602 | SEQ ID NO: |
|---|---|---|
| bags39i20 | GGTTGTCAGACTCGTGCACCT<br>GGTTGTCAGATTCGTGCACCT | 17441 |
| bags39i20 | TCTGGCACGGCCAAGGGGAAC<br>TCTGGCACGGTCAAGGGGAAC | 17442 |
| bags39i20 | AGGGGAACTCGAACTCTTGAT<br>AGGGGAACTCTAACTCTTGAT | 17443 |
| kr15a0402 | ATAGTAGAAATGCATGGTCAC<br>ATAGTAGAAACGCATGGTCAC | 17444 |
| baal3c01 | CATCAACACATTTCAGCAAGA<br>CATCAACACAGTTCAGCAAGA | 17445 |
| baal3c01 | CCACGGTGGGGACGCCGGGT<br>CCACGGTGGGAACGCCGGGT | 17446 |
| baal3c01 | CGTTGTTGTACGTGAACGCAC<br>CGTTGTTGTAGGTGAACGCAC | 17447 |
| baak41i03 | TCTCGGCACTTTTATGAGTTG<br>TCTCGGCACTCTTATGAGTTG | 17448 |
| BaGS29M13 | AGGAAGAAAAGGTAGAGATCT<br>AGGAAGAAAAGTAGAGATCT | 17449 |
| BaH24I06 | TCATACTAATGCCCCACACGA<br>TCATACTAATACCCCACACGA | 17452 |
| basd25c22 | AGACTGCTTATTCATGCATTG<br>AGACTGCTTACTCATGCATTG | 17454 |
| basd25c22 | AATTCCGAACAGAGGGAGTAT<br>AATTCCGAACGGAGGGAGTAT | 17455 |
| basd25c22 | GGGTGGCTGCGTGTGACAACA<br>GGGTGGCTGCATGTGACAACA | 17456 |
| basd25c22 | AATGCCTCGAATTAGTTATGA<br>AATGCCTCGACTTAGTTATGA | 17457 |
| basd25c22 | TTTTTCCTTAACTATTATATC<br>TTTTTCCTTATCTATTATATC | 17458 |
| basd25c22 | TAACTATCTCCTCATCTGGGT<br>TAACTATCTCATCATCTGGGT | 17459 |
| basd25c22 | ATGACAGATGCAACCAAGCAT<br>ATGACAGATGGAACCAAGCAT | 17460 |
| bah46p14 | TATTCCAGGTAAAGCTACCCC<br>TATTCCAGGTGAAGCTACCCC | 17463 |
| bags18d19 | ATGGAACAGCACTGAGCATTT<br>ATGGAACAGCGCTGAGCATTT | 17464 |
| bags18d19 | ACAGAACTTTCTGCACAACAG<br>ACAGAACTTTTTGCACAACAG | 17465 |
| bags18d19 | GCAAAGAGATCAAATACAATA<br>GCAAAGAGATAAAATACAATA | 17466 |
| bags18d19 | TTACTTACAGCTCTCTTTCCA<br>TTACTTACAGGTCTCTTTCCA | 17467 |
| bags18d19 | GGACTTTATCGTTAACCGGGC<br>GGACTTTATCATTAACCGGGC | 17468 |
| bags18d19 | GATCTGAATATTAGCATACTC<br>GATCTGAATACTAGCATACTC | 17469 |
| baak34j19 | TTTTCTTCTTGTAGTGTGTTT<br>TTTTCTTCTTTTAGTGTGTTT | 17470 |

TABLE 22-5

| Clones | Haruna Nijo / H602 | SEQ ID NO: |
|---|---|---|
| baak34j19 | TGAAGAAACATGAACAATATA<br>TGAAGAAACAGGAACAATATA | 17471 |
| baak2m05 | ACCTTTTTAATGAAGCATAC<br>ACCTTTTTATTGAAGCATAC | 17475 |
| baak2m05 | AGACACATAAAATGACGAGCT<br>AGACACATAAGATGACGAGCT | 17476 |
| baak2m05 | GAGTACATCGTAATAGACATA<br>GAGTACATCGCAATAGACATA | 17477 |
| BaGS31B11 | GCAAGGAATTGGAAACAGAAG<br>GCAAGGAATTAGAAACAGAAG | 17479 |
| BaAL35M08 | CAAGCCGCGCGCGAGCTAGCT<br>CAAGCCGCGCACGAGCTAGCT | 17480 |
| BaAL35M08 | CTGTATATGTCCGACCTGCAA<br>CTGTATATGTGCGACCTGCAA | 17481 |
| BaH58J20 | TGCCATGGTGTCTGAAATTCT<br>TGCCATGGTGCCTGAAATTCT | 17483 |
| BaGS22B13 | GTTCCTGCTTCTGACGAAGAG<br>GTTCCTGCTTTTGACGAAGAG | 17484 |
| BaGS22B13 | AACCCATATCCCACACACACC<br>AACCCATATCTCACACACACC | 17485 |
| BaGS22B13 | TAGGAGTAATTCACAACCCAT<br>TAGGAGTAATCCACAACCCAT | 17486 |
| BaAK43M01 | ATACACACTGAAAACCAGCGA<br>GAACACACTGGAAACCAGCGA | 17487 |
| bah14i07 | AGCCGGAAGATAATAACATGA<br>AGCCGGAAGAAAATAACATGA | 17488 |
| bah14i07 | TCAAGAATCGCCTTTGGGGT<br>TCAAGAATCGTCTTTGGGGT | 17489 |
| bah14i07 | GGTGTTTGGACCCAATACCAN<br>GGTGTTTGGAACCAATACCAN | 17490 |
| baal9j16 | CTGGCCAAAGAGTCTCCTCGG<br>CTGGCCAAAGTGTCTCCTCGG | 17492 |
| baal9j16 | CGGCGCGAAGGGATCGCGCTC<br>CGGCGCGAAGCGATCGCGCTC | 17493 |
| baal9j16 | TTGAACTATGCCCGGATGAGC<br>TTGAACTATGACCGGATGAGC | 17494 |
| BaAK2O24 | CCTTCCACTGCGAAGAAGTCA<br>CCTTCCACTGTGAAGAAGTCA | 17495 |
| bags22j15 | ATTGGCTTGCAGAATTCTCTC<br>ATTGGCTTGCGGAATTCTCTC | 17498 |
| baak44a23 | AAAATTCTATATTATGCTAGG<br>AAAATTCTATGTTATGCTAGG | 17499 |
| baak32n04 | GTGAAAAGTGACCGCTTCTC<br>GTGAAAAGTCACCGCTTCTC | 17500 |
| basd21e22 | CTCGTGTTTTTGCACTGCTCT<br>CTCGTGTTTTGGCACTGCTCT | 17501 |
| basd21e22 | CATGTACAACAAGAACGCGAC<br>CATGTACAACGAGAACGCGAC | 17502 |
| baak42e22 | GAAAATCGCGGGCGTTCATC<br>GAAAATCGCAGGCGTTCATC | 17503 |

TABLE 22-6

| Clones | Haruna Nijo / H602 | SEQ ID NO: |
|---|---|---|
| baake42e22 | ACACCCACGTTTGAAAATCTG<br>ACACCCACGTCTGAAAATCTG | 17504 |
| bast75e0610 | TCGGAGAAGAGACGGAGGGCG<br>TCGGAGAAGAAACGGAGGGCG | 17505 |
| baet16a1002 | TCCGCTGAGCCGCGCTTCTAG<br>TCCGCTGAGCGGCGCTTCTAG | 17506 |
| baak21i01 | GGCCCTCCTCTGCCCTAGCCG<br>GGCCCTCCTCCGCCCTAGCCG | 17508 |
| baak22o23 | GAAAAGAGTCTGCACCTTATC<br>GAAAAGAGTCCGCACCTTATC | 17510 |
| bah52h18 | ATATATACGAACTCATGTAGC<br>ATATATACGACCTCATGTAGC | 17512 |
| bah52h18 | AGGCTTCTGCACCCCTTGCTG<br>AGGCTTCTGCGCCCCTTGCTG | 17513 |
| bah52h18 | CGTACAGAGAAGAAACAGACA<br>CGTACAGAGAGGAAACAGACA | 17514 |
| baak33k20 | ATTTTGACTACGGTAGCTTGG<br>ATTTTGACTATGGTAGCTTGG | 17515 |
| baak33k20 | TTTGAACTATCTGGGACTGGG<br>TTTGAACTATGTGGGACTGGG | 17516 |
| baak33k20 | AAAGCTTAGATAATAACTGGT<br>AAAGCTTAGAGAATAACTGGT | 17517 |
| bags21f16 | ATAGATGCTTCACCAGTGCAC<br>ATAGATGCTTTACCAGTGCAC | 17518 |
| bags21f16 | GTAGAACCTCATGAACATTTC<br>GTAGAACCTCGTGAACATTTC | 17519 |
| bags34e05 | CCGCGTCCACAGCGAAGTCCA<br>CCGCGTCCACGGCGAAGTCCA | 17520 |
| bags34e05 | GTCAACGCAGCTCTGGGCATC<br>GTCAACGCAGTTCTGGGCATC | 17521 |
| bags19a02 | GGCTTTTGCCACTATCAACTG<br>GGCTTTTGCCGCTATCAACTG | 17523 |
| bags19a02 | TCGGGTAGACGAAAAAACCCG<br>TCGGGTAGACCAAAAAACCCG | 17524 |
| bags35k02 | CCAACGGCACAATCATCCCTC<br>CCAACGGCACGATCATCCCTC | 17525 |
| bah35a22 | CTCTCCCTGCTGAAATGCCAT<br>CTCTCCCTGCGGAAATGCCAT | 17526 |
| bah35a22 | CAGCAACAGCTATAAAACAAT<br>CAGCAACAGCCATAAAACAAT | 17527 |
| bags17h13 | ACACTTGACCTTGGCTGCTGC<br>ACACTTGACCGTGGCTGCTGC | 17528 |
| bah47n12 | CGATGGGTACCGCAGCTTGAA<br>CGATGGGTACGGCAGCTTGAA | 17529 |
| bah47n12 | CTGCTTCTTCCGCTGGGGGCC<br>CTGCTTCTTCTGCTGGGGGCC | 17530 |
| bah47n12 | CTACACGTACACAAGCTGCAG<br>CTACACGTACGCAAGCTGCAG | 17531 |
| baak12p11 | AGAAGTAGTGAGTATGATTGT<br>AGAAGTAGTGGGTATGATTGT | 17532 |

TABLE 22-7

| Clones | Haruna Nijo / H602 | SEQ ID NO: |
|---|---|---|
| baet38B1004 | ACCGAGACCCGACTCCACGGA<br>ACCGAGACCCAACTCCACGGA | 17533 |
| baet38B1004 | ATTTTCCCACACAGCCCTTTT<br>ATTTTCCCACGCAGCCCTTTT | 17534 |
| BaGS13K12 | TCGAGACGGCAGTCCACCAGC<br>TCGAGACGGCGGTCCACCAGC | 17535 |
| baal25a05 | GGTAGTTTATATGTGCAGCAT<br>GGTAGTTTATGTGTGCAGCAT | 17536 |
| baal25a05 | AGTGAACCAAATATCATAAAT<br>AGTGAACCAAGTATCATAAAT | 17537 |
| baal25a05 | TCATAAATGAGATGGTTTACG<br>TCATAAATGAAATGGTTTACG | 17538 |
| baal25a05 | TCGCCTTCTCAGTGTCCTTGT<br>TCGCCTTCTCGGTGTCCTTGT | 17539 |
| BaAK24J12 | TTCAGAGAATGAATGGATTAA<br>TTCAGAGAATAAATGGATTAA | 17540 |
| BaAK24J12 | CACCCACCTTTTTATTTATTGT<br>CACCCACCTTCTATTTATTGT | 17541 |
| basd1 4m22 | GCAGTTATAAATTGCTACTGT<br>GCAGTTATAATTTGCTACTGT | 17542 |
| basd1 4m22 | AGCACTTCATAAGTGCTTCCA<br>AGCACTTCATCAGTGCTTCCA | 17543 |
| bah17l24 | TCCCCCACAGTCGTGTTTCTC<br>TCCCCCACAGGCGTGTTTCTC | 17544 |
| bah17l24 | AAAGGTAAGTAAACATAAACT<br>AAAGGTAAGTGAACATAAACT | 17545 |
| baal29j09 | AGCCCTATGTAAAAACATTTC<br>AGCCCTATGTGAAAACATTTC | 17546 |
| baal29j09 | TAGGGCACCAAACAAACTAGA<br>TAGGGCACCAGACAAACTAGA | 17547 |
| baal29j09 | TATGTACACATTTTGCACAG<br>TATGTACACAATTTTGCACAG | 17548 |
| baal29j09 | TCATTCAGAGTCGTATATGTA<br>TCATTCAGAGCCGTATATGTA | 17549 |
| baal29j09 | AATGGTAATTACTCCAGAAGA<br>AATGGTAATTGCTCCAGAAGA | 17550 |
| bah16d09 | CATGTTGGATAGCTGCAACAC<br>CATGTTGGATTGCTGCAACAC | 17551 |
| bah16d09 | TTGCGCTCTCGGCAAGGCATA<br>TTGCGCTCTCTGCAAGGCATA | 17552 |
| bah60d03 | GGGCAACAAGATCGCCTGCAT<br>GGGCAACAAGGTCGCCTGCAT | 17553 |
| bah60d03 | ACAAATAATTTTGACAGTTCA<br>ACAAATAATTCTGACAGTTCA | 17554 |
| bah60d03 | TTATGGGCTCCGCGGCTTCTG<br>TTATGGGCTCTGCGGCTTCTG | 17555 |
| bah45i13 | GCAAAAGCAGCTTGAAGTATA<br>GCAAAAGCAGTTTGAAGTATA | 17556 |
| bah11h03 | GCGCCAAGATCAGGCGGCTGA<br>GCGCCAAGATAAGGCGGCTGA | 17557 |

TABLE 22-8

| Clones | Haruna Nijo H602 | SEQ ID NO: |
|---|---|---|
| bah47h17 | CATCCACCATTACAAGACAAG<br>CATCCACCATAACAAGACAAG | 17558 |
| bah47h17 | CACTCCCTCAGGAACTCAACA<br>CACTCCCTCAAGAACTCAACA | 17559 |
| bags35d02 | ATCAGTTTATATGCCTCGTGT<br>ATCAGTTTATTTGCCTCGTGT | 17560 |
| bags35d02 | AATAAAATTGCCTTATTTTTG<br>AATAAAATTGTCTTATTTTTG | 17561 |
| bags35d02 | GATGTAGAAGTTGGAGAGCAT<br>GATGTAGAAGCTGGAGAGCAT | 17562 |
| baak14c12 | TCAAGTTCTCGGTGTCGTAGA<br>TCAAGTTCTCAGTGTCGTAGA | 17564 |
| baak34c01 | GCATGTCGTCATTGTCCCCAT<br>GCATGTCGTCGTTGTCCCCAT | 17565 |
| bah35a11 | AGTTATATTAAGGTTGAGACA<br>AGTTATATTATGGTTGAGACA | 17566 |
| bah35a11 | ACCACACAAGGCTCAGATCTT<br>ACCACACAAGCCTCAGATCTT | 17567 |
| BaAK30M16 | GTTTACTGCCGAAATTAGCAG<br>GTTTACTGCCAAAATTAGCAG | 17568 |
| BaAL2G20 | GTAAATATGCAATAATGCTGT<br>GTAAATATGCTATAATGCTGT | 17571 |
| BaAL2G20 | GCTAATTCAGGTTCACTGTAG<br>GCTAATTCAGATTCACTGTAG | 17572 |
| bah37f01 | AAGCTGGCGCCTGTACTATGT<br>AAGCTGGCGCATGTACTATGT | 17576 |
| bah37f01 | GACGTGGCCGTATATTCTTCT<br>GACGTGGCCGCATATTCTTCT | 17577 |
| bags29m05 | CAAACGTCACACCCTTCTTGT<br>CAAACGTCACGCCCTTCTTGT | 17578 |
| baet34A0501 | TGGTAGATGCTCGCGAATCCT<br>TGGTAGATGCCCGCGAATCCT | 17580 |
| BaH30E13 | GCTGGCCTGGCCGTTTTGTCG<br>GCTGGCCTGGTCGTTTTGTCG | 17584 |
| BaH30E13 | CGAGCATATGTTTGATTTTTG<br>CGAGCATATGGTTGATTTTTG | 17585 |
| bags4e23 | GTCCAGTTTGTTGGGGGGAGA<br>GTCCAGTTTGCTGGGGGGAGA | 17586 |
| baak45b03 | TGGCCGTGTAGAAGGCGTCCA<br>TGGCCGTGTACAAGGCGTCCA | 17587 |
| baak45b03 | TATACGCGCGTGCGTACGTAC<br>TATACGCGCGCGCGTACGTAC | 17588 |
| baak45b03 | AGGCGTCCACGGTGGTGTCGA<br>AGGCGTCCACTGTGGTGTCGA | 17589 |
| bah12o12 | GATCATCAGTTGGTCTAACAC<br>GATCATCAGTCGGTCTAACAC | 17590 |
| bah12o12 | TAGAAATGAAGTCAAGTGCTC<br>TAGAAATGAAATCAAGTGCTC | 17591 |
| bah12o12 | GAATCGGAACCGTTATAATCA<br>GAATCGGAACTGTTATAATCA | 17592 |

TABLE 22-9

| Clones | Haruna Nijo H602 | SEQ ID NO: |
|---|---|---|
| baal3e14 | GTCGGAGCATTGCTCACATAT<br>GTCGGAGCATCGCTCACATAT | 17594 |
| basd1 j14 | CAGAATAAAACGGAGGAACAT<br>CAGAATAAAATGGAGGAACAT | 17598 |
| basd1 j14 | TTTGGCCATAAAGCATGGCAC<br>TTTGGCCATAGAGCATGGCAC | 17599 |
| bags35b18 | GAGGAGGTGCTGGCTTTCTTA<br>GAGGAGGTGCCGGCTTTCTTA | 17600 |
| baal41i11 | AACCAAATCAAATCGGTTACA<br>AACCAAATCAGATCGGTTACA | 17601 |
| baal41i11 | CATCTCTTGTGTACGTACCAT<br>CATCTCTTGTTTACGTACCAT | 17602 |
| baal41i11 | GCCAGGCTTACATATTTTGGA<br>GCCAGGCTTAGATATTTTGGA | 17603 |
| baal41i11 | ATGTGATTGGGGCTCAACTGA<br>ATGTGATTGGTGCTCAACTGA | 17604 |
| bags13e23 | AACATAATTTTCAATCTGTTA<br>AACATAATTTCCAATCTGTTA | 17605 |
| bags13e23 | GGCCTGCACATTGGGGAAAAT<br>GGCCTGCACAGTGGGGAAAAT | 17606 |
| bah20d03 | TCGCCCTTGGGGGAGACAGCG<br>TCGCCCTTGGAGGAGACAGCG | 17607 |
| baet19f0212 | AGCAGAAAGGAGCAGCTCAAC<br>AGCAGAAAGGGGCAGCTCAAC | 17608 |
| basd12j05 | AAGAAGAACAACACAGAAGTT<br>AAGAAGAACAGCACAGAAGTT | 17609 |
| basd24d17 | CCTAAGCAGTAGGTGCATTCT<br>CCTAAGCAGTCGGTGCATTCT | 17610 |
| basd24d17 | GACACAACAGAGGGCTCCTGG<br>GACACAACAGGGGGCTCCTGG | 17611 |
| basd24d17 | AGGCGTTGAGGACGGCTGATA<br>AGGCGTTGAGAACGGCTGATA | 17612 |
| bags24k10 | AAAAAAACACATGTACCTTAT<br>AAAAAAACACGTGTACCTTAT | 17613 |
| baal9e05 | GTAAAATGCCAGCGCGTCTAC<br>GTAAAATGCCGGCGCGTCTAC | 17614 |
| baal9e05 | TGCCCCACCACTTGCGCTTGG<br>TGCCCCACCATTTGCGCTTGG | 17615 |
| baal9e05 | TGCCACCGGCACTGCCGCCGC<br>TGCCACCGGCCCTGCCGCCGC | 17616 |
| bags33m23 | AATACAAGTAGGATCATCCTA<br>AATACAAGTACGATCATCCTA | 17617 |
| bags33m23 | TGTCCTCTCTCCTGACAAAAC<br>TGTCCTCTCTTCTGACAAAAC | 17618 |
| bags33m23 | AATAAATGAATGAAGACAACA<br>AATAAATGAACGAAGACAACA | 17619 |
| bah46g14 | AAATCAATGAGCAGGTAGAAT<br>AAATCAATGAACAGGTAGAAT | 17620 |
| bah46g14 | AGCTCAGATCGAAACCGGCTT<br>AGCTCAGATCAAAACCGGCTT | 17621 |

TABLE 22-10

| Clones | Haruna Nijo / H602 | SEQ ID NO: |
|---|---|---|
| bags33h05 | GCTGGAAATTTTTCCACGGGG<br>GCTGGAAATTGTTCCACGGGG | 17622 |
| bags33h05 | TGGCAATGCTATGCCGGCTCA<br>TGGCAATGCTTTGCCGGCTCA | 17623 |
| baak24h12 | ATATGCTACCACTAAGCTGCA<br>ATATGCTACCCCTAAGCTGCA | 17624 |
| baak24h12 | CACACTAGATGAGATGGAGGG<br>CACACTAGATAAGATGGAGGG | 17625 |
| bah50n19 | ACGGCGCCGATAGGGCGGAGA<br>ACGGCGCCGAGAGGGCGGAGA | 17626 |
| baak31o05 | GATCGAGGTAGCCGACGGAAT<br>GATCGAGGTATCCGACGGAAT | 17627 |
| baak31o05 | ACGCTGTAAATTGGCTACCGG<br>ACGCTGTAAACTGGCTACCGG | 17628 |
| bags39l14 | CCCCTGCGTGATCACCGTGTC<br>CCCCTGCGTGGTCACCGTGTC | 17629 |
| bags39l14 | TCAATATTTGAAGGTGCTTGA<br>TCAATATTTGCAGGTGCTTGA | 17630 |
| bags39l14 | TGGATCTACCATCAATATTTG<br>TGGATCTACCTTCAATATTTG | 17631 |
| bags39l14 | AATAAGTTGAGAGACTGGATC<br>AATAAGTTGAAAGACTGGATC | 17632 |
| bags39l14 | CGTGCATGTTCGCCTGCACAG<br>CGTGCATGTTTGCCTGCACAG | 17633 |
| bags39l14 | GTTTGCAAACAAAAGAAGCT<br>GTTTGCAAACGAAAAGAAGCT | 17634 |
| BaGS27C22 | GTTACAACTCGGTTCAATTCC<br>GTTACAACTCAGTTCAATTCC | 17635 |
| bags20o24 | TGTCAACTCATCTTAGTGTCG<br>TGTCAACTCAACTTAGTGTCG | 17636 |
| bags20o24 | TCTACATAGAATGTACTAGCT<br>TCTACATAGACTGTACTAGCT | 17637 |
| bags20o24 | CAATCGACAGTGGCTCCAGGG<br>CAATCGACAGCGGCTCCAGGG | 17638 |
| bast42c0806 | CCATATAAAAGGGTTCAGCTA<br>CCATATAAAAGGTTCAGCTA | 17651 |
| baak26c05 | CAGTTCGATGCCGATTGCAAA<br>CAGTTCGATGTCGATTGCAAA | 17652 |
| baak26c05 | ATGCGTTCAACATTTAGCCTG<br>ATGCGTTCAAAATTTAGCCTG | 17653 |
| bags19a16 | GGTGTTGACATTACAACAAAG<br>GGTGTTGACACTACAACAAAG | 17654 |
| bags19a16 | TCAAAGCTACGCACGACTGCG<br>TCAAAGCTACCCACGACTGCG | 17655 |
| bags19a16 | GAGTGATTCACATGTGATTGC<br>GAGTGATTCAGATGTGATTGC | 17656 |
| kr11f1212 | CACACTCGTTCACACACGACA<br>CACACTCGTTAACACACGACA | 17657 |
| baak35l20 | GGATGCAGTCAGCGAACTTGC<br>GGATGCAGTCGGCGAACTTGC | 17660 |

TABLE 22-11

| Clones | Haruna Nijo / H602 | SEQ ID NO: |
|---|---|---|
| bah57m07 | CTCGTGAAGAATGACACAGGC<br>CTCGTGAAGAGTGACACAGGC | 17661 |
| bah60k11 | TCCATGAGGCCGAACCTAACT<br>TCCATGAGGCTGAACCTAACT | 17662 |
| bah60k11 | ATAAGAAATCGTCAGAAACAG<br>ATAAGAAATCATCAGAAACAG | 17663 |
| bah60k11 | AGAAACAGTGAGAAAACCTAG<br>AGAAACAGTGGGAAAACCTAG | 17664 |
| basd20o09 | ATATAAGTTCACTAATTTTGC<br>ATATAAGTTCTCTAATTTTGC | 17665 |
| basd20o09 | TCTAAACGATTATTACCACCA<br>TCTAAACGATCATTACCACCA | 17666 |
| basd24i22 | GCCTACACTTCACTGATGATT<br>GCCTACACTTTACTGATGATT | 17667 |
| basd24i22 | ATGACTCACAATGTGACAGCA<br>ATGACTCACATTGTGACAGCA | 17668 |
| bags30g20 | CGGACTGAAACGAGTGAACAA<br>CGGACTGAAATGAGTGAACAA | 17669 |
| bags30g20 | TAAGAAAGATGACATGAAAAT<br>TAAGAAAGATCACATGAAAAT | 17670 |
| bags1 m11 | GTTCATTCTCGGCCAAGGTCA<br>GTTCATTCTCAGCCAAGGTCA | 17671 |
| bags23g20 | GACAGACGCCGATGGACATGC<br>GACAGACGCCAATGGACATGC | 17672 |
| bags23g20 | GTATTTCCGGGAATTCTGCAG<br>GTATTTCCGGAAATTCTGCAG | 17673 |
| bags15b05 | GCACGCATGTGTCCTTGAATT<br>GCACGCATGTATCCTTGAATT | 17674 |
| bags15b05 | CCTCCGACTAGTCGATCTTAT<br>CCTCCGACTACTCGATCTTAT | 17675 |
| bags15b05 | GCTGGCGGCGGCGCCGTTGCC<br>GCTGGCGGCGCCGCCGTTGCC | 17676 |
| BaGS24P05 | TCACTCGTAATGACATGATCA<br>TCACTCGTAACGACATGATCA | 17677 |
| bags10g06 | ACGTCCTGTGATTTGCGTGCC<br>ACGTCCTGTGCTTTGCGTGCC | 17678 |
| bah32o04 | GCGACCGCCATCTCAGGCTCG<br>GCGACCGCCACCTCAGGCTCG | 17679 |
| bah32o04 | CGACGGGAGAGTGGCCAGCCA<br>CGACGGGAGACTGGCCAGCCA | 17680 |
| bags32p08 | CACCACTGCTCGATTGTTCAT<br>CACCACTGCTTGATTGTTCAT | 17681 |
| BaGS37L06 | TCTCGGCCTCGGTGAACTCCA<br>TCTCGGCCTCAGTGAACTCCA | 17685 |
| BaGS37L06 | AAAGCACAATGCCACATAAAT<br>AAAGCACAATACCACATAAAT | 17686 |
| BaGS37L06 | CATTCATGTTGCTCTCGGCCT<br>CATTCATGTTACTCTCGGCCT | 17687 |
| bags3h12 | AAGAAAAATGTGAGGAGAGAA<br>AAGAAAAATGAGAGGAGAGAA | 17689 |

TABLE 22-12

| Clones | Haruna Nijo / H602 | SEQ ID NO: |
|---|---|---|
| bags3h12 | ACAAGTCAAGCAAGCCGTACG<br>ACAAGTCAAGTAAGCCGTACG | 17690 |
| bags1e21 | CACCATTGTTTGGCAATTTAC<br>CACCATTGTTGGGCCATTTAC | 17691 |
| bags1e21 | ATTGTTTGGCAATTTACAGCA<br>ATTGTTGGGCCATTTACAGCA | 17692 |
| baak27m21 | CCAACCAGCAGAAAACAGTTT<br>CCAACCAGCACAAAACAGTTT | 17693 |
| bah35b05 | GCACGGACCAACATCAAAGGT<br>GCACGGACCAGCATCAAAGGT | 17694 |
| basd21h11 | ATCATAAGAACGATTTGGAGA<br>ATCATAAGAATGATTTGGAGA | 17695 |
| BaH32E20 | TCGTGCCCCATCTCCCTCGTT<br>TCGTGCCCCACCTCCCTCGTT | 17696 |
| BaH32E20 | TGTCTGGGCAGGTGTGGAGCG<br>TGTCTGGGCAAGTGTGGAGCG | 17697 |
| bags22a20 | GAAGCTACTCGTCAGTTAGGA<br>GAAGCTACTCATCAGTTAGGA | 17698 |
| bags22a20 | AATCCGCATGATGCAGCGATG<br>AATCCGCATGGTGCAGCGATG | 17699 |
| bags29l04 | CACCTGATACAATGAAGATGT<br>CACCTGATACGATGAAGATGT | 17701 |
| bags22g16 | AAAACTCGTCGGCGCTGCTGT<br>AAAACTCGTCAGCGCTGCTGT | 17702 |
| bags22g16 | CCACACTTGTAATTAGCAACC<br>CCACACTTGTGATTAGCAACC | 17703 |
| bah61h20 | CGTTCATAACACATCACCATT<br>CGTTCATAACGCATCACCATT | 17704 |
| bah61h20 | CGTGCCTAACGACCTGAAACG<br>CGTGCCTAACAACCTGAAACG | 17705 |
| bah61h20 | TCTGAATGATGGTGTGAAAGA<br>TCTGAATGATAGTGTGAAAGA | 17706 |
| bah15p01 | CTGCATTTGGGTTGGITCCAG<br>CTGCATTTGGATTGGTTCCAG | 17707 |
| baak41p03 | TCTGGACTTGTGACGCCACGA<br>TCTGGACTTGCGACGCCACGA | 17708 |
| BaSD12L06 | ACACAGTTTAGTAATACTGTA<br>ACACAGTTTAATAATACTGTA | 17709 |
| BaSD12L06 | TTCTGTACTACAAGAGATGAC<br>TTCTGTACTAAAAGAGATGAC | 17710 |
| BaSD23P07 | CCCTGAAGTCACTGCCCTTGA<br>CCCTGAAGTCGCTGCCCTTGA | 17711 |
| BaGS7J05 | GGGATGAGTCCAGCGACTCGA<br>GGGATGAGTCGAGCGACTCGA | 17712 |
| BaGS7J05 | AGTCACACTTTCAGGGTCGAC<br>AGTCACACTTCCAGGGTCGAC | 17713 |
| BaGS7J05 | TTTGAGACGCTCGACTAGTCG<br>TTTGAGACGCCCGACTAGTCG | 17714 |
| BaGS7J05 | TGAAATTATCGTGAAACGGAA<br>TGAAATTATCATGAAACGGAA | 17715 |

TABLE 22-13

| Clones | Haruna Nijo / H602 | SEQ ID NO: |
|---|---|---|
| bah29b06 | AGAGGAAGCCGTCCCTGCGAT<br>AGAGGAAGCCATCCCTGCGAT | 17716 |
| bags31n17 | TAAACACAGACGCAGCTTAGC<br>TAAACACAGATGCAGCTTAGC | 17717 |
| bags31n17 | CATGCTGATCCATACTGCTCT<br>CATGCTGATCAATACTGCTCT | 17718 |
| bags31n17 | TTGCCAGTAACTACAGCAGTT<br>TTGCCAGTAATTACAGCAGTT | 17719 |
| bags31n17 | TACTTTGAGATGCAGAAAGCA<br>TACTTTGAGACGCAGAAAGCA | 17720 |
| bags31n17 | ATGAACATACGAAAATCTAAC<br>ATGAACATACTAAAATCTAAC | 17721 |
| bags31n17 | ACAAGTAGAGCCAAAAGGTGA<br>ACAAGTAGAGACAAAAGGTGA | 17722 |
| BaGS13F08 | CAAAACAATTTAGCCACAAAA<br>CAAAACAATTCAGCCACAAAA | 17723 |
| bags39d12 | ATGTCCAAAAAGAAAGTCAGC<br>ATGTCCAAAAGGAAAGTCAGC | 17727 |
| bags39d12 | TCATGGTACAGAAATCTTACA<br>TCATCGTACATAAATCTTACA | 17728 |
| bags39d12 | TTACTTGTTTTGTTGATAGAC<br>TTACTTGTTTCGTTGATAGAC | 17729 |
| BaAK20B19 | ACATCTTGCCATCGAACTTGT<br>ACATCTTGCCGTCGAACTTGT | 17731 |
| BaAK20B19 | TCCGCACGGCGACCGCCCTGC<br>TCCGCACGGCCACCGCCCTGC | 17732 |
| bags15j15 | TCTTCCTCGTCGTCGTCGAGA<br>TCTTCCTCGTTGTCGTCGAGA | 17733 |
| bags15j15 | GAAGTACTTGTTCCTCTCGGC<br>GAAGTACTTGCTCCTCTCGGC | 17734 |
| BaGS22A21 | ACATATCGCACATATCTGAGC<br>ACATATCGCATATATCTGAGC | 17736 |
| BaGS22A21 | GGCAACCATCATTAGGCACAA<br>GGCAACCATCGTTAGGCACAA | 17737 |
| BaGS22A21 | CAAAGGCAGCGATCTTCTTCC<br>CAAAGGCAGCAATCTTCTTCC | 17738 |
| BaGS22A21 | TCTTCTTCCCATTCTTCACCA<br>TCTTCTTCCCGTTCTTCACCA | 17739 |
| BaGS22A21 | ACTTCAGGTTGTATAGGACAT<br>ACTTCAGGTTATATAGGACAT | 17740 |
| BaGS22A21 | CCTTAACAGTCCATTCCATCC<br>CCTTAACAGTGCATTCCATCC | 17741 |
| baet45e0410 | CAAGCGGTAAGCATAACTACA<br>CAAGCGGTAATCATAACTACA | 17742 |
| bags22c14 | AGGTTCATCAGTTCCCTTTCC<br>AGGTTCATCAATTCCCTTTCC | 17743 |
| bags22c14 | TAATCCACCGCCCCTCAATCT<br>TAATCCACCGACCCTCAATCT | 17744 |
| bah23k12 | GCTAGGACTGTAAAATAAACG<br>GCTAGGACTGCAAAATAAACG | 17745 |

TABLE 22-14

| Clones | Haruna Nijo / H602 | SEQ ID NO: |
|---|---|---|
| bah15o13 | ATCCAAATTACAACCACTTCC<br>ATCCAAATTAGAACCACTTCC | 17746 |
| kr24f0412 | GAACAGAAGATTGCCATTAAC<br>GAACAGAAGAATGCCATTAAC | 17747 |
| kr24f0412 | TAGCTGGCGGGTAACAGTTTC<br>TAGCTGGCGGATAACAGTTTC | 17748 |
| bags28o21 | TCCTCTTCGAACTGTAGGGGA<br>TCCTCTTCGAGCTGTAGGGGA | 17749 |
| bags28o21 | CGCCCTTGCCCAGACCCTTGC<br>CGCCCTTGCCGAGACCCTTGC | 17750 |
| bags28o21 | AGATCTTGAGCACGCCGCGGG<br>AGATCTTGAGGACGCCGCGGG | 17751 |
| baal15n19 | CAACGGAGGCAGCGCACTGTC<br>CAACGGAGGCGGCGCACTGTC | 17752 |
| baal15n19 | CCGCGATGGCAAGGGCGGCGC<br>CCGCGATGGCGAGGGCGGCGC | 17753 |
| bags32j03 | CAAATTGATCGCAGACTCCAC<br>CAAATTGATCACAGACTCCAC | 17755 |
| bags32j03 | ACTACTAAGAGAGTCCAGCTG<br>ACTACTAAGAAAGTCCAGCTG | 17756 |
| bags32j03 | CAGACCAGACAACAGAGATGA<br>CAGACCAGACCACAGAGATGA | 17757 |
| bags20e14 | ACCTGTCCTGTTTCAGCGCGT<br>ACCTGTCCTGCTTCAGCGCGT | 17758 |
| basd27n01 | AACCCCGCCAGTTGTATAAGA<br>AACCCCGCCACTTGTATAAGA | 17760 |
| basd27n01 | TATCAGGGATCCAGGAGGGGA<br>TATCAGGGATTCAGGAGGGGA | 17761 |
| basd27n01 | TTCACGAGTGCACACTACAAT<br>TTCACGAGTGTACACTACAAT | 17762 |
| basd27n01 | CAGGAGGGGAGGAGCGATCGC<br>CAGGAGGGGACGAGCGATCGC | 17763 |
| bags6m19 | GAATAACGACCTACAAATCCA<br>GAATAACGACGTACAAATCGA | 17764 |
| bags6m19 | CCTACAAATCCAGTATACTAG<br>CGTACAAATCGAGTATACTAG | 17765 |
| baak13e03 | CATAGGGCTCCTCGTTATCAA<br>CATAGGGCTCGTCGTTATCAA | 17766 |
| bah23i02 | AGAATGGCGACATTAGAAATA<br>AGAATGGCGAGATTAGAAATA | 17774 |
| bah23i02 | CCTGGCCGCGCGACCTTTATA<br>CCTGGCCGCGGGACCTTTATA | 17775 |
| baak15h22 | ATTTTGATTCGCACCTGCACT<br>ATTTTGATTCACACCTGCACT | 17776 |
| baak15h22 | CAGAGTATACTAGACGTAGTA<br>CAGAGTATACCAGACGTAGTA | 17777 |
| baak15h22 | TATTGTCGACCCTCACACAGC<br>TATTGTCGACACTCACACAGC | 17778 |
| bags32b03 | AATACCAAGTCACCCGTTGTG<br>AATACCAAGTAACCCGTTGTG | 17779 |

TABLE 22-15

| Clones | Haruna Nijo / H602 | SEQ ID NO: |
|---|---|---|
| baak30c15 | ATGAATGGCCGGGCACAATGC<br>ATGAATGGCCAGGCAGAATGC | 17780 |
| baak30c15 | TGGCCGGGCACAATGCATATT<br>TGGCCAGGCAGAATGCATATT | 17781 |
| BaGS22A05 | AGCTAACTAGGGCCAACGCCT<br>AGCTAACTAGCGCCAACGCCT | 17782 |
| BaGS22A05 | CAAGGCGCCCGTTCTTGACCT<br>CAAGGCGCCCATTCTTGACCT | 17783 |
| BaGS22A05 | CGAAGCTGCCGCCAGGGTAGA<br>CGAAGCTGCCACCAGGGTAGA | 17784 |
| bah16m01 | GTTTTGGCTCTCCTAGCAAGG<br>GTTTTGGCTCGCCTAGCAAGG | 17785 |
| bags37d12 | CTCGGACCCCCGGAGCAGCAG<br>CTCGGACCCCTGGAGCAGCAG | 17787 |
| baal37n24 | CTCCCTCCTCTGTTCCTGATT<br>CTCCCTCCTCCGTTCCTGATT | 17788 |
| baal37n24 | CCATGAGGCCGATGATCCACC<br>CCATGAGGCCAATGATCCACC | 17789 |
| baal37n24 | TTGCCGTGCTCTGTATCGGAC<br>TTGCCGTGCTTTGTATCGGAC | 17790 |
| BaH28B09 | CAACAAATACAAAAGTGAGTT<br>CAACAAATACGAAAGTGAGTT | 17791 |
| BaH28B09 | AATCGGCCGGGGACCATCAGA<br>AATCGGCCGGAGACCATCAGA | 17792 |
| BaH28B09 | ACGATGCAGCGGACACAAGCT<br>ACGATGCAGCAGACACAAGCT | 17793 |
| BaH28B09 | TTGTCTTTTATAATAAGCATT<br>TTGTCTTTTAAAATAAGCATT | 17794 |
| BaH28B09 | TTTTATTGACGGTGCAAAACA<br>TTTTATTGACAGTGCAAAACA | 17795 |
| BaH28B09 | AAACTCTGACGTGGGATAGAA<br>AAACTCTGACATGGGATAGAA | 17796 |
| bah47h08 | ATGTGTTGATCACAGCTGCTC<br>ATGTGTTGATTACAGCTGCTC | 17797 |
| bah57n07 | TGGTGCAGACAGGCGCGGTGA<br>TGGTGCAGACGGGCGCGGTGA | 17798 |
| baak38o02 | CCACGACGTAGGTACGTCGTT<br>CCACGACGTACGTACGTCGTT | 17799 |
| baak20f16 | AGTCATTTATTTGGAATGAAG<br>AGTCATTTATCTGGAATGAAG | 17800 |
| baak20f16 | ACTCAACTAACTTTAGGTGG<br>ACTCAACTAATTTTAGGTGG | 17801 |
| baak28n19 | CGAAGCTGCCGCCAGGGTAGA<br>CGAAGCTGCCACCAGGGTAGA | 17802 |
| baak28n19 | CGAGGCCACCCTCGCTGAAGA<br>CGAGGCCACCGTCGCTGAAGA | 17803 |
| bah59j07 | AGCTAGTTCAGACATCGTCCT<br>AGCTAGTTCACACATCGTCCT | 17804 |
| bah59j07 | GGAATCTTGGATAGTTGGAGC<br>GGAATCTTGGGTAGTTGGAGC | 17805 |

TABLE 22-16

| Clones | Haruna Nijo H602 | SEQ ID NO: |
|---|---|---|
| bah59j07 | TCCATGACGATTCCACACACC<br>TCCATGACGAATCCACACACC | 17806 |
| bah59j07 | GGTACTGGCAACATCCATGAC<br>GGTACTGGCAGCATCCATGAC | 17807 |
| bah59j07 | TCCTCTTGCTGTCTTACAGTC<br>TCCTCTTGCTATCTTACAGTC | 17808 |
| bah59j07 | AGACAAAGAAGATTGCAAGTC<br>AGACAAAGAAAATTGCAAGTC | 17809 |
| bah59j07 | CAGGTCGTTCGGGGGAAGCAG<br>CAGGTCGTTCTGGGGAAGCAG | 17810 |
| bah59j07 | CTGCTTGAAACATCACCATAA<br>CTGCTTGAAATATCACCATAA | 17811 |
| bah59j07 | CAAATGCCTTGTGTGCACTGC<br>CAAATGCCTTATCTGCACTGC | 17812 |
| bah44j20 | AAGGTCTTGCAACTGAAGGCG<br>AAGGTCTTGCGACTGAAGGCG | 17813 |
| baet39b0303 | CCATCTCCGCATTGGCCCAGT<br>CCATCTCCGCCTTGGCCCAGT | 17815 |
| baet39b0303 | GCTTTCTTGGCAGGGTAAGGA<br>GCTTTCTTGGTAGGGTAAGGA | 17816 |
| baet39b0303 | GCTCGCCGTCGAGCACGCTGC<br>CCTCGCCGTCCAGCACGCTGC | 17817 |
| baak27d19 | ACGAGTGGTCGTCCCAGCCAG<br>ACGAGTGGTCTTCCCAGCCAG | 17818 |
| baak27d19 | TTAACAGCCGGCGGCTGAACG<br>TTAACAGCCGACGGCTGAACG | 17819 |
| basd25g01 | TCCCTACCTTCCCTGGCCTCC<br>TCCCTACCTTACCTGGCCTCC | 17820 |
| basd25g01 | TCCCGGAGCTCGCGTTCGCGT<br>TCCCGGAGCTAGCGTTCGCGT | 17821 |
| baal34k17 | TCTTTCGGAGCTGCTACTCTA<br>TCTTTCGGAGATGCTACTCTA | 17822 |
| baal34k17 | AGTTTCGGGGTAAATTTATCC<br>AGTTTCGGGGAAAATTTATCC | 17823 |
| basd21i17 | CCTCCCCGCACCGCAGTGTGG<br>CCTCCCCGCATCGCAGTGTGG | 17824 |
| basd21i17 | GGCAGCATCTCACGAAACACC<br>GGCAGCATCTGACGAAACACC | 17825 |
| bags15o12 | GAAAAGAGTGAAAACATACAA<br>GAAAAGAGTGGAAACATACAA | 17826 |
| baak44n10 | GTGATGGCAATGAATTTTATG<br>GTGATGGCAAGGAATTTTATG | 17828 |
| baak44n10 | GTGACCTCGTCGAAACTTGGT<br>GTGACCTCGTTGAAACTTGGT | 17829 |
| baak21e08 | TGCGGTACACTGCGCTCAGCC<br>TGCGGTACACCGCGCTCAGCC | 17830 |
| baak41i21 | CGAGCCGACAGTGCACACCGC<br>CGAGCCGACACTGCACACCGC | 17832 |
| BaGS19C07 | CCGCGCCTCTCGGGTCACCGG<br>CCGCGCCTCTTGGGTCACCGG | 17833 |

TABLE 22-17

| Clones | Haruna Nijo H602 | SEQ ID NO: |
|---|---|---|
| BaGS19C07 | TGAAAAATGTCATATCATTCA<br>TGAAAAATGTTATATCATTCA | 17834 |
| BaGS19C07 | GACAGGATGAGCAACTTGCCT<br>GACAGGATGAACAACTTGCCT | 17835 |
| BaGS19C07 | CTCGATTGCCAATGTATATGA<br>CTCGATTGCCGATGTATATGA | 17836 |
| BaGS19C07 | CTTTCCTGATCATGGAGCAAT<br>CTTTCCTGATAATGGAGCAAT | 17837 |
| BaGS19C07 | CTGGTATTGGAGGCAATGGGA<br>CTGGTATTGGCGGCAATGGGA | 17838 |
| BaGS15O08 | CCCTGCCGGCAATCTCACCGA<br>CCCTGCCGGCGATCTCACCGA | 17839 |
| BaGS15O08 | CAGACATCTCATCTGTCCAGG<br>CAGACATCTCGTCTGTCCAGG | 17840 |
| baak40p22 | ATATGGCACCCATACAACCCT<br>ATATGGCACCGATACAACCCT | 17841 |
| baal40n03 | TAGTAATTGTAATGTAGTAGG<br>TAGTAATTGTTATGTAGTAGG | 17843 |
| baal40n03 | GGCCTCGGCCACCATAGAACC<br>GGCCTCGGCCGCCATAGAACC | 17844 |
| bags23b08 | CAGATCACTTGCAAATGTGGT<br>CAGATCACTTACAAATGTGGT | 17845 |
| bags23b08 | GTTTGTGTATGAGAAGAAGAG<br>GTTTGTGTATCAGAAGAAGAG | 17846 |
| bags23b08 | AGTCGTTGTCCATCTGGTCAT<br>AGTCGTTGTCTATCTGGTCAT | 17847 |
| BaGS39L18 | TGGCCTTCAGCTCAGGCTTCA<br>TGGCCTTCAGTTCAGGCTTCA | 17848 |
| BaGS39L18 | CCAGGGCATACTCCTTCCTAC<br>CCAGGGCATAGTCCTTCCTAC | 17849 |
| BaGS39L18 | CCTCCAAGTCAGAAGAGATGA<br>CCTCCAAGTCGGAAGAGATGA | 17850 |
| bah18d15 | AGAAGAGATCATTCGCCGCCA<br>AGAAGAGATCGTTCGCCGCCA | 17853 |
| bastl04f0911 | TCTTGCACGAGCAATGAGGTG<br>TCTTGCACGACCAATGAGGTG | 17854 |
| BaGS31E03 | CCTTGAAAACTGACGAGTAGT<br>CCTTGAAAACCGACGAGTAGT | 17855 |
| BaGS19J21 | ACTGCGGCACACTCCAGGTCT<br>ACTGCGGCACGCTCCAGGTCT | 17856 |
| BaGS19J21 | GAGTGCCAAGCTTCCATAGCA<br>GAGTGCCAAGTTTCCATAGCA | 17857 |
| BaGS19J21 | GGCTTGGAGTTGGAGGTACTG<br>GGCTTGGAGTCGGAGGTACTG | 17858 |
| bags39p08 | GAATCAGATGAACAAGACAGT<br>GAATCAGATGCACAAGACAGT | 17859 |
| BaH56B06 | TCAGTCCTCATCAAGTAGCAT<br>TCAGTCCTCACCAAGTAGCAT | 17860 |
| baaL13m24 | ACAACACAAGCAAATGAAGGG<br>ACAACACAAGGAAATGAAGGG | 17861 |

TABLE 22-18

| Clones | Haruna Nijo / H602 | SEQ ID NO: |
|---|---|---|
| baal13m24 | GATCAGGATCGTCACTTTTCC<br>GATCAGGATCATCACTTTTCC | 17862 |
| baal13m24 | ATACGCTCTTTATATGCTACA<br>ATACGCTCTTAATATGCTACA | 17863 |
| baal13m24 | ATGAAGGGGGTAAAACAGGTT<br>ATGAAGGGGGCAAAACAGGTT | 17864 |
| bags15h14 | AGGAGGAGGCGTCGTCAGAAA<br>AGGAGGAGGCATCGTCAGAAA | 17865 |
| baal34b14 | ACTGAGAGTCAACCACTGTAT<br>ACTGAGAGTCGACCACTGTAT | 17868 |
| baal34b14 | TGTCGATGCACAAGTTGCGAC<br>TGTCGATGCAGAAGTTGCGAC | 17869 |
| baal34b14 | AATAGTCTGTCTCAGTCTCAC<br>AATAGTCTGTTTCAGTCTCAC | 17870 |
| baal34b14 | CAAACCAAGATAGCATCAGTC<br>CAAACCAAGAAAGCATCAGTC | 17871 |
| bast58C1206 | TTCTTCTTCTTGGGCAACGTA<br>TTCTTCTTCTAGGGCAACGTA | 17874 |
| bast58C1206 | TTTAGGTAAACTGAACCTCAA<br>TTTAGGTAAATTGAACCTCAA | 17875 |
| bastl20B0404 | AAAAAAAAAAAAAAAAAAAA<br>AAAAAAAAAAGAAAAAAAAA | 17877 |
| bastl20B0404 | AAGAGCTGACCGTGGAAACCA<br>AAGAGCTGACTGTGGAAACCA | 17878 |
| bastl20B0404 | AAAAAAAAAGAAAAAAAAAA<br>AAAAAAAAAAAAAAAAAAAA | 17879 |
| BaH15P22 | TGGGGGCACCGACCTTTCGGA<br>TGGGGGCACCAACCTTTCGGA | 17881 |
| BaGS17I22 | AAACAAGTGCAGACCATGGCC<br>AAACAAGTGCCGACCATGGCC | 17882 |
| BaGS17I22 | GCATGTACTCATTGGAGGAAC<br>GCATGTACTCGTTGGAGGAAC | 17883 |
| BaGS17I22 | CTCAACATCAAACATACTGCT<br>CTCAACATCATACATACTGCT | 17884 |
| bags15h01 | CAGGAGGAATGCTAAACTGCT<br>CAGGAGGAATACTAAACTGCT | 17885 |
| bags15h01 | GCTAGAATGTTCTAGATCAGT<br>GCTAGAATGTACTAGATCAGT | 17886 |
| bags7p13 | TGGTCACTCAGGCAGAAAGGA<br>TGGTCACTCAAGCAGAAAGGA | 17887 |
| bags29h13 | TGGGGGCACCAACCTTTCGGA<br>TGGGGGCACCGACCTTTCGGA | 17888 |
| bags29h13 | TGTGAGGGACAAGTCAATACT<br>TGTGAGGGACGAGTCAATACT | 17889 |
| bah47b01 | AGTAGATGCAAGGGTTCGAAG<br>AGTAGATGCAGGGGTTCGAAG | 17890 |
| bah47b01 | TGAGCACATATATGTAGTAGA<br>TGAGCACATACATGTAGTAGA | 17891 |
| bags32m15 | TATGATTGACACTACGACTTT<br>TATGATTGACGCTACGACTTT | 17893 |

TABLE 22-19

| Clones | Haruna Nijo / H602 | SEQ ID NO: |
|---|---|---|
| bags32m15 | ATGACCATCCAGTGGGGTAGT<br>ATGACCATCCGGTGGGGTAGT | 17894 |
| bags32m15 | TCATGCTTGAAACGGTGCAGA<br>TCATGCTTGAGACGGTGCAGA | 17895 |
| bags32m15 | GACTTCAAGGGGGTCCACAA<br>GACTTCAAGGTGGTTCCACAA | 17896 |
| baal27m11 | ACAGTATATCGCACGAGAAAA<br>ACAGTATATCACACGAGAAAA | 17897 |
| baal27m11 | GCTGGCCTGTGGCACCATTCG<br>GCTGGCCTGTCGCACCATTCG | 17898 |
| baal27m11 | TGTCTGCAGAGTGATTCTGCA<br>TGTCTGCAGAATGATTCTCCA | 17899 |
| basdl2k01 | GAGTGAACAGCCTTGGAAAGC<br>GAGTGAAGAGTCTTGGAAAGG | 17900 |
| bags1b01 | TCGCCAGCTCGCCGACACCAC<br>TCGCCAGCTCACCGACACCAC | 17901 |
| bags21e21 | GGTGCACACGGGACACATAAC<br>GGTGCACACGAGACACATAAC | 17904 |
| baes21e21 | TCTGTGGCTTCGCAGGATCTT<br>TCTGTGGCTTGGCAGGATCTT | 17905 |
| bags21e21 | TCATCATGTCAGCGCCAGATA<br>TCATCATGTCCGCGCCAGATA | 17906 |
| bags21e21 | ACATGTTTGCGGTGTTGAGGT<br>ACATGTTTGCAGTGTTGAGGT | 17907 |
| baes21e21 | TGAAGTGGTCTCGGGGGTGCA<br>TGAAGTGGTCGCGGGGGTGCA | 17908 |
| baet02b0503 | CCACCAGCACTCCGGCACCTG<br>CCACCAGCACGCCGGCACCTG | 17909 |
| baet02b0503 | GGCCGTATGGATCCATTGGCG<br>GGCCGTATGGCTCCATTGGCG | 17910 |
| bah29l05 | GATTTCTTGAGTTGTAATCCG<br>GATTTCTTGAATTGTAATCCG | 17911 |
| bah29l05 | GCAACATCCGCCTAGATTTCT<br>GCAACATCCGACTAGATTTCT | 17912 |
| bah29l05 | TGTAGTCCCCATGCAACTTCC<br>TGTAGTCCCCGTGCAACTTCC | 17913 |
| bah29l05 | TTTTATTAAAGAAATAGAAAT<br>TTTTATTAAAAAAATAGAAAT | 17914 |
| baet43H1016 | GACAGGGTCGGCAATGTGGTC<br>GACAGGGTCGACAATGTGGTC | 17915 |
| baet43H1016 | TAATATACATCGTTGGTGTTA<br>TAATATACATAGTTGGTGTTA | 17916 |
| baak20b06 | CACACTCATCGATCCATTCGC<br>CACACTCATCAATCCATTCGC | 17921 |
| BaH16l04 | CCACATCAAAGAGCAGTCAG<br>CCACATCAAA-GAGCAGTCAG | 17922<br>17923 |
| bah22p07 | GGTGGAATTCTTTGGTGTCCC<br>GGTGGAATTCCTTGGTGTCCC | 17924 |
| bah22p07 | CCAGATGCTTTCATCCTCTCA<br>CCAGATGCTTCCATCCTCTCA | 17925 |

TABLE 22-20

| Clones | Haruna Nijo / H602 | SEQ ID NO: |
|---|---|---|
| baak21j02 | GCTCTTTGTCGGTGCCTTGCA<br>GCTCTTTGTCCGTGCCTTGCA | 17926 |
| bags21o12 | TGCCAAACGGAACGGTGCCGA<br>TGCCAAACGGGACGGTGCCGA | 17936 |
| bag21o12 | TGAGCGACCGCGTGTATATGT<br>TGAGCGACCGTGTGTATATGT | 17937 |
| bags21o12 | TCTTCTGCCCTGCCGGAACAT<br>TCTTCTGCCCCGCCGGAACAT | 17938 |
| bags9b14 | ATGTGCAGCAGATGAGATGAG<br>ATGTGCAGCAAATGAGATGAG | 17939 |
| bags9b1 | CTGCCCAGATATATGATTAGG<br>CTGCCCAGATGTATGATTAGG | 17940 |
| bags9b14 | GGAATGGAATATGCGAAATAG<br>GGAATGGAATGTGCGAAATAG | 17941 |
| bags9b14 | GATTTAAAAGGCTTCTTCCAG<br>GATTTAAAAGACTTCTTCCAG | 17942 |
| bags9b14 | AGATGAGAAACGACGCGACAC<br>AGATGAGAAATGACGCGACAC | 17943 |
| bags9b14 | ACTCACATACGCAGCTTTCAA<br>ACTCACATACACAGCTTTCAA | 17944 |
| baak1a17 | CAGGGGGCAGAGTCATAAGAT<br>CAGGGGGCAGCGTCATAAGAT | 17946 |
| baak1a17 | AGCACTATAATCGTCCGAAAC<br>AGCACTATAACCGTCCGAAAC | 17947 |
| bags1p04 | AAACTTACTTGGTGCACGACT<br>AAACTTACTTAGTGCACGACT | 17951 |
| bags1p04 | TAATAAATTTACAAACTCAAA<br>TAATAAATTTCCAAACTCAAA | 17952 |
| BaAL17O03 | TAAGGTAGGTAGGTTGGTTGG<br>TAAGGTAGGTTGGTTGGTTGG | 17953 |
| baal8e17 | CTACTGGCTCTGTCGCTGGAT<br>CTACTGGCTCCGTCGCTGGAT | 17954 |
| baal839e17 | TGGTGGTGGACAAACATATAT<br>TGGTGGTGGATAAACATATAT | 17955 |
| BaH39L18 | CAATGGGCGGCGCGGCGCAGC<br>CAATGGGCGGGGCGGCGCAGC | 17958 |
| BaH39L18 | CGCAGACAAGTCACTGGCAGC<br>CGCAGACAAGCCACTGGCAGC | 17959 |
| bags18e18 | CCAGTTGCCCCCACGCTGCAG<br>CCAGTTGCCCGCACGCTGCAG | 17960 |
| bags18e18 | TTGAGCAGATGGTCAGTGTTT<br>TTGAGCAGATTGTCAGTGTTT | 17961 |
| bags18e18 | CTGTAGGCAATGTGTGGATGT<br>CTGTAGGCAAAGTGTGGATGT | 17962 |

TABLE 23-1

| Clones | Haruna Nijo / H602 | SEQ ID NO: |
|---|---|---|
| BaGS20L10 | CGCGACAAACCGCGGAGCACA<br>CGCGACAAACAGCGGAGCACA | 17963 |
| BaGS20L10 | CTACCGATGACCAACCGAGTG<br>CTACCGATGATCAACCGAGTG | 17964 |
| basd15p22 | ACAGGTGCTCCATCGACTCAC<br>ACAGGTGCTCGATCGACTCAC | 17965 |
| bags7b16 | TCGTCACTGTTGCAAATCATA<br>TCGTCACTGTCGCAAATCATA | 17966 |
| bags7b16 | AGGACACTGTTACAGGTTAAG<br>AGGACACTGTGACAGGTTAAG | 17967 |
| BaAK22H13 | TTTCAGTTCTGTCGATGCAGT<br>TCTCAGTTCTATCGATGCAGT | 17969 |
| BaAK22H13 | TTATCTACCTTTCAGTTCTGT<br>TTATCTACCTCTCAGTTCTAT | 17970 |
| BaH41L14 | ATCAAGCTTACAAAACAGAAT<br>ATCAAGCTTATAAAACAGAAT | 17973 |
| BaH41L14 | TTGCAACCCCACCACCATCAA<br>TTGCAACCCCGCCACCATCAA | 17974 |
| BaAK24H17 | TGCATCAGAACGAATGTGCAT<br>TGCATCAGAATGAATGTGCAT | 17975 |
| bast21A0602 | ATATACCTTCTACCTTACATA<br>ATATACCTTCCACCTTACATA | 17976 |
| BaAL27L20 | ACCGCTGCAAGGGATCCTGCT<br>ACCGCTGCAAAGGATCCTGCT | 17977 |
| BaAL27L20 | CTCATTTCTGTGACGACCGCT<br>CTCATTTCTGGGACGACCGCT | 17978 |
| BaAL27L20 | ATGTCGGTCCAATAAATACTT<br>ATGTCGGTCCGATAAATACTT | 17979 |
| BaAL27L20 | GAGATTCACAAAACTACATG<br>GAGATTCACGAAACTACATG | 17980 |
| bags34p10 | TGCATCAGAACGAATGTGCAT<br>TGCATCAGAATGAATGTGCAT | 17981 |
| baes34p10 | ACCACCATGGGTTCTATGTCC<br>ACCACCATGGATTCTATGTCC | 17982 |
| BaAL29B07 | GGTTGTGTTGCCGCACGAACG<br>GGTTGTGTTGTCGCACGAACG | 17986 |
| baak20o16 | TAACAGCATTGTCGACAGTCA<br>TAACAGCATTATCGACAGTCA | 17987 |
| baak20o16 | GGATGTGCAGTGGCACCTACA<br>GGATGTGCAGGGGCACCTACA | 17988 |
| BaH36B07 | AGCAGCATGATGAGGTCCTTG<br>AGCAGCATGACGAGGTCCTTG | 17991 |
| BaH36B07 | AGCCGGAGGTTAGCAGGGCCG<br>AGCCGGAGGTGAGCAGGGCCG | 17992 |
| BaH36B07 | CGGCGTCCTCTTCCTCGGCAT<br>CGGCGTCCTCCTCCTCGGCAT | 17993 |
| BaH36B07 | GACCTCCTCCATCTTGCTCTC<br>GACCTCCTCCGTCTTGCTCTC | 17994 |
| BaSD3C20 | TCATACAGTAGCGGCGGCGGG<br>TCATACAGTACCGGCGGCGGG | 17997 |

TABLE 23-2

| Clones | Haruna Nijo H602 | SEQ ID NO: |
|---|---|---|
| BaSD3C20 | CCATGTATCAGATTGTCTCAT<br>CCATGTATCAAATTGTCTCAT | 17998 |
| BaSD3C20 | TAAAAATCCCTTGCGTTCACC<br>TAAAAATCCCCTGCGTTCACC | 17999 |
| bastl17G0113 | ATTATAGAAGGTTATCTTTCA<br>ATTATAGAAGATTATCTTTCA | 18000 |
| baak11h14 | CAATGGTGTGCAGACACAGGT<br>CAATGGTGTGTAGACACAGGT | 18001 |
| baak11h14 | CGGAGAAGAATGCTTCAAGGT<br>CGGAGAAGAAGGCTTCAAGGT | 18002 |
| baal33a18 | CATCCTTTGAGGTGCTGATAC<br>CATCCTTTGAAGTCCTGATAC | 18004 |
| baal33a18 | TCTCAAGAGGTTCAACTAACG<br>TCTCAAGAGGCTCAACTAACG | 18005 |
| baal33a18 | AGAATCAATCGTCAACTAGTA<br>AGAATCAATCATCAACTAGTA | 18006 |
| baal33a18 | AGAAGTGGACATTATCTTGCT<br>AGAAGTGGACGTTATCTTGCT | 18007 |
| baal33a18 | ACTTGACTCATCTATGTCCTA<br>ACTTGACTCAACTATGTCCTA | 18008 |
| bah28a18 | TGTTGAGTGCGTGTTCTTCCA<br>TGTTGAGTGCATCTTCTTCCA | 18009 |
| bah28a18 | GTTCACAGAAAAAAGTAGCTC<br>GTTCACAGAAGAAAGTAGCTC | 18010 |
| bah28a18 | CGCCGTCATACGCAGAGAGGA<br>CGCCGTCATATGCAGAGAGGA | 18011 |
| bah28a18 | CATCGTTTGCCTCATTGCTTC<br>CATCGTTTGCTTCATTGCTTC | 18012 |
| bags39o04 | CATTGTATCAGCATCTCGGAT<br>CATTGTATCAACATCTCGGAT | 18013 |
| bags39o04 | GGGGGTCCTCGACGACGTCCT<br>GGGGGTCCTCAACGACGTCCT | 18014 |
| bags39o04 | AATAAGGCTTCCGTAGACACC<br>AATAAGGCTTTCGTAGACACC | 18015 |
| bags39o04 | GTCAATTGACAGCGCCCCCTC<br>GTCAATTGACGGCGCCCCCTC | 18016 |
| BaH48H04 | CCCCTCCGATCAGCGGATCAT<br>CCCCTCCGATTAGCGGATCAT | 18017 |
| bags4p16 | CCGTTCCTTCGTGCGTATGCT<br>CCTTTCCTTCCTGCGTATGCT | 18018 |
| bags4p16 | TTGCTCCACCGTTCCTTCGTG<br>TTGCTCCACCTTTCCTTCCTG | 18019 |
| basd24j22 | TTGCCTGCTTTGTCAGGCGAG<br>TTGCCTGCTTCGTCAGGCGAG | 18020 |
| basd16p15 | ATACACCACAGGACGCCATTA<br>ATACACCACATGACGCCATTA | 18021 |
| basd16p15 | AGTACAGGTACAAGAAATGAT<br>AGTACAGGTATAAGAAATGAT | 18022 |
| bags15k16 | CTTTGTCCTCTAATGTCAGAT<br>CTTTGTCCTCCAATGTCAGAT | 18023 |

TABLE 23-3

| Clones | Haruna Nijo H602 | SEQ ID NO: |
|---|---|---|
| bags15k16 | GCCTTGCCATCGGTCTTCCTC<br>GCCTTGCCATTGGTCTTCCTC | 18024 |
| bast23D1208 | TGTGCTCGACGGTCTTCAGTT<br>TGTGCTCGACAGTCTTCAGTT | 18025 |
| bast23D1208 | AAACATAACCAATCGTGACGA<br>AAACATAACCGATCGTGACGA | 18026 |
| baaG2b22 | TTAGTCGTCCATATATCTTTT<br>TTAGTCGTCCCTATATCTTTT | 18027 |
| baaB2b22 | CATCATCTCTGTTGTATACTT<br>CATCATCTCTATTGTATACTT | 18028 |
| baaB2b22 | TGTATACTTGCCACACACCCG<br>TGTATACTTGTCACACACCCG | 18029 |
| baaB2b22 | ACGAAGTGCTGAGAGATAATA<br>ACGAAGTGCTCAGAGATAATA | 18030 |
| baaB2b22 | ACAAAATGACATGTTAATACA<br>ACAAAATGACCTGTTAATACA | 18031 |
| baaB2b22 | ACTTAGTTGATGGGTTAAAAG<br>ACTTAGTTGACGGGTTAAAAG | 18032 |
| baaB2b22 | CCACTGATATTATAGTACCTA<br>CCACTGATATGATAGTACCTA | 18033 |
| baaB2b22 | GTGACGGGTTACCCAAATATA<br>GTGACGGGTTGCCCAAATATA | 18034 |
| baaB2b22 | CACTCAATATGTATACTACTT<br>CACTCAATATATATACTACTT | 18035 |
| BaH19L09 | CACCCGACTCCATCAGGTTCT<br>CACCCGACTCGATCAGGTTCT | 18036 |
| BaH19L09 | ACACCGAGGCAGCGTTCTGGA<br>ACACCGAGGCGGCGTTCTGGA | 18037 |
| BaH19L09 | CGCATCTCGTTACCTTGGCGG<br>CGCATCTCGTCACCTTGGCGG | 18038 |
| bags38a17 | CAGATAAACTCTCAAGAATGA<br>CAGATAAACTTTCAAGAATGA | 18039 |
| BaAK39I11 | GCTTGCTGCCGTCGGTCGTGA<br>GCTTGCTGCCATCGGTCGTGA | 18040 |
| BaSD3I24 | CTCTAAGGAGGATAGAGCAAC<br>CTCTAAGGAGAATAGAGCAAC | 18041 |
| BaSD3I24 | TGACGACGACATCGTACATGT<br>TGACGACGACGTCGTACATGT | 18042 |
| BaSD3I24 | TCATCAGGAACACAAGGGTAT<br>TCATCAGGAATACAAGGGTAT | 18043 |
| bah13123 | CCATATGGTAGACAGTATGCC<br>CCATATGGTATACAGTATGCC | 18046 |
| bah13123 | ATAAAATTTCCGAGAACCCAA<br>ATAAAATTTCTGAGAACCCAA | 18047 |
| bah13123 | TTTCATAAATACTCTATTCTT<br>TTTCATAAATTCTCTATTCTT | 18048 |
| bah13123 | TTGTGCATCCATTTTTTATGT<br>TTGTGCATCCGTTTTTTATGT | 18049 |
| bah13123 | TCGAGTTTGCGGATCTCCGTA<br>TCGAGTTTGCAGATCTCCGTA | 18050 |

TABLE 23-4

| Clones | Haruna Nijo H602 | SEQ ID NO: |
|---|---|---|
| bah13123 | ACCCAAGTAATCCATATGGTA<br>ACCCAAGTAACCCATATGGTA | 18051 |
| BaAL26H21 | TGCATCGCTCATCAAACATGA<br>TGCATCGCTCGTCAAACATGA | 18052 |
| BaAL26H21 | CACACTGCACGGCAGAAAACT<br>CACACTGCACCGCAGAAAACT | 18053 |
| BaAL26H21 | CGCCGAAAAGCGTCGCGGCGG<br>CGCCGAAAAGTGTCGCGGCGG | 18054 |
| BaAL26H21 | CGAGATCTTCCGAAGGGTATA<br>CGAGATCTTCTGAAGGGTATA | 18055 |
| BaAL26H21 | AATCCAGACACCCTAAGACAC<br>AATCCAGACATCCTAAGACAC | 18056 |
| baak32l16 | GCAGGTTGTCAAAGCCGATGA<br>GCAGGTTGTCGAAGCCGATGA | 18060 |
| baak32l16 | ACTGCACCTGCCGCAGGTTGT<br>ACTGCACCTGACGCAGGTTGT | 18061 |
| baak32l16 | AGCCGATGATGCGGACGTAGG<br>AGCCGATGATACGGACGTAGG | 18062 |
| baak32l16 | GGTTACTTCAACTTGCACTTT<br>GGTTACTTCATCTTGCACTTT | 18063 |
| baak32l16 | TCAGGTAGTCGACCTGCTTCA<br>TCAGGTAGTCAACCTGCTTCA | 18064 |
| baak32l16 | TGTGTGGCGTGGGTGCACCCG<br>TGTGTGGCGTCGGTGCACCCG | 18065 |
| baak32l16 | AGTATCGGCCATCGTAGTACC<br>AGTATCGGCCGTCGTAGTACC | 18066 |
| baak32l16 | TGACCTCCTCGACCTCATTGA<br>TGACCTCCTCGACCTCATTGA | 18067 |
| baak32l16 | GGAGGGCCTCAGTGGTGAGGG<br>GGAGGGCCTCCGTGGTGAGGG | 18068 |
| bags5c02 | TCCCAGGCCACAACTCCTCTC<br>TCCCAGGCCAAAACTCCTCTC | 18073 |
| bags35p07 | GCTTCGGTGGGACTGGCTTCT<br>GCTTCGGTGGCACGGCTTCT | 18074 |
| bags35p07 | TCGGTGGGACTGGCTTCTTGT<br>TCGGTGGCACGGGCTTCTTGT | 18075 |
| BaAK24B09 | CCTGTGGGAAGACCATGATGT<br>CCTGTGGGAACACCATGATGT | 18076 |
| BaAK24B09 | CGGCGGACGGCAGGTTGTTGG<br>CGGCGGACGGGAGGTTGTTGG | 18077 |
| BaAK24B09 | AGAGCTTGATTAGCCGCTGCC<br>AGAGCTTGATCAGCCGCTGCC | 18078 |
| bags33a11 | TTTCGTCATCATCAAAGCGAG<br>TTTCGTCATCGTCAAAGCGAG | 18079 |
| bags33a11 | TCCGAGTAAGTCCGTGCAAGT<br>TCCGAGTAAGGCCGTGCAAGT | 18080 |
| bah56a24 | ACTTGGGCGCTGCCTCCAGCT<br>ACTTGGGCGCTGCCTCCAGCT | 18082 |
| bah56a24 | GCTCCTTCTTTTCCACGCTCT<br>GCTCCTTCTTCTCCACGCTCT | 18083 |

TABLE 23-5

| Clones | Haruna Nijo H602 | SEQ ID NO: |
|---|---|---|
| BaSD21D14 | GACTCCATTCGGTTCCAGCAA<br>GACTCCATTCCGTTCCAGCAA | 18084 |
| BaSD21D14 | ACATTGCTTCTCCCACATGGT<br>ACATTGCTTCCCCCACATGGT | 18085 |
| BaSD21D14 | ACAAAGAAGGCCGTTCATGAT<br>ACAAAGAAGGTCGTTCATGAT | 18086 |
| BaSD21D14 | TGATGATCCAGCAAACAAGGG<br>TGATGATCCAACAAACAAGGG | 18087 |
| basd1a17 | TCTGTTGTACTTTATGACAAT<br>TCTGTTGTACCTTATGACAAT | 18088 |
| basd1a17 | TCATGTCAATGCAAATCTTTA<br>TCATGTCAATACAAATCTTTA | 18089 |
| basd1a17 | TGGTTCTATTTTAGTTTTATT<br>TGGTTCTATTGTAGTTTTATT | 18090 |
| kr70g0113 | CTTGTTATTCCGAATTGGAAA<br>CTTGTTATTC-GAATTGGAAA | 18092<br>18093 |
| basd15f08 | ATAATATAAGTGTGTTTTTGT<br>ATAATATAAGAGTGTTTTTGT | 18094 |
| basd15f08 | GCTTCTTGACGTTGGTTCGGT<br>GCTTCTTGACATTGGTTCGGT | 18095 |
| baal35h05 | GGATCTTGTGATATAGCACTT<br>GGATCTTGTGGTATAGCACTT | 18101 |
| baal35h05 | AGCTTCCTCATCCCAAGCGTC<br>AGCTTCCTCAGCCCAAGCGTC | 18102 |
| baal35h05 | AAGATAGATACTTGCAGCAAC<br>AAGATAGATAGTTGCAGCAAC | 18103 |
| baal35h05 | ACCAGCTAGACCACCAGCTTC<br>ACCAGCTAGATCACCAGCTTC | 18104 |
| baal35h05 | CTGATTCAATTGACTCCTAAC<br>CTGATTCAATCGACTCCTAAC | 18105 |
| baal35h05 | ACGGGATTCAAAGAGGGATCT<br>ACGGGATTCAGAGAGGGATCT | 18106 |
| baak14a24 | CGTGGTACTTGTCGCCGTTGA<br>CGTGGTACTTATCGCCGTTGA | 18108 |
| baak30d07 | AAAAACATGTCGCATACCACA<br>AAAAACATGTTGCATACCACA | 18109 |
| baak30d07 | CGTGCACTCAGCAAGTTCCTC<br>CGTGCACTCACCAAGTTCCTC | 18110 |
| kr14c0305 | GAGACCGGGCCGGATCCGGCC<br>GAGACCGGGCGGATCCGGCC | 18112 |
| bast74c0705 | CTAGCAGCAGCAGGAGGACTA<br>CTAGCAGCAGGAGGAGGACTA | 18115 |
| baal4g17 | TCGCAAGGCATCACACGCAAA<br>TCGCAAGGCAACACACGCAAA | 18116 |
| baal4g17 | CTAGCAGCAGCAGGAGGACTA<br>CTAGCAGCAGGAGGAGGACTA | 18117 |
| bast143H0515 | AAGCCGATCATACACACACAC<br>AAGCCGATCACACACACACAC | 18118 |
| BaH58M22 | GCGTACGTGCACGAGCCATGC<br>GCGTACGTGCGCGAGCCATGC | 18119 |

TABLE 23-6

| Clones | Haruna Nijo / H602 | SEQ ID NO: |
|---|---|---|
| BaH58M22 | CGTGGTACTTATCGCCGTTGA<br>CGTGGTACTTGTCGCCGTTGA | 18120 |
| bags10i21 | CGAACGCGTCACTGTAAGGAA<br>CGAACGCGTCGCTGTAAGGAA | 18121 |
| bags10i21 | ACAAAATGGCAACTTCAGGGG<br>ACAAAATGGCGACTTCAGGGG | 18122 |
| bah20h16 | CGTCGCAAACATTATTGCCAA<br>CGTCGCAAACGTTATTGCCAA | 18123 |
| bah20h16 | ATGGGTCAGGTATCGAAGCCG<br>ATGGGTCAGGAATCGAAGCCG | 18124 |
| bah20h16 | ATCCTACGGTTAACGGTGAAG<br>ATCCTACGGTCAACGGTGAAG | 18125 |
| BaH17P13 | GCTGAACATACCCCTTTTCAC<br>GCTGAACATATCCCTTTTCAC | 18126 |
| baak16e24 | ACTCGCATGCCTTCAACAGCA<br>ACTCGCATGCTTTCAACAGCA | 18129 |
| baak16e24 | CTGAGCTGACACACACAAGAT<br>CTGAGCTGACCCACACAAGAT | 18130 |
| baak16e24 | ATGCTCACAT-TTTCTACACA<br>ATGCTCACATATTTCTACACA | 18131<br>18132 |
| baak16e24 | TATTCGAACC-CTGCTATGCT<br>TATTCGAACCACTGCTATGCT | 18133<br>18134 |
| BaSD18F09 | CCGCGCTGGATGCGAAGTTCC<br>CCGCGCTGGACGCGAAGTTCC | 18135 |
| BaSD18F09 | CGAGGTTCGCCAGGTTGCCGT<br>CGAGGTTCGCTAGGTTGCCGT | 18136 |
| BaSD18F09 | GAAGGCGCTGGTGAAGGCCGC<br>GAAGGCGCTGCTGAAGGCCGC | 18137 |
| BaSD18F09 | GCGCGATGTTGCCCATCTTGA<br>GCGCGATGTTTCCCATCTTGA | 18138 |
| baet42A0501 | AGCTGATCCTCACCTGGCCCT<br>AGCTGATCCTGACCTGGCCCT | 18139 |
| baet42A0501 | GCCGTTGATCACCTTGTTAAT<br>GCCGTTGATCGCCTTGTTAAT | 18140 |
| baet42A0501 | AATTCACCTTGGAGCAGCTGA<br>AATTCACCTTCGAGCAGCTGA | 18141 |
| baet42A0501 | GGCCCTGCGAGCCGGTCAACG<br>GGCCCTGCGAACCGGTCAACG | 18142 |
| baet42A0501 | CACCATGGCCGAGGCGAAGGC<br>CACCATGGCCAAGGCGAAGGC | 18143 |
| baak20l07 | GCTTGCGAGCCCTGCCGACTA<br>GCTTGCGAGCGCTGCCGACTA | 18144 |
| baak16e20 | TTCAAAAGTGAGAAAATACCA<br>TTCAAAAGTGGGAAAATACCA | 18145 |
| baak16e20 | AATTCTGCTTGGGCTGTTCCG<br>AATTCTGCTTCGGCTGTTCCG | 18146 |
| basd13m14 | GGACATCAAAGCTACTTGTAT<br>GGACATCAAATCTACTTGTAT | 18147 |
| basd13m14 | GGTAACCTGAATTTATTATAG<br>GGTAACCTGATTTTATTATAG | 18148 |

TABLE 23-7

| Clones | Haruna Nijo / H602 | SEQ ID NO: |
|---|---|---|
| basd13m14 | TACCTACAGATGAGGCAAGTT<br>TACCTACAGACGAGGCAAGTT | 18149 |
| basd13m14 | TTTCACAGCCCGTGAGGGACA<br>TTTCACAGCCGGTGAGGGACA | 18150 |
| bags20g23 | TAAATAAATATAATTCTGAAG<br>TAAATAAATACAATTCTGAAG | 18151 |
| bags20g23 | TTCTGAAGGTTGTTACTCCCT<br>TTCTGAAGGTCGTTACTCCCT | 18152 |
| basd1l17 | CGATGGCGAATGACTTCAAGA<br>CGATGGCGAACGACTTCAAGA | 18153 |
| basd1l17 | AACGGACCCTGCGGCGGCTCA<br>AACGGACCCTTCGGCGGCTCA | 18154 |
| basd1l17 | AGGAGTGGCCGATGATGTACG<br>AGGAGTGGCCAATGATGTACG | 18155 |
| basd1l17 | GAAGGAACGAATAGGCGTAGT<br>GAAGGAACGAGTAGGCGTAGT | 18156 |
| basd1l17 | GCGTCACCGACGGGCCCTGC<br>GCGTCACCGATGGGCCCTGC | 18157 |
| basd26l01 | TGCCATAGGTTTATCGTTCCG<br>TGCCATAGGTCTATCGTTCCG | 18158 |
| basd26l01 | TATCGTTCCGTTTACCTGTTT<br>TATCGTTCCGATTACCTGTTT | 18159 |
| basd26l01 | CGTTCCAAGGGCGCGCTCTTG<br>CGTTCCAAGGTCGCGCTCTTG | 18160 |
| basd26l01 | TCGCCTGTAGTGACGAGGACG<br>TCGCCTGTAGCGACGAGGACG | 18161 |
| baal37j18 | GGGTGGTCCAGATGACTAAGT<br>GGGTGGTCCAAATGACTAAGT | 18162 |
| baal37j18 | GGAGGGCAGATCTGATCTCTT<br>GGAGGGCAGACCTGATCTCTT | 18163 |
| baal37j18 | GACAGAAAGAGGACACACGGA<br>GACAGAAAGAAGACACACGGA | 18164 |
| baal37j18 | CAAGCCAGTTCATATACATAT<br>CAAGCCAGTTGATATACATAT | 18165 |
| bags7i05 | AAAAGGGATGATGGAATACAA<br>AAAAGGGATGGTGGAATACAA | 18166 |
| bags7i05 | CGGGTTCAGGCTTGGGCTCTG<br>CGGGTTCAGGTTTGGGCTCTG | 18167 |
| bags7i05 | ATCAATTGTCCGTCATCGGCG<br>ATCAATTGTCAGTCATCGGCG | 18168 |
| bags7i05 | CAAGGAATGCAAAAAAGATGC<br>CAAGGAATGCTAAAAAGATGC | 18169 |
| bah60m17 | AAATCTGTTCAGTTGTGTTGC<br>AAATCTGTTCGGTTGTGTTGC | 18170 |
| bah60m17 | GAGAATGTTATAACTAGGAGC<br>GAGAATGTTAGAACTAGGAGC | 18171 |
| bah60m17 | TTGAGGTGCACGGAAGGTGTG<br>TTGAGCTGCAAGGAAGGTCTG | 18172 |
| bah60m17 | TTGGATCTTCACCGCTGGCAT<br>TTGGATCTTCGCCGCTGGCAT | 18173 |

TABLE 23-8

| Clones | Haruna Nijo H602 | SEQ ID NO: |
|---|---|---|
| bah60m17 | GTTGCCGTCACAATCATCGAT<br>GTTGCCGTCAGAATCATCGAT | 18174 |
| bah60m17 | GAGGCACCTACTAAAATGGTA<br>GAGGCACCTAGTAAAATGGTA | 18175 |
| bah60m17 | AAAACCTGCACCAGTTTGGAT<br>AAAACCTGCAGCAGTTTGGAT | 18176 |
| bags21l01 | GCCTCCGCGTAGGTTCTTCC<br>GCCTCCGCGGGAGGTTCTTCC | 18177 |
| bags21l01 | ACTCGTCAGCATGCTTCTTCT<br>ACTCGTCAGCGTGCTTCTTCT | 18178 |
| baes21l01 | TTCCTCTTGGTGCTTCCTCTT<br>TTCCTCTTGGGGCTTCCTCTT | 18179 |
| baes21l01 | TTGGACTTCTCTTTCTCCTGC<br>TTGGACTTCTGTTTCTCCTGC | 18180 |
| bags21l01 | GCTAGCATCAGCATCAGCTGC<br>GCTAGCATCAACATCAGCTGC | 18181 |
| baet31e0109 | CAATATTTCTGACCCGTCGTG<br>CAATATTTCTAACCCGTCGTG | 18182 |
| baet31e0109 | CATATGCGCGATCGTGCACAT<br>CATATGCGCGGTCGTGCACAT | 18183 |
| bags34m12 | GTACGTCTTCGTACCGGATTC<br>GTACGTCTTCATACCGGATTC | 18184 |
| bags34m12 | CCTAGTTTTTATAGTTAGCTA<br>CCTAGTTTTTGTAGTTAGCTA | 18185 |
| bags34m12 | TTTATTCTGGGATCCTTATTT<br>TTTATTCTGGAATCCTTATTT | 18186 |
| bags34m12 | TTCGCTGGATTCTAGGAGTCC<br>TTCGCTGGATACTAGGACTCC | 18187 |
| bags34m12 | ATACCACTCAGAATCTAGGTC<br>ATACCACTCAAAATCTAGGTC | 18188 |
| bah50n02 | CTGCTCCCACTGAGGCGCCA<br>CTGCTCCCACCGAGGCGCCA | 18189 |
| BaH50M11 | TGCTTCATCACCTATCACTAT<br>TGCTTCATCATCTATCACTAT | 18190 |
| BaH50M11 | AATTTTGGGGTGGAGGGAGTA<br>AATTTTGGGGCGGAGGGAGTA | 18191 |
| bast27e1010 | TACCTTTCGCAAGGCGGAGCG<br>TACCTTTCGCGAGGCGGAGCG | 18192 |
| bast27e1010 | TACTGGTCATGAGGCGGGAGC<br>TACTGGTCATCAGGCGGGAGC | 18193 |
| bags23c12 | TCTCGGTTCCAGTTTCAGCCT<br>TCTCGGTTCCCGTTTCAGCCT | 18194 |
| bah51m11 | ATTTATCCGTCGAGACCGAGA<br>ATTTATCCGTGGAGACCGAGA | 18195 |
| baak20d17 | GCGCAGGGTCAGTTCTCCTG<br>GCGCAGGGTGTAGTTCTCCTG | 18196 |
| bags23l21 | GCCTCAATTAAAAGATTGGAA<br>GCCTCAATTATAAGATTGGAA | 18197 |
| bags23l21 | CAGGGCATCCCATGTGACAAC<br>CAGGGCATCCGATGTGACAAC | 18198 |

TABLE 23-9

| Clones | Haruna Nijo H602 | SEQ ID NO: |
|---|---|---|
| bags23l21 | CGTGCCATATCAGGTTCAATC<br>CGTGCCATATGAGGTTCAATC | 18199 |
| bags23l21 | ATGCTCGTCTCGCCTCGAGAA<br>ATGCTCGTCTTGCCTCGAGAA | 18200 |
| bags23l21 | CTAGCTATCTAAAGGATGTCT<br>CTAGCTATCTGAAGCATGTCT | 18201 |
| bags23d01 | TTACTCTGAANAGAAATGAGT<br>TTACTCTGAAGAGAAATGAGT | 18204 |
| bags23d01 | TTTGAACACCACGGAGAGCCT<br>TTTGAACACCGCGGACAGCCT | 18205 |
| baal29m02 | ATACTCGAGGAGAAGAAGGGA<br>ATACTCGACGGGAAGAAGGGA | 18207 |
| baal29m02 | TATTGTTGCCTATACTCACGC<br>TATTGTTGCCTATACTCACGC | 18208 |
| baal29m02 | GGGTAGGGCTCCACATATTGT<br>GGGTAGGGGTTGAGATATTGT | 18209 |
| bah17e21 | CATGCGTAGAAAACCTTGGTA<br>GGAGCTGAGAGAAGGTTGGTA | 18210 |
| bah56j18 | GAGGCAAAAGGAGAAGGATA<br>GAGGGAAAAAGAGAAGGATA | 18211 |
| bah56j18 | GGTTAATTTTGGTGGTGGGAC<br>GGTTAATTTTCCTCCTGGGAC | 18212 |
| BaAL34O13 | AATAAGGGCGGTCGGTTAATT<br>AATAAGGGGGATGGGTTAATT | 18215 |
| BaAL34O13 | TTAGTAAGTGAATGTGTGGTA<br>TTAGTAAGTGGATGTGTGGTA | 18216 |
| bags4n05 | GCACCAACGCGCTCCAGACTA<br>GCACCAACGCCCTCCAGACTA | 18217 |
| bags4n05 | GCCACCTGTGGGCAATTATGA<br>GCCACCTGTGCGCAATTATGA | 18218 |
| BaSD15P20 | GCAAGCCATCATCATCCTCCT<br>GCAAGCCATCGTCATCCTCCT | 18219 |
| bah27g02 | TTAAAATGGCGAGATTGCCCA<br>TTAAAATGGCCAGATTGCCCA | 18221 |
| bah27e02 | TCATAGTAGAGACTACTACTC<br>TCATAGTAGAAACTACTACTC | 18222 |
| bah27g02 | AATCTACACTGAACAACATGC<br>AATCTACACTAAACAACATGC | 18223 |
| bah27g02 | GCAAGCGGGCGGCGTTGCAAT<br>GCAAGCGGGCAGCGTTGCAAT | 18224 |
| bah27g02 | CCTTCTAGACTAGCACACAGA<br>CCTTCTAGACAAGCACACAGA | 18225 |
| bah27g02 | CCCAGGAAAACCTCTACGCAC<br>CCCAGGAAAAACTCTACGCAC | 18226 |
| bah27g02 | TCTCAAAATATAAACAACCCA<br>TCTCAAAATAGAAACAACCCA | 18227 |
| basd27m10 | TTGCTTCCTCATAAACCCAGT<br>TTGCTTCCTCGTAAACCCAGT | 18228 |
| basd23f16 | TTGCCGAGTCGGAGCAAAAGC<br>TTGCCGAGTCCGAGCAAAAGC | 18229 |

TABLE 23-10

| Clones | Haruna Nijo / H602 | SEQ. ID NO: |
|---|---|---|
| basd23f16 | TAATTTGCCGCGTTAGCTTGT<br>TAATTTGCCGTGTTAGCTTGT | 18230 |
| basd23f16 | TGGCCTCCATATTGCCGCCAC<br>TGGCCTCCATTTTGCCGCCAC | 18231 |
| basd23f16 | AGCACCTTGGAGCTGCTGAAC<br>AGCACCTTGGTGCTGCTGAAC | 18232 |
| basd23f16 | CATTGCATGTTTAGCACAACC<br>CATTGCATGTATAGCACAACC | 18233 |
| basd23f16 | TCGTATTCAGGATTCATTGCA<br>TCGTATTCAGAATTCATTGCA | 18234 |
| bah16i19 | ATACATTATCTTGAGTGACTA<br>ATACATTATCGTGAGTGACTA | 18235 |
| bah16i19 | GATTGTAGCAGTTAGATACAT<br>GATTGTAGCAATTAGATACAT | 18236 |
| bah16i19 | ATGATGCACAATTGCATCTCT<br>ATGATGCACATTTGCATCTCT | 18237 |
| bah16i19 | GTCTTTCTCTGGATAGAATAA<br>GTCTTTCTCTCGATAGAATAA | 18238 |
| BaH50I20 | GGCAAGTAGCAACATATGTCG<br>GGCAAGTAGCGACATATGTCG | 18239 |
| bah28b24 | CTGGTTGTCATCGGTAGCTCC<br>CTGGTTGTCACCGGTAGCTCC | 18241 |
| basd14h21 | CAAGTCATTTTACTTACTGAC<br>CAAGTCATTTAACTTACTGAC | 18252 |
| basd14h21 | GGGACGACAGATGACATCTTA<br>GGGACGACAGGTGACATCTTA | 18253 |
| basd14h21 | AATTTCACACATGTCATGGGA<br>AATTTCACACGTGTCATGGGA | 18254 |
| basd14h21 | GGGACTCTATGTCTCCCATCA<br>GGGACTCTATATCTCCCATCA | 18255 |
| basd14h21 | CAGAGCATTCTGAAAGCATCT<br>CAGAGCATTCGGAAAGCATCT | 18256 |
| basd14h21 | CTAACAATCCAAAGCTAAAG<br>CTAACAATCCGAAGCTAAAG | 18257 |
| basd14h21 | AGGCAATTTAAACACCACACG<br>AGGCAATTTATACACCACACG | 18258 |
| bags13g18 | CTCTAACCAGAGTCAGGATAT<br>CTCTAACCAGCGTCAGGATAT | 18262 |
| BaH15D23 | ACATTGCTTAAACACTATAGA<br>ACATTGCTTATACACTATAGA | 18263 |
| BaH15D23 | TTTCAGAATGCTGGAGGAATA<br>TTTCAGAATGTTGGAGGAATA | 18264 |
| BaGS33I07 | GAGTGTGGTAACGGTCACCCA<br>GAGTGTGGTAGCGGTCACCCA | 18266 |
| BaGS33I07 | GAGACTGTGATGCATTCAGCC<br>GAGACTGTGACGCATTCAGCC | 18267 |
| BaGS33I07 | ACCGCTTGCAGATGCCAACTA<br>ACCGCTTGCAAATGCCAACTA | 18268 |
| BaGS33I07 | AGTACCAATACCTCATAAGCA<br>AGTACCAATAGCTCATAAGCA | 18269 |

TABLE 23-11

| Clones | Haruna Nijo / H602 | SEQ. ID NO: |
|---|---|---|
| basd27b02 | TTGGCTTCAGGGCGGCATTCG<br>TTGGCTTCAGAGCGGCATTCG | 18270 |
| bags30n12 | GTACACACCCTGGGCTCTCAC<br>GTACACACCCGGGGCTCTCAC | 18271 |
| bags30n12 | CTTTGTCACCAAATCCAAGTT<br>CTTTGTCACCGAATCCAAGTT | 18272 |
| basd3h13 | TAAAGGCATCATTTAGCTAAT<br>TAAAGGCATCCTTTAGCTAAT | 18273 |
| BaGS37L19 | AGTAAAATGAATGAATTTACG<br>AGTAAAATGAGTGAATTTACG | 18274 |
| BaGS37L19 | GGGAAGTGATTTCTAGGCGCC<br>GGGAAGTGATGTCTAGGCGCC | 18275 |
| BaGS37L19 | GCTAGTTCTTAAAGAAAATCA<br>GCTAGTTCTTTAAGAAAATCA | 18276 |
| BaGS37L19 | TCAAGCATTGCGATGCATGTT<br>TCAAGCATTGTGATGCATGTT | 18277 |
| bags20i15 | TTATTGTTTGCGCTGCTGCAT<br>TTATTGTTTGTGCTGCTGCAT | 18279 |
| bags20i15 | TCAACGTTACCAAACACAAGT<br>TCAACGTTACAAACACAAGT | 18280 |
| bags20i15 | TACAGCCAATACAACTAGGAT<br>TACAGCCAATGCAACTAGGAT | 18281 |
| bags20i15 | GCTGCATTGTTCACCGACCGC<br>GCTGCATTGTCCACCGACCGC | 18282 |
| bags20i15 | GCATCACCAAAATTGAAGTAC<br>GCATCACCAACATTGAAGTAC | 18283 |
| bah56k07 | GCATACTTCACCGTTGCAGCG<br>GCATACTTCATCGTTGCAGCG | 18285 |
| bah56k07 | GTCGCAGTCTCGTTCATCATC<br>GTCGCAGTCTTGTTCATCATC | 18286 |
| bah56k07 | CCAAACTTCACGGCTTGCTGA<br>CCAAACTTCAGGGCTTGCTGA | 18287 |
| bags37d02 | CATTCAGGTTCTTTTTGTTCT<br>CATTCAGGTTTTTTTTGTTCT | 18288 |
| bags37d02 | TATTTTCCACGGTAAATGGGA<br>TATTTTCCACAGTAAATGGGA | 18289 |
| bags37d02 | GAAATGAGTCGAGCGATGGTA<br>GAAATGAGTCCAGCGATGGTA | 18290 |
| bags37d02 | ACAAAGATCAGCGGGGAGGAC<br>ACAAAGATCATCGGGGAGGAC | 18291 |
| bags37d02 | ATAAGCCACAGCAAAGACAGA<br>ATAAGCCACATCAAAGACAGA | 18292 |
| bags22l23 | ATGGTTTGGTGTTTAGGGCTG<br>ATGGTTTGGTTTTTAGGGCTG | 18295 |
| kr33a0901 | CGCTGCCCAAGGTCGAGCTAC<br>CGCTGCCCAATGTCGAGCTAC | 18296 |
| kr33a0901 | ATGGCTTCAACAAACGCCGCA<br>ATGGCTTCAAAAAACGCCGCA | 18297 |
| bast138C0606 | AGAGAAACGCTTCCTTTGGCC<br>AGAGAAACGCGTCCTTTGGCC | 18298 |

TABLE 23-12

| Clones | Haruna Nijo H6102 | SEQ ID NO: |
|---|---|---|
| bast138C0606 | AGATGTTGCATCTGTCGTACC<br>AGATGTTGCACCTGTCGTACC | 18299 |
| baak11J13 | GATTGGCTGACTCTTGCAAGG<br>GATTGGCTGATTCTTGCAAGG | 18300 |
| baak11j13 | TTCCCTTCCTGTCACCGGTTC<br>TTCCCTTCCTATCACCGGTTC | 18301 |
| bah58e19 | TATTTTTCAATAACCAAGGAC<br>TATTTTTCAACAACCAAGGAC | 18302 |
| BaGS31G22 | AGAAAGAGACATGACAAATCA<br>AGAAAGAGACGTGACAAATCA | 18303 |
| BaGS31G22 | ACGCTGATGGTGAATCCGGAC<br>ACGCTGATGGCGAATCCGGAC | 18304 |
| bah37h01 | CAGATAGCATGTGTAGCTTCT<br>CAGATAGCATTTGTAGCTTCT | 18305 |
| bah37h01 | CCACAGGTGGGTCACTATCCA<br>CCACAGGTGGTTCACTATCCA | 18306 |
| bah37h01 | TCAGGCCAAAGACGATCATCT<br>TCAGGCCAAAAACGATCATCT | 18307 |
| bah37h01 | TAGCCTAATAGAATTTTTAGT<br>TAGCCTAATATAATTTTTAGT | 18308 |
| baal29p13 | AGTTTTTTAGGTTTCACTTAG<br>AGTTTTTTAGATTTCACTTAG | 18309 |
| bags39a22 | CTCTTTTTCCCAGCCCCATAA<br>CTCTTTTTCCAAGCCCCATAA | 18310 |
| bah19g10 | GTATGCAGAGTGCTCCTGCCC<br>GTATGCAGAGCGCTCCTGCCC | 18311 |
| baal31a14 | TCGCTATGGCTGCAAAGAAGA<br>TCGCTATGGCGGCAAAGAAGA | 18312 |
| bah50g15 | AAGCTGAGGCAGCTCGCTCTT<br>AAGCTGAGGCTGCTCGCTCTT | 18313 |
| bah50g15 | TCCTTGTCCCGGTATTTTCTT<br>TCCTTGTCCCAGTATTTTCTT | 18314 |
| bah51m12 | TTGAATGAAGGTTTAAAAACT<br>TTGAATGAAGATTTAAAAACT | 18315 |
| bags18k22 | ACGATCTAACGCTGTACGAAA<br>ACGATCTAACACTGTACGAAA | 18316 |
| bags18k22 | CCTTCAGCGGTGCATCAGGTA<br>CCTTCAGCGGAGCATCAGGTA | 18317 |
| bags20n21 | CCTTTCCATCAGAGAATATGT<br>CCTTTCCATCGGAGAATATGT | 18318 |
| basd17o21 | CCCGATCTGCATAACCAAGAA<br>CCCGATCTGCGTAACCAAGAA | 18319 |
| basd17o21 | TCAAAAGTGACGGAAAGAAAA<br>TCAAAAGTGATGGAAAGAAAA | 18320 |
| bah37g17 | AAAATTGGACAAGGTTCTCTA<br>AAAATTGGACGAGGTTCTCTA | 18321 |
| bags30l22 | AGTAAGAAACATCAGCTAATA<br>AGTAAGAAACGTCAGCTAATA | 18322 |
| bags30l22 | GCTTCTTCTATGGTTGCATAT<br>GCTTCTTCTACGGTTGCATAT | 18323 |

TABLE 23-13

| Clones | Haruna Nijo H602 | SEQ ID NO: |
|---|---|---|
| bags30l22 | ATCTAGGATTCATCCCTTCCT<br>ATCTAGGATTTATCCCTTCCT | 18324 |
| bast72G0113 | CTTCCCATACGGACAGCACAA<br>CTTCCCGTACAGACAGCACAA | 18327 |
| bast72G0113 | TTAGCTTCCCATACGGACAGC<br>TTAGCTTCCCGTACAGACAGC | 18328 |
| BaH30B05 | CATGCTTCCGCTCAGATAATG<br>CATGCTTCCGTTCAGATAATG | 18329 |
| BaH60B14 | ACCCCTCCCTACCCAACCTGC<br>ACCCCTCCCTCCCCAACCTGC | 18330 |
| BaH60B14 | TTGCAATATGGGACCTTACAT<br>TTGCAATATGTGACCTTACAT | 18331 |

TABLE 23-13-continued

| Clones | Haruna Nijo H602 | SEQ ID NO: |
|---|---|---|
| BaH60B14 | CTGCACCTGATCTGCATGTCT<br>CTGCACCTGACCTGCATGTCT | 18332 |
| BaH17B16 | CAAAAAGATACGAGTGTTTGT<br>CAAAAAGATATGAGTGTTTGT | 18333 |
| basd12n23 | AGTTCGGCAGCTTTGTTGCCA<br>AGTTCGGCAGTTTTGTTGCCA | 18334 |
| basd12n23 | AAACGATGGAGATTAATCGTG<br>AAACGATGGAAATTAATCGTG | 18335 |
| basd12n23 | GATGTAGCAGATGATCTTACA<br>GATGTAGCAGTTGATCTTACA | 18336 |
| basd12n23 | GATGACATTTCACATGTCATT<br>GATGACATTTTACATGTCATT | 18337 |
| basd12n23 | CCTTGAGTTTCTTGCAAATAA<br>CCTTGAGTTTATTGCAAATAA | 18338 |
| basd12n23 | GATTCACTGGTCCATTCGGAT<br>GATTCACTGGCCCATTCGGAT | 18339 |
| basd12n23 | CAACAGCTTGTTCAGTGGTGC<br>CAACAGCTTGATCAGTGGTGC | 18340 |
| basd12n23 | TTGTGCGGACTTCAACAGCTT<br>TTGTGCGGACATCAACAGCTT | 18341 |
| bah61a21 | GCTATTTTATATCAATGATGA<br>GCTATTTTATCTCAATGATGA | 18342 |
| baak19h17 | TTCTAATCAGTGGTATAATAG<br>TTCTAATCAGGGGTATAATAG | 18343 |
| baak19h17 | GTCGTGCAGAGCGCCGTTTGT<br>GTCGTGCAGAGCGCCGTTTGT | 18344 |
| bah47H2 | AAGAGTTAGGAAAGAAGAGGC<br>AAGAGTTAGGCAAGAAGAGGC | 18345 |
| bah47l12 | AGCAGCGAGAAGACAGCTGGA<br>AGCAGCGAGAAGACAGCTGGA | 18346 |
| baak18p11 | AGCTGGCGTTTGATCTGTTGA<br>AGCTGGCGTTGGATCTGTTGA | 18347 |
| baak18p11 | ACAACAGAGAGATTATCACAA<br>ACAACAGAGAAATTATCACAA | 18348 |
| baak18p11 | AAAAGTTCTTCCTTTTAATCC<br>AAAAGTTCTTTCTTTTAATCC | 18349 |
| baak18p11 | TGGATCTGCTAGTGCTGGCGC<br>TGGATCTGCTGGTGCTGGCGC | 18350 |

TABLE 23-14

| Clones | Haruna Nijo H602 | SEQ ID NO: |
|---|---|---|
| baet29h0715 | CCTCCTTGGCCGCCGCGGATA<br>CCTCCTTGGCTGCCGCGG-TA | 18351<br>18352 |
| BaH13D11 | GAAATCCTTCAGCATAGTTTG<br>GAAATCCTTCGGCATAGTTTG | 18353 |
| BaH13D11 | GTCTCAGACAAGGTACTTCCA<br>GTCTCAGACACGGTACTTCCA | 18354 |
| BaH13D11 | ACAGTACACACCGACTGAATA<br>ACAGTACACAACGACTGAATA | 18355 |

TABLE 23-14-continued

| Clones | Haruna Nijo H602 | SEQ ID NO: |
|---|---|---|
| BaH13D11 | ATAGAAGCACAATTGTTGAGA<br>ATAGAAGCACGATTGTTGAGA | 18356 |
| baet39D1107 | GACCGCCAACATTAGCGCGCC<br>GACCGCCAACGTTAGCGCGCC | 18357 |
| BaH53E15 | TATTAAGCTATGAAAAATATT<br>TATTAAGCTATGAAAAATATT | 18358 |
| bags32o15 | TTACTGCGACGCACGCACAGA<br>TTACTGCGACCCACGCACAGA | 18359 |
| bags32o15 | TAGAGTCGCGGCATCTTTTGT<br>TAGAGTCGCGCCATCTTTTGT | 18360 |
| bags32o15 | GTCTTACACCAGATACTTGGG<br>GTCTTACACCCGATACTTGGG | 18361 |
| bast48a0701 | AAGCTAGCAGCTCTCAAGGAC<br>AAGCTAGCAGGTCTCAAGGAC | 18362 |
| bast62d0907 | GTACTAGGGACACCTCCCACA<br>GTACTAGGGAGACCTCCCACA | 18363 |
| bast62d0907 | ACAGCGCACAGCGAGACGACG<br>ACAGCGCACACCGAGACGACG | 18364 |
| bah45p22 | TCTGTGCTCACATGGAATGGG<br>TCTGTGCTCATATGGAATGGG | 18365 |
| bah45p22 | AATATGAAAATGAGAAGTAAC<br>AATATGAAAACGAGAAGTAAC | 18366 |
| bags32H6 | CAAAAAACTACCACGAGCAGA<br>CAAAAAACTAACACGAGCAGA | 18367 |
| baak30j05 | AACTAAAATACACTTTAACGG<br>AACTAAAATATACTTTAACGG | 18368 |
| baak30j05 | GTCTCTGACGAGCATTCATGA<br>GTCTCTGACGGGCATTCATGA | 18369 |
| bah52a14 | TTTCTCATCGATATCTCCCGA<br>TTTCTCATCGGTATCTCCCGA | 18370 |
| bah52a14 | TGTAACTTGGAACCACTCTTG<br>TGTAACTTGGCACCACTCTTG | 18371 |
| bah58i22 | AGGTGTGTATGAAATACCACT<br>AGGTGTGTATCAAATACCACT | 18372 |
| BaH56L16 | GTTTAGACTGAACAGCAAAGC<br>GTTTAGACTGGACAGCAAAGC | 18373 |
| BaH56L16 | TTTCTTTTTCCAATCCAGAAA<br>TTTCTTTTTCAAATCCAGAAA | 18374 |
| bah52a21 | CTGAAATTATTTTACTAACAT<br>CTGAAATTATATTACTAACAT | 18375 |
| bah52a21 | CCATAGATTTAGGTGACTGGA<br>CCATAGATTTGGGTGACTGGA | 18376 |

TABLE 23-15

| Clones | Haruna Nijo H602 | SEQ ID NO: |
|---|---|---|
| bah52a21 | ATAATATTAACACCTTGATAT<br>ATAATATTAAAACCTTGATAT | 18377 |
| basd14g11 | AACAACAGTTCCTGTTGACAG<br>AACAACAGTTGCTGTTGACAG | 18378 |

TABLE 23-15-continued

| Clones | Haruna Nijo H602 | SEQ ID NO: |
|---|---|---|
| bags6a03 | ACAAGAGGCAGATAAATTGAG<br>ACAAGAGGCACATAAATTGAG | 18379 |
| bast72e0109 | TTTTTTTTTATTTTTTTTTT<br>TTTTTTTTTTTTTTTTTTTT | 18380 |
| bags21a21 | CCTGGATCATTGCATAGATGT<br>CCTGGATCATAGCATAGATGT | 18381 |
| bags21a21 | AGTTGGGGTGCAACTCTGATA<br>AGTTGGGGTGTAACTCTGATA | 18382 |
| bags21a21 | CTACTTGGGTGTAAAGGTGTT<br>CTACTTGGGTATAAAGGTGTT | 18383 |
| bah58p13 | CTACATAGAAGCATGCAGGTG<br>CTACATAGAAACATGCAGGTG | 18384 |
| bah58p13 | TCGGAGGGAGAATTATAATTT<br>TCGGAGGGAGTATTATAATTT | 18385 |
| bah58p13 | TGTATGCCAACCGTACCTTCT<br>TGTATGCCAATCGTACCTTCT | 18386 |
| bah27n22 | GTACAAAATATCATACATATA<br>GTACAAAATACCATACATATA | 18387 |
| bags20c13 | GGTTATTGCACATAAAGTGA<br>GGTTATTGCAAATAAAGTGA | 18388 |
| bags20c13 | AACAAATGCAGGAGTTGCAGA<br>AACAAATGCATGAGTTGCAGA | 18389 |
| bags20c13 | GATATGTTCCCATGCATTTTT<br>GATATGTTCCGATGCATTTTT | 18390 |
| bags20c13 | TTTATCTCGTTATATGACGCT<br>TTTATCTCGTCATATGACGCT | 18391 |
| bags30i14 | TCGCACGCCGACTCAATTTTA<br>TCGCACGCCGTCTCAATTTTA | 18392 |
| bass30i14 | GATACGGAATCTACCTCTCAG<br>GATACGGAATTTACCTCTCAG | 18393 |
| bags30i14 | GCTCGTCCGGATGGATACGGA<br>GCTCGTCCGGTTGGATACGGA | 18394 |
| BaAK17E11 | GCGTAAGTAGGTCATCAAAAC<br>GCGTAAGTAGAGTCATCAAAAC | 18395 |
| BaAK17E11 | GAAATCCTTCAGCATAGTTTG<br>GAAATCCTTCGGCATAGTTTG | 18396 |
| baal10l01 | CACCACTAAG-GACAGACCAC<br>CACCACTAAGAGACAGACCAC | 18399<br>18400 |
| baal10l01 | TGCGAAATCTCTGGTTCCTGA<br>TGCGAAATCTTTGGTTCCTGA | 18401 |
| baak26e17 | AAAGCACAATGGACTATCTCG<br>AAAGCACAATAGACTATCTCG | 18402 |
| baak26e17 | TATCTCCAGATGAGGTGATAC<br>TATCTCCAGACGAGGTGATAC | 18403 |
| bags32d21 | CTTCCTTTTCACCTTATAACG<br>CTTCCTTTTCGCCTTATAACG | 18407 |

TABLE 23-16

| Clones | Haruna Nijo H602 | SEQ ID NO: |
|---|---|---|
| bags32d21 | CTCTTTCCAGCAGTTTGGTCC<br>CTCTTTCCAGAAGTTTGGTCC | 18408 |
| bags32d21 | GTTAAGCAGGTGCTGGATCCT<br>GTTAAGCAGGGGCTGGATCCT | 18409 |
| bah54j22 | TAACTGACTTCTACAAGAAAA<br>TAACTGACTTTTACAAGAAAA | 18410 |
| bah54j22 | AGATTATTGAACGGACCACAT<br>AGATTATTGATCGGACCACAT | 18411 |
| bah54j22 | GCCAAAACTAAGAGAGGACGA<br>GCCAAAACTATGAGAGGACGA | 18412 |
| bah54j22 | GTTGGTGTCATAGAAGATTAT<br>GTTGGTGTCACAGAAGATTAT | 18413 |
| bah54j22 | TTTTGGAGCAATGACACGAGC<br>TTTTGGAGCACTGACACGAGC | 18414 |
| bah13f11 | GCTTATTGGTAAACTGCATCA<br>GCTTATTGGTGAACTGCATCA | 18417 |
| baal4f01 | AAACGCACTCGTGGCCCACAC<br>AAACGCACTC-TGGCCCACAC | 18421<br>18422 |
| baal4f01 | AAACTCTAAGTTGGGAGACCA<br>AAACTCTAAGATGGGAGACCA | 18423 |
| baal4f01 | CTCGATTGGCATGGGATCAAC<br>CTCGATTGGCNTGGGATCAAC | 18424 |
| baal4l21 | TCTTCGCTTTTTGATTGATGG<br>TCTTCGCTTTCTGATTGATGG | 18426 |
| BaAK31O14 | CAGCTCATCCGCATCGCTGGA<br>CAGCTCATCCACATCGCTGGA | 18428 |
| baafl3d17 | TCCACACGATTTCAGCAACTT<br>TCCACACGATCTCAGCAACTT | 18430 |
| baal13d17 | TGAGCCCCTGGGCGAGCGTGC<br>TGAGCCCCTGCGCGAGCGTGC | 18431 |
| baal13d17 | AGGCTTCAGAATGGCCGTTTG<br>AGGCTTCAGAGTGGCCGTTTG | 18432 |
| baal13d17 | GCTTATTTCCCCACGGGTTCT<br>GCTTATTTCGAGACCCGTTCT | 18433 |
| bags22j12 | CCCACGCACAATTCGGAAGCA<br>CCCACGCACAGTTCGGAAGCA | 18434 |
| bags33p05 | AAGACGCCATGTCAGAATAAG<br>AAGACGCCATATCAGAATAAG | 18435 |
| bags33p05 | CAAAATGACCGAACACATGAA<br>CAAAATGACCAAACACATGAA | 18436 |
| bags33p05 | TTCGATCACTTCTCAGATCAT<br>TTCGATCACTCCTCAGATCAT | 18437 |
| bags33j07 | TCGGGTTCAGACATGCAATGA<br>TCGGGTTCAGGCATGCAATGA | 18438 |
| bags15d19 | TGCCACGGCTGCCGTAAGGGT<br>TGCCACGGCTACGGTAAGGGT | 18441 |
| bah57o03 | AAAAGAACTTTATGTTGTCGC<br>AAAAGAACTTCATGTTCTCGC | 18447 |
| bah57o03 | GGATTGGGCAAAGATGATATT<br>GGATTGGGCACAGATGATATT | 18448 |

TABLE 23-17

| Clones | Haruna Nijo H602 | SEQ ID NO: |
|---|---|---|
| BaAK12F04 | CTTGAAAACTCTGGCAGTATC<br>CTTGAAAACTATGGCAGTATC | 18454 |
| BaAK12F04 | TATGGTACAACAGAAACAATT<br>TATGGTACAATAGAAACAATT | 18455 |
| BaAK12F04 | TAAACCGACCCTTGATGTAGC<br>TAAACCGACCATTGATGTAGC | 18456 |
| bah53j16 | GCTCGAGTCTCAATCGTCTCC<br>GCTCGAGTCTAAATCGTCTCC | 18457 |
| bah53j16 | TTCATTCATCTGTTCTAACAC<br>TTCATTCATCGGTTCTAACAC | 18458 |
| bah53j16 | CTCCTAGGGACTCAAGACCCT<br>CTCCTAGGGATTCAAGACCCT | 18459 |
| BaSD2E24 | TCTCTCTTTTTCAGCATGAAG<br>TCTCTCTTTTCCAGCATGAAG | 18460 |
| BaSD2E24 | CGTAATCTTAAGATTCATATA<br>CGTAATCTTAGGATTCATATA | 18461 |
| bags39h08 | AGGATCTAGCGATACACCGTT<br>AGGATCTAGCAATACACCGTT | 18462 |
| basd1n02 | TGGCGGACGCGCCGTCGCGCA<br>TGGCGGACGCACCGTCGCGCA | 18463 |
| bags20m21 | CGCACACGGGTTGCAGTTCAC<br>CGCACACGGGGTGCAGTTCAC | 18464 |
| baat10h19 | GGATACCAAGAGTCCTGGAGA<br>GGATACCAAGGGTCCTGGAGA | 18465 |
| basd12m11 | CTTGCATACCTCTTACCGATT<br>CTTGCATACCGCTTACCGATT | 18466 |
| basd12m11 | ATTAGCATTTTTCTTAACATC<br>ATTAGCATTTCTGTTAACATG | 18467 |
| bah29d24 | CCTCCCTGCTTCTTTGCTGGC<br>CCTCCCTGCTGCTTTGCTGGC | 18468 |
| bah29d24 | TTACATACCTACCCCCCTCCT<br>TTACATACCTTCCCCCCTCCT | 18469 |
| BaGS39P09 | CAGATATTCTAAGCTAGATTA<br>CAGATATTCTGAGCTAGATTA | 18470 |
| BaGS39P09 | ATCCCTGTCGACATATCTTGG<br>ATCCCTGTCGCCATATCTTGG | 18471 |
| BaGS31F17 | CATGGGTGCCAATGAGCCCAA<br>CATGGGTGCCGATGAGCCCAA | 18472 |
| BaGS23D08 | ATTGAGTGATTGGTCTATGAC<br>ATTGAGTGATGGGTCTATGAC | 18473 |
| BaGS23D08 | CGTCACCAAATTGTCAGAAA<br>CGTCACCAAACTGTCAGAAA | 18474 |
| bags39d15 | ATGGTTGGAGCGCGACGCTGG<br>ATGGTTGGAGTGCGACGCTGG | 18475 |
| BaGS34I17 | ACCACAAAAATTCTGGCTTTC<br>ACCACAAAAAATCTGGCTTTC | 18476 |
| BaGS34I17 | ATGCATGATCCGTGTTGCCTG<br>ATCCATGATCTGTGTTGCCTG | 18477 |
| BaH32N02 | GCTGCCTGGAGGCAATTTTCC<br>GCTGCCTGGAAGCAATTTTCC | 18478 |

TABLE 23-18

| Clones | Haruna Nijo H602 | SEQ ID NO: |
|---|---|---|
| BaSD18H19 | CACGATCTATACATGTGTTCC<br>CACGATCTATGCATGTGTTCC | 18479 |
| bast63A0101 | GGCCCGAGTGGTTGCGATGCA<br>GGCCCGAGTGATTGCGATGCA | 18480 |
| BaH50N04 | GAGCGGCGCGCGGTACGGTGG<br>GAGCGGCGCGTGGTACGGTGG | 18481 |
| BaH50N04 | GTACGTAGCTTGCTTGGTCGC<br>GTACGTAGCTCGCTTGGTCGC | 18482 |
| baal4a13 | TATCGTATTGAGTGCTTTTCA<br>TATCGTATTGTGTGCTTTTCA | 18483 |
| baal4a13 | TTTATCAGCTGTGCATAAGTT<br>TTTATCAGCTTTGCATAAGTT | 18484 |
| baal4a13 | GAATGGATGACAACCACGATG<br>GAATGGATGAGAACCACGATG | 18485 |
| baal4a13 | TACCAGAACAGATGTCATTTT<br>TACCAGAACAAATGTCATTTT | 18486 |
| baal41118 | GCCATCTAATAGTATTAGCAT<br>GCCATCTAATGGTATTAGCAT | 18487 |
| baal41118 | TCCTCTTTCTTCCTTCTCCTT<br>TCCTCTTTCTCCCTTCTCCTT | 18488 |
| baal41118 | ATATCTATTCGCAGGTAAGAC<br>ATATCTATTCACAGGTAAGAC | 18489 |
| baal41118 | TTAAACAGGAAAGATAGAGAG<br>TTAAACAGGAGAGATAGAGAG | 18490 |
| baal41118 | GTGTTACTGGTTACTTATCAT<br>GTGTTACTGGGTACTTATCAT | 18491 |
| baal41118 | GTACTAHCAGTTAGCCGCCAT<br>GTACTACCAGGTAGCCGCCAT | 18492 |
| baal41118 | ATAGAGAGAGTTTTATTTATA<br>ATAGAGAGAGGTTTATTTATA | 18493 |
| baal41118 | TTGACAACTAGTTATATCTAT<br>TTGACAACTAATTATATCTAT | 18494 |
| baal27e20 | AAATGCATGTAAAGCACCAGC<br>AAATGnATGTGAAGCACCAGC | 18497 |
| baal27e20 | TCAGCTGGCAAGCTTGAAGGC<br>TCAGCTGGCATGCTTGAAGGC | 18498 |
| baal27e20 | GTTGCGTTTTCTCACCATCTT<br>GTTGCGTTTTTTCACCATCTT | 18499 |
| baal27e20 | GCCTACTTACCGTGATGAAAA<br>GCCTACTTACTGTGATGAAAA | 18500 |
| bags37116 | CAGCACCAGGAGATGATGCAT<br>CAGCACCAGGGGATGATGCAT | 18501 |
| baak34o06 | TCGGAAGAGTAAATGTATCTT<br>TCGGAAGAGTGAATGTATCTT | 18502 |
| baak34o06 | TGATCACAGCAGTGAGGATTC<br>TGATCACAGCCGTGAGGATTC | 18503 |
| baak34o06 | CATCTTTGGAGCATGCTACAG<br>CATCTTTGGAACATGCTACAG | 18504 |
| baak34o06 | CGACAACTAACTCCGGACGGA<br>CGACAACTAATTCCGGACGGA | 18505 |

TABLE 23-19

| Clones | Haruna Nijo H602 | SEQ ID NO: |
|---|---|---|
| baak34o06 | ATCGGCGATACGATATTACAT<br>ATCGGCGATATGATATTAGAT | 18506 |
| baal30i11 | TATTGGTCAACTTTATACTAC<br>TATTGGTCAAATTTATACTAC | 18507 |
| BaH62C15 | GAATTAACTCCTGCCCCTCCT<br>GAATTAACTCTTGCCCCTCCT | 18508 |
| baak16l19 | TGCGCCACCGTCTCCGGGTTG<br>TGCGCCACCGCCTCCGGGTTG | 18512 |
| kr41h0315 | GTCGCTGTTCCGTCTGTGGAA<br>GTCGCTGTTCAGTCTGTGGAA | 18514 |
| bah62i23 | TTCCACAGACGGAACAGCGAC<br>TTCCACAGACTGAACAGCGAC | 18515 |
| bah52i24 | CGTCTGGTGATTCTGCCTTTG<br>CGTCTGGTGACTCTGCCTTTG | 18516 |
| bastl33a0301 | CGTCTGGTGACTCTGCCTTTG<br>CGTCTGGTGATTCTGCCTTTG | 18517 |
| bastl56A0301 | TGCCACTACAAGTATATGCAG<br>TGCCACTACAGGTATATGCAG | 18519 |
| baal39a03 | ACTCAAGCTTCCATTTTTTCT<br>ACTCAAGCTTGCATTTTTTCT | 18520 |
| baal39a03 | CTTTCTCTGACGAAGAAACAA<br>CTTTCTCTGAAGAAGAAACAA | 18521 |
| baal39a03 | GTGGTATATTTTCCAAACTCA<br>GTGGTATATTCTCCAAACTCA | 18522 |
| baal39a03 | TCTCACAATCCCTGATATGTT<br>TCTCACAATCGCTGATATGTT | 18523 |
| baal39a03 | ATGCACATTTTCCGTGCGCGC<br>ATGCACATTTACCGTGCGCGC | 18524 |
| baal39a03 | ATTGTCGGGGAAAAATGTATG<br>ATTGTCGGGGGAAAATGTATG | 18525 |
| baak34l03 | TTCTTAGACATGCATTATGTG<br>TTCTTAGACACGCATTATGTG | 18527 |
| baak34l03 | TGCACATGAAGGAAATAGATG<br>TGCACATGAAAGAAATAGATG | 18528 |
| baak34l03 | ATGTCTGTTGATGTACTTGTG<br>ATGTCTGTTGGTGTACTTGTG | 18529 |
| baak34l03 | CATGGAAGTTCTCATAGGGAT<br>CATGGAAGTTTTCATAGGGAT | 18530 |
| baak34l03 | TACATCTATACAATGTCATGG<br>TACATCTATATAATGTCATGG | 18531 |
| baak34l03 | GTGATAAATTTTCTGTGTCAT<br>GTGATAAATTCTCTGTGTCAT | 18532 |
| baak34l03 | TAAACAAGAAAAGCTTGATG<br>TAAACAAGATAAGCTTGATG | 18533 |
| BaSD20J15 | ACTATGTATGCACAGACGCGC<br>ACTATGTATGTACAGACGCGC | 18534 |
| bastl30f0711 | CACAAACAAACGGGACCCCCA<br>CACAAACAAAGGGGACCCCCA | 18535 |
| bastl30f0711 | GTTTGCTTATATACTATACAC<br>GTTTGCTTATTTACTATACAC | 18536 |

TABLE 23-20

| Clones | Haruna Nijo H602 | SEQ ID NO: |
|---|---|---|
| bast56G0713 | ACCAGAAGCTCTCTACTACCA<br>ACCAGAAGCTTTCTACTACCA | 18539 |
| bast56G0713 | CAGCCGAACCCCTGGCTGGCT<br>CAGCCGAACCCGCTGGCTGGCT | 18540 |
| bast102H0715 | GATTTGGCATCAATGTTACAA<br>GATTTGGCATTAATGTTACAA | 18543 |
| bast102H0715 | GTGTCAAAGGAAACTCCAAAA<br>GTGTCAAAGGGAACTCCAAAA | 18544 |
| bags8i05 | CACCGCACCGACTTTCTCGTT<br>CACCGCACCGGCTTTCTCGTT | 18545 |
| basd18m04 | GGCGACGCCGGAACCAACGAA<br>GGCGACGCCGAAACCAACGAA | 18547 |
| bah28g01 | CGTAGTCTTCCGGTGTTAGTG<br>CGTAGTCTTCAGGTGTTAGTG | 18550 |
| basd1m13 | ACGGCAAACCGAGACGAGAAC<br>ACGGCAAACCCAGACGAGAAC | 18551 |
| bags37h19 | AAGAAGGATATCTATGAGACG<br>AAGAAGGATAACTATGAGACG | 18552 |
| bags37h19 | TGTGTGTGTGATGATCGGTTT<br>TGTGTGTGTGGTGATCGGTTT | 18553 |
| bags37h19 | CTACGTCACCAACGACAGAAA<br>CTACGTCACCGACGACAGAAA | 18554 |
| bah21a10 | GATGCCTCCTGGCCCTCGGCG<br>GATGCCTCCTCGCCCTCGGCG | 18556 |
| bah21a10 | CTCAGTCTCAGACCACACCTA<br>CTCAGTCTCAAACCACACCTA | 18557 |
| bags23d06 | AAAATCAATACTAAATACTCC<br>AAAATCAATATTAAATACTCC | 18558 |
| BaGS19G10 | TTTGCTTCACACCGGGGTTCT<br>TTTGCTTCACGCCGGGGTTCT | 18560 |
| bah11b24 | TCAAAAAGCAGAAGTGGGCTC<br>TCAAAAAGCAAAAGTGGGCTC | 18561 |
| bah11b24 | TAAGAAAGCTATGTATCAGCA<br>TAAGAAACCTCTGTATCAGCA | 18562 |
| bah11b24 | TACAAACAGTGAATAAGCCTG<br>TACAAACAGTAAATAAGCCTG | 18563 |
| bah11b24 | CAGGAAGTTCGTGCAGATTGC<br>CAGGAAGTTGTTGGAGATTGC | 18564 |
| bah11b24 | ATAATAATAGTTCAAACAGGG<br>ATAATAATAGCTCAAACAGGG | 18565 |
| bah11b24 | GTGGGCTCCGATGTATGTAAC<br>GTGGGCTCCGGTGTATGTAAC | 18566 |
| bah11b24 | TTAACACTTGATTACTGGTGA<br>TTAACACTTGGTTACTGGTGA | 18567 |
| bah11b24 | ATAAGCCTGTAATCTAGATAT<br>ATAAGCCTGTGATCTAGATAT | 18568 |
| bast39d0408 | TGAGTTTGTATTGCTGCAAAT<br>TGAGTTTGTACTGCTGCAAAT | 18569 |
| bast39d0408 | TGCTACAATACAAATGGAATG<br>TGCTACAATATAAATGGAATG | 18570 |

TABLE 23-21

| Clones | Haruna Nijo H602 | SEQ ID NO: |
|---|---|---|
| bast39d0408 | GAATGATCGCATAGCGAGAAC<br>GAATGATCGCGTAGCGAGAAC | 18571 |
| bast39d0408 | CAATAATCGCGAGTTGGTGCA<br>CAATAATCGCAAGTTGGTGCA | 18572 |
| baak33e08 | TGAGAAACACAGCAAACGATG<br>TGAGAAACACGGCAAACGATG | 18573 |
| BaAL33B08 | ACTCAAATTGAACGGTCAGTA<br>ACTCAAATTGCACGGTCAGTA | 18575 |
| BaAL33B08 | CGTTCACTGTATACGGGCCAA<br>CGTTCACTGTGTACGGGCCAA | 18576 |
| BaAL33B08 | CCTCGGTCTCTCCTTGTCTCT<br>CCTCGGTCTCCCCTTGTCTCT | 18577 |
| BaAL33B08 | CGGTCAGTAACTGTGTCTCCG<br>GGGTCAGTAATTGTGTCTCGG | 18578 |
| bags39e12 | TGAGTACACTTATTAACCTGT<br>TGAGTACACTCATTAACCTGT | 18579 |
| bags39e12 | ACAGAGCTTCAGATAATTGGT<br>ACAGAGCTTCTGATAATTGGT | 18580 |
| bags39e12 | TGTCAATCAATGACTTGTACT<br>TGTCAATCAAGGACTTGTACT | 18581 |
| bags39e12 | TTCAGCAAGTCATTGAAGTGT<br>TTCAGCAAGTAATTGAAGTGT | 18582 |
| bags39e12 | ATCACGTGCCCGCAACCGCCA<br>ATCACGTGCCTGCAACCGCCA | 18583 |
| bags33n09 | ACCTTCCAATAAATTTAGTT<br>ACCTTCCAATGAAATTTAGTT | 18586 |
| baal32h09 | ACTTGGCCAGTGGTCACAGCA<br>ACTTGGCCAGNGGTCACAGCA | 18587 |
| baal32h09 | CACCACCTGATCATCAGATTG<br>CACCACCTGACCATCAGATTG | 18588 |
| baal32h09 | CCGAGTCCGGTTGATTCTGGC<br>CCGAGTCCGGNTGATTCTGGC | 18589 |
| baal32h09 | GATTCTGGCGGGCTCCTGCTC<br>GATTCTGGCGAGCTCCTGCTC | 18590 |
| BaAK20017 | ACTGCCCTCCGTCCTTTTACG<br>ACTGCCCTCCCTCCTTTTACG | 18591 |
| BaAK20017 | GGAGTAGTTTGCAACACTGCC<br>GGAGTAGTTTACAACACTGCC | 18592 |
| BaAK20017 | ATTTCTAAAATGTCTTATATT<br>ATTTCTAAAGGTCTTATATT | 18593 |
| bags32g10 | CCGCATTCTCCCCTTCAAACA<br>CCGCATTCTCTCCTTCAAACA | 18594 |
| baet33E1210 | GAGCTCGTGCCGCTGCCGTCA<br>GAGCTCGTGCGGCTGCCGTCA | 18595 |
| baet33E1210 | GCCCGTGTGGGCACTGGGCAC<br>GCCCGTGTGGACACTGGGCAC | 18596 |
| bah50o08 | TTGATTCCTGCAGCCTTTTCC<br>TTGATTCCTGTACCCTTTTCC | 18597 |
| bah50o08 | CCGGCATCTCCGGTACTGCTT<br>CCGGCATCTCTGGTACTGTTT | 18598 |

TABLE 23-22

| Clones | Haruna Nijo / H602 | SEQ ID NO: |
|---|---|---|
| bah50o08 | GATTCCTGCAGCCTTTTCCTG<br>GATTCCTGTACCCTTTTCCTG | 18599 |
| bast46F0711 | ATAACCCTACGACTCAGAAGG<br>ATAACCCTACAACTCAGAAGG | 18600 |
| bast46F0711 | GCCGACCCCGATACTAGCACG<br>GCCGACCCCGTTACTAGCACG | 18601 |
| bast46F0711 | GAGAGCAGGAAATATCTATCA<br>GAGAGCAGGACATATCTATCA | 18602 |
| bast46F0711 | ATCTATCATTTCAGGCCAAAT<br>ATCTATCATTCCAGGCCAAAT | 18603 |
| bah16f05 | TATCTCCTGGCCAGCGTTTT<br>TATCTCCTGGGACAGCGTTTT | 18604 |
| bah16f05 | GGAGCGTCAGGAACTGATTCA<br>GGAGCGTCACAAACTGATTCA | 18605 |
| bah13o11 | GCACCGTAGCGGAGGACATCC<br>GCACCGTAGCAGAGGACATCC | 18607 |
| basd27i13 | AAACTGTTACTCTACCGAACA<br>AAACTGTTACGCTACCGAACA | 18609 |
| basd27i13 | CTAGGATCTCGGTCAGCAGCT<br>CTAGGATCTCAGTCAGCAGCT | 18610 |
| bags26e20 | AAATGCTTCAAAAAGATATCA<br>AAATGCTTCACAAAGATATCA | 18613 |
| bags26e20 | GCGTGCATGTCACCAGTATAG<br>GCGTGCATGTTACCAGTATAG | 18614 |
| bags26e20 | CATCAAGAACGGTATGAACCA<br>CATCAAGAACAGTATGAACCA | 18615 |
| baet45g1214 | ACATAACATATTCCGTATACG<br>ACATAACATAGTCCGTATACG | 18616 |
| baet45g1214 | ATTACACATGCCACATAACAT<br>ATTACACATGTCACATAACAT | 18617 |
| basd13j22 | CCCTGCGGCAGTTGTTCCTCA<br>CCCTGCGGCAATTGTTCCTCA | 18619 |
| baak46e10 | GGGCGGCCCAGGTTCCAGGGG<br>GGGCGGCCCATGTTCCAGGGG | 18620 |
| baak46e10 | CCGACGGAACCAAACAATCAG<br>CCGACGGAACAAAACAATCAG | 18621 |
| baak46e10 | TAATACGAGGACACGTGTG<br>TAATACGACGACACGTGTG | 18622 |
| bastE5f0812 | AAAGGGTTATGAAATTACCC<br>AAAGGGTTAGGAAATTACCC | 18623 |
| baak44i12 | CGAGCGATCCGAAGGTGTTCT<br>CGAGCGATCCAAAGGTGTTCT | 18632 |
| bah21j03 | AACGTGTCTCATTCCAGCTTC<br>AACGTGTCTCGTTCCAGCTTC | 18633 |
| bah21j03 | TCAGTCCCGAAGCAGAGGAA<br>TCAGTCCCGTAGCAGAGGAA | 18634 |
| bah21j03 | TGAGTCTTCAAGACAGAGTGT<br>TCACTCTTCAGGACAGAGTGT | 18635 |
| bah21j03 | ACCTCTCAGCTTCAAGCATCG<br>ACCTCTCAGCCTCAAGCATCG | 18636 |

TABLE 23-23

| Clones | Haruna Nijo / H602 | SEQ ID NO: |
|---|---|---|
| kr71b0103 | HGCGCGTCCTTGCCGGCAAGG<br>CGCGCGTCCTCGCCGGCAAGG | 18637 |
| baak21p23 | CTACTTTATCCACATGCTGCG<br>CTACTTTATCAACATGCTGCG | 18639 |
| baak21p23 | AATACATCAGACCCTGAGCTA<br>AATACATCAGCCCCTGAGCTA | 18640 |
| bags6g09 | AAAAGGAAAATCAACACATGA<br>AAAAGGAAAAGCAACACATGA | 18641 |
| BaSD15M02 | GGCCGATAGCAGGGATCCCAG<br>GGCCGATAGCGGGGATCCCAG | 18642 |
| basd13f02 | ATGCCTGTACATGGACACCAG<br>ATGCCTGTACTTGGACACCAG | 18643 |
| basd13f02 | AAGCTCATATGAAGTTAATCA<br>AAGCTCATATAAAGTTAATCA | 18644 |
| basd13f02 | GGTCAAACCATCAAAAAGATT<br>GGTCAAACCACCAAAAAGATT | 18645 |
| basd13f02 | TTACTCCTTCACAGTGATGCA<br>TTACTCCTTCGCAGTGATGCA | 18646 |
| basd13f02 | TAACAAGTAACGGTAAAAACT<br>TAACAAGTAATGGTAAAAACT | 18647 |
| bah26j10 | TCACCATGACTGGTTTAGACT<br>TCACCATGACAGGTTTAGACT | 18650 |
| bah26j10 | CAGATTCCCAGATGGCTCGTC<br>CAGATTCCCAAATGGCTCGTC | 18651 |
| bast65g0113 | TTCGTGCCGCGTGATGCAGCC<br>TTCGTGCCGCCTGATGCAGCC | 18652 |
| baak4k13 | GCTCACTTGCTTTTCAGTGTG<br>GCTCACTTGCGTTTCAGTGTG | 18653 |
| baak4k13 | GGAGGTCGCCGAACGTCTTGG<br>GGAGGTCGCCAAACGTCTTGG | 18654 |
| bags34h11 | CATCCCGAAACTTGTCACAGA<br>CATCCCGAAATTTGTCACAGA | 18655 |
| bags37j03 | CTAACTTATTATTGTTACTAA<br>CTAACTTATTTTTGTTACTAA | 18656 |
| bags37j03 | CATCCTGACAAAAGAGAGCAA<br>CATCCTGACAGAAGAGAGCAA | 18657 |
| bags37j03 | TCAAATAGAGCGTGCAGCTAC<br>TCAAATAGAGTGTGCAGCTAC | 18658 |
| bags37j03 | AGCAAAATCAAGACAGGCAGT<br>AGCAAAATCAGGACAGGCAGT | 18659 |
| bah22o08 | TGATCTTCTGCCTGTAGAATA<br>TGATCTTCTGTCTGTAGAATA | 18661 |
| bah22o08 | CTGATAGGTAGGCTGATTCAT<br>CTGATAGGTAAGCTGATTCAT | 18662 |
| bah22o08 | TCCATAACTTTCCCTTGCACA<br>TCCATAACTTCCCCTTGCACA | 18663 |
| bah22o08 | TACAGGGTGTGCGAATTCAGA<br>TACAGGGTGTCCGAATTCAGA | 18664 |
| bah22o08 | GCAACATTTGCGTCACCATCC<br>GCAACATTTGTGTCACCATCC | 18665 |

TABLE 23-24

| Clones | Haruna Nijo H602 | SEQ ID NO: |
|---|---|---|
| bags6k13 | TGACTGTTACAAGAAATACTG<br>TGACTGTTACGAGAAATACTG | 18666 |
| bags6k13 | AAATCAGCCAGACACTGACTG<br>AAATCAGCCACACACTGACTG | 18667 |
| bags6k13 | CCCTCTCTCTCTCTATCGACA<br>CCCTCTCTCTGTCTATCGACA | 18668 |
| bags6k13 | TTCAGTATGCGAGAATTAACC<br>TTCAGTATGCAAGAATTAACC | 18669 |
| bags6k13 | GCACCGGCAGTAGCACCTGCA<br>GCACCGGCAGCAGCACCTGCA | 18670 |
| bags6k13 | ATAGTAACCAGCAGCAGCACC<br>ATAGTAACCACCAGCAGCACC | 18671 |
| bast143C0705 | TTGCTGAAACAATTAAAAGTA<br>TTGCTGAAACGATTAAAAGTA | 18672 |
| bast143C0705 | ATATGTTGCACATACAAGTGC<br>ATATGTTGCAGATACAAGTGC | 18673 |
| bast143C0705 | TACAAGTGCCCACAAATGCTG<br>TACAAGTGCCGACAAATGCTG | 18674 |
| bags23h03 | TGCTTCTGAACATTTGAGCCC<br>TGCTTCTGAATATTTGAGCCC | 18676 |
| bast63B0703 | TCAAGTCCATGTGCCTCTGAT<br>TCAAGTCCATATGCCTCTGAT | 18678 |
| BaSD13E02 | AGAGACTCAGAAAACTAGAAG<br>AGAGACTCAGGAAACTAGAAG | 18679 |
| bah13a17 | AATCATCAAGTTCGATCAAGG<br>AATCATCAAGGTCGATCAAGG | 18681 |
| bah50123 | CTGGCCTCTTTGCTGGCCTGT<br>CTGGCCTCTTGGCTGGCCTGT | 18682 |
| bah50123 | TTGCATACGATACTGAAACAT<br>TTGCATACGAAACTGAAACAT | 18683 |
| bah50123 | TTTCGACTTTGGCTGACTCTG<br>TTTCGACTTTTGCTGACTCTG | 18684 |
| bast73e0210 | GGCATTGCGCGGCGGCCAACA<br>GGCATTGCGCCGCGGCCAACA | 18686 |
| BaH50021 | TTCCATTTCAGATCTGATGCT<br>TTCCATTTCAAATCTGATGCT | 18687 |
| BaH50021 | TTCACTACACTTATTTGAGCA<br>TTCACTACACATATTTGAGCA | 18688 |
| BaH50021 | TGGAGTACTAGACTTGGATCT<br>TGGAGTACTACACTTGGATCT | 18689 |
| BaH50021 | TTGAGCATGAAGCACTATATT<br>TTGAGCATGAGGCACTATATT | 18690 |
| BaH50021 | GCACCCTCCTCTTCCCCGCCA<br>GCACCCTCCTTTTCCCCGCCA | 18691 |
| basd21g05 | GTTGGCAACATCATAAACTAG<br>GTTGGCAACAGCATAAACTAG | 18692 |
| baal5i19 | TATAACCCGGGGAGAGATAGA<br>TATAACCCGGAGAGAGATAGA | 18694 |
| baal5i19 | CACGCACATGGCCCTGTTCAA<br>CACGCACATGTCCCTGTTCAA | 18695 |

TABLE 23-25

| Clones | Haruna Nijo H602 | SEQ ID NO: |
|---|---|---|
| baal5i19 | ATTATACCTGAAATTCAAGGA<br>ATTATACCTGTAATTCAAGGA | 18696 |
| baal5i19 | TCTTTGTTGGGATTACACCCA<br>TCTTTGTTGGAATTACACCCA | 18697 |
| bah16e04 | TTATACCACATGCGGCCCGGG<br>TTATACCACAGGCGGCCCGGG | 18698 |
| bah16e04 | ACCTGTACCATACAGAGCAGT<br>ACCTGTACCAAACAGAGCAGT | 18699 |
| bah16e04 | GCACCGTCAGCACAGAAGAAC<br>GCACCGTCAGTACAGAAGAAC | 18700 |
| bah16e04 | TAGTAGTCATCTCTGGAAATA<br>TAGTAGTCATGTCTGGAAATA | 18701 |
| bah16e04 | GAAGAACAGAAACTGAATCAG<br>GAAGAACAGATACTGAATCAG | 18702 |
| baak32p24 | GCACCTTTCTCCGCTGCCCTG<br>GCACCTTTCTTCGCTGCCCTG | 18703 |
| baak13d11 | ATATACATAGCCAAGAGGTTT<br>ATATACATAGGCAAGAGGTTT | 18709 |
| baak13d11 | GGGTTGTCATAATTTTATTTG<br>GGGTTGTCATGATTTTATTTG | 18710 |
| bah49p10 | TTCACCACGGAGCCGTCGACC<br>TTCACCACGGTGCCGTCGACC | 18711 |
| bah49p10 | ACTGGAGCTGTAGCTCGACCT<br>ACTGGAGCTGGAGCTCGACCT | 18712 |
| bah49p10 | GCCTGACGCGCCCTTGGAGCC<br>GCCTGACGCGCCCTTGGAGCC | 18713 |
| bah49p10 | TCCACCAGCGACCCGATGTCC<br>TCCACCAGCGGCCCGATGTCC | 18714 |
| baal32n15 | TCTATGTCTGATCCAACCTGC<br>TCTATGTCTGTTCCAACCTGC | 18715 |
| baal32n15 | TCTCGTTCTCATTAGCCAGTT<br>TCTCGTTCTCGTTAGCCAGTT | 18716 |
| BaAK22H04 | TCCCGGTGCCGTAGGGAGCTT<br>TCCCGGTGCCATAGGGAGCTT | 18718 |
| bags15j13 | AGGTGGCGCCCGGGCGGGTGT<br>AGGTGGCGCCGGGGCGGGTGT | 18719 |
| bags15j13 | CGACCTGCGCTTTCGGATTCC<br>CGACCTGCGCCTTCGGATTCC | 18720 |
| kr66G0414 | AGGACATGTTTCGTATGGTCC<br>AGGACATGTTCCGTATGGTCC | 18721 |
| basd22c07 | CGCTCTGAAACTGACAGACAG<br>CGCTCTGAAAATGACAGACAG | 18722 |
| kr71c1105 | TCTAAAACCTTAATCTTATTG<br>TCTAAAACCTCAATCTTATTG | 18723 |
| bags34i11 | CGGCAAAACCACTCTAAGGTG<br>CGGCAAAACCGCTCTAAGGTG | 18724 |
| bags34i11 | TCCAAGATTATGACACGGAGT<br>TCCAAGATTACGACACGGAGT | 18725 |
| bags34i11 | CACATTTATTCTGTACTAGAA<br>CACATTTATTTTGTACTAGAA | 18726 |

TABLE 23-26

| Clones | Haruna Nijo / H602 | SEQ ID NO: |
|---|---|---|
| bah23k17 | CTCATCATCTAGTTCTCTACA<br>CTCATCATCTGGTTCTCTACA | 18727 |
| bah23k17 | TTTGTTTTCAATCACATTCCA<br>TTTGTTTTCATTCACATTCCA | 18728 |
| bah23k17 | TGTATCATTGGTACATGGATA<br>TGTATCATTGATACATGGATA | 18729 |
| bah23k17 | ACAATGTGTCCCTCTGTATCA<br>ACAATGTGTCTCTCTGTATCA | 18730 |
| bah23k17 | GAAAGTACATAATTTGAGTGT<br>GAAAGTACATGATTTGAGTGT | 18731 |
| bah23k17 | AAACACTGAAAATAGGGATGA<br>AAACACTGAAGATAGGGATGA | 18732 |
| bast39D0107 | GGATGCATCAGAGGAGACTCA<br>GGATGCATCATAGGAGACTCA | 18733 |
| bast39D0107 | TCCTACCAGAAAAGGGACGAT<br>TCCTACCAGAGAAGGGACGAT | 18734 |
| bast39D0107 | TCTTGGTACAAGGATGCATCA<br>TCTTGGTACAGGGATGCATCA | 18735 |
| bast39D0107 | ATGTTACTCAAGAGTTGAGAT<br>ATGTTACTCACGAGTTGAGAT | 18736 |
| bast39D0107 | CCTAGGAGAACTCTTCCTACC<br>CCTAGGAGAATTCTTCCTACC | 18737 |
| bast39D0107 | AGTATTAGAAAACTGAGAGCT<br>AGTATTAGAATACTGAGAGCT | 18738 |
| BaH44K24 | CTGCCTGAGGTGGTGGAATAT<br>CTGCCTGAGGCGGTGGAATAT | 18739 |
| BaH44K24 | TGCTGGGAATATAGAGGCCAG<br>TGCTGGGAATGTAGAGGCCAG | 18740 |
| BaH44K24 | TAGAAAATGGTGCCAGAATGC<br>TAGAAAATGGCGCCAGAATGC | 18741 |
| baak32k15 | TTATAAAGAACATACTTGAGA<br>TTATAAAGAAGATACTTGAGA | 18743 |
| baak32k15 | TGACATCATAACCACATTAAT<br>TGACATCATACCCACATTAAT | 18744 |
| baak32k15 | CATGAAGCAATAAAACCAGTT<br>CATGAAGCAACAAAACCAGTT | 18745 |
| bah61a13 | CCTCGCATAATTATCAACATG<br>CCTCGCATAACTATCAACATG | 18746 |
| bah61a13 | CTTTGTGCGTCCCGAAACTTT<br>CTTTGTGCGTACCGAAACTTT | 18747 |
| bags35n11 | TCAGATGTAAATAGGTGTTTT<br>TCAGATGTAATTAGGTGTTTT | 18748 |
| bags35n11 | CCATACCATCATCAGTTATCA<br>CCATACCATCGTCAGTTATCA | 18749 |
| bags35n11 | CATCGTCTAATTTGGGGCGGA<br>CATCGTCTAACTTGGGGCGGA | 18750 |
| bags35n11 | CAGCCTGCAGATGTGTCCATA<br>CAGCCTGCAGGTGTGTCCATA | 18751 |
| baak24i03 | CAGCCTGCAGATGTGTCCATA<br>CAGCCTGCAGGTGTGTCCATA | 18752 |

TABLE 23-27

| Clones | Haruna Nijo / H602 | SEQ ID NO: |
|---|---|---|
| baak24i03 | CATCGTCTAATTTGGGGCGGA<br>CATCGTCTAACTTGGGGCGGA | 18753 |
| baak24i03 | CCATACCATCATCAGTTATCA<br>CCATACCATCGTCAGTTATCA | 18754 |
| bah28n23 | CGTTCTTATGGATTTTACTCC<br>CGTTCTTATGAATTTTACTCC | 18755 |
| bah28n23 | TTCTTTGCATACTCGGCATCA<br>TTCTTTGCATGCTCGGCATCA | 18756 |
| bags10e13 | ATGTAACTCAATCCGCATCAT<br>ATGTAACTCAGTCCGCATCAT | 18757 |
| bags10e13 | TTTGTTTTCAATCACATTCCA<br>TTTGTTTTCATTCACATTCCA | 18758 |
| bags10e13 | CTCATCATCTAGTTCTCTACA<br>CTCATCATCTGGTTCTCTACA | 18759 |
| bags10e13 | GAAAGTACATAATTTGAGTGT<br>GAAAGTACATGATTTGAGTGT | 18760 |
| bags10e13 | GGATGCCTCACGCTTGTCGAT<br>GGATGCCTCAGGCTTGTCGAT | 18761 |
| bags10e13 | CCATTTTGCATACAGAAACAT<br>CCATTTTGCAGACAGAAACAT | 18762 |
| bags19d13 | CCTCACCCTCGCCTATTTGTT<br>CCTCACCCTCACCTATTTGTT | 18763 |
| bags19d13 | GGACGTCGAAGGGCTTCACTT<br>GGACGTCGAATGGCTTCACTT | 18764 |
| baak19d04 | GCATGAAGTCGTGCCGTGTTA<br>GCATGAAGTCATGCCGTGTTA | 18765 |
| baak19d04 | CATGATTATAAACAACTTGCC<br>CATGATTATAGACAACTTGCC | 18766 |
| BaAL34019 | CGATCTTGACGATCTTCTCCG<br>CGATCTTGACAATCTTCTCCG | 18767 |
| BaAK1P04 | CGTTCTTATGAATTTTACTCC<br>CGTTCTTATGGATTTTACTCC | 18769 |
| BaAK1P04 | TTCTTTGCATGCTCGGCATCA<br>TTCTTTGCATACTCGGCATCA | 18770 |
| baak35m13 | TGAACTCCTCAGCTATCGAGA<br>TGAACTCCTCGGCTATCGAGA | 18771 |
| baak35m13 | TCGACTGAATTTACTCTGCCA<br>TCGACTGAATGTACTCTGCCA | 18772 |
| baak35m13 | TGTTAAGACTCCAGAATGACT<br>TGTTAAGACTTCAGAATGACT | 18773 |
| baak35m13 | CGATAAGTAACTTGCCCGTGA<br>CGATAAGTAATTTGCCCGTGA | 18774 |
| bah41n09 | TGGCATAGGAGAACACATATA<br>TGGCATAGGAAAACACATATA | 18776 |
| bah41n09 | CGAAATACCACCAGTGAAGTG<br>CGAAATACCAACAGTGAAGTG | 18777 |
| bah41n09 | ACGCTTGTTTGGGAGTCGGC<br>ACGCTTGTTGGGGAGTCGGC | 18778 |
| bah41n09 | CACCAGCTCATGACGGACCAA<br>CACCAGCTCAGGACGGACCAA | 18779 |

TABLE 23-28

| Clones | Haruna Nijo / H602 | SEQ ID NO: |
|---|---|---|
| bah41n09 | TTCACTATGAGAGTCATGCAG<br>TTCACTATGAAAGTCATGCAG | 18780 |
| BaGS23I12 | GGAACCTTACTGACATTACCC<br>GGAACCTTACCGACATTACCC | 18781 |
| BaGS23I12 | CTCCACCGCGCGGCGGGTACCT<br>CTCCACCGGCAGCGGGTACCT | 18782 |
| bah16p20 | CGACGGTGCCGACCACCGTCA<br>CGACGGTGCCCACCACCGTCA | 18783 |
| bah16p20 | CCTCCTTGGCAGGGCCGACGG<br>CCTCCTTGGCCGGGCCGACGG | 18784 |
| BaH45O16 | ACAGGCAGGATAGGACAGCGA<br>ACAGGCAGGACAGGACAGCGA | 18788 |
| BaH45O16 | CTATCGATGCAGTGCAACTGG<br>CTATCGATGCGGTGCAACTGG | 18789 |
| bah21h09 | TTGTCTGGTGGCTAGGTAGAT<br>TTGTCTGGTGTCTAGGTAGAT | 18790 |
| bah21h09 | ATAAAACTGAATTGGAAAAGT<br>ATAAAACTGATTTGGAAAAGT | 18791 |
| bah21h09 | CAGTTCATCTAATTTTGGTTT<br>CAGTTCATCTGATTTTGGTTT | 18792 |
| bah58p22 | ACCCGAAATATAGGTGATCCA<br>ACCCGAAATAGAGGTGATCCA | 18793 |
| bah58p22 | CAGCAACATCAAAGCTAACAT<br>CAGCAACATCTAAGCTAACAT | 18794 |
| bags20l19 | ACAGGCTACAGCATTTACAGG<br>ACAGGCTACATCATTTACAGG | 18795 |
| bah13i10 | AGGCTTTCAAAGGCTTGAAGT<br>AGGCTTTCAAGGGCTTGAAGT | 18796 |
| bah13i10 | TCGATTACTACCTGAGACTGC<br>TCGATTACTATCTGAGACTGC | 18797 |
| bah13i10 | CTCGGCCTGTCGAATAACCAT<br>CTCGGCCTGTTGAATAACCAT | 18798 |
| baal7c15 | GGGTCGCTACGAAGGCGAGGT<br>GGGTCGCTACTAAGGCGAGGT | 18801 |
| baal7c15 | GATCCGGGCATGGGACGATCC<br>GATCCGGGCACGGGACGATCC | 18802 |
| bah63f05 | GTATGCTATGTTGTGCAACAA<br>GTATGCTATGCTGTGCAACAA | 18803 |
| bah63f05 | GTTTCCCCTACGACATTATAT<br>GTTTCCCCTAGGACATTATAT | 18804 |
| bah63f05 | TTCCCCTCGACACCGTATGGA<br>TTCCCCTCGAAACCGTATGGA | 18805 |
| bags15j16 | GAGCGGAACCGGATATAAGCT<br>GAGCGGAACCCGATATAAGCT | 18806 |
| bags15j16 | GGCAGATCGATGCGACCGGCT<br>GGCAGATCGACGCGACCGGCT | 18807 |
| bags15j16 | GTCACGCCGTAAACGACGCGT<br>GTCACGCCGTCAACGACGCGT | 18808 |
| bah41e10 | GGATGGGCTGCCCCGAAGTGGA<br>GGATGGGCTGGCCGAAGTGGA | 18810 |

TABLE 23-29

| Clones | Haruna Nijo / H602 | SEQ ID NO: |
|---|---|---|
| bah54d08 | GTACAGTGCTCAACGGTGTGC<br>GTACAGTGCTAAACGGTGTGC | 18811 |
| bah54d08 | CCACGTTCAGATTCACCAAGG<br>CCACGTTCAGCTTCACCAAGG | 18812 |
| baak18c01 | ACTGCGAAGAGTATGAAATTT<br>ACTGCGAAGAATATGAAATTT | 18813 |
| baak18c01 | AGGAGCCGAGCGAGTTGGGGT<br>AGGAGCCGAGGGAGTTGGGGT | 18814 |
| baak18c01 | CGTGCACAGATCCAGAGTGGT<br>CGTGCACAGACCCAGAGTGGT | 18815 |
| baak18c01 | AGTTGGGGTCGGTTCCCCACC<br>AGTTGGGGTCAGTTCCCCACC | 18816 |
| baak18c01 | ATCTAAAGCTTTACCGGCTCG<br>ATCTAAAGCTATACCGGCTCG | 18817 |
| baak18c01 | GACATTAGCGATTAGAACCTG<br>GACATTAGCGGTTAGAACCTG | 18818 |
| basd21o07 | ATGCTGCAGCGAAAATAAACA<br>ATGCTGCAGCAAAAATAAACA | 18819 |
| baak43c03 | CACACATGTCAGTGGTTATTT<br>CACACATGTCGGTGGTTATTT | 18821 |
| baal13f18 | GCCGGAAGGTGCTCTTGAATC<br>GCCGGAAGGTACTCTTGAATC | 18824 |
| baal13f18 | CAACAAGCTCGGCAGCTTCGA<br>CAACAAGCTCAGCAGCTTCGA | 18825 |
| baal13f18 | ATGTGAGGCACAGGTACATGT<br>ATGTGAGGCAAAGGTACATGT | 18826 |
| bags18i22 | CTATTACTCACGAGCTAGCGT<br>CTATTACTCATGAGCTAGCGT | 18827 |
| bags18i22 | AAGATTGAAGATGTCTTGAGA<br>AAGATTGAAGGTGTCTTGAGA | 18828 |
| bags9b02 | ATGGCATACAGTCTGCGCAAC<br>ATGGCATACAATCTGCGCAAC | 18829 |
| bags9b02 | TATTTTTCCACAAATAAATAT<br>TATTTTTCCAAAAATAAATAT | 18830 |
| bah11e22 | CCTGGTTTACCCTGTCATCAT<br>CCTGGTTTACTCTGTCATCAT | 18831 |
| bah11e22 | GAATGCCTACCTCGATCGTCT<br>GAATGCCTACATCGATCGTCT | 18832 |
| bah11e22 | GCGCTTACATACGGCGCGGCT<br>GCGCTTACATGCGGCGCGGCT | 18833 |
| bah58h09 | GACGCCACTGGTGATCTCTTG<br>GACGCCACTGCTGATCTCTTT | 18834 |
| baak4c12 | GGACGACGACAGCATCGCCGG<br>GGACGACGACGGCATCGCCGG | 18836 |
| bags37a05 | TTCGGTGTGGCCGATGACAAG<br>TTCGGTGTGGGCGATGACAAG | 18837 |
| baak36a20 | TTGCTTGAGGAAGAGACGTCT<br>TTGCTTGAGGCAGAGACGTCT | 18840 |
| baak36a20 | TTTATTATTATAACCAATCCC<br>TTTATTATTACAACCAATCCC | 18841 |

TABLE 23-30

| Clones | Haruna Nijo H602 | SEQ ID NO: |
|---|---|---|
| baak36a20 | TTACTGAGGCAATGTGTACTT<br>TTACTGAGGCGATGTGTACTT | 18842 |
| baak36a20 | ACCAATCCCATTTCTTCCTGC<br>ACCAATCCCAGTTCTTCCTGC | 18843 |
| baal13m04 | ACCTCCTCCTCCTTGTGCCTG<br>ACCTCCTCCTGCTTGTGCCTG | 18847 |
| basl13m04 | TTTCCGTTAATGCCGTCTAAT<br>TTTCCGTTAACGCCGTCTAAT | 18848 |
| bags9o24 | ACTCAGTCACGCTACACTTTT<br>ACTCAGTCACACTACACTTTT | 18849 |
| bah12h16 | TGATGCTGCCGCTGCTCCGGT<br>TGATGCTGCCACTGCTCCGGT | 18851 |
| bah12h16 | GGGGGCCGCAAAGAAGAAGCT<br>GGGGGCCGCAGAGAAGAAGCT | 18852 |
| bah12h16 | ATGCCTGTTCCTAAGCTGATC<br>ATGCCTGTTCTTAAGCTGATC | 18853 |
| baak33n16 | GAAACATAATACAGCTACAAA<br>GAAACATAATTCAGCTACAAA | 18854 |
| baak33n16 | AACGCTGCCGGGGACGCTACC<br>AACGCTGCCGTGGACGCTACC | 18855 |
| baak33n16 | CACCGAGGGCACACTCGGATA<br>CACCGAGGGCTCACTCGGATA | 18856 |
| baak33n16 | AGCGGGTTCTTGAGGCCCACA<br>AGCGGGTTCTCGAGGCCCACA | 18857 |
| baak33n16 | TGAACAGGATCGCCCAGTATC<br>TGAACAGGATAGCCCAGTATC | 18858 |
| bah26n01 | CACTCTCAGCGTTCCTTGTGA<br>CACTCTCAGCATTCCTTGTGA | 18860 |
| BaGS39E07 | ATGCACGCAGCGAAGAAGAGC<br>ATGCACGCAGTGAAGAAGAGC | 18861 |
| BaH33A09 | ATACTATCTAGGGTGCAATCT<br>ATACTATCTATGGTGCAATCT | 18863 |
| BaH38A09 | AGAGGCTATCACTTCCGTCGG<br>AGAGGCTATCGCTTCCGTCGG | 18864 |
| BaH33A09 | TCTTGTCTTAGGATTGTCTAG<br>TCTTGTCTTAAGATTGTCTAG | 18865 |

TABLE 24-1

| Clones | Haruna Nijo H602 | SEQ ID NO: |
|---|---|---|
| BaAL15P01 | TGCAAGGCGCATGCCAAAAG<br>TGCAAGGCGCCTGCCAAAAG | 18866 |
| bags1d06 | TATTATATTAGGACTGCTCAT<br>TATTATATTATGACTGCTCAT | 18867 |
| bags1d06 | AGCATGGCAGGAAGTAGCAGA<br>AGCATGGCAGCAAGTAGCAGA | 18868 |
| bast18A0602 | CATACTAGTAATGCTTACGGC<br>CATACTAGTAGTGCTTACGGC | 18869 |
| bah63h24 | TAGAGCGTGTGGCATGCCATC<br>TAGAGCGTGTAGCATGCCATC | 18872 |

TABLE 24-1-continued

| Clones | Haruna Nijo H602 | SEQ ID NO: |
|---|---|---|
| BaAK13C16 | CTCATGTACAATTAGTACACA<br>CTCATGTACAGTTAGTACACA | 18874 |
| BaGS32C19 | TGCAGGTCGGAGCACACTGCT<br>TGCAGGTCGGGGCACACTGCT | 18875 |
| baak36f08 | TTACCGCCGGCGGCAACGTCC<br>TTACCGCCGGTGGCAACGTCC | 18876 |
| baak36f08 | CCATGGACGGTCCGCAGGACT<br>CCATGGACGGCCCGCAGGACT | 18877 |
| baak36f08 | GCATGCGGTAACTAGTTACCG<br>GCATGCGGTACCTAGTTACCG | 18878 |
| baak36f08 | GGGCGTGCATCGGGGCGGGAC<br>GGGCGTGCATAGGGGCGGGAC | 18879 |
| baak36f08 | CGACCTGGACAGCAGGCAGGT<br>CGACCTGGACGGCAGGCAGGT | 18880 |
| baak36f08 | TGCAGGTTTTGGGGCACTCGA<br>TGCAGGTTTTCGGGCACTCGA | 18881 |
| baak36f08 | CGACGTACTGATCCTGGCAGA<br>CGACGTACTGGTCCTGGCAGA | 18882 |
| bast142D1107 | TCTCCTATGCCTCGATGTGCA<br>TCTCCTATGCTTCGATGTGCA | 18884 |
| bast142D1107 | GCTCTATAAAATTAAATTAGA<br>GCTCTATAAATTTAAATTAGA | 10885 |
| baak20g06 | CAGAGAAACAAGCAAAAACAG<br>CAGAAAAACAGGCAAAAACAG | 18889 |
| baak46o05 | GCCGCAACGAATCACAGTCCG<br>GCCGCAACGATTCACAGTCCG | 18891 |
| baak46o05 | CATCCAATACGTATATATGTT<br>CATCCAATACTTATATATGTT | 18892 |
| baak46o05 | GAATGCTGCTACAAGCATGTG<br>GAATGCTGCTCCAAGCATGTG | 18893 |
| baak46o05 | TTTCACATGAATGGTCATACC<br>TTTCACATGAGTGGTCATACC | 18894 |
| basd15h22 | AGAGAGCGCCCTCCACGATCT<br>AGAGAGCGCCGTCCACGATCT | 18895 |
| basd15h22 | TCGCTCATCAACTTGTACATG<br>TCGCTCATCAGCTTGTACATG | 18896 |
| basd15h22 | GCAGTCTAATTAATGAACATC<br>GCAGTCTAATGAATGAACATC | 18897 |
| basd15h22 | CCGGATCGCCGCACCGGATGT<br>CCGGATCGCCACACCGGATGT | 18898 |

TABLE 24-2

| Clones | Haruna Nijo H602 | SEQ ID NO: |
|---|---|---|
| basd15h22 | CATCCCAGCTAACGCTCTTGG<br>CATCCCAGCTCACGCTCTTGG | 18899 |
| basd19c07 | CAACAATCAAACAAACTTTAT<br>CAACAATCAAGCAAACTTTAT | 18900 |
| basd19c07 | TCAAGGCACCGGCCTTTGGGT<br>TCAAGGCACCTGCCTTTGGGT | 18901 |

TABLE 24-2-continued

| Clones | Haruna Nijo H602 | SEQ ID NO: |
|---|---|---|
| baak39a14 | TCTCTGATTCTTTCAAATACT<br>TCTCTGATTCCTTCAAATACT | 18903 |
| bah31e12 | GAGACAGGTCCAGCGATTCTA<br>GAGACAGGTCGAGCGATTCTA | 18904 |
| BaSD15L22 | ACGCCTTCTTCCTCATGCTCT<br>ACGCCTTCTTTTCTCATGCTCT | 18905 |
| basd21j11 | AACACAGCAGCTCTTTGATTC<br>AACACAGCAGTTCTTTGATTC | 18908 |
| BaH48C10 | TTCTCTGGAAAGAGGCATATG<br>TTCTCTGGAACGAGGCATATG | 18909 |
| BaH48C10 | AAATAGAAATTTGGGAGAAAT<br>AAATAGAAATGTGGGAGAAAT | 18910 |
| BaH48C10 | AGTTATTGCACAATATTAATT<br>AGTTATTGCATAATATTAATT | 18911 |
| BaH54J07 | TGCCCAATCATACCATCCAAT<br>TGCCCAATCACACCATCCAAT | 18912 |
| BaH54J07 | ACTCCAGATGCATGCTTGATT<br>ACTCCAGATGAATGCTTGATT | 18913 |
| baet46b0903 | CCGTGTGCCATGCATTGCCTC<br>CCGTGTGCCACGCATTGCCTC | 18924 |
| baet46b0903 | TAAGGCGAAGTCACCTAGGGC<br>TAAGGCGAAGGCACCTAGGGC | 18925 |
| BaGS19F16 | AAAATCATACAGATCCATTCT<br>AAAATCATACGGATCCATTCT | 18926 |
| BaGS19F16 | AGGCCCACACAGTAACGTCGG<br>AGGCCCACACCGTAACGTCGG | 18927 |
| BaGS19F16 | AACATTTCAAAAATTCTAAAT<br>AACATTTCAAGAATTCTAAAT | 18928 |
| BaGS19F16 | ATTCTAAATTCTGTGGTAGAA<br>ATTCTAAATTTTGTGGTAGAA | 18929 |
| BaGS19F16 | GAGATATCTGTGGAACAACAA<br>GAGATATCGCGGAACAACAA | 18930 |
| baak13g18 | CTTGCTTGTCGGCGGTGCTCT<br>CTTGCTTGTCAGCGGTGCTCT | 18931 |
| baak13g18 | GCCTTGCCAGTGTTTAACCCA<br>GCCTTGCCAGCGTTTAACCCA | 18932 |
| bast74h0216 | CTTAATTTCACCTATCTGAGC<br>CTTAATTTCAACTATCTGAGC | 18934 |
| BaAK45C14 | TCTCTTTCATTCTTGTTCTTT<br>TCTCTTTCATCCTTGTTCTTT | 18935 |
| kr63f0111 | GCATAAATATGAATTACATGC<br>GCATAAATATTAATTACATGC | 18937 |
| baak13h18 | TGGTGCTAGGGTGCTTGCAGA<br>TGGTGCTAGGATGCTTGCAGA | 18938 |

TABLE 24-3

| Clones | Haruna Nijo H602 | SEQ ID NO: |
|---|---|---|
| BaH49B13 | GATAAGCATGTACATACACAT<br>GATAAGCATGCACATACACAT | 18942 |

TABLE 24-3-continued

| Clones | Haruna Nijo H602 | SEQ ID NO: |
|---|---|---|
| BaH49B13 | CAAGCATATAGAACATCAGCA<br>CAAGCATATACAACATCAGCA | 18943 |
| BaH49B13 | CAAGCTATGGCTTGTGTTCTT<br>CAAGCTATGGTTTGTGTTCTT | 18944 |
| BaH49B13 | TTACCCAGGACATTGAAATGG<br>TTACCCAGGAAATTGAAATGG | 18945 |
| BaGS35A09 | TGGTGGCAACAAGCTCCATCA<br>TGGTGGCAACGAGCTCCATCA | 18946 |
| bast16a0802 | AATTCAAGTGGTTGGAATTAC<br>AATTCAAGTGATTGGAATTAC | 18948 |
| basd18k01 | GCCGCCACGGTAAGGAAGACG<br>GCCGCCACGGCAAGGAAGACG | 18949 |
| BaH58D17 | CTGTAGTGCTTCTTCGTCAGG<br>CTGTAGTGCTCCTTCGTCAGG | 18950 |
| bags26d01 | GGATTGCTTGGACATACCGAG<br>GGATTGCTTGCACATACCGAG | 18953 |
| bags26d01 | TCTGCTTTGTCGGTGTCATCT<br>TCTGCTTTGTTGGTGTCATCT | 18954 |
| bags26d01 | AGACCAGTGACGTTCAGCAAT<br>AGACCAGTGATGTTCAGCAAT | 18955 |
| bags26d01 | CAGAAAGTCGACCATGAGGGA<br>CAGAAAGTCGTCCATGAGGGA | 18956 |
| bags26d01 | CCTACGCCTTTCCCTTCTTTC<br>CCTACGCCTTCCCCTTCTTTC | 18957 |
| bags26d01 | GCGGCTCGCTTTGAAGGTGTC<br>GCGGCTCGCTCTGAAGGTGTC | 18958 |
| bags26d01 | CTGGCTGACTCAGAAAAAGGA<br>CTGGCTGACTGAGAAAAAGGA | 18959 |
| bags26d01 | CTGAAACCCTAGATGCGGCTC<br>CTGAAACCCTGGATGCGGCTC | 18960 |
| basd14k04 | ATGCTGCCTAGAACCACTTTG<br>ATGCTGCCTAAAACCACTTTG | 18961 |
| basd14k04 | TGGCCTAGAAGCATGCTGCCT<br>TGGCCTAGAATCATGCTGCCT | 18962 |
| basd14k04 | GGCCTTCGACGCTAAGCTTTG<br>GGCCTTCGACACTAAGCTTTG | 18963 |
| BaSD24D11 | ATATTTGCATGATATCAAGGT<br>ATATTTGCATCATATCAAGGT | 18964 |
| BaSD24D11 | CGGTCAAGGCTATGAGATGCC<br>CGGTCAAGGCAATGAGATGCC | 18965 |
| BaSD24D11 | CGAGGTGTTATACTTCATAGC<br>CGAGGTGTTACACTTCATAGC | 18966 |
| BaSD24D11 | CTTTTCTGACAAAGCGCATGT<br>CTTTTCTGACCAAGCGCATGT | 18967 |
| BaSD24D11 | GCACGCTTCAAAAGATTAACG<br>GCACGCTTCACAAGATTAACG | 18968 |
| BaSD24D11 | GTGGTGTTGCCGCAGACTGCG<br>GTGGTGTTGCGGCAGACTGCG | 18969 |

TABLE 24-4

| Clones | Haruna Nijo H602 | SEQ ID NO: |
|---|---|---|
| BaSD24D11 | GGCAGGAAACGGAACATTGAG<br>GGCAGGAAACAGAACATTGAG | 18970 |
| BaH53L10 | GCGATCCTACCGTAATGTACT<br>GCGATCCTACTGTAATGTACT | 18971 |
| BaH53L10 | GACCTTTTGCGCTTCTTTCCA<br>GACCTTTTGCCCTTCTTTCCA | 18972 |
| bah57m03 | TGGAACAAGTCCAGTAGAAAT<br>TGGAACAAGTTCAGTAGAAAT | 18973 |
| bah57m03 | GATGAAATAGAGGCGTCGTTA<br>GATGAAATAGTGGCGTCGTTA | 18974 |
| bah57m03 | ACTTGCGCGATGCGATCGCAT<br>ACTTGCGCGACGCGATCGCAT | 18975 |
| bah57m03 | CGGATTTCTATCAGACAAGAA<br>CGGATTTCTACCAGACAAGAA | 18976 |
| bah57m03 | ATTTTTAGAATTAGGTGCAGA<br>ATTTTTAGAAATAGGTGCAGA | 18977 |
| bah57m03 | TAAGATGAGCATGCCATTTTT<br>TAAGATGAGCGTGCCATTTTT | 18978 |
| baal30b10 | AAGATTGGGTTTCTACTTAT<br>AAGATTGGGCTTCTACTTAT | 18979 |
| bah62n16 | ACATATATTATTGGCTGCTTT<br>ACATATATTACTGGCTGCTTT | 18980 |
| bah62n16 | TATGGATCTACGGCGCAGCTT<br>TATGGATCTATGGCGCAGCTT | 18981 |
| bah62n16 | ATCAGCGTGGCTGCTGATGAC<br>ATCAGCGTGGTTGCTGATGAC | 18982 |
| BaGS22F15 | CTCCGTACTTTGCAACAAGTT<br>CTCCGTACTTCGCAACAAGTT | 18983 |
| BaGS22F15 | AGAGGAGTTCACACTGGTAAT<br>AGAGGAGTTCGCACTGGTAAT | 18984 |
| BaGS22F15 | ACTTTGAGCCGGAAGATTTCG<br>ACTTTGAGCCAGAAGATTTCG | 18985 |
| BaGS22F15 | TGAATACGAAGGGTGAGATCC<br>TGAATACGAATGGTGAGATCC | 18986 |
| BaGS22F15 | CACATAGACAGTCTCTTAGAA<br>CACATAGACATTCTCTTAGAA | 18987 |
| BaH50J14 | CAAGGCTTTGTTAGGTACTAC<br>CAAGGCTTTGCTAGGTACTAC | 18988 |
| BaH50J14 | CCAAGATGCATGGTCTACTTC<br>CCAAGATGCACGGTCTACTTC | 18989 |
| BaH50J14 | TATCATTTCATAACCCAAGAT<br>TATCATTTCACAACCCAAGAT | 18990 |
| BaH50J14 | AGCTCATGGTTGAAGCCGCGA<br>AGCTCATGGTCGAAGCCGCGA | 18991 |
| bah19d23 | CCACATCTGGAAGGTGTTCAG<br>CCACATCTGGCAGGTGTTCAG | 18992 |
| bah19d23 | GCCTTCAAGCTTTCATACGCA<br>GCCTTCAAGCCTTCATACGCA | 18993 |
| bah19d23 | CTGCTGTAGCCTAGCTGAGAC<br>CTGCTGTAGCTTAGCTGAGAC | 18994 |

TABLE 24-5

| Clones | Haruna Nijo H602 | SEQ ID NO: |
|---|---|---|
| bags38c06 | TGCTGCAAGCAAATTTCTTTT<br>TGCTGCAAGCCAATTTCTTTT | 18995 |
| bags38c06 | CCCCCTCCTATTTCTTTGTTT<br>CCCCCTCCTACTTCTTTGTTT | 18996 |
| bags38c06 | GGGAAGCTCAACTGTGGTGGT<br>GGGAAGCTCAGCTGTGGTGGT | 18997 |
| BaGS25N05 | CGAGCTTGACGACCTGCTTGC<br>CGAGCTTGACAACCTGCTTGC | 18998 |
| bast129B0503 | AGGTTCAAGGGCCGGGAGATT<br>AGGTTCAAGG-CCGGGAGATT | 18999<br>19000 |
| baak43n21 | CCCAAAGCTGAATCCACCACA<br>CCCAAAGCTGGATCCACCACA | 19002 |
| baak43n21 | TTCACCTATTCAGGGAACTAA<br>TTCACCTATTGAGGGAACTAA | 19003 |
| baal4a06 | ATTTTCTTTCGGCTCCTTATG<br>ATTTTCTTTCAGCTCCTTATG | 19004 |
| baal4a06 | CGATTTCGATTGCCTTGGGTT<br>CGATTTCGATCGCCTTGGGTT | 19005 |
| baal4a06 | CGAGGGCACCAAATCTGCAGT<br>CGAGGGCACCGAATCTGCAGT | 19006 |
| baal4a06 | TCTGTTCCACGTCCATGTCGC<br>TCTGTTCCACCTCCATGTCGC | 19007 |
| baal4a06 | TTATGATCGCGTTGCCTCGGG<br>TTATGATCGCCTTGCCTCGGG | 19008 |
| baal4a06 | ATAGCCTGCTCGTTCTGCCTA<br>ATAGCCTGCTTGTTCTGCCTA | 19009 |
| baal4a06 | CTCCTTCTGGTGATTTTCATT<br>CTCCTTCTGGAGATTTTCATT | 19010 |
| baal4a06 | CCATGACAGTATCCCTTGTCT<br>CCATGACAGTCTCCCTTGTCT | 19011 |
| bast17D1008 | CAAACACAAGCAAACTCTTGG<br>CAAACACAAGTAAACTCTTGG | 19012 |
| bast17D1008 | TACGGCCGGGCACGTTACTC<br>TACGGCCGGGTACGTTACTC | 19013 |
| BaGS16B17 | TCTTGTCGAGGCCTGATGTGT<br>TCTTGTCGAGACCTGATGTGT | 19014 |
| BaGS16B17 | CTTGATGATGATATAAGGGCC<br>CTTGATGATGTTATAAGGGCC | 19015 |
| BaAK16B19 | ATCCGCGCTAGCTTTTAGCTA<br>ATCCGCGCTACCTTTTAGCTA | 19018 |
| baal40p07 | CCATCGAGTAAGGTGAATCGA<br>CCATCGAGTAGGGTGAATCGA | 19019 |
| baal40p07 | GGCAAAAGAATTGAAGAAACT<br>GGCAAAAGAACTGAAGAAACT | 19020 |
| baal40p07 | ACCCTGCATGCAAGTCACCGG<br>ACCCTGCATGTAAGTCACCGG | 19021 |
| baal40p07 | CCATCTTACCGCCTGCATCGA<br>CCATCTTACCACCTGCATCGA | 19022 |
| bah49c19 | GAACGGTGGTTTATGGTGTTG<br>GAACGGTGGTGTATGGTGTTG | 19023 |

TABLE 24-6

| Clones | Haruna Nijo / H602 | SEQ ID NO: |
|---|---|---|
| bah49c19 | CGAGCTGTTAGAAAATAGCTG<br>CGAGCTGTTAAAAAATAGCTG | 19024 |
| bast58C0406 | AGACTCGTCAGAAGACGACCA<br>AGACTCGTCAAAAGACGACCA | 19025 |
| baak35m24 | GCCCGTAAACATCTTGCTGGC<br>GCCCGTAAACGTCTTGCTGGC | 19026 |
| bags19h13 | TGGGAGGATTGAAAACTTACT<br>TGGGAGGATTTAAAACTTACT | 19027 |
| bags19h13 | GATTCGTCTCGGATTTGCAGG<br>GATTCGTCTCAGATTTGCAGG | 19028 |
| bah57c21 | CGACCTTCGCGCCGCCCTTGC<br>CGACCTTCGCACCGCCCTTGC | 19029 |
| BaH53P15 | ATCTGACAACCTCAAAATCGT<br>ATCTGACAACTTCAAAATCGT | 19030 |
| bags20a10 | GGAAGAGAAAGCANAACANAG<br>GGAAGAGAAAACAAAACAAAG | 19031 |
| bast02d0808 | TCACTTTCCGGACAGAAAACA<br>TCACTTTCCGAACAGAAAACA | 19032 |
| bags31c04 | AACCTTTGTAAACTTGGCACC<br>AACCTTTGTACACTTGGCACC | 19033 |
| bah60o22 | CCTTCCGACAGATTCAACACC<br>CCTTCCGACAAATTCAACACC | 19035 |
| bah60o22 | ATTCGCCGTTCACTGCGTCAT<br>ATTCGCCGTTTACTGCGTCAT | 19036 |
| bah60o22 | AGCATATCTCCTCTTCGGGTC<br>AGCATATCTCTTCTTCGGGTC | 19037 |
| BaH50C16 | TCTCTGCTCACAAGCTTCATA<br>TCTCTGCTCATAAGCTTCATA | 19038 |
| BaH50C16 | CGGTACGCCCGAATTTCCTGG<br>CGGTACGCCCTAATTTCCTGG | 19039 |
| baak43e04 | AAGCTCCTGACGGCGACGCAG<br>AAGCTCCTGATGGCGACGCAG | 19041 |
| kr17g1113 | TTGTAGCTACCGCCTGCGTGT<br>TTGTAGCTACGGCCTGCGTGT | 19042 |
| bags19k19 | TTCCATTGTCAGAACATAAGC<br>TTCCATTGTCGGAACATAAGC | 19043 |
| baak38b13 | GCAGCTTCAGCAGCTCCTCTC<br>GCAGCTTCAGGAGCTCCTCTC | 19044 |
| baak38b13 | TCAAGAAGGATTATACGTTTA<br>TCAAGAAGGAGTATACGTTTA | 19045 |
| baak1d12 | ATTATCAAACGGAATAGTCCC<br>ATTATCAAACAGAATAGTCCC | 19046 |
| baak1d12 | ATTTGGCATGTCTCAGAAATT<br>ATTTGGCATGCCTCAGAAATT | 19047 |
| baak1d12 | TGCATTCTCTCGTTCGACAGG<br>TGCATTCTCTTGTTCGACAGG | 19048 |
| bah28m14 | AGTCCCACTCGCTGAGCAGAT<br>AGTCCCACTCACTGAGCAGAT | 19049 |
| bah48i15 | TAATAATATAGTTAAGCGCAA<br>TAATAATATAATTAAGCGCAA | 19050 |

TABLE 24-7

| Clones | Haruna Nijo / H602 | SEQ ID NO: |
|---|---|---|
| basd27h23 | AGCTCACTCCTTTTGAGCCAC<br>AGCTCACTCCGTTTGAGCCAC | 19051 |
| baak21a11 | AGCAATAAAAGACGTATTGGC<br>AGCAATAAAAAACGTATTGGC | 19052 |
| bast04b0804 | TTGCTATGTCCGGCCGATGCT<br>TTGCTATGTCGGGCCGATGCT | 19053 |
| bah45f13 | TGCGATTTTATATAACGAAAT<br>TGCGATTTTACATAACGAAAT | 19054 |
| BaAL8J18 | TAATAATATAATTAAGCGCAA<br>TAATAATATAGTTAAGCGCAA | 19055 |
| BaGS9D01 | CATGTAAAAGTGACCTCCTG<br>CATGTAAAAACTGACCTCCTG | 19056 |
| baal4i06 | CTTGCTCTTTCTTCTTATCT<br>CTTGCTCTTTCCTTCTTATCT | 19058 |
| baal4i06 | TGAGCTACGAAGGATATTATA<br>TGAGCTACGAGGGATATTATA | 19059 |
| baal4i06 | CCATCTGCGTGTTCGTGCATC<br>CCATCTGCGTTTTCGTGCATC | 19060 |
| bah26i01 | CTGTAAAGAAGATCAAACAG<br>CTGTAAAGAGGATCAAACAG | 19061 |
| bah26i01 | CATCATCCTTCGCTCGAGGAA<br>CATCATCCTTTGCTCGAGGAA | 19062 |
| bah26i01 | CCTCTTCATTCGACAATACAT<br>CCTCTTCATTTGACAATACAT | 19063 |
| bah26i01 | TACGTTGGGCGGATGACAAGT<br>TACGTTGGGCAGATGACAAGT | 19064 |
| bags15c17 | GCTGCAACACAAATGGAAAG<br>GCTGCAACACCAATGGAAAG | 19065 |
| baak1k08 | CCGTGGCTTCGCTGTCAAACG<br>CCGTGGCTTCACTGTCAAACG | 19066 |
| bags9b03 | ACTCCTCAAGCTCGACGATTA<br>ACTCCTCAAGTTCGACGATTA | 19067 |
| bags9b03 | TAATTATGACCAGAGAGACAA<br>TAATTATGACGAGAGAGACAA | 19068 |
| baet42G1214 | AGCACCTGCGGGGAGTAAGTG<br>AGCACCTGCGAGGAGTAAGTG | 19069 |
| bags22b22 | GCATTCATGCCGCTCATCTTT<br>GCATTCATGCGGCTCATCTTT | 19071 |
| bags22b22 | GACAAACTAGTCATCAAATGC<br>GACAAACTAGCCATCAAATGC | 19072 |
| bags22b22 | GATGGACACTCGGTAGCAAAA<br>GATGGACACTTGGTAGCAAAA | 19073 |
| baal36g05 | ACCACCCAGATTATATAATCC<br>ACCACCCAGAATATATAATCC | 19074 |
| baal36g05 | ACTAGCACTAGCACTAGCACT<br>ACTAGCACTATCACTAGCACT | 19075 |
| baal36g05 | GATGTATCTACACACGTTTTA<br>GATGTATCTAGACACGTTTTA | 19076 |
| baal36g05 | TCATGTACGCGAAGAAAACAG<br>TCATGTACGCAAAGAAAACAG | 19077 |

TABLE 24-8

| Clones | Haruna Nijo H602 | SEQ ID NO: |
|---|---|---|
| bags33j15 | AAAGCAATGTCCGGTTAAGTT<br>AAAGCAATGTGTGGTTAAGTT | 19078 |
| bags33j15 | CTTGTGGATTCAAGTACATGA<br>CTTGTGGATTGAAGTACATGA | 19079 |
| bags33j15 | GGGTTCTGGTTGACATACAAA<br>GGGTTCTGGTGGACATACAAA | 19080 |
| bast61d0707 | TCGAACGCGGCAGGCAACGGC<br>TCGAACGCGGAAGGCAACGGC | 19082 |
| basd23a04 | GATGATAACTTCATTTGCGCA<br>GATGATAACTCCATTTGCGCA | 19087 |
| basd14c15 | CACTTACAAAAGACTTCATCA<br>CACTTACAAAGGACTTCATCA | 19088 |
| basd14c15 | TGTTAACACTCACGACCAGGA<br>TGTTAACACTTACGACCAGGA | 19089 |
| bast63c0105 | ACTCTACGGAACGGTCGACCT<br>ACTCTACGGAGCGGTCGACCT | 19090 |
| bast23c1105 | ATGTTTATAACATGATACAGG<br>ATGTTTATAATATGATACAGG | 19091 |
| bast23c1105 | ACGAGTGTTCTAACGAGTGGT<br>ACGAGTGTTCCAACGAGTGGT | 19092 |
| BaAL19H10 | TCTGGTACAAATCCTTCAACC<br>TCTGGTACAAGTCCTTCAACC | 19101 |
| BaAL19H10 | GTTAAATAAAACCTCAAAATT<br>GTTAAATAAAGCCTCAAAATT | 19102 |
| BaSD24B15 | ACATACAAGAAGCAATAAAAA<br>ACATACAAGAGGCAATAAAAA | 19104 |
| BaSD24B15 | GTAATCAACTAATTCCTTTGG<br>GTAATCAACTGATTCCTTTGG | 19105 |
| bah48n17 | GAAAACAGGAACCAAAGGACG<br>GAAAACAGGAGCCAAAGGACG | 19106 |
| bah48n17 | CAACATTCCGTTTCGAAAGAA<br>CAACATTCCGCTTCGAAAGAA | 19107 |
| bags9i05 | GCCAACTTGTCGTCGATGTAG<br>GCCAACTTGTTGTCGATGTAG | 19108 |
| bags9i05 | TCTCTTTTCTGAGCTTCAGAT<br>TCTCTTTTCTAAGCTTCAGAT | 19109 |
| bags1l22 | GTGTAGCACAAATACAGTTAG<br>GTGTAGCACATATACAGTTAG | 19110 |
| bags1l22 | TACTGGGCTCACACTGATGAG<br>TACTGGGCTCCCACTGATGAG | 19111 |
| bags1l22 | AGAAAGTGCTTTACTGGGCTC<br>AGAAAGTGCTGTACTGGGCTC | 19112 |
| bags1l22 | ACTGCATGGCAAATAATGCAG<br>ACTGCATGGCGAATAATGCAG | 19113 |
| bags1l22 | TACTGCCGTAAAGTATATTTA<br>TACTGCCGTACAGTATATTTA | 19114 |
| bah62p18 | CCGATAGGCCACACTTGTCAA<br>CCGATAGGCCTCACTTGTCAA | 19115 |
| bah62p18 | CAGAATTCTGCTCCTTAGTGC<br>CAGAATTCTGTTCCTTAGTGC | 19116 |

TABLE 24-9

| Clones | Haruna Nijo H602 | SEQ ID NO: |
|---|---|---|
| bah62p18 | CAGGAGAATACGGAAGTCAGA<br>CAGGAGAATATGGAAGTCAGA | 19117 |
| bah55n21 | TCGAGGTTTCCACTTTCTAGA<br>TCGAGGTTTCGACTTTCTAGA | 19118 |
| bah55n21 | ATCATGTACAAATATGTCAGG<br>ATCATGTACAGATATGTCAGG | 19119 |
| bah44a05 | GTGGACTGTGTAACCCAGTTA<br>GTGGACTGTGCAACCCAGTTA | 19120 |
| bah19c13 | AATGGTAGTGGTTTGGGAAAA<br>AATGGTAGTGCTTTGGGAAAA | 19121 |
| bah19c13 | TGTGCTTCAACTTCCTCGTCA<br>TGTGCTTCAATTTCCTCGTCA | 19122 |
| bah19c13 | GATCATCATAAGCAACAGGCA<br>GATCATCATACGCAACAGGCA | 19123 |
| kr28B0703 | ATATTGCAGCAGTCATTTACT<br>ATATTGCAGCGGTCATTTACT | 19125 |
| kr28B0703 | GACCTACCAAGGTTTGCTAAA<br>GACCTACCAACGTTTGCTAAA | 19126 |
| kr28B0703 | CTTGTATATAGTGACCTACCA<br>CTTGTATATAATGACCTACCA | 19127 |
| kr28B0703 | TACTCCCTTCCAGTTCAGTTT<br>TACTCCCTTCTAGTTCAGTTT | 19128 |
| bast150C0606 | CTTGCAATTAGTAAATGAATG<br>CTTGCAATTAATAAATGAATG | 19129 |
| bast150C0606 | AATTTCTGAACGATTCACCTG<br>AATTTCTGAATGATTCACCTG | 19130 |
| bah19a05 | CAAGAGAAAGGATCATGTGG<br>CAAGAGAAAAGATCATGTGG | 19132 |
| baal10c06 | ATCCGTAGCC-CAAGGATCCT<br>ATCCGTAGCCACAAGGATCCT | 19133<br>19134 |
| bags19p04 | GCATCCCACAGCCGAAGAAGT<br>GCATCCCACAACCGAAGAAGT | 19135 |
| baak21a17 | TTTTTAACACAATTTTTAACA<br>TTTTTAACACGATTTTTAACA | 19136 |
| bah20j14 | GATTTAAACACCTCATTTCGT<br>GATTTAAACAGCTCATTTCGT | 19137 |
| bah20j14 | CATAGCACTCCGATTTCCTTC<br>CATAGCACTCGGATTTCCTTC | 19138 |
| baak19a03 | AGCTTTAGGGTAAATACATAT<br>AGCTTTAGGGAAAATACATAT | 19139 |
| baak19a03 | ATTTCCCGTGCTGTCTGAAAC<br>ATTTCCCGTGATGTCTGAAAC | 19140 |
| baak19a03 | TAACATACAACACCAGAGAAA<br>TAACATACAAAACCAGAGAAA | 19141 |
| bags30e19 | CGATTTCTGTATACCTTCTTC<br>CGATTTCTGTGTACCTTCTTC | 19142 |
| bags11o14 | GAACCAGATACCATGGTGTAT<br>GAACCAGATATCATGGTGTAT | 19143 |
| bags13p22 | TACAGGCAAGTGAACCACCTC<br>TACAGGCAAGCGAACCACCTC | 19144 |

TABLE 24-10

| Clones | Haruna Nijo / H602 | SEQ ID NO: |
|---|---|---|
| bags13p22 | ATCAGCTAGATTTGGCATACA<br>ATCAGCTAGAGTTGGCATACA | 19145 |
| kr27A1101 | ACGCCTACTCACCGCGCCCG<br>ACGCCTACTCCCCGCGCCCG | 19146 |
| kr27A1101 | ACCCCTCCGCCTCCCGATCTC<br>ACCCCTCCGCGTCCCGATCTC | 19147 |
| kr27A1101 | CCTAGAGGAGGGAAGGCAAGA<br>CCTAGAGGAGAGAAGGCAAGA | 19148 |
| kr27A1101 | CCCTCGCCTATAACCCCTCCG<br>CCCTCGCCTAGAACCCCTCCG | 19149 |
| bast58f0412 | CGGGGCCGCAGATATACATTG<br>CGGGGCCGCAAATATACATTG | 19152 |
| bast58f0412 | AATGAACCCATAAAGGAGATT<br>AATGAACCCAGAAAGGAGATT | 19153 |
| bast58f0412 | ACAGGGAACGACTATAAAAGC<br>ACAGGGAACGGCTATAAAAGC | 19154 |
| bast58f0412 | CCTAACAGTATAAATGCTATG<br>CCTAACAGTAGAAATGCTATG | 19155 |
| bast58f0412 | TACTACTAACGCGTTACTGGG<br>TACTACTAACACGTTACTGGG | 19156 |
| baal32p23 | CTCCCTCTGTAAAACTTTCAG<br>CTCCCTCTGTGAAACTTTCAG | 19159 |
| baal32p23 | GACATAACCACTATTAGTTGC<br>GACATAACCATTATTAGTTGC | 19160 |
| baal32p23 | CAGAGCTCCTCTGAAGTTTCG<br>CAGAGCTCCTATGAAGTTTCG | 19161 |
| basd23m17 | CTGCATTAAAAAATTGAGTGT<br>CTGCATTAAACAATTGAGTGT | 19162 |
| basd23m17 | CATTCGGAACATACCAACCAC<br>CATTCGGAACGTACCAACCAC | 19163 |
| bastl30E0509 | ACCTGGAATATAAAAACATCG<br>ACCTGGAATACAAAAACATCG | 19164 |
| bastl30E0509 | TCGCTTCAGAAAGCATCATTA<br>TCGCTTCAGACAGCATCATTA | 19165 |
| bah44b08 | AGGCCGGGCCGGGCCGGAGAT<br>AGGCCGGGCCAGGCCGGAGAT | 19166 |
| bah44b08 | CAAAAATCACGGAACAGCAAG<br>CAAAAATCACAGAACAGCAAG | 19167 |
| BaGS14N10 | GCCTGGGCCAGCGGACGATGA<br>GCCTGGGCCAACGGACGATGA | 19168 |
| BaGS14N10 | CAGCAGGTGACTTCGGGGACT<br>CAGCAGGTGATTTCGGGGACT | 19169 |
| BaGS14N10 | GGCCACATTACTCTTGGTGGC<br>GGCCACATTATTCTTGGTGGC | 19170 |
| BaGS32B13 | ATTTGCTCCATATGTAGACT<br>ATTTGCTCCGTATGTAGACT | 19171 |
| BaGS32B13 | ATAAGTCATTTGCGTAGTTTT<br>ATAAGTCATTCGCGTAGTTTT | 19172 |
| BaGS32B13 | AGAGAAAATACGGGACGGCAG<br>AGAGAAAATATGGGACGGCAG | 19173 |

TABLE 24-11

| Clones | Haruna Nijo / H602 | SEQ ID NO: |
|---|---|---|
| BaH30B03 | TCAAGCCTGAAAATACGACAA<br>TCAAGCCTGACAATACGACAA | 19174 |
| BaH30B03 | TTCACATGTTTGCTTTCCTCT<br>TTCACATGTTCGCTTTCCTCT | 19175 |
| BaH30B03 | GGCCATAAGATATTTCACACC<br>GGCCATAAGAAATTTCACACC | 19176 |
| basd11o06 | GTAGCACTGACATGGAAGTTC<br>GTAGCACTGAAATGGAAGTTC | 19178 |
| basd11o06 | TCTGCATACTTTCGATTTGGT<br>TCTGCATACTGTCGATTTGGT | 19179 |
| basd11o06 | ATAAAGAGGAAATGGTTAGGC<br>ATAAAGAGGAGATGGTTAGGC | 19180 |
| basd11o06 | GAACGCTCACGAGGACTGAAC<br>GAACGCTCACAAGGACTGAAC | 19181 |
| basd11o06 | CTCTAGGTGAAAACGTGACTA<br>CTCTAGGTGAGAACGTGACTA | 19182 |
| bah17f24 | GATCTGTTACATCTACAGCAT<br>GATCTGTTACGTCTACAGCAT | 19183 |
| bah17f24 | TAACAATCCTCATATTGTGGA<br>TAACAATCCTTATATTGTGGA | 19184 |
| bah17f24 | AAATACAACAGCATATGAAAA<br>AAATACAACAACATATGAAAA | 19185 |
| bah17f24 | AAGCCACGCACATAGATCTGT<br>AAGCCACGCAAATAGATCTGT | 19186 |
| bah17f24 | CTTACAAAATGTAGACAAGCA<br>CTTACAAAATTTAGACAAGCA | 19187 |
| BaAK26L17 | TCGATCCGGTTCCAAAGAGCT<br>TCGATCCGGTCCCAAAGAGCT | 19188 |
| BaAK26L17 | GACATGACACTAGGTCCAGCA<br>GACATGACACCAGGTCCAGCA | 19189 |
| BaAK26L17 | CTCCATCAGCGAGGAACTTCA<br>CTCCATCAGCAAGGAACTTCA | 19190 |
| bags23f03 | CAGCTATAGTCATGGAAATAA<br>CAGCTATAGTTATGGAAATAA | 19191 |
| bags20o06 | TTTTCTCCTGTACTCTAGCTG<br>TTTTCTCCTGCACTCTAGCTG | 19192 |
| bags20o06 | GTGCCGGACATCGCTGTTGTT<br>GTGCCGGACACCGCTGTTGTT | 19193 |
| bags19n12 | GAAGGCTAGCGTGAAGTTGCA<br>GAAGGCTAGCATGAAGTTGCA | 19194 |
| bast14f0612 | ATATAGTTTCCCAGCATACTA<br>ATATAGTTTCACAGCATACTA | 19195 |
| bags16k13 | CTTTCACAGTTTTGATTTGAG<br>CTTTCACAGTCTTGATTTGAG | 19197 |
| bags16k13 | TGAATCGATGAGTAGTGACTA<br>TGAATCGATGGGTAGTGACTA | 19198 |
| baak22c16 | GCTCCCTGCAGTCCATATTAA<br>GCTCCCTGCAATCCATATTAA | 19199 |
| baak22c16 | CATTGCAATCATAGCAAAAAG<br>CATTGCAATCGTAGCAAAAAG | 19200 |

TABLE 24-12

| Clones | Haruna Nijo / H602 | SEQ ID NO: |
|---|---|---|
| baak22c16 | TGAAGACATAATAATCAGCAG<br>TGAAGACATAGTAATCAGCAG | 19201 |
| baak22c16 | CAGGGCTTGTTAATAGTTTTA<br>CAGGGCTTGTGAATAGTTTTA | 19202 |
| baak22c16 | ATCTCACTGAAAACAGAGCAT<br>ATCTCACTGAGAACAGAGCAT | 19203 |
| baak22c16 | GGGAACATGTTCATGCTTCGG<br>GGGAACATGTACATGCTTCGG | 19204 |
| baak22c16 | TCCGCAGGGCCTGTCTCCCAG<br>TCCGCAGGGC-TGTCTCCCAG | 19205<br>19206 |
| baak22c16 | TGCATCACAGCACGATCAACA<br>TGCATCACAG-ACGATCAACA | 19207<br>19208 |
| baal40m06 | GAATCGTCCTCTTTTGCTGCC<br>GAATCGTCCTATTTTGCTGCC | 19209 |
| baal40m06 | CCTTTCCTGTCGCCTCCCTTG<br>CCTTTCCTGTTGCCTCCCTTG | 19210 |
| bah57a11 | ACATCAAAGGATCACTATAAT<br>ACATCAAAGGGTCACTATAAT | 19213 |
| bah57a11 | TGAAACTGGTGAGGAGATATA<br>TGAAACTGGTAAGGAGATATA | 19214 |
| bah41e23 | AAACTACCAAGGTTGTATCCA<br>AAACTACCAAAGTTGTATCCA | 19215 |
| bah41e23 | TGATACAAAAAATGTTTGCAT<br>TGATACAAAAGATGTTTGCAT | 19216 |
| bah41e23 | CCTGGTATTTTGCTATCAGAA<br>CCTGGTATTTCGCTATCAGAA | 19217 |
| BaSD14L18 | ACATATGAGTTAGTCCGATGA<br>ACATATGAGTAAGTCCGATGA | 19218 |
| BaSD14L18 | TTGTCACTCATGAAATACTCA<br>TTGTCACTCAAGAAATACTCA | 19219 |
| BaSD14L18 | CTCAGCTTCAGTATTTCTGAA<br>CTCAGCTTCACTATTTCTGAA | 19220 |
| BaSD14L18 | TTTTACGTTTTCCTCAGCTTC<br>TTTTACGTTTCCCTCAGCTTC | 19221 |
| BaSD14L18 | GCCCAGCAGTGTTCTCCTGAA<br>GCCCAGCAGTATTCTCCTGAA | 19222 |
| bah14d17 | CCACCCCTCTTCCATCTCCTT<br>CCACCCCTCTACCATCTCCTT | 19223 |
| bah14d17 | CCATGTCGACGTCGGCCGGCT<br>CCATGTCGACATCGGCCGGCT | 19224 |
| bah14d17 | CGGCAGCTCGCGGTACCGCTC<br>CGGCAGCTCGTGGTACCGCTC | 19225 |
| BaGS1N17 | ACACACACACGAAGAGAGAGA<br>ACACACACACAAAGAGAGAGA | 19226 |
| BaGS1N17 | CTTTGTCAGATGCAGCCACAG<br>CTTTGTCAGACGCAGCCACAG | 19227 |
| BaGS1N17 | AGAGCTCACATATCCATTTTC<br>AGAGCTCACAAATCCATTTTC | 19228 |
| bags27h17 | CAGCTCTGAA-GAACCTCGTN<br>CAGCTCTGAAAGAACCTCGTN | 19229<br>19230 |

TABLE 24-13

| Clones | Haruna Nijo / H602 | SEQ ID NO: |
|---|---|---|
| bah47p22 | GTATCGAATA-GTTAATTAAT<br>GAATCGAATAAGTTAATTAAT | 19231<br>19232 |
| bah47p22 | CCTGTATGTG-AAAATGAAAA<br>CCTGTATGTGTAAAATGAGAA | 19233<br>19234 |
| bah50a16 | GTTGTTTGGGCGTGCAGAGAA<br>GTTGTTTGGGGGTGCAGAGAA | 19235 |
| bags7b20 | TTAGAACTTAGGCATGCAATG<br>TTAGAACTTACGCATGCAATG | 19236 |
| bags7b20 | CCTGGTATTTCGCTATCAGAA<br>CCTGGTATTTTGCTATCAGAA | 19237 |
| bags7b20 | TTGTTTCAGAAAGACTTAGTA<br>TTGTTTCAGACAGACTTAGTA | 19238 |
| bags22a02 | TGTCTTAGTTGTACATTAATC<br>TGTCTTAGTTATACATTAATC | 19239 |
| bags22a02 | TATACAGAGAGGGTTTTACTA<br>TATACAGAGATGGTTTTACTA | 19240 |
| bags22a02 | ATCACACAAATCGTACATGAA<br>ATCACACAAACCGTACATGAA | 19241 |
| basd12g02 | GGATCAGCAGAGGCAAACAGA<br>GGATCAGCAGTGGCAAACAGA | 19242 |
| basd12g02 | CAATTAAGTGAAACTGCACCT<br>CAATTAAGTGGAACTGCACCT | 19243 |
| basd12g02 | GTGCCGAGTATGCCACTTGTA<br>GTGCCGAGTACGCCACTTGTA | 19244 |
| basd15o18 | AAACGCTTGTGGGCAACCGCC<br>AAACGCTTGTAGGCAACCGCC | 19245 |
| basd15o18 | TAGCGGAGCCACCGGAATCGT<br>TAGCGGAGCCGCCGGAATCGT | 19246 |
| baal25d19 | GTTCCTCGTTTGGTTTTGTCG<br>GTTCCTCGTTCGGTTTTGTCG | 19247 |
| bast52g0414 | AATCGTAATGCAGCACGGATG<br>AATCGTAATGAAGCACGGATG | 19248 |
| bags37k06 | CACATAGAAACTATCACGCCA<br>CACATAGAAATTATCACGCCA | 19250 |
| bags6e22 | ACCTGGAGACAACATAGATTA<br>ACCTGGAGACTACATAGATTA | 19251 |
| bags6e22 | AGATATCTAAAACCTGGAGAC<br>AGATATCTAACACCTGGAGAC | 19252 |
| bags6e22 | TTTCTCATTATCTGCAAAAAA<br>TTTCTCATTAGCTGCAAAAAA | 19253 |
| bags7b06 | ATATTTCTGGTTCATGGATTT<br>ATATTTCTGGGTCATGGATTT | 19255 |
| bags7b06 | GGTCGGGGCCTGGCTGGCTAT<br>GGTCGGGGCCGGGCTGGCTAT | 19256 |
| bags7b06 | TGGCTATCGAGCTCCGGCGAC<br>TGGCTATCGAACTCCGGCGAC | 19257 |
| bags7b06 | AGCATGTGCTAGAAATGCCGG<br>AGCATGTGCTTGAAATGCCGG | 19258 |
| bast46c0406 | CAGACGCCATAACCCATCTGA<br>CAGACGCCATGACCCATCTGA | 19261 |

TABLE 24-14

| Clones | Haruna Nijo H602 | SEQ ID NO: |
|---|---|---|
| bast46c0406 | TCAAGGTCAATAAGTTTCACA<br>TCAAGGTCAACAAGTTTCACA | 19262 |
| bast46c0406 | GAGGAATTGGTCAAACGCCAA<br>GAGGAATTGGACAAACGCCAA | 19263 |
| bast145e0509 | ACATAGAGGAGAGGATACACC<br>ACATAGAGGATAGGATACACC | 19264 |
| bast145e0509 | GGATTTACACGACCGATTTTG<br>GGATTTACACAACCGATTTTG | 19265 |
| BaH41G07 | CTTCTTCCCCCACATCTGCAT<br>CTTCTTCCCCTACATCTGCAT | 19267 |
| bast46H1016 | AATTCCACCCTAGAAAATCCA<br>AATTCCACCCCAGAAAATCCA | 19268 |
| bah60d12 | GAGCCCTCTGTCCTTGGTCCT<br>GAGCCCTCTGCCCTTGGTCCT | 19269 |
| bah60d12 | CCCTGAGTGCCTTGCCGCCCT<br>CCCTGAGTGCATTGCCGCCCT | 19270 |
| bah60d12 | TGCCGCCCTCAGACGCCATGA<br>TGCCGCCCTCGGACGCCATGA | 19271 |
| bah60d12 | CGGCAGCTGCAACCTTCGCCG<br>CGGCAGCTGCGACCTTCGCCG | 19272 |
| bah60d12 | CCGCGTACAGAGGCCAGCATA<br>CCGCGTACAGCGGCCAGCATA | 19273 |
| bah60d12 | CTTCATTGTATCCTCTCATCT<br>CTTCATTGTAGCCTCTCATCT | 19274 |
| bah60d12 | CCCTTAACCACCTCTTCATTG<br>CCCTTAACCAGCTCTTCATTG | 19275 |
| bah60d12 | TTCCACCTCCTCGCCCTTAAC<br>TTCCACCTCCACGCCCTTAAC | 19276 |
| bah60d12 | CCTTGAGCGCGTCGGCAGCTG<br>CCTTGAGCGCCTCGGCAGCTG | 19277 |
| baal39a19 | GTAGGGTCTCCTCTTGGGCAG<br>GTAGGGTCTCTTCTTGGGCAG | 19278 |
| baal39a19 | TGACGGGGATCGCGGGAGGCC<br>TGACGGGGATGGCGGGAGGCC | 19279 |
| baal39a19 | GACACTCTGACTCTCAACCGC<br>GACACTCTGAGTCTCAACCGC | 19280 |
| baal39a19 | TGCCGCTCCGAGCCATCATCA<br>TGCCGCTCCGCGCCATCATCA | 19281 |
| baal39a19 | TCATCAGGTTCGCGCAGGAGC<br>TCATCAGGTTTGCGCAGGAGC | 19282 |
| baal39a19 | ACCTCACCTCGGACATGCACG<br>ACCTCACCTCCGACATGCACG | 19283 |
| baal39a19 | GGGCAGGTCCGCCAGGCACCT<br>GGGCAGGTCCTCCAGGCACCT | 19284 |
| baal39a19 | TGCACGCGAACGACTGGGACT<br>TGCACGCGAAGGACTGGGACT | 19285 |
| bast14e0909 | GACACACAAAAATAATGGTAC<br>GACACACAAAGATAATGGTAC | 19287 |
| baet13g0713 | CGTCGCCGGCCGGCTTGATGC<br>CGTCGCCGGCTGGCTTGATGC | 19288 |

TABLE 24-15

| Clones | Haruna Nijo H602 | SEQ ID NO: |
|---|---|---|
| baak13c05 | GGAGGACGTGCAGATCATCCC<br>GGAGGACGTGGAGATCATCCC | 19289 |
| bast141g0513 | ACTTGCTCAGGGAGGAGTGGT<br>ACTTGCTCAGCGAGGAGTGGT | 19290 |
| baal19b12 | TAGTGCATCTTTTGCAATGGC<br>TAGTGCATCTCTTGCAATGGC | 19292 |
| baal19b12 | TTACATGATAGGGTCATTACC<br>TTACATGATAAGGTCATTACC | 19293 |
| baal19b12 | TAGAGTATCAGATGGAAATAT<br>TAGAGTATCAAATGGAAATAT | 19294 |
| baal19b12 | TTCATGAGTTTACAATTATTT<br>TTCATGAGTTCACAATTATTT | 19295 |
| baal19b12 | ATAGAATCCAGAGTGTCAACT<br>ATAGAATCCAAAGTGTCAACT | 19296 |
| baal19b12 | TGGAAATATTGTAAATGACGA<br>TGGAAATATTATAAATGACGA | 19297 |
| baal19b12 | TGACGAAATAGAGTACACAGC<br>TGACGAAATAAAGTACACAGC | 19298 |
| baal39b05 | CCTGGTCACCTCCACCCTGCG<br>CCTGGTCACCGCCACCCTGCG | 19299 |
| baal1j03 | CAACCTACGCTGTGGCTATCA<br>CAACCTACGCCGTGGCTATCA | 19300 |
| BaGS33N15 | TAAAGAAGGGAAAAATTAACG<br>TAAAGAAGGGGAAAATTAACG | 19301 |
| basd11k09 | CCTGGTCACCTCCACCCTGCG<br>CCTGGTCACCGCCACCCTGCG | 19302 |
| basd11k09 | GACGGCCTTAACTTCTTCACC<br>GACGGCCTTACCTTCTTCACC | 19303 |
| baet43H0416 | GAACTAGCCACAGGTTGCACT<br>GAACTAGCCATAGGTTGCACT | 19304 |
| bah11m06 | CAGATAGTACCTCGATCCTCT<br>CAGATAGTACTTCGATCCTCT | 19305 |
| bah11m06 | GAATAAGGAACGTTCTTAGAA<br>GAATAAGGAATGTTCTTAGAA | 19306 |
| bags27h20 | ATTAGCATCGTTTTAGACAAG<br>ATTAGCATCGGTTTAGACAAG | 19310 |
| basd27c09 | GAACTAGCCACAGGTTGCACT<br>GAACTAGCCATAGGTTGCACT | 19311 |
| basd27c09 | TCAACACTTTTGTATAGAAGG<br>TCAACACTTTGGTATAGAAGG | 19312 |
| basd27c09 | TCTCCAGGTGGTTCTGCATGA<br>TCTCCAGGTGTTTCTGCATGA | 19313 |
| baal25o01 | TTAACATAATTAGAGGATTGA<br>TTAACATAATCAGAGGATTGA | 19315 |
| baal25o01 | AAACAACTAGGTAGTGAAAAC<br>AAACAACTAGATAGTGAAAAC | 19316 |
| baal25o01 | TTATCACTGCCCCAGATCCTT<br>TTATCACTGCACCAGATCCTT | 19317 |
| BaAK19J09 | GGGCTTTGTTCTCCACTCAGG<br>GGGCTTTGTTTTCCACTCAGG | 19319 |

TABLE 24-16

| Clones | Haruna Nijo H602 | SEQ ID NO: |
|---|---|---|
| BaAK19J09 | CCATTTTGACGTATGTTTGTG<br>CCATTTTGACATATGTTTGTG | 19320 |
| bags20n14 | CCGTCATGACGGATATACAGG<br>CCGTCATGACAGATATACAGG | 19321 |
| baak31k16 | AGAATTGAGCAGCGACTCTAA<br>AGAATTGAGCGGCGACTCTAA | 19322 |
| baak31k16 | CCATCCCCACCGTTTCTTTCA<br>CCATCCCCACTGTTTCTTTCA | 19323 |
| baak31k16 | CGTAGTAGGCGTGCGTCCGGT<br>CGTAGTAGGCNTGCGTCCGGT | 19324 |
| bah42o12 | TAGCGTGAGTTATGAAGTTAT<br>TAGCGTGAGTGATGAAGTTAT | 19325 |
| bags4p14 | TGATAGTTCATATACAAAACA<br>TGATAGTTCAGATACAAAACA | 19326 |
| bags4p14 | CCTGTGTGCAACCCAAAAACA<br>CCTGTGTGCAGCCCAAAAACA | 19327 |
| bags4p14 | ATAAAATTTGAACTAACGTAG<br>ATAAAATTTGTACTAACGTAG | 19328 |
| bags4p14 | GCTAGAGAAGCCAACAAGTAG<br>GCTAGAGAAGTCAACAAGTAG | 19329 |
| BaH62B09 | AATCCCTTGCCCAAGGCTTGA<br>AATCCCTTGCTCAAGGCTTGA | 19331 |
| BaH62B09 | ATATGTAGAAAGAGCATGACA<br>ATATGTAGAAGGAGCATGACA | 19332 |
| BaH62B09 | GAAATCCAAAGCCCTAGCCCA<br>GAAATCCAAAACCCTAGCCCA | 19333 |
| bags19j10 | CCTTCCTGCTGGGGTCTTCAT<br>CCTTCCTGCTCGGGTCTTCAT | 19334 |
| bags15k18 | CAAACCAGCAGTGGGAAGCGA<br>CAAACCAGCAATGGGAAGCGA | 19336 |
| bags15k18 | GTTGACAAACAGTATAGCGTG<br>GTTGACAAACGGTATAGCGTG | 19337 |
| bags15k18 | AACACACTGTGCGCTGAATAC<br>AACACACTGTACGCTGAATAC | 19338 |
| bags15k18 | TCCCTATAATCAGTATGAAAC<br>TCCCTATAATGAGTATGAAAC | 19339 |
| basd26c09 | ACTCCAAGAGCGTCCGCCTTC<br>ACTCCAAGAGTGTCCGCCTTC | 19342 |
| basd26c09 | ATGGAAAAGAGCAATGTCGAC<br>ATGGAAAAGAACAATGTCGAC | 19343 |
| basd26c09 | CCATGTGGCTCACCATGGAAA<br>CCATGTGGCTTACCATGGAAA | 19344 |
| basd20b11 | TCCGGACGGAAGGAGTACTAC<br>TCCGGACGGAGGGAGTACTAC | 19345 |
| basd20b11 | CCTAGAAATGAATGTATCTAG<br>CCTAGAAATGGATGTATCTAG | 19346 |
| BaH46F11 | CATTTTCTATCTGAAATCTTG<br>CATTTTCTATTTGAAATCTTG | 19347 |
| BaH46F11 | AAACACACACACGCAACCCAA<br>AAACACACACCCGCAACCCAA | 19348 |

TABLE 24-17

| Clones | Haruna Nijo H602 | SEQ ID NO: |
|---|---|---|
| BaH46F11 | ACTTCAGGAATACCGAGTTCT<br>ACTTCAGGAACACCGAGTTCT | 19349 |
| bah30f03 | GGTTGTAAACGTCATGTGTCT<br>GGTTGTAAACATCATGTGTCT | 19351 |
| baak33i12 | ATAAAGTTCTGGAAACAATGG<br>ATAAAGTTCTTGAAACAATGG | 19354 |
| bags37a16 | TTCCTGGCCGCCGGCGCCCTC<br>TTCCTGGCCGGCGGCGCCCTC | 19356 |
| bags37a16 | TGGCGATGCCGCTGCCGCGCT<br>TGGCGATGCCCCTGCCGCGCT | 19357 |
| bags39p06 | TCGGCCCATTCCCGCAGGGCC<br>TCGGCCCATTTCCGCAGGGCC | 19358 |
| baal12n06 | TCAGCAGTTTCCATCCCTCAC<br>TCAGCAGTTTTCATCCCTCAC | 19359 |
| bags9a03 | GGCAATCTCAAGGACGAGAGG<br>GGCAATCTCAGGGACGAGAGG | 19360 |
| bags9a03 | AGGGTCGTCCCGGTTAGGGTC<br>AGGGTCGTCCGGGTTAGGGTC | 19361 |
| bags9a03 | GCAGCGAGCACATTGAAAGCA<br>GCAGCGAGCAGATTGAAAGCA | 19362 |
| bags9a03 | CATACTTCTGGGTCCAGCTGC<br>CATACTTCTGCGTCCAGCTGC | 19363 |
| bags9a03 | TGCGGGCTGTTGTCTCGTACT<br>TGCGGGCTGTCGTCTCGTACT | 19364 |
| baet24F1212 | GTTTCCACAATGCAAGGCTAC<br>GTTTCCACAACGCAAGGCTAC | 19365 |
| baak29d10 | AGCATTGTCAGTTCTTGGACG<br>AGCATTGTCAATTCTTGGACG | 19366 |
| bags13i12 | CCGTGGAAGCTTGTCGGGTCC<br>CCGTGGAAGCCTGTCGGGTCC | 19367 |
| baal16a23 | CCTGGAAGCCGTGGAGGTTCA<br>CCTGGAAGCCATGGAGGTTCA | 19368 |
| baal16a23 | CAGGCTGAAGCGTGTGCGAGG<br>CAGGCTGAAGTGTGTGCGAGG | 19369 |
| bastl29F0711 | GGCCCAGAGAGGAAGATTTCA<br>GGCCCAGAGAAGAAGATTTCA | 19370 |
| bastl29F0711 | GCTTGGCCGCCTCTCCCCTGC<br>GCTTGGCCGCGTCTCCCCTGC | 19371 |
| bastl29F0711 | CTCTTCAGCAGGCTCTGCAGC<br>CTCTTCAGCAAGCTCTGCAGC | 19372 |
| bastl29F0711 | CGTACAGTAGCCATACTGTGA<br>CGTACAGTAGTCATACTGTGA | 19373 |
| bastl16b1204 | TTTTGGACGACCAGATTTGTG<br>TTTTGGACGAGCAGATTTGTG | 19374 |
| baal15e10 | GATTCATGACGAAATTCCTTC<br>GATTCATGACAAAATTCCTTC | 19376 |
| baal33m18 | CACCATCAGACGTGCTGCCTG<br>CACCATCAGATGTGCTGCCTG | 19378 |
| baak24e23 | TAATGTCAGAAATCATGAGAA<br>TAATGTCAGACATCATGAGAA | 19379 |

TABLE 24-18

| Clones | Haruna Nijo H602 | SEQ ID NO: |
|---|---|---|
| baak24e23 | CCACACTGCTCAAGGGACTCC CCACACTGCTAAAGGGACTCC | 19380 |
| baak24e23 | AAAAATGTTCGCAAGGATGTT AAAAATGTTCTCAAGGATGTT | 19381 |
| baak24e23 | CAGAAACAAGTCATTATGGTC CAGAAACAAGACATTATGGTC | 19382 |
| baak24e23 | ATTTGCAATAGTTAGTATATC ATTTGCAATAATTAGTATATC | 19383 |
| baak24e23 | ACACGCTACTCATAGTCGACA ACACGCTACTTATAGTCGACA | 19384 |
| baak24e23 | AACTCCCACAGGTATAAATGA AACTCCCACATGTATAAATGA | 19385 |
| baak24e23 | TGATGGTCAGTGGATAATAAT TGATGGTCAGCGGATAATAAT | 19386 |
| baak46j13 | TCATACACATAGTCGCACAAA TCATACACATGGTCGCACAAA | 19387 |
| baak46j13 | CGAGGAGGGTAAAGAGGATGA CGAGGAGGGTGAAGAGGATGA | 19388 |
| bah49o05 | GTTCATTGATAGTGTAAAATT GTTCATTGATCGTGTAAAATT | 19389 |
| bah49o05 | CAAGGTGCGGTGGACATCAGC CAAGGTGCGGAGGACATCAGC | 19390 |
| bah49o05 | CTGTCTGCCGCCGGACATGAA CTGTCTGCCGTCGGACATGAA | 19391 |
| bah49o05 | GACCATCAGAAATGGAGTGTT GACCATCAGATATGGAGTGTT | 19392 |
| baal15e05 | TGTTATCGTCGCCCTCGTATG TGTTATCGTCCCCCTCGTATG | 19393 |
| BaGS30P02 | CCTCGCTCTCAAACTGCACGA CCTCGCTCTCGAACTGCACGA | 19394 |
| BaGS30P02 | GATCCCTCGAGCTTGCTCGCA GATCCCTCGATCTTGCTCGCA | 19395 |
| baak1o08 | CCTAACCACAGAAATAAATAA CCTAACCACACAAATAAATAA | 19396 |
| BaSD15D05 | TTTTTGACCCTGCACTCTCCT TTTTTGACCCCGCACTCTCCT | 19397 |
| bags38n23 | ACGCAAATGCTATCGCCAATT ACGCAAATGCCATCGCCAATT | 19399 |
| bags38n23 | ACTGATGCACCTGACCCTTAA ACTGATGCACTTGACCCTTAA | 19400 |
| bags38n23 | AATCTCTCGACCAGTGACCTG AATCTCTCGAGCAGTGACCTG | 19401 |
| bags38n23 | GCCTTGGATGGGATTTATCTC GCCTTGGATGAGATTTATCTC | 19402 |
| bags38n23 | AGGAACTCCTCCAGGTAAGCT AGGAACTCCTTCAGGTAAGCT | 19403 |
| baak36a14 | CTATGAATCACGCTCATAACA CTATGAATCATGCTCATAACA | 19404 |
| baak36a14 | TCCTAATAGCGGCAGCAACAA TCCTAATAGCAGCAGCAACAA | 19405 |

TABLE 24-19

| Clones | Haruna Nijo H602 | SEQ ID NO: |
|---|---|---|
| bags35n24 | GGTCGAGCGTGATGCGATGCA GGTCGAGCGTCATGCGATGCA | 19410 |
| bags35n24 | GCCATGAGAAGGAGCTCGAGG GCCATGAGAAAGAGCTCGAGG | 19411 |
| bah37j21 | AGTACTTGTCTTCACTCGCCT AGTACTTGTCCTCACTCGCCT | 19412 |
| bah31e13 | ATCATCAAATCGTTTACTATA ATCATCAAATTGTTTACTATA | 19413 |
| bah31e13 | TGAAGCACACGATGTGGCAGT TGAAGCACACAATGTGGCAGT | 19414 |
| bah31e13 | TCCGACTTATACAGCGGAAAG TCCGACTTATGCAGCGGAAAG | 19415 |
| bah31e13 | CTACACCGCCTTTTATTCTCT CTACACCGCCATTTATTCTCT | 19416 |
| baal30l05 | AATACCTATCCACTTGTTGTA AATACCTATCAACTTGTTGTA | 19417 |
| baal30l05 | TGTATAATGACACAATGCATG TGTATAATGAGACAATGCATG | 19418 |
| baal30l05 | TAGACCCAAGTGAGCCAAAAG TAGACCCAAGCGAGCCAAAAG | 19419 |
| baal30l05 | GATCGTATATAAAATAAAACA GATCGTATATCAAATAAAACA | 19420 |
| bags38o10 | CCAGTGCAGATGTCTCAAGGA CCAGTGCAGAGGTCTCAAGGA | 19421 |
| bags38o10 | CTTTCTCAGAAAATGCTTGGC CTTTCTCAGAGAATGCTTGGC | 19422 |
| bags38o10 | CGTTAATAGTGCTTTCCTTGC CGTTAATAGTCCTTTCCTTGC | 19423 |
| bast130A0701 | CTCCTCCCCTCTTTACACCTA CTCCTCCCCTTTTTACACCTA | 19425 |
| bah49l21 | AGCACTTCACCTTCTCCCGCG AGCACTTCACTTTCTCCCGCG | 19426 |
| bah49l21 | TGCACTAACTGTTCCTGTGAA TGCACTAACTATTCCTGTGAA | 19427 |
| bags19l03 | GACAACATAGTAAAATAGTAT GACAACATAGCAAAATAGTAT | 19428 |
| bags19l03 | AACAAAAAGGAAAATGAACT AACAAAAAGAAAAATGAACT | 19429 |
| bags19l03 | TAACCAAGTCATCTAGAACAA TAACCAAGTCGTCTAGAACAA | 19430 |
| baak44p03 | AGGAGGAGGAGGAAGAAGAAG AGGAGGAGGAAGAAGAAGAAG | 19431 |
| kr10h0216 | CCATAATCCTGCAAGAATTCC CCATAATCCTCCAAGAATTCC | 19433 |
| kr10h0216 | CGTCCCGGCGCCCCAGATCCA CGTCCCGGCGTCCCAGATCCA | 19434 |
| bah11i21 | ATGTACATATGGTTCGTGTAT ATGTACATATAGTTCGTGTAT | 19436 |
| bah11i21 | TTTTAGCCGTGAGAAAAGAAT TTTTAGCCGTAAGAAAAGAAT | 19437 |

TABLE 24-20

| Clones | Haruna Nijo H602 | SEQ ID NO: |
|---|---|---|
| bah11i21 | AATTTCATGTCTTCTTTCCCG<br>AATTTCATGTTTTCTTTCCCG | 19438 |
| baak20k23 | GGAATTTATGCGGCTGCGCTA<br>GGAATTTATGTGGCTGCGCTA | 19439 |
| baak20k23 | CATCCTGCAAGCAGTGTTGAC<br>CATCCTGCAAACAGTGTTGAC | 19440 |
| basd14n22 | ACGACTGAGATCTTGTGTACC<br>ACGACTGAGACCTTGTGTACC | 19443 |
| basd14n22 | ATTTGCAGCACACAGAGAGCA<br>ATTTGCAGCATACAGAGAGCA | 19444 |
| basd14n22 | ACAGAGTTCAGGGCCGATATC<br>ACAGAGTTCACGGCCGATATC | 19445 |
| basd14n22 | TATTAGATGTGCGGTTTGATG<br>TATTAGATGTTCGGTTTGATG | 19446 |
| basd14n22 | CGCGGCAGAATGGGCACGACT<br>CGCGGCAGAAAGGGCACGACT | 19447 |
| basd14n22 | TGTCGGGGACTATGAGGGGCA<br>TGTCGGGGACGATGAGGGGCA | 19448 |
| basd14n22 | TAGTAGACCAACAGGAGGTTG<br>TAGTAGACCAGCAGGAGGTTG | 19449 |
| basd14n22 | AAAGCCAGAGAAACAAATAAT<br>AAAGCCAGAGCAACAAATAAT | 19450 |
| baet44D0707 | CGCTTGCTGGTGGCAGCTTGC<br>CGCTTGCTGGCGGCAGCTTGC | 19451 |
| bah16p10 | CATTCATCAGGGAATGCACAG<br>CATTCATCAGCGAATGCACAG | 19452 |
| bah16p10 | TGTGTCACCCGCAACCTCCAG<br>TGTGTCACCCTCAACCTCCAG | 19453 |
| baak42j01 | CCAGCTGGACCCCAGTGCTTAG<br>CCAGCTGGACACAGTGCTTAG | 19455 |
| baak42j01 | ACAAATAGACACATGATTTAG<br>ACAAATAGACCCATGATTTAG | 19456 |
| BaAK38008 | TGGTGCTAAAGAAGTGTTTGC<br>TGGTGCTAAAAAAGTGTTTGC | 19457 |
| baal15f24 | ATAACTTTTAGCTGCTTTCAG<br>ATAACTTTTATCTGCTTTCAG | 19461 |
| baal15f24 | TCTCATATCTCTAGTCTCGAG<br>TCTCATATCTGTAGTCTCGAG | 19462 |
| baal15f24 | AACACCTGAAACCACTTTTCT<br>AACACCTGAAGCCACTTTTCT | 19463 |
| baal15f24 | AGGTGCTGATGGTGTTTTTG<br>AGGTGCTGATAGTGTTTTTG | 19464 |
| baal15f24 | CTCTTTTGCTTGAGCAATTAG<br>CTCTTTTGCTAGAGCAATTAG | 19465 |
| baal15f24 | TCTAACAACAAATAGATACGT<br>TCTAACAACATATAGATACGT | 19466 |
| baal15f24 | GATGAATTTAGATAAATGACA<br>GATGAATTTACATAAATGACA | 19467 |
| baal15f24 | GCAATTAGCTCTGCTTGCATC<br>GCAATTAGCTGTGCTTGCATC | 19468 |

TABLE 24-21

| Clones | Haruna Nijo H602 | SEQ. ID NO: |
|---|---|---|
| basd18b21 | TGGCATAGCATGTCAGAGGTC<br>TGGCATAGCAAGTCAGAGGTC | 19469 |
| basd18b21 | GGCGGATCATCGGTATGCATC<br>GGCGGATCATTGGTATGCATC | 19470 |
| basd18b21 | TCAGAGGTCAACCATAACACA<br>TCAGAGGTCATCCATAACACA | 19471 |
| basd17g23 | GCAGCTCATTGAGCTCCGTCT<br>GCAGCTCATTTAGCTCCGTCT | 19472 |
| basd17g23 | TGGTCTTCTTCCGCAGCTCAT<br>TGGTCTTCTTTCGCAGCTCAT | 19473 |
| basd17g23 | GCCTGGCGACGCAGACATGTC<br>GCCTGGCGACACAGACATGTC | 19474 |
| baak41k22 | TCATGTTAAACTCACGGTTCA<br>TCATGTTAAATTCACGGTTCA | 19475 |
| baak41k22 | GTTCAGGAAAAAGCACAAAGT<br>GTTCAGGAAATAGCACAAAGT | 19476 |
| baak41k22 | ATACACCAATTTGAACCTACT<br>ATACACCAATGTGAACCTACT | 19477 |
| BaSD16B18 | GGTGGAAACAGTTCACGGTTA<br>GGTGGAAACAATTCACGGTTA | 19478 |
| BaSD16B18 | GCTGATTTTACCATACATGAT<br>GCTGATTTTATCATACATGAT | 19479 |
| BaSD16B18 | TACATGATATCTGTGAAGTAC<br>TACATGATATGTGTGAAGTAC | 19480 |
| BaSD16B18 | CCATCTGATCTGCAGCACCCG<br>CCATCTGATCAGCAGCACCCG | 19481 |
| BaSD16B18 | TGCAGACTGGGCAGCTAAACT<br>TGCAGACTGGACAGCTAAACT | 19482 |
| BaSD16B18 | TGTGGCCACAGATGGTTGATG<br>TGTGGCCACATATGGTTGATG | 19483 |
| baak21o03 | CTTCAGTACTGAAGTTAAACA<br>CTTCAGTACTTAAGTTAAACA | 19484 |
| baak21o03 | GCATGCTGGACTACTACTACT<br>GCATGCTGGAATACTACTACT | 19485 |
| bast79C1105 | AGTCTGTTTTTATTCAGGTAG<br>AGTCTGTTTTCATTCAGGTAG | 19486 |
| BaAL37H08 | CGGAAATTACTTCCTGGATAC<br>CGGAAATTACCTCCTGGATAC | 19487 |
| baak4j17 | AGACCCCATCGGGGCCGCCA<br>AGACCCCATTGGGGCCGCCA | 19488 |
| baak4j17 | GCGACGCCGACCGGGAGTAGC<br>GCGACGCCGAGCGGGAGTAGC | 19489 |
| bags11i15 | TCACCAGACTCGCAAGCCTGT<br>TCACCAGACTTGCAAGCCTGT | 19491 |
| bags11i15 | GAGGGGTCGCCACATGGACAT<br>GAGGGGTCGCGACATGGACAT | 19492 |
| bags11i15 | ATGAGGGGTCACAACGTGGAC<br>ATGAGGGGTCGCAACGTGGAC | 19493 |
| baak35b18 | TATGCAAGTTTTTGGCTGAAA<br>TATGCAAGTTATTGGCTGAAA | 19495 |

TABLE 24-22

| Clones | Haruna Nijo H602 | SEQ ID NO: |
|---|---|---|
| baak35b18 | GCTGCTACCAAATCAGCTACT<br>GCTGCTACCAGATCAGCTACT | 19496 |
| baak35b18 | TGGTACTTAACGCCCCTGAGG<br>TGGTACTTAAAGCCCCTGAGG | 19497 |
| baak35b18 | GCTTTTACTGCCCTTCAGGCC<br>GCTTTTACTGTCCTTCAGGCC | 19498 |
| baak35b18 | CAGAGAAGTGAAAAAAAAAAG<br>CAGAGAAGTGGAAAAAAAAAG | 19499 |
| baak35b18 | ACTACAAAGCTTATGGTACTT<br>ACTACAAAGCATATGGTACTT | 19500 |
| baak41o03 | GCAGGTGACAAAACTGGCAGT<br>GCAGGTGACAGAACTGACAGT | 19501 |
| baak41o03 | GACAAAACTGGCAGTAACAAC<br>GACAGAACTGACAGTAACAAC | 19502 |
| baal1b16 | ATGCAGTGCTCAATTCCAAGC<br>ATGCAGTGCTAAATTCCAAGC | 19504 |
| baalb16 | AGATGCAGGTAAACTTCATGC<br>AGATGCAGGTCAACTTCATGC | 19505 |
| baalb16 | AGTACAAGACGGAAAACGGAA<br>AGTACAAGACAGAAAACGGAA | 19506 |
| baalb16 | TTTCATCTATATTACCTTCCA<br>TTTCATCTATGTTACCTTCCA | 19507 |
| baalb16 | AGCTTCGAGCAAAGAACACAT<br>AGCTTCGAGCTAAGAACACAT | 19508 |
| bags30n17 | GGGCATCCTCAAGCCTTGCCC<br>GGGCATCCTCGAGCCTTGCCC | 19511 |
| bags30n17 | TTGCCCTGGAATCCTCAAGCT<br>TTGCCCTGGAGTCCTCAAGCT | 19512 |
| bags5b16 | GCTTCGACAAAGACACAACAT<br>GCTTCGACAACGACACAACAT | 19514 |
| baal5f06 | ACTTGCCATTCTCTTGGACAT<br>ACTTGCCATTTTCTTGGACAT | 19515 |
| bah42g19 | TGGTAAAACAACTGAGACACA<br>TGGTAAAACATCTGAGACACA | 19516 |
| bah42g19 | GGTCGTTAGCTATGCAGGAAC<br>GGTCGTTAGCCATGCAGGAAC | 19517 |
| bah42g19 | TCGACCAAGTTACCTTCACTG<br>TCGACCAAGTCACCTTCACTG | 19518 |
| BaH47O14 | CGTACCGTGCCTGATACCCCG<br>CGTACCGTGCTTGATACCCCG | 19519 |
| BaH47O14 | TGTGGATGGATAATAACACGA<br>TGTGGATGGAGAATAACACGA | 19520 |
| BaH47O14 | TGCCATCCTGCATTGTTGAGC<br>TGCCATCCTGTATTGTTGAGC | 19521 |
| BaH47O14 | TGTTGAATTACTGACCTTATT<br>TGTTGAATTATTGACCTTATT | 19522 |
| BaH47O14 | AACACGAGGAATTTTTGTTGT<br>AACACGAGGATTTTTTGTTGT | 19523 |
| BaH12L06 | TTGGTATGGACGTCAGGATGC<br>TTGGTATGGATGTCAGGATGC | 19524 |

TABLE 24-23

| Clones | Haruna Nijo H602 | SEQ ID NO: |
|---|---|---|
| BaH12L06 | ATGGGATGGCATCGGCGAAGG<br>ATGGGATGGCGTCGGCGAAGG | 19525 |
| bah51a21 | GTGCATCCCAATCGGTAGTGT<br>GTGCATCCCAGTCGGTAGTGT | 19528 |
| bah51a21 | CTTCCCTTTGGTTTAGCAATA<br>CTTCCCTTTGTTTTAGCAATA | 19529 |
| basd12p12 | TACATAACTTATTTACATGGG<br>TACATAACTTCTTTACATGGG | 19532 |
| bags19l10 | TTGCCTCAATCGACGGGAACA<br>TTGCCTCAATTGACGGGAACA | 19538 |
| BaH56J21 | GCGAGCCGCGGGTATGCCTTG<br>GCGAGCCGCGAGTATGCCTTG | 19539 |
| BaH56J21 | AAACAACCTTTGATAAAGTAT<br>AAACAACCTTCGATAAAGTAT | 19540 |
| BaH56J21 | GCAGGAACCAGGTGATGAACG<br>GCAGGAACCACGTGATGAACG | 19541 |
| BaH56J21 | GTGACACTACGATCATCGACA<br>GTGACACTACAATCATCGACA | 19542 |
| bags16i19 | GCAGGCATGTGTTACGGCACT<br>GCAGGCATGTTTTACGGCACT | 19544 |
| bags16i19 | CGCTGCTGCGGCCAGAGCATC<br>CGCTGCTGCGCCCAGAGCATC | 19545 |
| bags16i19 | GCATCCTGAGCGAGGCAGGCC<br>GCATCCTGAGAGAGGCAGGCC | 19546 |
| bah54h01 | AGCTGGATGCTTATGTGCACC<br>AGCTGGATGCATATGTGCACC | 19548 |
| bah54h01 | TAATAATTCAAAGCAAATCAA<br>TAATAATTCAGAGCAAATCAA | 19549 |
| bags20e19 | CCATTCCGGCGACACAAGCAT<br>CCATTCCGGCAACACAAGCAT | 19550 |
| bags20e19 | TACTCAACAAAGTCGATGGCC<br>TACTCAACAAGGTCGATGGCC | 19551 |
| bags20e19 | GAACCTTGTCCCTTCAGCCAG<br>GAACCTTGTCACTTCAGCCAG | 19552 |
| bags20e19 | CCTTTCTCGAGGTCCGGCAGC<br>CCTTTCTCGACGTCCGGCAGC | 19553 |
| bast74c0206 | TGAACAGCCCAAAGTTCTTCT<br>TGAACAGCCCGAAGTTCTTCT | 19554 |
| bast74c0206 | TTATTCGACCACGAAATATCC<br>TTATTCGACCGCGAAATATCC | 19555 |
| bast74c0206 | GCGTGCCATTGCCGACGTGGT<br>GCGTGCCATTCCCGACGTGGT | 19556 |
| bags20i01 | GTGTGCTCGAAGGCTGTATCT<br>GTGTGCTCGAGGGCTGTATCT | 19557 |
| bags20i01 | GAAAGAGCAATCTATCAAGG<br>GAAAGAGCAGTCTATCAAGG | 19558 |
| baak13l10 | TGGACAGACCATTATCGCTTC<br>TGGACAGACCGTTATCGCTTC | 19559 |
| baak42g21 | CAGTAGAGGC-ATCACTTATG<br>CAGTAGAGGCCATCACTTATG | 19560<br>19561 |

TABLE 24-24

| Clones | Haruna Nijo H602 | SEQ ID NO: |
|---|---|---|
| baak42g21 | CTAGATTTGCGAATATAGCGC<br>CTAGATTTGCAAATATAGCGC | 19562 |
| basd19n14 | TAAAGGATAGTTGCAGCTGCA<br>TAAAGGATAGCTGCAGCTGCA | 19563 |
| basd19n14 | TACAAGCATATCTTTTGTTTA<br>TACAAGCATACCTTTTGTTTA | 19564 |
| basd19n14 | GACCCACAAATTTGACAGACA<br>GACCCACAAACTTGACAGACA | 19565 |
| basd19n14 | TGTAGTGGTACCATCACAACT<br>TGTAGTGGTAGCATCACAACT | 19566 |
| basd19n14 | ATGCTTCATCACACGGTAATG<br>ATGCTTCATCGCACGGTAATG | 19567 |
| BaAK22K17 | TTGCTACGTACGTACGCGTAT<br>TTGCTACGTATGTACGCGTAT | 19570 |
| baal6o24 | GAGTTTGCTCATAGGGACGTA<br>GAGTTTGCTCGTAGGGACGTA | 19571 |
| baal6o24 | TCATAAGCCAAAACCAGTTGT<br>TCATAAGCCAGAACCAGTTGT | 19572 |
| baal6o24 | TTTGCATCGCGTCACATGAAA<br>TTTGCATCGCATCACATGAAA | 19573 |
| BaH22C09 | CAAAGGCCAATAATGAAATGA<br>CAAAGGCCAACAATGAAATGA | 19574 |
| baal24n12 | GCGCGCGACTTATAACTTGTT<br>GCGCGCGACTAATAACTTGTT | 19577 |
| baal24n12 | TGATACATTACGCAAAGAAAT<br>TGATACATTATGCAAAGAAAT | 19578 |
| BaSD16I09 | TATGATATACATGTGCGAGAG<br>TATGATATACGTGTGCGAGAG | 19579 |
| BaSD16I09 | CTGGCTCCTCGGTGATGGTAA<br>CTGGCTCCTCAGTGATGGTAA | 19580 |
| BaSD16I09 | TACATCCACCGCAGGACCAAA<br>TACATCCACCCCAGGACCAAA | 19581 |
| BaAL13B22 | CATCAGGTTGGAATATGCCGG<br>CATCAGGTTGAACTATGCCGG | 19582 |
| BaAL13B22 | TTGACATGGTCGGTCGATCGT<br>TTGACATGGTTGGTCGATCGT | 19583 |
| BaAL13B22 | TTGAACTAATGCAGAAATATA<br>TTGAACTAATACAGAAATATA | 19504 |
| bastl30f0111 | GCATGCCGGGGCCTTAACACC<br>GCATGCCGGGACCTTAACACC | 19586 |
| baak40c12 | ACAGCAGAGTGGCAATTACAT<br>ACAGCAGAGTCGCAATTACAT | 19587 |
| baak40c12 | AAGATAGCCCTTTGAAAAAAG<br>AAGATAGCCCCTTGAAAAAAG | 19588 |
| baak40c12 | CGTCAGCTTTGTCAGAATGA<br>CGTCTAGCTTCGTCAGAATGA | 19589 |
| baak40c12 | CCCCTTCGCCTACACCAACAA<br>CCCCTTCGCCGACACCAACAA | 19590 |
| bah15l04 | ATGTGCAATTGCGGTGCATCG<br>ATGTGCAATTCCGGTGCATCG | 19591 |

TABLE 24-25

| Clones | Haruna Nijo H602 | SEQ ID NO: |
|---|---|---|
| baak31e03 | TTGTCCGACTACATAAGGAAA<br>TTGTCCGACTGCATAAGGAAA | 19593 |
| baak31e03 | CTCCCTCGCAACCGCTCATCC<br>CTCCCTCGCACCCGCTCATCC | 19594 |
| baak31e03 | ACAGAACATTATCCTCCCTCG<br>ACAGAACATTTTCCTCCCTCG | 19595 |
| baak31e03 | TGATTAAGATTCATCTAAATT<br>TGATTAAGATCCATCTAAATT | 19596 |
| bah57d15 | AATTCTGCTGCGTTCCAGTTA<br>AATTCTGCTGTGTTCCAGTTA | 19597 |
| baal13o01 | CTACTGATATAATTAAACTAA<br>CTACTGATATGATTAAACTAA | 19598 |
| baal13o01 | TGAGGCCACAGGGTTATTATT<br>TGAGGCCACATGGTTATTATT | 19599 |
| baal13o01 | ACCAGAACAGAGCTTAGTTTA<br>ACCAGAACAGGGCTTAGTTTA | 19600 |
| bags20f18 | TCTAGGCTAGCATACAACAAT<br>CTTATTCTAG-ATACAACAAT | 19601<br>19602 |
| bags20f18 | AACAATTGGCTACAAATAACG<br>AACAATTGGC-ACAAATAACA | 19603<br>19604 |
| basd26p04 | AGAACTAGCCATGCAAGTTTC<br>AGAACTAGCCGTGCAAGTTTT | 19605 |
| basd26p04 | TTGTCAAAACCAAAAACAGAT<br>TTGTCAAAACTAAAAACACAT | 19606 |
| basd26p04 | ACCAAAAACAGATGATGAATG<br>ACTAAAAACACATGATGAATG | 19607 |
| basd26p04 | CGCATCATGAAAATTTTGCTA<br>CGCATCATGACAAGTTTGCTA | 19608 |
| basd26p04 | ATCATGAAAATTTTGCTAAGA<br>ATCATGACAAGTTTGCTAAGA | 19609 |
| basd26p04 | TGATAGCTGAATAACTGTCAG<br>TGATAGCTGAGTTACTGTCAG | 19610 |
| basd26p04 | TATCTTATTCTAACCTCATAA<br>TATGTTATTCAAACCTCATAA | 19611 |
| basd26p04 | CTGCAGATATCTTATTCTAAC<br>CTGCAGATATGTTATTCAAAC | 19612 |
| basd26p04 | TAAATCAGTGAAATGGGAATA<br>TAAATCGGTGGAATGGGAATA | 19613 |
| BaH42J22 | ATTTGGCCAGACGAACAACCG<br>ATTTGGCCAGGCGAACAACCG | 19614 |
| BaH42J22 | CGCCCCTCTCGACTGCATCCC<br>CGCCCCTCTCAACTGCATCCC | 19615 |
| BaH42J22 | TCATGTGTTTTCCTATGATCC<br>TCATGTGTTTGCCTATGATCC | 19616 |
| kr30b1103 | TCCCACCAGGCATCGCTCCCT<br>TCCCACCAGGTATCGCTCCCT | 19618 |
| kr30b1103 | TTCCAACTTCTAATTTGCAT<br>TTCCAACTTATAATTTGCAT | 19619 |
| kr30b1103 | CTGCAATGTCTTTGCACCACC<br>CTGCAATGTCGTTGCACCACC | 19620 |

TABLE 24-26

| Clones | Haruna Nijo H602 | SEQ ID NO: |
|---|---|---|
| kr30b1103 | AGGTCTATGTAATCTTTGTTT<br>AGGTCTATGTTATCTTTGTTT | 19621 |
| baal4e21 | CTCCATTTTTTTTAATCAACT<br>CTCCATTTTTCTTAATCAACT | 19624 |
| baal4e21 | TCTACCACAATCCAGAATATC<br>TCTACCACAACCCAGAATATC | 19625 |
| BaGS29D05 | GAAGATAACACCATCTTAGAA<br>GAAGATAACAACATCTTAGAA | 19626 |
| BaGS29D05 | TTAGAAAACGCTGTGACGTCA<br>TTAGAAAACGATGTGACGTCA | 19627 |
| BaGS29D05 | GTGACGTCATCTAGGGTCAGT<br>GTGACGTCATTTAGGGTCAGT | 19628 |
| bah54d24 | TGCATCAAGACTCATCCAATT<br>TGCATCAAGAATCATCCAATT | 19629 |
| bah54d24 | GGCTCTGTGATTCTGCATCAA<br>GGCTCTGTGACTCTGCATCAA | 19630 |
| bah54d24 | TCCGGGGCGATGTTGGCCGCG<br>TCCGGGGCGACGTTGGCCGCG | 19631 |
| bah54d24 | GGGGGCATCCAGGGGCTCCGG<br>GGGGGCATCCTGGGGCTCCGG | 19632 |
| bags38h17 | AACCGGTTTTCCGAGGCTTCA<br>AACCGGTTTTGCGAGGCTTCA | 19635 |
| baak30b23 | CGTCCTCCGATGGCAGGAAGT<br>CGTCCTCCGACGGCAGGAAGT | 19636 |
| baak30b23 | TGGCCTCGTATGCGTCCTCCG<br>TGGCCTCGTAGGCGTCCTCCG | 19637 |
| baak30b23 | GGTAGATAACGCTCTTGACAC<br>GGTAGATAACTCTCTTGACAC | 19638 |
| baak24p09 | CTCCCTCTATTAACTAATATA<br>CTCCCTCTATAAACTAATATA | 19640 |
| baak24p09 | GCAGCTAAACTGGCTAGGCAT<br>GCAGCTAAACAGGCTAGGCAT | 19641 |
| baak24p09 | TATGCTTGCAGACCCTCTGCA<br>TATGCTTGCACACCCTCTGCA | 19642 |
| BaGS22I06 | TGTAAATAAATTTTGTAATAA<br>TGTAAATAAACTTTGTAATAA | 19643 |
| BaGS22I06 | CACTACAAAATTATGATGCTA<br>CACTACAAAACTATGATGCTA | 19644 |
| BaAL34P18 | AAATCCCCACGAAAAACTTAT<br>AAATCCCCACTAAAAACTTAT | 19645 |
| BaAL34P18 | TCTCGCCGACGTAGTACTCGT<br>TCTCGCCGACATAGTACTCGT | 19646 |
| BaAL34P18 | AACTTATTCATCTCTTGAACC<br>AACTTATTCAGCTCTTGAACC | 19647 |
| bah12e02 | GGTTTGCTCCTACTGCTACTT<br>GGTTTGCTCCCACTGCTACTT | 19650 |
| BaAL15F23 | GGATGGTCAGCATTTCTGTGC<br>GGATGGTCAGTATTTCTGTGC | 19651 |
| BaAL15F23 | TCATGTCATTCCACTGATGAC<br>TCATGTCATTACACTGATGAC | 19652 |

TABLE 24-27

| Clones | Haruna Nijo H602 | SEQ ID NO: |
|---|---|---|
| BaGS25015 | TGCAATAGCTGAAATTGTGAC<br>TGCAATAGCTAAAATTGTGAC | 19653 |
| BaGS25015 | ATGGGTTGGTCGGGATGCTCG<br>ATGGGTTGGTTGGGATGCTCG | 19654 |
| bags33m02 | GCATATAATCAACACTCAACA<br>GCATATAATCGACACTCAACA | 19657 |
| bags33m02 | GAGTAGTTTCGATGCGAGAGT<br>GAGTAGTTTCAATGCGAGAGT | 19658 |
| bags27p13 | GCTATTTTGCCGTTCTCAACA<br>GCTATTTTGCTGTTCTCAACA | 19659 |
| bags27p13 | TCAACAGAGTATAAACGATAA<br>TCAACAGACTGTAAACGATAA | 19660 |
| bags27p13 | AAACCCATCTTCATACATCAG<br>AAACCCATCTCCATACATCAG | 19661 |
| bah48g21 | TGTAGTTGACTAAGCAAAGAT<br>TGTAGTTGACGAAGCAAAGAT | 19662 |
| bah48g21 | AAGGCGGCGGAACGATCATGG<br>AAGGCGGCGGGACGATCATGG | 19663 |

TABLE 25-1

| Clones | Haruna Nijo H602 | SEQ ID NO: |
|---|---|---|
| bah14a22 | CTCGGACAGCATCCACGGCTT<br>CTCGGACAGCGTCCACGGCTT | 19664 |
| bah14a22 | CTTCAAGGGGTTCGACGCCGT<br>CTTCAAGGGGCTCGACGCCGT | 19665 |
| BaGS32P17 | TGGAGTGGATCGACACCATCC<br>TGGAGTGGATAGACACCATCC | 19667 |
| BaGS32P17 | GAGAACACAGGCATAGAACAC<br>GAGAACACAGCCATAGAACAC | 19668 |
| BaGS32P17 | CCCTCTCCATAAGGTCCTTGA<br>CCCTCTCCATCAGGTCCTTGA | 19669 |
| BaGS32P17 | ACACCATCCTGATGAGCCCCC<br>ACACCATCCTAATGAGCCCCC | 19670 |
| baak35b06 | TCAATTTTGCGAAACCCGCCT<br>TCAATTTTGCAAAACCCGCCT | 19671 |
| basd21f17 | AGGAGGAGGATTGAAGAGGAG<br>AGGAGGAGGACTGAAGAGGAG | 19672 |
| basd21f17 | CCCTTTCCCTCTCCCTCTCCC<br>CCCTTTCCCTTTCCCTCTCCC | 19673 |
| basd21f17 | AGAATCCGACAATGGATGCTG<br>AGAATCCGACGATGGATGCTG | 19674 |
| baal22h02 | TCTTCTTCTTCTCCTTCTTCT<br>TCTTCTTCTTGTCCTTCTTCT | 19679 |
| bah56g24 | ATCTCTCCTCGCATACTTGCT<br>ATCTCTCCTCACATACTTGCT | 19680 |
| bah56g24 | CATTGGCCGGCGGCGGGTTCA<br>CATTGGCCGGTGGCGGGTTCA | 19681 |
| bah56g24 | CGCGCACGTCGGCAATCAGCG<br>CGCGCACGTCAGCAATCAGCG | 19682 |

TABLE 25-1-continued

| Clones | Haruna Nijo H602 | SEQ ID NO: |
|---|---|---|
| bah56g24 | CTTCCGCCTCTGGGGAGACCT<br>CTTCCGCCTCCGGGGAGACCT | 19683 |
| baak32f06 | CGAACGACGGTTTCACGCGAG<br>CGAACGACGGCTTCACGCGAG | 19688 |
| basd21d13 | CATCATCACACGGCGCACTCA<br>CATCATCACAAGGCGCACTCA | 19690 |
| basd21d13 | TACAGCTAAAGTAAAATAGTT<br>TACAGCTAAAATAAAATAGTT | 19691 |
| bast46d0408 | CGAAAAGGATGGATCGATAAC<br>CGAAAAGGATAGATCGATAAC | 19692 |
| bast55B1204 | TCTACTCCTACTTTGTTTTTA<br>TCTACTCCTAGTTTGTTTTTA | 19693 |
| bast55B1204 | ACCTTGGCAATGATGTCCTCC<br>ACCTTGGCAACGATGTCCTCC | 19694 |
| bast55B1204 | GATAACAATGTCAGTTCAGTT<br>GATAACAATGCCAGTTCAGTT | 19695 |
| bast55B1204 | GTGAATTCTGTCCAAAGATGC<br>GTGAATTCTGCCCAAAGATGC | 19696 |
| bags39b15 | CTTAATGACAGTAAGGGTTAT<br>CTTAATGACACTAAGGGTTAT | 19697 |
| bags39b15 | GAAAACCTAAAAATTGCATGC<br>GAAAACCTAACAATTGCATGC | 19698 |

TABLE 25-2

| Clones | Haruna Nijo H602 | SEQ ID NO: |
|---|---|---|
| bah29o22 | GTAGATATCCTCTTCCCCGCC<br>GTAGATATCCCCTTCCCCGCC | 19701 |
| bah29o22 | TGCAGCAGAGGCGACGGCTCA<br>TGCAGCAGAGCCGACGGCTCA | 19702 |
| baet31e1010 | TCTATTGCATGTTGTGCAAA<br>TCTATTGCATCGTTGTGCAAA | 19703 |
| baal39h14 | AGATCAAAACTGCTTTATTTA<br>AGATCAAAACCGCTTTATTTA | 19704 |
| baal39h14 | TACATGAAGAAACACAGTGAT<br>TACATGAAGACACACAGTGAT | 19705 |
| baal18m18 | CTGCAAAGACGAAACAGTCTC<br>CTGCAAAGACAAAACAGTCTC | 19706 |
| baal18m18 | TATCAAAATTTTCTTTTGAGA<br>TATCAAAATTGTCTTTTGAGA | 19707 |
| baal18m18 | CGATCATCAGGCTGTCAAGAA<br>CGATCATCAGACTGTCAAGAA | 19708 |
| basd24e02 | AGGCTTGCTAGAATCCGCCGG<br>AGGCTTGCTACAATCCGCCGG | 19709 |
| basd24e02 | AAAGTAAAGGTGTCAGCGAGT<br>AAAGTAAAGGCGTCAGCGAGT | 19710 |
| basd24e02 | AGAGGATGACGACGAGCTTCA<br>AGAGGATGACCACGAGCTTCA | 19711 |
| baak11d04 | AGTCAAGGCTTGCCGAGGATT<br>AGTCAAGGCT_GCCGAGGATT | 19714<br>19715 |

TABLE 25-2-continued

| Clones | Haruna Nijo H602 | SEQ ID NO: |
|---|---|---|
| baal33m06 | TTAAGGTGAANGGCAATAGAT<br>TTAAGGTGAAAGGCAATAGAT | 19719 |
| baal33m06 | TTGTACCTGGCTCGTGAGCAA<br>TTGTACCTGGTTCGTGAGCAA | 19720 |
| bast150E0309 | GCTCCGGGTCGTGGTTCATGC<br>GCTCCGGGTCATGGTTCATGC | 19721 |
| bast150E0309 | CGTGGCGAACACCCTTTATTC<br>CGTGGCGAACGCCCTTTATTC | 19722 |
| bags20i17 | GAATCTTGACATAGGGCAACA<br>GAATCTTGACGTAGGGCAACA | 19723 |
| bags20i17 | GCCACCATGCGTGTCCCTGCG<br>GCCACCATGCATGTCCCTGCG | 19724 |
| BaGS22A07 | ATATACACACCCTGATGCAAA<br>ATATACACACTCTGATGCAAA | 19725 |
| BaGS22A07 | GCACAAAAACGTGGATGGAA<br>GCACAAAAATGTGGATGGAA | 19726 |
| bah41b09 | CTCCCAGCCTGTGCCCCCGGC<br>CTCCCAGCCTCTGCCCCCGGC | 19727 |
| bah41b09 | CCCTTCTTGGGCTTCTTGCTA<br>CCCTTCTTGGCCTTCTTGCTA | 19728 |
| bah41b09 | TGCCAACCCGAGCTCGTCGG<br>TGCCAACCCAAGCTCGTCGG | 19729 |
| bah41b09 | CCCCCCTCGGGCTTGCCCTTC<br>CCCCCCTCGGCCTTGCCCTTC | 19730 |
| bah41b09 | GTCGATCTCGATGCTCTCCTT<br>GTCGATCTCGTTGCTCTCCTT | 19731 |

TABLE 25-3

| Clones | Haruna Nijo H602 | SEQ ID NO: |
|---|---|---|
| bah41b09 | TGTCGGACTTGGTGGCCTCGA<br>TGTCGGACTTAGTGGCCTCGA | 19732 |
| bah41b09 | CCCCCGGCCTGCTTCTTGCTC<br>CCCCCGGCCTCCTTCTTGCTC | 19733 |
| BaGS19023 | CGACCGTGCCGTCTTTCGAGC<br>TGACCGTGCCATCTTTCGAGC | 19735 |
| BaGS19023 | GCTTGGGTGCCGCCAGAAGCG<br>GCTTGGGTGCTGCCAGAAGTG | 19736 |
| bags14h12 | CGACGGGAATCATTTGAAGG<br>CGACGGGAAACATTTGAAGG | 19740 |
| bags14h12 | CTTCCTTTGGTTTGGTTCAAG<br>CTTCCTTTGGATTGGTTCAAG | 19741 |
| bags14h12 | ACAAGAGTCAAAACTGCATCC<br>ACAAGAGTCAGAACTGCATCC | 19742 |
| bah32e15 | GGGCACGAGACGTCCTTTTGG<br>GGGCACGAGATGTCCTTTTGG | 19743 |
| bah32e15 | TGCACTGCTGTTGCACCTGCC<br>TGCACTGCTGCTGCACCTGCC | 19744 |
| bah32e15 | CAGCCTCGCAAAGTGCTCGGC<br>CAGCCTCGCATAGTGCTCGGC | 19745 |

TABLE 25-3-continued

| Clones | Haruna Nijo / H602 | SEQ ID NO: |
|---|---|---|
| bags39e16 | TGTATAGCTTTATGAGGATAG<br>TGTATAGCTTCATGAGGATAG | 19747 |
| bags39e16 | TTTTGAGTGGTTGGCATAGTT<br>TTTTGAGTGGCTGGCATAGTT | 19748 |
| bags39e16 | CAGGAAATAGTTTTTGAGGGG<br>CAGGAAATAGGTTTTGAGGGG | 19749 |
| baal32m10 | ATCAGTGGATCTTATCCCTGA<br>ATCAGTGGATGTTATCCCTGA | 19752 |
| baal32m10 | CCTTGTTTAATTATCTTTTAG<br>CCTTGTTTAAGTATCTTTTAG | 19753 |
| baal32m10 | CTTTTAGGGAGTGACAATTTG<br>CTTTTAGGGATTGACAATTTG | 19754 |
| baal32m10 | AAAAAATTAGCTCAGTATTGC<br>AAAAAATTAGTTCAGTATTGC | 19755 |
| basd12p12 | ATGCACATAGTGCATGTATTA<br>ATGCACATAGGGCATGTATTA | 19756 |
| basd12p12 | CGGCAAGATCGGCATCTATTT<br>CGGCAAGATCAGCATCTATTT | 19757 |
| basd12p12 | CTATTTGCAACTTACAAATCA<br>CTATTTGCAAGTTACAAATCA | 19758 |
| basd12p12 | CAGATGTATATCAGCAGCAAT<br>CAGATGTATAGCAGCAGCAAT | 19759 |
| baal39e15 | GTGCGTGTGCATGCGCCGGAG<br>GTGCGTGTGCGTGCGCCGGAG | 19760 |
| baal39e15 | CCAAACCGTAAAGTGGTAACC<br>CCAAACCGTAGAGTGGTAACC | 19761 |
| BaGS31B01 | AGCACGATGCCGTAATGTTTA<br>AGCACGATGCTGTAATGTTTA | 19763 |
| BaGS31B01 | ACTCAGCCTTCGCAATCCACA<br>ACTCAGCCTTTGCAATCCACA | 19764 |

TABLE 25-4

| Clones | Haruna Nijo / H602 | SEQ ID NO: |
|---|---|---|
| BaH48L11 | CTGCTTTCAAGTTTCGCTGCT<br>CTGCTTTCAAATTTCGCTGCT | 19767 |
| BaH48L11 | CAAATTTATACTCCCAGCCAA<br>CAAATTTATATTCCCAGCCAA | 19768 |
| bah56c09 | TCAGTGAAGCCCATGAACTTC<br>TCAGTGAAGCTCATGAACTTC | 19770 |
| bags20k09 | GAAGTGCGGGCGGCATCAGC<br>GAAGTGCGGGACGGCATCAGC | 19771 |
| bags20k09 | GGCCCTTTCAAGGGGAAGTGC<br>GGCCCTTTCAGGGGGAAGTGC | 19772 |
| bags20k09 | TGTGGTCGTCGGGCGCCAGGC<br>TGTGGTCGTCAGGCGCCAGGC | 19773 |
| bags20k09 | GAGTTACATTGCAACACAGCT<br>GAGTTACATTTCAACACAGCT | 19774 |
| basd25b08 | TCGCCGCCTGAGACGACGCTG<br>TCGCCGCCTGGGACGACGCTG | 19775 |

TABLE 25-4-continued

| Clones | Haruna Nijo / H602 | SEQ ID NO: |
|---|---|---|
| basd25b08 | TGGGGCACCAGTCGACGAACT<br>TGGGGCACCAATCGACGAACT | 19776 |
| basd25b08 | GCACACGGCCATCTGGACCTT<br>GCACACGGCCCTCTGGACCTT | 19777 |
| basd25b08 | TGCCCTCGCCGACGTACCAGT<br>TGCCCTCGCCCACGTACCAGT | 19778 |
| basd25b08 | CGTCGCCCTCGTCACCGTCCT<br>CGTCGCCCTCATCACCGTCCT | 19779 |
| basd25b08 | TGAGACAGCAGGCCATGTACT<br>TGAGACAGCATGCCATGTACT | 19780 |
| bast27e0309 | CAAGCTGCTTGGGCCAACCAG<br>CAAGCTGCTTCGGCCAACCAG | 19781 |
| baet20D0107 | AAATTTACAATACACTACAGG<br>AAATTTACAACACACTACAGG | 19782 |
| baet20D0107 | GCAGAGAAAACAATAATGAG<br>GCAGAGAAAACCATAATGAG | 19783 |
| baet20D0107 | AACGAGCAGAATTGCATTCTA<br>AACGAGCAGAGTTGCATTCTA | 19784 |
| baak26n10 | CTTCTTCTTTCGGATAAGAAA<br>CTTCTTCTTTGGGATAAGAAA | 19790 |
| baak26n10 | GTGTGCCTTTCAGTGTGTAGT<br>GTGTGCCTTTNAGTGTGTAGT | 19791 |
| baak26n10 | TATATTTTAG-CCTTCATCAT<br>TATATTTTAGGCCTTCATCAT | 19792<br>19793 |
| bast22b0204 | CTTCGTTGCCGGCCGGCCAGC<br>CTTCGTTGCCAGCCGGCCAGC | 19794 |
| baal3c05 | TTTTAGGACCGCAACATCTCG<br>TTTTAGGACCACAACATCTCG | 19795 |
| baal3c05 | GTGACGCTGAAGATTCGCTCT<br>GTGACGCTGACGATTCGCTCT | 19796 |
| BaAK20B09 | CCATCTGTTGTTCCCTCCATT<br>CCATCTGTTGCTCCCTCCATT | 19798 |
| BaAK37H01 | AAAATGAAAAATTGAAAGCTC<br>AAAATGAAAATTTGAAAGCTC | 19799 |

TABLE 25-5

| Clones | Haruna Nijo / H602 | SEQ ID NO: |
|---|---|---|
| BaAK37H01 | CGGCCTGGTCATGGATTCGGG<br>CGGCCTGGTCTTGGATTCGGG | 19800 |
| BaAK37H01 | GAAAGCTCTCACTGGAATTGT<br>GAAAGCTCTCGCTGGAATTGT | 19801 |
| BaGS33P13 | GTAGCCCAACTCATGCTACTA<br>GTAGCCCAACGCATGCTACTA | 19802 |
| BaGS33P13 | TGCCCCTTATGATCTTGAAGT<br>TGCCCCTTATAATCTTGAAGT | 19803 |
| bags18h09 | GGGATGGACATCAAACAATAA<br>GGGATGGACACCAAACAATAA | 19806 |
| baal9m23 | CCTGTTTCCTCGACAGGAAAT<br>CCTGTTTCCTTGACAGGAAAT | 19808 |

TABLE 25-5-continued

| Clones | Haruna Nijo H602 | SEQ ID NO: |
|---|---|---|
| baak17d18 | TCTTTTGCTTCGGGTTGGGAC<br>TCTTTTGCTTTGGGTTGGGAC | 19814 |
| bags13a12 | CAAGTGTTGGAGATATATGGT<br>CAAGTGTTGGTGATATATGGT | 19815 |
| bags13a12 | TTCCAGCCTCAAAGTACATGT<br>TTCCAGCCTCGAAGTACATGT | 19816 |
| kr34f0212 | AATTACGGCCCATCCATGTGG<br>AATTACGGCCTATCCATGTGG | 19818 |
| kr34f0212 | GTGAAATTGTATTACTTTACT<br>GTGAAATTGTCTTACTTTACT | 19819 |
| kr34f0212 | AACGGAGGGACTATTTAATAT<br>AACGGAGGGAGTATTTAATAT | 19820 |
| kr34f0212 | CACGACAAGTATTTTGGAACG<br>CACGACAAGTGTTTTGGAACG | 19821 |
| kr34f0212 | AATTCATTTAAAAGAAGAAGA<br>AATTCATTTACAAGAAGAAGA | 19822 |
| baal16d11 | GCTTGCTGTTGCTAACTAGCA<br>GCTTGCTGTTCCTAACTAGCA | 19823 |
| baal16d11 | CGAGAGCAACAGAAGGTATGT<br>CGAGAGCAACCGAAGGTATGT | 19824 |
| baal16d11 | ATCCATCATCGAGAAATTTAC<br>ATCCATCATCAAGAAATTTAC | 19825 |
| bah22d04 | CATAAGGTTCGTCGAAGTATT<br>CATAAGGTTCATCGAAGTATT | 19826 |
| bah22d04 | GCGAGGCGACGAATGCGAGTG<br>GCGAGGCGACAAATGCGAGTG | 19827 |
| bah22d04 | CCTGCCACGCTCTGAGGAACA<br>CCTGCCACGCCCTGAGGAACA | 19828 |
| BaGS6007 | ATGGCCATAGCAGCAGCAGCA<br>ATGGCCATAGTAGCAGCAGCA | 19830 |
| BaH37O10 | GACATTGAACGCGAGGTTTGT<br>GACATTGAACACGAGGTTTGT | 19831 |
| baal9i11 | GGCACGGGCTTGTAATTCTGG<br>GGCACGGGCTCGTAATTCTGG | 19834 |
| BaAL39NO6 | CCCGAGTAACCATCCCTTGAC<br>CCCGAGTAACTATCCCTTGAC | 19835 |
| BaAL19I19 | CTATCTGTACGTGATTTTCTT<br>CTATCTGTACATGATTTTCTT | 19836 |

TABLE 25-6

| Clones | Haruna Nijo H602 | SEQ ID NO: |
|---|---|---|
| BaAL19I19 | TGCCAGGTGCATTATACCACA<br>TGCCAGGTGCTTTATACCACA | 19837 |
| basd12I11 | GCAGTTACTATGAAGCTTAGG<br>GCAGTTACTACGAAGCTTAGG | 19838 |
| bastl46D1008 | AAACAACTAGTGTAAAGGAGA<br>AAACAACTAGCGTAAAGGAGA | 19839 |
| BaH50H16 | TTGTCAGGCAAAGTAATATTA<br>TTGTCAGGCAGAGTAATATTA | 19840 |

TABLE 25-6-continued

| Clones | Haruna Nijo H602 | SEQ ID NO: |
|---|---|---|
| bags9n05 | GCTTCAGGTCCTCTTGCTCTG<br>GCTTCAGGTCATCTTGCTCTG | 19841 |
| bags9n05 | ATGAGAGACCAAATATTTGCT<br>ATGAGAGACCGAATATTTGCT | 19842 |
| kr61b1103 | AACCTTTATTTATATTATGTG<br>AACCTTTATT-ATATTATGTG | 19843<br>19844 |
| kr27b0103 | CTGCACTGCA-TCGCGCAATG<br>CTGCACTGCAGTCGCGCAATG | 19845<br>19846 |
| kr33h1115 | CCCAAATGGCGGCGTCGGCGG<br>CCCAAATGGCCGCGTCGGCGG | 19847 |
| baak30l02 | GAGCAGCAGAGATTGTGCATG<br>GAGCAGCAGACATTGTGCATG | 19848 |
| baak30l02 | CACTCAGATGCTGTCCTCGTC<br>CACTCAGATGTTGTCCTCGTC | 19849 |
| bah55a12 | GTTCCAGAAGGACACAATGAT<br>GTTCCAGAAGTACACAATGAT | 19850 |
| bah55a12 | CACGGGGCCGACATATTCACC<br>CACGGGGCCGCCATATTCACC | 19851 |
| bah55a12 | AAGTAAATGTCATCTTTTTCT<br>AAGTAAATGTTATCTTTTTCT | 19852 |
| bah26k14 | TAAAACCTGAAAACCACTAAT<br>TAAAACCTGAGAACCACTAAT | 19853 |
| bah26k14 | ATGTCCATGTACATCAATAGG<br>ATGTCCATGTGCATCAATAGG | 19854 |
| bah26k14 | ATTTATCTAGAAATGGATATA<br>ATTTATCTAGCAATGGATATA | 19855 |
| basd18m17 | AAGACTGGGTATTATCCATAT<br>AAGACTGGGTGTTATCCATAT | 19857 |
| BaH53B03 | GAAGGCTGAGACGAAGCTGTC<br>GAAGGCTGAGGCGAAGCTGTC | 19859 |
| bags14d19 | ATGAGCACGTATTAGGTGGTA<br>ATGAGCACGTCTTAGGTGGTA | 19864 |
| bags14d19 | TGCTGAGCTATATGTTGCACA<br>TGCTGAGCTACATGTTGCACA | 19865 |
| baal20f05 | TACCTCCTTCCGCTCCTTTCT<br>-ACCTCCTTCGGCTCCTTTCT | 19866<br>19867 |
| baal20f05 | ACTGATGATCCTGGG-AAAG<br>ACTGATGATCTTTGGGAAAG | 19868<br>19869 |
| BaH18H12 | TTGGAGTTATGAGCCAGAGGA<br>TTGGAGTTATAAGCCAGAGGA | 19870 |
| baal9o21 | GTGTGTATCCACCGTCAGTTC<br>GTGTGTATCCTCCGTCAGTTC | 19871 |

TABLE 25-7

| Clones | Haruna Nijo H602 | SEQ ID NO: |
|---|---|---|
| baal9o21 | GCGTGCCACCGACGTTGAGGC<br>GCGTGCCACCTACGTTGAGGC | 19872 |
| baal9o21 | TTGAGGCTGGTGAATCCATCT<br>TTGAGGCTGGCGAATCCATCT | 19873 |

TABLE 25-7-continued

| Clones | Haruna Nijo H602 | SEQ ID NO: |
|---|---|---|
| bags21a02 | ACTTCATCAGGGCTACGTCGA<br>ACTTCATCAGCGCTACGTCGA | 19874 |
| BaAL3G19 | GAAATTCTGCTACAGACCACA<br>GAAATTCTGCCACAGACCACA | 19875 |
| baal7a09 | CACTTGGACAATTCTATGCAA<br>CACTTGGACACTTCTATGCAA | 19876 |
| baal7a09 | ATCTAGTATAGGTTTGGATGC<br>ATCTAGTATAAGTTTGGATGC | 19877 |
| baal7a09 | CTGTCTTCGCAGCAGATGCGA<br>CTGTCTTCGCGGCAGATGCGA | 19878 |
| bast70b0804 | GACCGGTGATCCGTCCGCCTC<br>GACCGGTGATGCGTCCGCCTC | 19879 |
| bastl14f0412 | CCAACGACTACGCAAATTATA<br>CCAACGACTAGGCAAATTATA | 19881 |
| baal3f19 | TGCCTCCTTTCCCCGATAGGC<br>TGCCTCCTTTTCCCGATAGGC | 19883 |
| baal3f19 | TCGTATCAGCGATAACTATGC<br>TCGTATCAGCAATAACTATGC | 19884 |
| baal3f19 | GTATGTGGATCTTCGTATCAG<br>GTATGTGGATATTCGTATCAG | 19885 |
| baal3f19 | ACAGGTCATCTAGACGAAGCA<br>ACAGGTCATCAAGACGAAGCA | 19886 |
| baal3f19 | AATCCCTGGCAACCTTGATGT<br>AATCCCTGGCTACCTTGATGT | 19887 |
| baal1e10 | TCTTCTGAGTCGGGAATTTCA<br>TCTTCTGAGTGGGGAATTTCA | 19888 |
| baal1e10 | GACTTGGATCGACAGCAGCTT<br>GACTTGGATCAACAGCAGCTT | 19889 |
| bags6k02 | CAGAAGACCCCATGTGGGTTC<br>CAGAAGACCCGATGTGGGTTC | 19890 |
| kr42h0315 | ATCAATAGTCTTAATATTGTA<br>ATCAATAGTCCTAATATTGTA | 19891 |
| kr42h0315 | GTGAGTAACCTCTCTTCTCTC<br>GTGAGTAACCGCTCTTCTCTC | 19892 |
| bah39p02 | AAGGTCCAGACCATGCCCTGT<br>AAGGTCCAGAGCATGCCCTGT | 19893 |
| bah39p02 | AAGCAGTGAATTCTCTCTCAT<br>AAGCAGTGAAATCTCTCTCAT | 19894 |
| BaGS9L14 | ATGATGTCTCCGCAATCTCAT<br>ATGATGTCTCTGCAATCTCAT | 19895 |
| baal35l03 | TGGACTAGATTCGAAAAGGCA<br>TGGACTAGATCCGAAAAGGCA | 19896 |
| baal35l03 | GCACAAACATTATCGTTTTGT<br>GCACAAACATCATCGTTTTGT | 19897 |
| basd12m15 | CAGCCGAACTTCTAAAATATA<br>CAGCCGAACTGCTAAAATATA | 19898 |

TABLE 25-8

| Clones | Haruna Nijo H602 | SEQ ID NO: |
|---|---|---|
| baak35p01 | GTTGATCTTGGACAGCGACTC<br>GTTGATCTTGCACAGCGACTC | 19899 |
| baak35p01 | GCTAGGTACATTCGTGACATC<br>GCTAGGTACACTCGTGACATC | 19900 |
| basd11d18 | AGCTACAAAAGCAATGATGGA<br>AGCTACAAAAACAATGATGGA | 19901 |
| BaH38E07 | GTTACATCCCATCTGCTCAAA<br>GTTACATCCCGTCTGCTCAAA | 19902 |
| bags18h13 | ACAACAGATAAGTGCAATGCA<br>ACAACAGATATGTGCAATGCA | 19903 |
| bags18h13 | GTTTGTAAAACAGCAAACGTA<br>GTTTGTAAAAAAGCAAACGTA | 19904 |
| bags18g16 | GTGAAGTTGGCCCACTTGAAG<br>GTGAAGTTGGTCCACTTGAAG | 19905 |
| bags27f21 | CTGTCACCGCACCTTCAGCTG<br>CTGTCACCGCGCCTTCAGCTG | 19906 |
| bags27f21 | TTTTCGCTCGTTTCACTCTTC<br>TTTTCGCTCGATTCACTCTTC | 19907 |
| baal39c19 | TCACCCGGTGCGACGTGCCAA<br>TCACCCGGTGTGACGTGCCAA | 19909 |
| baak46j05 | ATTCTGAAGCCTACAGAAACA<br>ATTCTGAAGCTTACAGAAACA | 19910 |
| baak46j05 | GTATGCAAATCACATTAGAAA<br>GTATGCAAATTACATTAGAAA | 19911 |
| baak46j05 | TTATATTGTGGTTTAACTCAT<br>TTATATTGTGTTTAACTCAT | 19912 |
| baak46j05 | TAACTCATGAAATACATGGG<br>TAACTCATGGGAATACATGGG | 19913 |
| BaGS18M02 | CATCCATTGATAGGCACTGCA<br>CATCCATTGACAGGCACTGCA | 19915 |
| bags39g08 | TTCTTCGGACACATAATTTTT<br>TTCTTCGGACGCATAATTTTT | 19918 |
| bags39g08 | GCTGCATTACAGATCGCAACA<br>GCTGCATTACGGATCGCAACA | 19919 |
| bah32g18 | CTTCTCTGCCAAGCTGCGGCT<br>CTTCTCTGCCGAGCTGCGGCT | 19923 |
| bah32g18 | GGATCTGAGGCAGTGCACTTG<br>GGATCTGAGGAAGTGCACTTG | 19924 |
| bags38l18 | CATCTAAAGAAAAATGATGCT<br>CATCTAAAGACAAATGATGCT | 19927 |
| bags38l18 | TGATGATGACGGTGATGACGG<br>TGATGATGACAGTGATGACGG | 19928 |
| bags35c13 | AACAAAAGAAACATGTATTGT<br>AACAAAAGAATCATGTATTGT | 19929 |
| bags35c13 | AATGTCTTTCGAACATTGCTA<br>AATGTCTTTCAAACATTGCTA | 19930 |
| bags35c13 | GCCCACCTCAGGCATCTTGAT<br>GCCCACCTCACGCATCTTGAT | 19931 |
| bags35c13 | TGAATCAGTAAAAGAACATTC<br>TGAATCAGTAGAAGAACATTC | 19932 |

TABLE 25-9

| Clones | Haruna Nijo / H602 | SEQ ID NO: |
|---|---|---|
| bags35c13 | AATATCTGGCAAATATGCTTG<br>AATATCTGGCGAATATGCTTG | 19933 |
| bah47h04 | TCCTGTGTATGTGGCGCCACT<br>TCCTGTGTATCTGGCGCCACT | 19934 |
| bah47h04 | CTTTGCAAGAGATCGGTGAAT<br>CTTTGCAAGAAATCGGTGAAT | 19935 |
| bah47h04 | GATAAAATGGAAACAGTATTA<br>GATAAAATGGGAACAGTATTA | 19936 |
| bags30m11 | AGCATTTGTGCCGATGTCTCC<br>AGCATTTGTGGCGATGTCTCC | 19937 |
| bah22l15 | CGGCCGAGCCGATCTCTTAAA<br>CGGCCGAGCCAATCTCTTAAA | 19938 |
| bah22l15 | CTGCGTTTGGTAATGGTGGGA<br>CTGCGTTTGGCAATGGTGGGA | 19939 |
| bah22l15 | GGGAGCACAATTTTGGATTCG<br>GGGAGCACAAATTTGGATTCG | 19940 |
| bags39e15 | ATGTACCTTTTTCTGGGTTAG<br>ATGTACCTTTATCTGGGTTAG | 19941 |
| bags39e15 | CTTGATGACCATTACGTTCAT<br>CTTGATGACCGTTACGTTCAT | 19942 |
| bags39e15 | GTTGGTTAAGATTATGATGAA<br>GTTGGTTAAGGTTATGATGAA | 19943 |
| bags39e15 | TTAGGAGGATTTGTTAGTGGA<br>TTAGGAGGATCTGTTAGTGGA | 19944 |
| bags39e15 | AAATCATCGACCCAGCAGTCA<br>AAATCATCGAACCAGCAGTCA | 19945 |
| basd11h11 | TCACAAACACCAAGAGAGTTG<br>TCACAAACACAAAGAGAGTTG | 19947 |
| baak2b06 | TCAATTTGATCGATCATTTCC<br>TCAATTTGATTGATCATTTCC | 19948 |
| baak2b06 | ACACTAGACCAAGGTAAAGTC<br>ACACTAGACCCAGGTAAAGTC | 19949 |
| baak2b06 | GAATGAGGACAACGCGATGGG<br>GAATGAGGACCACGCGATGGG | 19950 |
| baak2b06 | AACAAAAAGAAGCACCATCTA<br>AACAAAAAGACGCACCATCTA | 19951 |
| baak2b06 | ATCATTTCCTAAAAAAAATTG<br>ATCATTTCCTGAAAAAAATTG | 19952 |
| baak2b06 | ACTGGAAGAGAAGTACCTCTC<br>ACTGGAAGAGGAGTACCTCTC | 19953 |
| baak2b06 | TCTGGATTGAAAAAGAATGAG<br>TCTGGATTGAGAAAGAATGAG | 19954 |
| baak2b06 | ACGCGATGGGGGAGAAGGAAC<br>ACGCGATGGGAGAGAAGGAAC | 19955 |
| basd14a23 | GCGCACGGCGGCTGCCACGTC<br>GCGCACGGCGTCTGCCACGTC | 19959 |
| basd14a23 | ACAAGCATCTCATAAGCTAAT<br>ACAAGCATCTTATAAGCTAAT | 19960 |
| basd14a23 | CAAGCATCAGATCAGCTCTAC<br>CAAGCATCAGTTCAGCTCTAC | 19961 |

TABLE 25-10

| Clones | Haruna Nijo / H602 | SEQ ID NO: |
|---|---|---|
| bast25c0705 | TTCCACGCTCACTAATTACTA<br>TTCCACGCTCGCTAATTACTA | 19962 |
| bast25c0705 | TGCTAAACAGTAACTTTACCG<br>TGCTAAACAGCAACTTTACCG | 19963 |
| bast25c0705 | ACCGCATATCGCCTTCTTCA<br>ACCGCATATCACCTTCTTCA | 19964 |
| bast21b1204 | CACTACTAAGGTAGATATAGC<br>CACTACTAAGATAGATATAGC | 19965 |
| bast21b1204 | ACCGAACAAGATGCATGCACA<br>ACCGAACAAGGTGCATGCACA | 19966 |
| BaAK21G02 | ATTCAAACTCTTCCAGCACGC<br>ATTCAAACTCCTCCAGCACGC | 19968 |
| bastl26e1109 | TCTAGAGCAAGCACTGCTGCT<br>TCTAGAGCAACCACTGCTGCT | 19969 |
| basd13k24 | CAACAGATGTGGCAGCACGTA<br>CAACAGATGTCGCAGCACGTA | 19970 |
| baal13f02 | CTAATTGGTCCGGTGTAGAGT<br>CTAATTGGTCAGGTGTAGAGT | 19971 |
| baal13f02 | ATGCAATGCATAGTCGCTTTA<br>ATGCAATGCACAGTCGCTTTA | 19972 |
| baal13f02 | CATAGCTGCCTTCAAATAAAA<br>CATAGCTGCCGTCAAATAAAA | 19973 |
| baal13f02 | CGCCAACATTTATGACACCTA<br>CGCCAACATTGATGACACCTA | 19974 |
| bags13c10 | GCATGCATGA-AGATACAGGC<br>GCATGCATGACAGATACAGGC | 19975<br>19976 |
| bags13c10 | CGTATCTGCA-GCGATACATG<br>CGTATCTGCAAGCGATACATG | 19977<br>19978 |
| bags13c10 | TTCACAAATC-ATCATGGCCT<br>TTCACAAATCCATCATGGCCT | 19979<br>19980 |
| bags11o11 | GTCCTTTGCCGTCCTGCTCTT<br>GTCCTTTGCCATCCTGCTCTT | 19981 |
| bags11o11 | CCCAGTGTCACCGTTAAATTT<br>CCCAGTGTCATCGTTAAATTT | 19982 |
| bags11o11 | CTAGATCTTGAGTTGGTTGGT<br>CTAGATCTTGCGTTGGTTGGT | 19983 |
| baak36p01 | CCTGCTGTTCTTCTTGGCATG<br>CCTGCTGTTCCTCTTGGCATG | 19984 |
| bah52d09 | GGCTGTAATTAGGATCTGCTC<br>GGCTGTAATTTGGATCTGCTC | 19985 |
| bah52d09 | CAGACGATCTCTGAGAGTGTC<br>CAGACGATCTTTGAGAGTGTC | 19986 |
| bah52d09 | ACAGGGATTTTACAGACGATC<br>ACAGGGATTTCACAGACGATC | 19987 |
| bah52d09 | GGATCTGCTCTTTGTCTCTTG<br>GGATCTGCTCCTTGTCTCTTG | 19988 |
| bah52d09 | TCTGGGCACTTGGACTAGCT<br>TCTGGGCACGTGGACTAGCT | 19989 |
| bah52d09 | AGTTCAGGTGCAATTTTGGGT<br>AGTTCAGGTGTAATTTTGGGT | 19990 |

TABLE 25-11

| Clones | Haruna Nijo / H602 | SEQ ID NO: |
|---|---|---|
| BaGS26D18 | TCGTCAATTGTTTTCAGACAG<br>TCGTCAATTGCTTTCAGACAG | 19991 |
| BaGS26D18 | TGCTGAAATCATGCATTCCCC<br>TGCTGAAATCGTGCATTCCCC | 19992 |
| BaGS26D18 | CAGCGCCGCGATGTTCACTCG<br>CAGCGCCGCGGTGTTCACTCG | 19993 |
| BaGS26D18 | CAGACAGAGATCGCAGAATGA<br>CAGACAGAGACCGCAGAATGA | 19994 |
| baak33c22 | ATGAATAAGCGAAGTACGACA<br>ATGAATAAGCCAAGTACGACA | 19995 |
| baak33c22 | CATGGTTAAATACTCTGGTAC<br>CATGGTTAAACACTCTGGTAC | 19996 |
| baak33c22 | ATCTCAAAAGCGTCGTGTACC<br>ATCTCAAAAGGGTCGTGTACC | 19997 |
| baak11c22 | CAAGATAGTCCAAGATGCCAA<br>CAAGATAGTCAAAGATGCCAA | 19999 |
| baak11c22 | GCAGGAATCTATGGTGGCCTG<br>GCAGGAATCTGTGGTGGCCTG | 20000 |
| bags34l06 | TAAATCCAGTGGCAGAGATGG<br>TAAATCCAGTAGCAGAGATGG | 20001 |
| bags20p21 | AGCGATATATGTATGTCTTCA<br>AGCGATATATATATGTCTTCA | 20005 |
| bah52m01 | GTTCATATCATTTCCCTGTAC<br>GTTCATATCACTTCCCTGTAC | 20006 |
| basd15d07 | TATCTCTGGCGGAAGAGGTCT<br>TATCTCTGGCAGAAGAGGTCT | 20007 |
| basd15d07 | CCACTGGAGGAACATACTGAT<br>CCACTGGAGGGACATACTGAT | 20008 |
| BaAL36B07 | CAGATGCTGGGTTGTGCCAAC<br>CAGATGCTGGATTGTGCCAAC | 20011 |
| BaAL36B07 | AGACGACCCAGAAATTAACAA<br>AGACGACCCATAAATTAACAA | 20012 |
| kr67C0206 | AAGTTACTGAAAGTTAGTGTA<br>AAGTTACTGATAGTTAGTGTA | 20015 |
| kr67C0206 | GGCCACAATATGTTGGTCATT<br>GGCCACAATACGTTGGTCATT | 20016 |
| kr67C0206 | ACTTGTATCTAAAGCACTACG<br>ACTTGTATCTTAAGCACTACG | 20017 |
| kr67C0206 | GCCCGGCATAGTTAATTTTTT<br>GCCCGGCATAATTAATTTTTT | 20018 |
| bags15j20 | TGGCACCTGTAGGGAAAAGGA<br>TGGCACCTGTTGGGAAAAGGA | 20019 |
| bags15j20 | GTACAAAACAAGAATCTCCCT<br>GTACAAAACAGGAATCTCCCT | 20020 |
| BaH15E05 | CACAAGTAGTAGAAGTATTCA<br>CACAAGTAGTGGAAGTATTCA | 20021 |
| bah58k02 | TCAAATGCTCTGAGAGACTGA<br>TCAAATGCTCCGAGAGACTGA | 20022 |
| bah58k02 | TTTCACTTTCGTCTTCGCTTT<br>TTTCACTTTCCTCTTCGCTTT | 20023 |

TABLE 25-12

| Clones | Haruna Nijo / H602 | SEQ ID NO: |
|---|---|---|
| basd13d17 | ACCGTTTCTAGTTGCACGGGA<br>ACCGTTTCTATTTGCACGGGA | 20024 |
| basd13d17 | ATTAGGTTCTGACCGTAGGCT<br>ATTAGGTTCTCACCGTAGGCT | 20025 |
| basd13d17 | CAGAGATTTCAAGCAATAGA<br>CAGAGATTTCGAGCAATAGA | 20026 |
| basd13d17 | TTAACAAGCGTTGTGTCACCT<br>TTAACAAGCGCTGTGTCACCT | 20027 |
| basd13d17 | TAAAAACCTAAAAAGAGACAG<br>TAAAAACCTACAAAGAGACAG | 20028 |
| BaAK30F13 | GTTCATTTGTCGAGTAGACAT<br>GTTCATTTGTTGAGTAGACAT | 20030 |
| baal2n22 | CAGCCACAGTCCTTTGGATTA<br>CAGCCACAGTCCTTTGCATTA | 20033 |
| baal2n22 | AAAGACTGAATTATTGAGTTT<br>AAAGACTGAACTATTGAGTTT | 20034 |
| baal2n22 | AACTTAAACTATTACAAAGAC<br>AACTTAAACTTTTACAAAGAC | 20035 |
| baal2n22 | CTGTAGGCAACAAAACTGTAA<br>CTGTAGGCAAGAAAACTGTAA | 20036 |
| kr30c0705 | TGGGGTTATATGGCTTAGCGG<br>TGGGGTTATACGGCTTAGCGG | 20037 |
| BaSD19J21 | AACTTAAACTTTTACAAAGAC<br>AACTTAAACTATTACAAAGAC | 20038 |
| BaSD19J21 | AAAGACTGAACTATTGAGTTT<br>AAAGACTGAATTATTGAGTTT | 20039 |
| BaSD19J21 | CATGGTTTGTACCTATATTAC<br>CATGGTTTGTGCCTATATTAC | 20040 |
| BaSD19J21 | CAGCCACAGTTCTTTGGATTA<br>CAGCCACAGTCCTTTGGATTA | 20041 |
| BaSD19J21 | CTGTAGGCAAGAAAACTGTAA<br>CTGTAGGCAACAAAACTGTAA | 20042 |
| BaH34N22 | ACCGGAACTCGCTGCCGAATC<br>ACCGGAACTCACTGCCGAATC | 20043 |
| BaH34N22 | CTTCAGCTGCTGCTGCAGCGG<br>CTTCAGCTGCCGCTGCAGCGG | 20044 |
| BaGS1E22 | GTTTATCCAGCTGATGCGGAG<br>GTTTATCCAGTTGATGCGGAG | 20046 |
| baak34b17 | CTACAAGGGAGGCAGCCCAGG<br>CTACAAGGGAAGCAGCCCAGG | 20047 |
| baak34b17 | AAAATACAGTGCCGACCAAGA<br>AAAATACAGTCCCGACCAAGA | 20048 |
| baak34b17 | GAGCTAGCGCGGGCAAGACCA<br>GAGCTAGCGCTGGCAAGACCA | 20049 |
| kr32a0202 | CAAATGCTATGGCCTATGGCT<br>CAAATGCTATTGCCTATGGCT | 20051 |
| bags27h21 | TCCGACGAGGATGAGTTCAAC<br>TCCGACGAGGGTGAGTTCAAC | 20052 |
| bah62d17 | TATAGTTACCGTACTAATACT<br>TATAGTTACCATACTAATACT | 20053 |

TABLE 25-13

| Clones | Haruna Nijo H602 | SEQ ID NO: |
|---|---|---|
| bah62d17 | TTGCTTGGAAGTCCTTCATGA<br>TTGCTTGGAAATCCTTCATGA | 20054 |
| bah43e22 | CCAAGATCTGATGTTGATGCA<br>CCAAGATCTGGTGTTGATGCA | 20055 |
| BaAL30I23 | CGGGTACGGCAGCCCGGCGAC<br>CGGGTACGGCGGCCCGGCGAC | 20056 |
| baak34p06 | TCGGAGGTCATAATGATGTTC<br>TCGGAGGTCAGAATGATGTTC | 20059 |
| baak34p06 | CGCATTGCCTACACAGCATAG<br>CGCATTGCCTGCACAGCATAG | 20060 |
| baak34p06 | AGATGGTACAAGACACAGCAG<br>AGATGGTACAGGACACAGCAG | 20061 |
| bah63b08 | CGGGTTACAACAAAAGTGGCA<br>CGGGTACAACAAAAGTGGCA | 20062 |
| bast103f0812 | CGGGTTACAACAAAAGTGGCA<br>CGGGTTACAAGAAAAGTGGCA | 20063 |
| basd14m17 | CAGAGCCAGAAGCAGCAGCCG<br>CAGAGCCAGACGCAGCAGCCG | 20064 |
| basd14m17 | ATCCATATCCAACAATCAGAA<br>ATCCATATCCACAATCAGAA | 20065 |
| basd14m17 | AAAGAAGGCGCGATTGCGGAA<br>AAAGAAGGCGAGATTGCGGAA | 20066 |
| basd14m17 | TAGGCGACGGTGATGTCGAAC<br>TAGGCGACGGGGATGTCGAAC | 20067 |
| basd2j03 | TCGGCTCTGAACACCAAAGGT<br>TCGGCTCTGACCACCAAAGGT | 20068 |
| basd2j03 | AGCAGCAAACGTATAATTACC<br>AGCAGCAAACATATAATTACC | 20069 |
| baal32b23 | TGTCTCTCTCTGACTCCATCT<br>TGTCTCTCTCCGACTCCATCT | 20070 |
| bah44n03 | GCTTGTCACGAAGGTGCGGCT<br>GCTTGTCACGGAGGTGCGGCT | 20074 |
| bah44n03 | GCATCTTGGCGTCGTTGCAGA<br>GCATCTTGGCATCGTTGCAGA | 20075 |
| bags20h05 | GGGGGTTAGAGTAGAAGTAAT<br>GGGGGTTAGAATAGAAGTAAT | 20076 |
| bags20115 | GTACAACCGTTTCCACCGTAC<br>GTACAACCGTCTCCACCGTAC | 20077 |
| BaGS7E03 | GGTGGTGGTGTGATGTCCTTC<br>GGTGGTGGTGCGATGTCCTTC | 20078 |
| bast55e0709 | TCCTTATTTGCTTCTGTCCCC<br>TCCTTATTTGGTTCTGTCCCC | 20080 |
| baak38k04 | CTTTTGTGTTTACCTCGATCT<br>CTTTTGTGTTGACCTCGATCT | 20082 |
| baak38k04 | TGCCAATCATGGGGTATTGAT<br>TGCCAATCATAGGGTATTGAT | 20083 |
| bah42l12 | TCGGCGACCGTTGCATAGGTC<br>TCGGCGACCGCTGCATAGGTC | 20086 |
| bah42l12 | GCAGGCCAGAAAAGTGTAAAC<br>GCAGGCCAGAGAAGTGTAAAC | 20087 |

TABLE 25-14

| Clones | Haruna Nijo H602 | SEQ ID NO: |
|---|---|---|
| baet46c0905 | CTGCGCGAACACGTGAAGGAA<br>CTGCGCGAACGCGTGAAGGAA | 20089 |
| baet46c0905 | GTGGGAAAGGGAACTAGTTGC<br>GTGGGAAAGGAAACTAGTTGC | 20090 |
| bah26e10 | GCTTTCTGTCACCTGATGAAT<br>GCTTTCTGTCGCCTGATGAAT | 20092 |
| bah26e10 | GAGGTTCCCGGCATTTTTCAG<br>GAGGTTCCCGACATTTTTCAG | 20093 |
| bah32j04 | GCTCTCCATGTTGAGAACTCT<br>GCTCTCCATGCTGAGAACTCT | 20094 |
| bah32j04 | AGAGAGAGCCTCTTCGATTAC<br>AGAGAGAGCCGCTTCGATTAC | 20095 |
| bah32j04 | ACATGTACAACAGATTTACAT<br>ACATGTACAAGAGATTTACAT | 20096 |
| bah32j04 | TGAAGGAGGCACAAAATGTAC<br>TGAAGGAGGCCCAAAATGTAC | 20097 |
| bah32j04 | TATGGACATGGCTACAGAATT<br>TATGGACATGACTACAGAATT | 20098 |
| bah32j04 | TTATCTCTCTGCTCTATTG<br>TTATCTCTCTATGCTCTATTG | 20099 |
| bags20107 | AACCAACATATCGAAACCCTT<br>AACCAACATAGCGAAACCCTT | 20100 |
| bags20107 | GTGTTAAGACCGTCAGCAGCT<br>GTGTTAAGACTGTCAGCAGCT | 20101 |
| bags20107 | GAGCATGTTATACCTCTTTAT<br>GAGCATGTTAGACCTCTTTAT | 20102 |
| bags20107 | GCTGCAGCCTGTTCTTGAAGC<br>GCTGCAGCCTCTTCTTGAAGC | 20103 |
| bags20107 | GCTCTCCATGTTGAGAACTCT<br>GCTCTCCATGCTGAGAACTCT | 20104 |
| bags20107 | GATCAAACCGCGAACTCAATG<br>GATCAAACCGTGAACTCAATG | 20105 |
| bags20107 | CTCAATGACTGGAGCATGTTA<br>CTCAATGACTTGAGCATGTTA | 20106 |
| bags20107 | AGGAGGCCCATTGCAGAAGAT<br>AGGAGGCCCAATGCAGAAGAT | 20107 |
| kr18c0505 | ATTTGGCAGAGACGAAATGCG<br>ATTTGGCAGACACGAAATGCG | 20108 |
| kr18c0505 | TGGACCATACGTGATATCCAT<br>TGGACCATACTTGATATCCAT | 20109 |
| kr18c0505 | GCTTTTGGGGGGTCATCTAG<br>GCTTTTGGGGCGGTCATCTAG | 20110 |
| kr18c0505 | ACAAAAATCATCAGATAATGT<br>ACAAAAATCAGCAGATAATGT | 20111 |
| kr18c0505 | AAACACTATCGTTACGCCTAT<br>AAACACTATCATTACGCCTAT | 20112 |
| kr18c0505 | TGATGATTGATCAGGGCCTGA<br>TGATGATTGAACAGGGCCTGA | 20113 |
| basd11m24 | TGCAGAAACTGTGTTGCTAAA<br>TGCAGAAACTATGTTGCTAAA | 20114 |

TABLE 25-15

| Clones | Haruna Nijo H602 | SEQ ID NO: |
|---|---|---|
| basd1i15 | TTGTCTAGTGTTTGGGCTTGA<br>TTGTCTAGTGCTTGGGCTTGA | 20115 |
| basd1i15 | ACAAATCTACTTTCGCGAAGG<br>ACAAATCTACATTCGCGAAGG | 20116 |
| bah13i21 | TTGCAGGAAATACTGCAGAAC<br>TTGCAGGAAACACTGCAGAAC | 20119 |
| basd27o20 | CCTGTATGAACTTCGAAATGA<br>CCTGTATGAATTTCGAAATGA | 20120 |
| baak45l08 | TTATTCACTACCAACTTTGTA<br>TTATTCACTAGCAACTTTGTA | 20123 |
| baak45l08 | GGATGCCCGTTCCATGATCAA<br>GGATGCCCGTCCCATGATCAA | 20124 |
| baak45l08 | AGAATATCCAAGGACAAAGGT<br>AGAATATCCATGGACAAAGGT | 20125 |
| baak45l08 | TTGGCACAAGGGCAGCAGTAA<br>TTGGCACAAGAGCAGCAGTAA | 20126 |
| baak45l08 | AGGGCATTCAGTTTCGTTCCA<br>AGGGCATTCAATTTCGTTCCA | 20127 |
| baak45l08 | CTGCCAGCCCCCCGACGGTGA<br>CTGCCAGCCCTCCGACGGTGA | 20128 |
| baak45l08 | GCCAGCTCTCCACGCCGGACC<br>GCCAGCTCTCAACGCCGGACC | 20129 |
| baak45l08 | CCTCCCACAATTAAGCAGTGC<br>CCTCCCACAAATAAGCAGTGC | 20130 |
| BaAL36N04 | GCCAGAGAAATTTTTCCTCGA<br>GCCAGAGAAATTTTTCCTCGA | 20131 |
| baak41d17 | ACATGCATGGTCAATTTTACG<br>ACATGCATGGACAATTTTACG | 20132 |
| baak41d17 | GTGGACTTCTCCTTGGCGGCG<br>GTGGACTTCTTCTTGGCGGCG | 20133 |
| baak41d17 | TGGCCTCGCCGCCCATCTTTT<br>TGGCCTCGCCACCCATCTTTT | 20134 |
| baak41d17 | TCGGTGGCCGTCTTCTTCACG<br>TCGGTGGCCGGCTTCTTCACG | 20135 |
| baak41d17 | TTCACGGCCTCCGTCTTCTCG<br>TTCACGGCCTACGTCTTCTCG | 20136 |
| baak41d17 | TCTGCAGCGGTGTCCTGGACA<br>TCTGCAGCGGCGTCCTGGACA | 20137 |
| BaGS25M06 | CTAAACCAGGGCGCCTGAACA<br>CTAAACCAGGACGCCTGAACA | 20139 |
| BaGS25M06 | CGATGTAGACGTGGACGTTGA<br>CGATGTAGACATGGACGTTGA | 20140 |
| bah36f21 | ATGTCTCCGCTGGCGGTGCGT<br>ATGTCTCCGCCGGCGGTGCGT | 20141 |
| bah36f21 | CTTGCCATCCACGTCGCCGTC<br>CTTGCCATCCCCGTCGCCGTC | 20142 |
| baak13b12 | ATGCGGTCCAAACTCCAACCA<br>ATGCGGTCCACACTCCAACCA | 20143 |
| baak13b12 | TGTTCCTTCCGCTTGTTTGTT<br>TGTTCCTTCCTCTTGTTTGTT | 20144 |

TABLE 25-16

| Clones | Haruna Nijo H602 | SEQ ID NO: |
|---|---|---|
| bast63B0604 | GAGGAGCCAGCAGCAGCATCT<br>GAGGAGCCAGAAGCAGCATCT | 20145 |
| baak11n06 | AAACATGATCTTGATCCATGC<br>AAACATGATCCTGATCCATGC | 20146 |
| kr13f1012 | GTGTCTCGCTCGGTTCGTTCT<br>GTGTCTCGCTGGGTTCGTTCT | 20147 |
| kr13f1012 | TCCCTTCTTCCTTTTTTTTGT<br>TCCCTTCTTCGTTTTTTTTGT | 20148 |
| bags20k06 | GTCCTGGGATCTGAAGGAATC<br>GTCCTGGGATTTGAAGGAATC | 20149 |
| bags20k06 | CTTCCGTCGAGCAACCCAAAC<br>CTTCCGTCGAACAACCCAAAC | 20150 |
| bags20k06 | CAGCTTCATCAAAAGAATCGA<br>CAGCTTCATCAAAAGAATCGA | 20151 |
| baak15p20 | CTGATGAACATCTAAGATTTC<br>CTGATGAACACCTAAGATTTC | 20152 |
| BaH23 J08 | ACGGATTCTAGGCATGATCAA<br>ACGGATTCTAAGCATGATCAA | 20153 |
| BaH23 J08 | ATAGCTTACCACAATGGTCTC<br>ATAGCTTACCGCAATGGTCTC | 20154 |
| baet30b1004 | TGGACGACTAGGAATTATTGG<br>TGGACGACTAAGAATTATTGG | 20155 |
| bast133h0816 | CCGATTAACAGTGGCCCACAC<br>CCGATTAACACTGGCCCACAC | 20156 |
| baak42k19 | CTTTGGCGTTCCCTTTTCCGC<br>CTTTGGCGTTGCCTTTTCCGC | 20162 |
| bast60a1101 | GAACTTGCCTCCTGTCCTTTA<br>GAACTTGCCTACTGTCCTTTA | 20163 |
| bast60a1101 | TATGGCACCCATCACACCACA<br>TATGGCACCCCTCACACCACA | 20164 |
| bah52l06 | TCGGGCCCCACTCCCTCATGT<br>TCGGGCCCCAATCCCTCATGT | 20165 |
| bah52l06 | CTAAGTACCGTGTCCACCTCT<br>CTAAGTACGGCGTCCACCTCT | 20166 |
| bah23h10 | GAAGTGTAGCGTCAGGGTTGT<br>GAAGTGTAGCATCAGGGTTGT | 20167 |
| bah23h10 | GCAAAGAATAAGGGCCGCCTT<br>GCAAAGAATACGGGCCGCCTT | 20168 |
| bags15o23 | GATTTTAATTCAGATGATGAT<br>GATTTTAATTAAGATGATGAT | 20169 |
| bags15o23 | CCTTATCATCTTCCTGTACCA<br>CCTTATCATCATCCTGTACCA | 20170 |
| bags15o23 | TGATGAACCACTTGTTGATTT<br>TGATGAACCAGTTGTTGATTT | 20171 |
| bags15o23 | AGAGGTTGCACTCTTAACCGA<br>AGAGGTTGCAGTCTTAACCGA | 20172 |
| baak20e08 | CTATCCAAGAAGTTGAACATC<br>CTATCCAAGAGGTTGAACATC | 20173 |
| baak20e08 | CGCGGAGGCCAATGGTGTAGT<br>CGCGGAGGCCGATGGTGTAGT | 20174 |

TABLE 25-17

| Clones | Haruna Nijo H602 | SEQ ID NO: |
|---|---|---|
| baak20e08 | CCACCTCGTAGGGGATCTCCG<br>CCACCTCGTATGGGATCTCCG | 20175 |
| baak20e08 | AATCAACCCAAGGTGAAATTG<br>AATCAACCCAGGGTGAAATTG | 20176 |
| kr61a1202 | ATCTGAAATTGTGAGCATGAA<br>ATCTGAAATTATGAGCATGAA | 20177 |
| kr61a1202 | GTGTCCAAAACCGTGATGTTC<br>GTGTCCAAAAACGTGATGTTC | 20178 |
| bast03f0212 | CGGACGATATCAGCTAGCTAG<br>CGGACGATATGAGCTAGCTAG | 20179 |
| baak30o17 | TTAATCCTTCGTAGGCTCATT<br>TTAATCCTTCATAGGCTCATT | 20181 |
| baak30o17 | TTTTTCCTCCAATCCAGATGC<br>TTTTTCCTCCCATCCAGATGC | 20182 |
| baal2n04 | AGAGGACACCGCCGATAGCAA<br>AGAGGACACCACCGATAGCAA | 20186 |
| bags30n15 | CACCATCTTGCAGTAAATACA<br>CACCATCTTGAAGTAAATACA | 20188 |
| baal34d18 | TGTAGAAGGTTCTCCTGTCGT<br>TGTAGAAGGTGCTCCTGTCGT | 20189 |
| bags37i06 | TTCCCTGATGCAGTTCTTCAA<br>TTCCCTGATGTAGTTCTTCAA | 20191 |
| BaGS19N09 | ACTGGTAGACGAGGTCCATGC<br>ACTGGTAGACAAGGTCCATGC | 20192 |
| BaGS19N09 | ACCCGTCCACCAGCAGGGAGT<br>ACCCGTCCACGAGCAGGGAGT | 20193 |
| BaSD13H09 | CTCCGGATCCGCCGCGACGAA<br>CTCCGGATCCACCGCGACGAA | 20194 |
| BaSD13H09 | AACTCAAGCTCGCCTCTAACA<br>AACTCAAGCTTGCCTCTAACA | 20195 |
| baak28o08 | CAGGATAACTATCTGAACCCT<br>CAGGATAAGTGTCTGAACCCT | 20197 |
| BaH15K08 | CCGAGATTCGATGCCCAGGTA<br>CCGAGATTCGGTGCCCAGGTA | 20198 |
| bah28a11 | TCATACAAAACAAGAAAAAAC<br>TCATACAAAAGAAGAAAAAAC | 20201 |
| bah28a11 | ACACTTTTTCATCCTTGACTG<br>ACACTTTTTCGTCCTTGACTG | 20202 |
| basd25e01 | AGGTATTAAGATTAACTGCTG<br>AGGTATTAAGCTTAACTGCTG | 20203 |
| baet23F0111 | AACTCAATCAGGCCTTGTGCT<br>AACTCAATCAAGCCTTGTGCT | 20204 |
| baet23F0111 | AAATTGGATTCATGTACTAAC<br>AAATTGGATTTATGTACTAAC | 20205 |
| baet23F0111 | AATGCACCCTTTGTCCTGCAA<br>AATGCACCCTGTGTCCTGCAA | 20206 |
| basd11c04 | TCTAACGAGATCACAACAAGA<br>TCTAACGAGAGCACAACAAGA | 20208 |
| basd11c04 | TGTCGTTGCCAGCCACTTCTC<br>TGTCGTTGCCGGCCACTTCTC | 20209 |

TABLE 25-18

| Clones | Haruna Nijo H602 | SEQ ID NO: |
|---|---|---|
| bags22K17 | AAACACAGCTACTAAAATAAG<br>AAACACAGCTGCTAAAATAAG | 20210 |
| bags22k17 | TCTAATAATTGATTCGCTTCA<br>TCTAATAATTAATTCGCTTCA | 20211 |
| bags22a16 | AAAATATGCTCAAGAGTTCAA<br>AAAATATGCTTAAGAGTTCAA | 20212 |
| bags22a16 | CAAAGAGCAACAAAAATTCA<br>CAAAGAGCAGCAAAAATTCA | 20213 |
| bags22a16 | GAACATGATA-GAGGTATGTT<br>GAACATGATAAGAGGTATGTT | 20214<br>20215 |
| baak41l23 | ACCTAACTAATTCACACCAGC<br>ACCTAACTAAATCACACCAGC | 20219 |
| baak41l23 | GTAATCAACTGATTCCTTTGG<br>GTAATCAACTAATTCCTTTGG | 20220 |
| bastl26c1206 | ATGATGCCTTAATTGAGCTCA<br>ATGATGCCTATATTGAGCTCA | 20223 |
| bah27p20 | TGGTTTCTGACGCTTTCAGAA<br>TGGTTTCTGATGCTTTCAGAA | 20224 |
| bah27p20 | CGATCATAACGTGGACGGCGG<br>CGATCATAACATGGACGGCGG | 20225 |
| baal12d24 | TTCAAGTCCTTTCTCTTATAC<br>TTCAAGTCCTCTCTCTTATAC | 20226 |
| bastl41f0511 | TCGACCGTGGAAATCCCAACA<br>TCGACCGTGGGAATCCCAACA | 20227 |
| bastl41f0511 | CTAGGAGTAAGTCCCCACGTC<br>CTAGGAGTAACTCCCCACGTC | 20228 |

TABLE 26-1

| Clones | Haruna Nijo H602 | SEQ ID NO: |
|---|---|---|
| baal10j04 | AGGCAAACTCAGTCAGGGAAA<br>AGGCAAACTCGGTCAGGGAAA | 20230 |
| BaAK33J17 | CAACCCAACTTGATGATAATG<br>CAACCCAACTCGATGATAATG | 20231 |
| bast17h0515 | CCTACAAGTACTACAACTCAC<br>CCTACAAGTAGTACAACTCAC | 20233 |
| baak35a06 | TCACATGCTTTCGGTACGATT<br>TCACATGCTTCCGGTACGATT | 20234 |
| baak35a06 | ATACACAGTCCCCTGTAATAT<br>ATACACAGTCACCTGTAATAT | 20235 |
| baak18m22 | GGAAGTGTGCTTGGGCATTCG<br>GGAAGTGTGCCTGGGCATTCG | 20239 |
| baak18m22 | AAATCATGCACAAGAGGCGAT<br>AAATCATGCAGAAGAGGCGAT | 20240 |
| baak18m22 | CCCCATGCTCATGCAGGCATG<br>CCCCATGCTCTTGCAGGCATG | 20241 |
| baak18m22 | CGGAAGATGCAATGCCGACGC<br>CGGAAGATGCGATGCCGACGC | 20242 |
| bast26g0614 | TCACCAAGTTACCGTCTTCAG<br>TCACCAAGTTGCCGTCTTCAG | 20243 |

TABLE 26-1-continued

| Clones | Haruna Nijo H602 | SEQ ID NO: |
|---|---|---|
| basd22f13 | AATGCGGTATCGTCCGACCTC<br>AATGCGGTATTGTCCGACCTC | 20244 |
| basd22f13 | GTAGTGCAGAGGACAGTGATG<br>GTAGTGCAGATGACAGTGATG | 20245 |
| bah63l18 | ATTCTGTTTGACAGGATCTCA<br>ATTCTGTTTGTCAGGATCTCA | 20249 |
| bah63l18 | TCTCGGCCTCATCAAAGAAGA<br>TCTCGGCCTCGTCAAAGAAGA | 20250 |
| BaGS9H22 | TCAAGTCTGGTACCACTCTAT<br>TCAAGTCTGGAACCACTCTAT | 20251 |
| BaGS9H22 | ATGCAGCACAGACAACACGTT<br>ATGCAGCACAAACAACACGTT | 20252 |
| BaGS9H22 | GTACAACTCACGAGCTCTTGT<br>GTACAACTCAAGAGCTCTTGT | 20253 |
| BaGS9H22 | GAGCTCTTGTAGACGGTTTTC<br>GAGCTCTTGTCGACGGTTTTC | 20254 |
| BaGS9H22 | CGTTCCAAATGCGTGGTCCCA<br>CGTTCCAAATACGTGGTCCCA | 20255 |
| BaGS9H22 | ATATCGGCACTGCAAGGTGG<br>ATATCGGCATTGCAAGGTGG | 20256 |
| BaH17N17 | CCGGCACAAGTTCACATATCC<br>CCGGCACAAGCTCACATATCC | 20259 |
| BaH17N17 | CCGGATTTTCACGTCCGATTC<br>CCGGATTTTCGCGTCCGATTC | 20260 |
| bags34a05 | ACACGAGTCCTTTACAGAATA<br>ACACGAGTCCCTTACAGAATA | 20261 |
| bags34a05 | TCATACCAGTGATGCTTTTAT<br>TCATACCAGTCATGCTTTTAT | 20262 |
| bags1m23 | AAAAAGAGACGACGTGCACTT<br>AAAAAGAGACAACGTGCACTT | 20263 |

TABLE 26-2

| Clones | Haruna Nijo H602 | SEQ ID NO: |
|---|---|---|
| bags1m23 | TTTTGCCTTGACTATCTGGCT<br>TTTTGCCTTGGCTATCTGGCT | 20264 |
| BaH50B05 | ACATTTCAGAATTGTGTCACT<br>ACATTTCAGAGTTGTGTCACT | 20265 |
| BaH50B05 | TGACTTCCTATCTTGTGAAAT<br>TGACTTCCTACCTTGTGAAAT | 20266 |
| BaH50B05 | CCAAGTTCTCCTACTCTTCTC<br>CCAAGTTCTCTTACTCTTCTC | 20267 |
| BaH50B05 | AGGTGCAGTTTTACCTAACAT<br>AGGTGCAGTTCTACCTAACAT | 20268 |
| BaH50B05 | TATTCGCTGCACTCGTTGGTC<br>TATTCGCTGCCCTCGTTGGTC | 20269 |
| bags1h11 | TGGCGGCCTCAACCATGTTGG<br>TGGCGGCCTCGACCATGTTGG | 20270 |
| bags1h11 | GACCGCAGTCAGGGTTCACCC<br>GACCGCAGTCGGGGTTCACCC | 20271 |

TABLE 26-2-continued

| Clones | Haruna Nijo H602 | SEQ ID NO: |
|---|---|---|
| bah47e01 | TGCAGGGGTGCTTCACAGTGC<br>TGCAGGGGTGGTTCACAGTGC | 20274 |
| bast52E0109 | TGACGCTTGATAGCTCATCAT<br>TGACGCTTGACAGCTCATCAT | 20275 |
| bags1o08 | AGGACCCATGGGTGATGCATT<br>AGGACCCATGTGTGATGCATT | 20276 |
| bags1o08 | TGAAGACTAGACTGACAGCAG<br>TGAAGACTAGGCTGACAGCAG | 20277 |
| baak32l14 | CTAGCACTCAAGTTCCGAGGA<br>CTAGCACTCAGGTTCCGAGGA | 20279 |
| baak32l14 | CCTGCTACCGTGAAAGGGCCG<br>CCTGCTACCGCGAAAGGGCCG | 20280 |
| bah50o06 | CGCCCAGCCGATATGCAATCT<br>CGCCCAGCCGTTATGCAATCT | 20281 |
| bah50o06 | ATATGATCCACTTTTCATGAT<br>ATATGATCCATTTTTCATGAT | 20282 |
| bah50o06 | TCATGTATACCGGGAAGGAAG<br>TCATGTATACAGGGAAGGAAG | 20283 |
| bah50o06 | ACATGCATACATGTTATAAAT<br>ACATGCATACTTGTTATAAAT | 20284 |
| bah50o06 | GTATGTCGCAATTGATCTAAA<br>GTATGTCGCATTTGATCTAAA | 20285 |
| bah50o06 | CTCGTTATATTTGTACAGGTC<br>CTCGTTATATCTGTACAGGTC | 20286 |
| BaSD26I01 | TATTCCAGTAAAGTGATATTA<br>TATTCCAGTACAGTGATATTA | 20287 |
| BaSD26I01 | AGATTGCAGACGATTTCAAAT<br>AGATTGCAGATGATTTCAAAT | 20288 |
| BaSD26I01 | AATGTGACTACCATGTCAGAC<br>AATGTGACTAACATGTCAGAC | 20289 |
| bags1h24 | TGCTCAGCCAGCGCCAAGATC<br>TGCTCAGCCAACGCCAAGATC | 20290 |
| basd27g16 | GGCTGCTCCTGGTCTTAAGAA<br>GGCTGCTCCTAGTCTTAAGAA | 20291 |

TABLE 26-3

| Clones | Haruna Nijo H602 | SEQ ID NO: |
|---|---|---|
| basd27g16 | AAATGAAATAATTGGCTGCTC<br>AAATGAAATAGTTGGCTGCTC | 20292 |
| bags34c19 | TCGTAAGTGGCCGCAGAACGT<br>TCGTAAGTGGTCGCAGAACGT | 20294 |
| bags34c19 | ACAAGTGTTCGTGTTCTGGCT<br>ACAAGTGTTCATGTTCTGGCT | 20295 |
| bags34c19 | TACAGTGTGAAGCCTGCAGTC<br>TACAGTGTGAGGCCTGCAGTC | 20296 |
| bah20k17 | ACAAATTCAAGGTCTCCAGAA<br>ACAAATTCAACGTCTCCAGAA | 20297 |
| baak29c12 | TGAGATGAAATAACACACTTT<br>TGAGATGAAAGAACACACTTT | 20299 |

TABLE 26-3-continued

| Clones | Haruna Nijo H602 | SEQ ID NO: |
|---|---|---|
| baak29c12 | CTTTGAAGGAGGTTAGTTAAA<br>CTTTGAAGGAAGTTAGTTAAA | 20300 |
| baak29c12 | GCGATCTGCAGGAGCACCCTG<br>GCGATCTGCAAGAGCACCCTG | 20301 |
| baak29c12 | ACTGACCTGCCCACGGCTCCAA<br>ACTGACCTGCGACGGCTCCAA | 20302 |
| baal6a09 | GAATAAGAAACATTTCTTCC<br>GAATAAGAAAGCATTTCTTCC | 20304 |
| bah30p15 | GCCCTTCATCGGACCACACTT<br>GCCCTTCATCTGACCACACTT | 20306 |
| basd25d22 | CACAGCAGGGGTCCGGCCAAG<br>CACAGCAGGGTTCCGGCCAAG | 20308 |
| baak13n10 | AGAAAGGTGCGTACATAATTG<br>AGAAAGGTGCATACATAATTG | 20310 |
| bags18j21 | CCTTGTGACCGTCATACATCG<br>CCTTGTGACCTTCATACATCG | 20311 |
| bags18j21 | AGGTCACAATAGGTTGATCAA<br>AGGTCACAATGGGTTGATCAA | 20312 |
| bags33j02 | GATAAGATACATGACGACTGT<br>GATAAGATACGTGACGACTGT | 20313 |
| bags33j02 | AAAACAAACGTTCGGATGAAT<br>AAAACAAACGGTCGGATGAAT | 20314 |
| bags37f05 | GAGATGTCATCGACCGTGCAT<br>GAGATGTCATTGACCGTGCAT | 20316 |
| bags37f05 | AACACCCCGCGCGCCTTTTCGA<br>AACACCCCGTGCCTTTTCGA | 20317 |
| bags37f05 | ATTGCGATGCGTAACGGGATA<br>ATTGCGATGCATAACGGGATA | 20318 |
| BaAL17L15 | CAGTCCGAGCCGCCCCCGCCG<br>CAGTCCGAGCTGCCCCCGCCG | 20319 |
| bags20h12 | TGCTAGAATCATGTATATGGC<br>TGCTAGAATCCTGTATATGGC | 20320 |
| bags20h12 | CACTGTAAATGTTCAGCCTAT<br>CACTGTAAATTTTCAGCCTAT | 20321 |
| bags20h12 | ATCTGAAAAAGGTGATGATT<br>ATCTGAAAAAGGGTGATGATT | 20322 |
| kr65a0802 | TGTTCTTGTACTCGGCAATGG<br>TGTTCTTGTAATCGGCAATGG | 20323 |

TABLE 26-4

| Clones | Haruna Nijo H602 | SEQ ID NO: |
|---|---|---|
| kr65a0802 | CGTCGTGGTCCTTCTACCGCG<br>CGTCGTGGTCGTTCTACCGCG | 20324 |
| basd22j16 | CTATAAGCATCGTCAAGTGAA<br>CTATAAGCATTGTCAAGTGAA | 20325 |
| bah39n18 | GCAGACACTGTGGCACCAGAC<br>GCAGACACTGGGGCACCAGAC | 20326 |
| bah39n18 | GAACGTGTCGGGAAACCTCGA<br>GAACGTGTCGTGAAACCTCGA | 20327 |

TABLE 26-4-continued

| Clones | Haruna Nijo H602 | SEQ ID NO: |
|---|---|---|
| bags20d19 | CTATAATGTGAAGGTACATCC<br>CTATAATGTGGAGGTACATCC | 20328 |
| bags20d19 | GCATGGTATCGCCCGTATGCC<br>GCATGGTATCACCCGTATGCC | 20329 |
| bags20d19 | ACTTGCGGAGAACTGCCGATC<br>ACTTGCGGAGGACTGCCGATC | 20330 |
| bags20d19 | TCGATTTTTAGATTGCTATAA<br>TCGATTTTTACATTGCTATAA | 20331 |
| bags20d19 | GATAGGTGAAGCACTGCATGG<br>GATAGGTGAAACACTGCATGG | 20332 |
| bags20d19 | TCACTGCTCTCCAGATGAAAC<br>TCACTGCTCTGCAGATGAAAC | 20333 |
| bags20d19 | GAAACTGCCAACACAAAGAT<br>GAAACTGCCAGCACAAAGAT | 20334 |
| bags20d19 | CAAAGATTGTTTGCTTATTT<br>CAAAGATTGATTGCTTATTT | 20335 |
| bags34h19 | AAGTCCTAACCAACCAGCAAT<br>AAGTCCTAACAAACCAGCAAT | 20336 |
| bags34h19 | CATACCAAATCAAATGTTACA<br>CATACCAAATTAAATGTTACA | 20337 |
| bags34h19 | TTCATATCCACGACCCCATTA<br>TTCATATCCATGACCCCATTA | 20338 |
| baak42n10 | ATTACCAGTAAATAAATTTCT<br>ATTACCAGTAGATAAATTTCT | 20339 |
| baak42n10 | GAAAGCACTTTCCATCTAACT<br>CAAAGCACTTCCCATCTAACT | 20340 |
| basd24f03 | TCACCATGGGGTTTGATTCCA<br>TCACCATGGGATTTGATTCCA | 20341 |
| BaGS23N21 | GAAATATATATAGAACAGAGG<br>GAAATATATAAAGAACAGAGG | 20342 |
| BaGS23N21 | TCCAAACAGTCCGATGCCAAA<br>TCCAAACAGTTCGATGCCAAA | 20343 |
| BaGS23N21 | CTTCAGAGCATCAATGCCTCT<br>CTTCAGAGCAGCAATGCCTCT | 20344 |
| BaGS23N21 | GCTCCCAACAATTCTAAATTC<br>GCTCCCAACAGTTCTAAATTC | 20345 |
| BaGS23N21 | TATAAGTCTTTTAAGAGATTC<br>TATAAGTCTTCTAAGAGATTC | 20346 |
| B9GS23N21 | TCTCTTAGTAGAATCTCTAGA<br>TCTCTTAGTAAAATCTCTAGA | 20347 |
| BaAK45E04 | CATTCAACGAGAGCGAAGCCA<br>CATTCAACGAAAGCGAAGCCA | 20348 |

TABLE 26-5

| Clones | Haruna Nijo H602 | SEQ ID NO: |
|---|---|---|
| bags5n23 | CCTTGGGCACCGACGCCGTCA<br>CCTTGGGCACAGACGCCGTCA | 20349 |
| bast52h1216 | CAACAGTTGTGACAAAAGAGA<br>CAACAGTTGTAACAAAAGAGA | 20350 |

TABLE 26-5-continued

| Clones | Haruna Nijo H602 | SEQ ID NO: |
|---|---|---|
| bags22f23 | TGTGTCCTTCACAAAGGAGAT<br>TGTGTCCTTCCCAAAGGAGAT | 20351 |
| bags22f23 | TCCTGTGGTTTCATACAGGCA<br>TCCTGTGGTTCCATACAGGCA | 20352 |
| bags22f23 | TATGCTAGTTCTCTCGATTGC<br>TATGCTAGTTTTCTCGATTGC | 20353 |
| BaH38E02 | ACAGAGCCGGCGGACAGAAAC<br>ACAGAGCCGGGGGACAGAAAC | 20354 |
| BaH38E02 | GATGTTCTTGTTACTCCGACG<br>GATGTTCTTGCTACTCCGACG | 20355 |
| BaH50O07 | TTCTTAAGTTTATATACATCT<br>TTCTTAAGTTAATATACATCT | 20356 |
| BaH50O07 | AAGAGGTGTCTGTTGGCAATG<br>AAGAGGTGTCCGTTGGCAATG | 20357 |
| BaH50O07 | CGAGATTGAATGAAAGTAATG<br>CGAGATTGAACGAAAGTAATG | 20358 |
| BaH50O07 | GATCAGTCTTTATTTCTATTG<br>GATCAGTCTTCATTTCTATTG | 20359 |
| kr07c1006 | GTTCATCCTTGCTTACATTAC<br>GTTCATCCTTACTTACATTAC | 20360 |
| baak26a02 | GGCAAGTTATCATAAATAATA<br>GGCAAGTTATGATAAATAATA | 20361 |
| baak2j22 | CGATGGAAACAAGCTCGCCAT<br>CGATGGAAACCAGCTCGCCAT | 20362 |
| baak2j22 | AGAACAAGGAGGCTGAGCGCT<br>AGAACAAGGAAGCTGAGCGCT | 20363 |
| bah45h23 | AAGGTTTACGTTATGCTATGC<br>AAGGTTTACGGTATGCTATGC | 20364 |
| bah45h23 | ATTGACCTTGTTCTTCTTCAG<br>ATTGACCTTGGTCTTCTTCAG | 20365 |
| bah45h23 | CTGTGCAGATAATGACTTGGC<br>CTGTGCAGATTATGACTTGGC | 20366 |
| baak46m16 | AACTATGCACACAACATATAA<br>AACTATGCACCCAACATATAA | 20367 |
| baak46m16 | TTTATTCTATAAGGCTAGATG<br>TTTATTCTATCAGGCTAGATG | 20368 |
| baak46m16 | AACAGCAGCACAACTAATCAC<br>AACAGCAGCAAAACTAATCAC | 20369 |
| bah55m23 | TCTTCTTCTTTGCCTCTCCTC<br>TCTTCTTCTTCGCCTCTCCTC | 20370 |
| bah59c05 | ACAGGTCGCTTGCGGCCCCGT<br>ACAGGTCGCTCGCGGCCCCGA | 20371 |
| basd11l17 | TGAACTTGGCATAGATGTCAG<br>TGAACTTGGCGTAGATGTCAG | 20372 |
| bah19e08 | GTCGCCGGAGTGGGAAATGCA<br>GTCGCCGGAGAGGGAAATGCA | 20373 |

TABLE 26-6

| Clones | Haruna Nijo H602 | SEQ ID NO: |
|---|---|---|
| bah19e08 | CGCTGGAGCCAAAAACGGGCT<br>CGCTGGAGCCGAAAACGGGCT | 20374 |
| BaAK21N24 | CACATAGTGAACTGAACTCTC<br>CACATAGTGAGCTGAACTCTC | 20375 |
| BaAK21N24 | AGGTGGTGGTGTCCTAAATTC<br>AGGTGGTGGTATCCTAAATTC | 20376 |
| BaAK21N24 | GAAATAGAGCATACATGCAGA<br>GAAATAGAGCTTACATGCAGA | 20377 |
| bah50e09 | AATTATTTATCTACGAGAGAT<br>AATTATTTATTTACGAGAGAT | 20378 |
| baak17p18 | TCTCCATTTCCCATCACAACC<br>TCTCCATTTCTCATCACAACC | 20379 |
| baak17p18 | AAGCAATCATTACCATGATAA<br>AAGCAATCATGACCATGATAA | 20380 |
| baal7a04 | TCTGTCACGCAGCCAAGGCAC<br>TCTGTCACGCGGCCAAGGCAC | 20381 |
| bast47b0303 | GATGACCATTCCAAACTTCTC<br>GATGACCATTGCAAACTTCTC | 20382 |
| bah28o17 | TCTGAAGCTCGATCTTCCCG<br>TCTGAAGCTCAATCTTCCCG | 20383 |
| bah37k03 | ATCTCTCTCAGTTTTCCTCCA<br>ATCTCTCTCAATTTTCCTCCA | 20384 |
| bah37k03 | TGTTTGCCGGTTCAGCTTTGT<br>TGTTTGCCGGGTCAGCTTTGT | 20385 |
| bastl38A0501 | CAGCCAAAGCACAGCTCACCA<br>CAGCCAAAGCGCAGCTCACCA | 20386 |
| bags23c03 | GTATACAACTATAAGCACGCA<br>GTATACAACTTTAAGCACGCA | 20387 |
| basd13j01 | GTTTTCTGACGGTAGTTGATG<br>GTTTTCTGACAGTAGTTGATG | 20388 |
| basd13j01 | CATGGTTATCTCTGTAGTCGC<br>CATGGTTATCCCTGTAGTCGC | 20389 |
| bags21c02 | GTATTGAGCAGAGAGAGGTGG<br>GTATTGAGCACAGAGAGGTGG | 20390 |
| bags21c02 | GCATCATGGCAACCATAGAAA<br>GCATCATGGCGACCATAGAAA | 20391 |
| bags6k10 | ATATAGATGTGTATGCATGTA<br>ATATAGATGTATATGCATGTA | 20394 |
| bags9k18 | TCATATGGCAGCTCTGTGAGG<br>TCATATGGCAACTCTGTGAGG | 20395 |
| bags9k18 | TTTCCTCATCACACACGACGT<br>TTTCCTCATCGCACACGACGT | 20396 |
| bags9k18 | TGCATACCGAAGGTGGAAGCT<br>TGCATAGCGACGGTGGAAGCT | 20397 |
| baal18c19 | AAAGGGTAC-GTTTGATGTA<br>AAAGGGTACCGTTTGATGTA | 20398<br>20399 |
| baal18c19 | AGGATCTTGGNTATAACCTCT<br>AGGATCTTGGTTATAACCTCT | 20400 |
| baal18c19 | GTGCAATGCA-TTTCTACAAA<br>GTGCAATGCAATTTCTACAAA | 20401<br>20402 |

TABLE 26-7

| Clones | Haruna Nijo H602 | SEQ ID NO: |
|---|---|---|
| baak27p14 | AATATATATATGTTATTAGTC<br>AATATATATACGTTATTAGTC | 20403 |
| baak27p14 | AGCATATATTCGAAAGATGAC<br>AGCATATATTTGAAAGATGAC | 20404 |
| baak27p14 | CTTGCTTAGGNGGCATCTATG<br>CTTGCTTAGGTGGCATCTATG | 20405 |
| baak27p14 | GATAGTCTAAAAGATGCATGA<br>GATAGTCTAANAGATGCATGA | 20406 |
| bags30n21 | ACTGGAAATCGACAATGATAT<br>ACTGGAAATCCACAATGATAT | 20407 |
| bah55p23 | TGTTTACATCATAGATTCAGT<br>TGTTTACATCGTAGATTCAGT | 20408 |
| bah55p23 | AGGCTAGCGCAGCTGGAGGCA<br>AGGCTAGCGCGGCTGGAGGCA | 20409 |
| bah54p22 | ACCCAGAACCGAACCAAAACT<br>ACCCAGAACCAAACCAAAACT | 20410 |
| bah54p22 | GTCCAGTACCGTACTCTTCAA<br>GTCCAGTACCATACTCTTCAA | 20411 |
| bags34f05 | AGTGATGCCTCCTGAGACGCA<br>AGTGATGCCTACTGAGACGCA | 20412 |
| bags34f05 | CGCCTACGTCAGGCAGGCCTA<br>CGCCTACGTCGGGCAGGCCTA | 20413 |
| bah14a24 | ACGAAATGAGCCGCCACAGAA<br>ACGAAATGAGACGCCACAGAA | 20416 |
| bah50j11 | ATATTTTCCACTATGTGTTAT<br>ATATTTTCCAATATGTGTTAT | 20417 |
| basd22l21 | GAGGCGGGATTTTGATGTCAA<br>GAGGCGGGATGTTGATGTCAA | 20424 |
| basd22l21 | TATTTCCAAGCGTCCTTAGTT<br>TATTTCCAAGTGTCCTTAGTT | 20425 |
| kr27e0909 | TAACTTGTGAGTCGAGCCATT<br>TAACTAGTGACTCGAGCCATT | 20426 |
| bastl41H0216 | TGGCTTTATCAACTTTCTCGC<br>TGGCTTTATCGACTTTCTCGC | 20427 |
| baak36o17 | TGCTCTTGCAGAAGTGTGGGG<br>TGCTCTTGCANAAGTGTGGGG | 20428 |
| BaH31P15 | AAACAGAATTAAAGGACACAC<br>AAACAGAATTGAAGGACACAC | 20429 |
| bags9h03 | ACAAAGTCCGTCGCAGAGCTT<br>ACAAAGTCCGCCGCAGAGCTT | 20431 |
| basd26d07 | TCAGTGAGCTTTTTATGCCTT<br>TCAGTGAGCTGTTTATGCCTT | 20442 |
| bah21h17 | TAACTGGGATCCGTTTAGTTT<br>TAACTGGGATTCGTTTAGTTT | 20444 |
| bags5d21 | GCTGATGAAAAATAGACAGTA<br>GCTGATGAAAGATAGACAGTA | 20445 |
| baak34d14 | GATTCGTTCTGCTGAACTCGT<br>GATTCGTTCTCCTCAACTCGT | 20446 |
| baak18a16 | GTCTGCACACAACTTACAAAG<br>GTCTGCACACGACTTACAAAG | 20447 |

TABLE 26-8

| Clones | Haruna Nijo H602 | SEQ ID NO: |
|---|---|---|
| baak18a16 | TTCACCTTGAGTTCTTCGAAC<br>TTCACCTTGAATTCTTCGAAC | 20448 |
| bags4b01 | CATTTCTACGCCGCCTTGTTA<br>CATTTCTACGTCGCCTTGTTA | 20449 |
| bags4b01 | TGTTATGTGGCGAAATAGATG<br>TGTTATGTGGTGAAATAGATG | 20450 |
| bags38c19 | AGTTAAATTTCTGTGCACAGG<br>AGTTAAATTTTTGTGCACAGG | 20451 |
| bags38c19 | CGCTGTGGGATCAGTTAAATT<br>CGCTGTGGGAGCAGTTAAATT | 20452 |
| bags38c19 | GCCAAGAGTGACACTCGACAA<br>GCCAAGAGTGGCACTCGACAA | 20453 |
| bags38c19 | GCTATATTGGTGCTGACTATC<br>GCTATATTGGGGCTGACTATC | 20454 |
| kr42d0208 | CAAAGTAAGCGGCTGAATATT<br>CAAAGTAAGCCGCTGAATATT | 20456 |
| BaAK35N11 | CCCATGACCGATACGACTGGG<br>CCCATGACCGGTACGACTGGG | 20460 |
| bags26n10 | CCACCTATGAGTCGAATCTTC<br>CCACCTATGAATCGAATCTTC | 20461 |
| bags37n02 | GCCATAACCTTTATTATGGAC<br>GCCATAACCTCTATTATGGAC | 20462 |
| bags37n02 | CAGAAGAAGCGGTGGTTTCTC<br>CAGAAGAAGCAGTGGTTTCTC | 20463 |
| bags37n02 | CTATAGCATATTAGCCAGACC<br>CTATAGCATAGTAGCCAGACC | 20464 |
| baak26l11 | TATACCTGTGCTAGATGTGTG<br>TATACCTGTGGTAGATGTGTG | 20465 |
| BaH57C19 | CAACTACCTTCCTGTCAAGCC<br>CAACTACCTTTCTGTCAAGCC | 20466 |
| bags7a01 | GGCGCCTCCCGCTGCACCTCG<br>GGCGCCTCCCACTGCACCTCG | 20467 |
| bah19l15 | CACATGAAGCTGTGGGCACGT<br>CACATGAAGCCGTGGGCACGT | 20468 |
| baal4o02 | TATTCTTTCAACCTTACATCT<br>TATTCTTTCAGCCTTACATCT | 20469 |
| baal4o02 | AGCACCGCACACCAATGTTAC<br>AGCACCGCACGCCAATGTTAC | 20470 |
| baal4o02 | CAAGGTAGCTCTCAGTGCTGG<br>CAAGGTAGCTTTCAGTGCTGG | 20471 |
| baal4o02 | ATTAAGCTGATAGGTCTGACT<br>ATTAAGCTGAAAGGTCTGACT | 20472 |
| bah58a12 | TGGTAGAGACGAATCACATCG<br>TGGTAGAGACAAATCACATCG | 20473 |
| bah58a12 | TGGTAAATTCGTCAAGATTCA<br>TGGTAAATTCATCAAGATTCA | 20474 |
| bah58a12 | TCTGAGAAAGTCCGTCATCTT<br>TCTGAGAAAGCCCGTCATCTT | 20475 |
| bah58a12 | AAGTGTCGAAGCTGTCTTCCC<br>AAGTGTCGAATCTGTCTTCCC | 20476 |

TABLE 26-9

| Clones | Haruna Nijo / H602 | SEQ ID NO: |
|---|---|---|
| bah11b08 | CCGTTTGTACCTGTGGTGCAA<br>CCGTTTGTACTTGTGGTGCAA | 20477 |
| bah11b08 | TCTTGTATAAGCAATGGGCTA<br>TCTTGTATAAACAATGGGCTA | 20478 |
| bah11b08 | GTCTCGCCATTATGTGCAGTT<br>GTCTCGCCATGATGTGCAGTT | 20479 |
| bah11b08 | ATCCTCATGATTTCTTCATAG<br>ATCCTCATGAATTCTTCATAG | 20480 |
| bags14m15 | ACTGCATGCAAGTACATCATG<br>ACTGCATGCATGTACATCATG | 20481 |
| bags14m15 | CGACGTTACGTTGTAGAACTG<br>CGACGTTACGGTGTAGAACTG | 20482 |
| bags14m15 | CAACCTCTGAAATGGGTCCTG<br>CAACCTCTGACATGGGTCCTG | 20483 |
| bags14m15 | TTCAAACCGGGAACCTTGAAA<br>TTCAAACCGGAAACCTTGAAA | 20484 |
| bast104b1103 | GCGTTCCCAGTCACGAGTTTC<br>GCGTTCCCAGCCACGAGTTTC | 20486 |
| bags13g08 | CCAAATGCTTGATATGAGCTT<br>CCAAATGCTTCATATGAGCTT | 20487 |
| bags13g08 | ATGCCGATCCAAAAGGGACAC<br>ATGCCGATCCGAAAGGGACAC | 20488 |
| bags13g08 | AAAGGGACACCAAGCAGGCAA<br>AAAGGGACACGAAGCAGGCAA | 20489 |
| basd27p03 | GTGGAGGAACTTACAACCTGG<br>GTGGAGGAACCTACAACCTGG | 20490 |
| basd27p03 | AGAAATACCCATTTCTGGCAA<br>AGAAATACCCGTTTCTGGCAA | 20491 |
| basd27p03 | CTGCACGCTAGGTGGAGGAAC<br>CTGCACGCTAAGTGGAGGAAC | 20492 |
| bast38D0707 | TTTAGGGGATCGGTTAGAGTT<br>TTTAGGGGATTGGTTAGAGTT | 20493 |
| bast38D0707 | CACCGTATATGCTGGTATTTC<br>CACCGTATATCCTGGTATTTC | 20494 |
| baal19k05 | TGAATCAACTGCAAATCTGAG<br>TGAATGAACTCCAAATCTGAG | 20496 |
| baal19k05 | TGTTGCAGGCAAAGTAAACCT<br>TGTTGCAGGCGAAGTAAACCT | 20497 |
| baal19k05 | CATGGTGCCACAAACAAGTAT<br>CATGGTGCCATAAACAAGTAT | 20498 |
| baal19k05 | TTACACGAAGTATAGCTTCAT<br>TTACACGAAGAATAGCTTCAT | 20499 |
| baal19k05 | TGAAGCAAGTATGAGATTGTC<br>TGAAGCAAGTTTGAGATTGTC | 20500 |
| BaH19C21 | CACAATGATGTGATCTGCTAA<br>CACAATGATGCGATCTGCTAA | 20501 |
| bah49g10 | GTCTAGAGTGGAGAAATACCA<br>GTGTAGAGTGAAGAAATACCA | 20502 |
| bah49g10 | CCGTAAGCCATACTTGCAAAT<br>CCGTAAGCCAAACTTGCAAAT | 20503 |

TABLE 26-10

| Clones | Haruna Nijo / H602 | SEQ ID NO: |
|---|---|---|
| bah49g10 | GCTTGAATTTGAGGAGAGCAG<br>GCTTGAATTTAAGGAGAGCAG | 20504 |
| bah49g10 | AAGCAAGCCGTTAACACAAT<br>AAGCAAGCCGGTAACACAAT | 20505 |
| bah49g10 | TCGTGAGATCGCTGGATCTCT<br>TCGTGAGATCCCTGGATCTCT | 20506 |
| bah49g10 | CATCTTGCAATGTGCGTGCCC<br>CATCTTGCAACGTGCGTGCCC | 20507 |
| bags23g18 | AGAGCCTTGCGCAGTGCCTCC<br>AGAGCCTTGCACAGTGCCTCC | 20509 |
| bags23g18 | TTGTAATGATTTACAATTTTG<br>TTGTAATGATGTACAATTTTG | 20510 |
| bags23g18 | TTTTGCACATCTGATTGCATC<br>TTTTGCACATTTGATTGCATC | 20511 |
| bags22o22 | TGCACTATACAGTAAAAGCCA<br>TGCACTATACGGTAAAAGCCA | 20512 |
| bags22o22 | GTGTACAACTACTCCCATCAT<br>GTGTACAACTGCTCCCATCAT | 20513 |
| bags22o22 | AACACACATTGTTTTATTCGA<br>AACACACATTTTTTTATTCGA | 20514 |
| bags22o22 | ACTTCTTAGAGGGAATGTCTT<br>ACTTCTTAGAAGGAATGTCTT | 20515 |
| baal20a03 | CTGGTCGCAAGCGGCGCTATA<br>CTGGTCGCAAACGGCGCTATA | 20516 |
| baal20a03 | GTGTTGGCACAGGCAGCGGCA<br>GTGTTGGCACCGGCAGCGGCA | 20517 |
| bags5e24 | GAAATGTTTTCGTCACTATT<br>GAAATGTTTTCCGTCACTATT | 20518 |
| bags5e24 | GTAGGCCAGCAGCTGCTTCTG<br>GTAGGCCAGCGGCTGCTTCTG | 20519 |
| bags5e24 | CCTGTTTGTAAGATAACTAGG<br>CCTGTTTGTAGGATAACTAGG | 20520 |
| bags5f11 | TACCTGGCTTAATGATCTCAG<br>TACCTGGCTTCATGATCTCAG | 20521 |
| bags5f11 | TGCCCTCGTCGGCGTTAATCA<br>TGCCCTCGTCAGCGTTAATCA | 20522 |
| bags5f11 | TGCTGTCCGTCACCCCCAAA<br>TGCTGTCCGCCACCCCCAAA | 20523 |
| BaAK33B10 | GAAAAAAGAATATGGCAGCC<br>GAAAAAAGAGTATGGCAGCC | 20524 |
| BaAK33B10 | GCAATCTTACAAACAAAATCA<br>GCAATCTTACTAACAAAATCA | 20525 |
| BaAK33B10 | AGAAATAGGTACTTCGATTAT<br>AGAAATAGGTCCTTCGATTAT | 20526 |
| BaAK33B10 | GATGTATGAAGAACCTTGGTA<br>GATGTATGAAAAACCTTGGTA | 20527 |
| BaAK33B10 | GTACGGACTATAACGTTGCGC<br>GTACGGACTAAAACGTTGCGC | 20528 |
| BaAK33B10 | GCTTCTAGTTCTGTTGGTGAG<br>GCTTCTAGTTTTGTTGGTGAG | 20529 |

TABLE 26-11

| Clones | Haruna Nijo H602 | SEQ ID NO: |
|---|---|---|
| BaAK33B10 | GTCAATATGATAGAAATAGGT<br>GTCAATATGAGAGCAATAGGT | 20530 |
| BaAK33B10 | AGGCATGCCACACTGGAGTAT<br>AGGCATGCCAAACTGGAGTAT | 20531 |
| baal39j02 | AGAGAGCATGGACAGGCATCG<br>AGAGAGCATGAACAGGCATCG | 20537 |
| BaSD27H14 | ATGTCCGCGGTGTCGTCCAGG<br>ATGTCCGCGGGGTCGTCCAGG | 20538 |
| BaSD27H14 | CGAAGACCTTTGCCTCAGGGT<br>CGAAGACCTTCGCCTCAGGGT | 20539 |
| bah50m01 | GGATGGACTACCTCAACCCGG<br>GGATGGACTATCTCAACCCGG | 20540 |
| BaSD24E13 | GGGGATCTTTCACCACAAACT<br>GGGGATCTTTTACCACAAACT | 20541 |
| bah28k24 | CATAGACGATTCAATATTAGA<br>CATAGACGATACAATATTAGA | 20546 |
| bah28k24 | ACACAACACCCGAGTGCACAC<br>ACACAACACCTGAGTGCACAC | 20547 |
| bah47c11 | GACAGTTGTTTCATTAGAATT<br>GACAGTTGTTCCATTAGAATT | 20548 |
| bah47c11 | TTAGGGCAGACAGTATGGTTG<br>TTAGGGCAGAAAGTATGGTTG | 20549 |
| basd26m15 | GGCATGCCACGATCCACATAT<br>GGCATGCCACAATCCACATAT | 20550 |
| basd26m15 | CTTAATAATAAGGCATGCATC<br>CTTAATAATACGGCATGCATC | 20551 |
| bah60o02 | CAAAAATGTTTGAGCTCCGTC<br>CAAAAATGTTGGAGCTCCGTC | 20552 |
| bah60o02 | CGTCAGCGATTAGGATTTCAT<br>CGTCAGCGATAAGGATTTCAT | 20553 |
| bah60o02 | GTACTGTATATTGTCACCGTA<br>GTACTGTATACTGTCACCGTA | 20554 |
| bah50g06 | GGGGGGATTTGTGGICCTGATG<br>GGGGGGATTTCTGGCCTGATG | 20555 |
| bast15g0913 | AGTACATCAGCAGCTAAAGCA<br>AGTACATCAGTAGCTAAAGCA | 20556 |
| baal10n23 | GACAGAAATGGTCGAACCTGT<br>GACAGAAATGATCGAACCTGT | 20557 |
| baal10n23 | TGACAAAGCATACAGCACTCC<br>TGACAAAGCAAACAGCACTCC | 20558 |
| baal10n23 | TATCACAGCCGAAATGAGCCC<br>TATCACAGCCAAAATGAGCCC | 20559 |
| bags20c12 | TATCAGACTTCTAATTTCTAC<br>TATCAGACTTTTAATTTCTAC | 20560 |
| basd16f13 | CCCGGGCGTCGGGGACTATCT<br>CCCGGGCGTCCGGGACTATCT | 20561 |
| bags22p08 | TGGCATTAGATGAGAAAAGA<br>TGGCATTAGACGAGAAAAGA | 20564 |
| BaH23N06 | AGATGGAGGCCAGCAGCACGG<br>AGATGGAGGCTAGCAGCACGG | 20565 |

TABLE 26-12

| Clones | Haruna Nijo H602 | SEQ ID NO: |
|---|---|---|
| bags29c08 | AATGAAGCCGACTCAAGCACT<br>AATGAAGCCGGCTCAAGCACT | 20566 |
| bags29c08 | ATCAGCGCCCCTTCTTCTACC<br>ATCAGCGCCCTTTCTTCTACC | 20567 |
| bags11o23 | GGTCAACTAGCTTCGTGTTCC<br>GGTCAACTAGGTTCGTGTTCC | 20568 |
| baal18j13 | ACATTGCTTCTTTACCCATGA<br>ACATTGCTTCCTTACCCATGA | 20571 |
| baal18j13 | ACCTCTCTCAGGCCCAAGCTC<br>ACCTCTCTCAAGCCCAAGCTC | 20572 |
| baal18j13 | TAAGTACTCCCTCCATCCCAA<br>TAAGTACTCCATCCATCCCAA | 20573 |
| baal18j13 | TAAAGGGTTATTTCCATTGAC<br>TAAAGGGTTAATTCCATTGAC | 20574 |
| baal18ji3 | ATGAAGGCCAGCAACGGGCAA<br>ATGAAGGCCAACAACGGGCAA | 20575 |
| baal18j13 | TTAAGTGACTCAACTTTGTAC<br>TTAAGTGACTGAACTTTGTAC | 20576 |
| bah15m02 | ACTTCTTCACAATGCAGTTCC<br>ACTTCTTCACGATGCAGTTCC | 20577 |
| kr68b1103 | CCCTTTCGTTTTGACTTCCCT<br>CCCTTTCGTTATGACTTCCCT | 20580 |
| kr68b1103 | GAGCAAGGTATGTGTTTCCAC<br>GAGCAAGGTACGTGTTTCCAC | 20581 |
| bags15b10 | ACACTATACTCTGCAATCTGA<br>ACACTATACTTTGCAATCTGA | 20583 |
| bags20h21 | GAGCAATTCAGAGACCACAGA<br>GAGCAATTCAAAGACCACAGA | 20584 |
| BaAK29K06 | GCTGGGTGCAGGGAGTGATGA<br>GCTGGGTGCATGGAGTGATGA | 20585 |
| BaAK29K06 | TGTAGATAGCATGGACATGAG<br>TGTAGATAGCCTGGACATGAG | 20586 |
| BaAK29K06 | TTGTGGTTATGGAGATGGTGG<br>TTGTGGTTATAGAGATGGTGG | 20587 |
| BaAK29K06 | ATGACATGAAGAGGAGCAATT<br>ATGACATGAATAGGAGCAATT | 20588 |
| BaAK29K06 | CTAGGAAAATAAATGGGAAC<br>CTAGGAAAATGAATGGGAAC | 20589 |
| bah56j14 | CTTCATGCCTGTGACATCTTT<br>CTTCATGCCTATGACATCTTT | 20591 |
| bah56j14 | TTGCCATCCAGCCTGCAGGGT<br>TTGCCATCCATCCTGCAGGGT | 20592 |
| bah56j14 | CTGCAGCTGTCTTGTCCTGTT<br>CTGCAGCTGTTTTGTCCTGTT | 20593 |
| bags3j24 | CGTGGGGGTCAGCCGGCATGA<br>CGTGGGGGTCGGCCGGCATGA | 20595 |
| bags38m08 | AGACTTTACTTTGGTAGTAAT<br>AGACTTACTCTGGTAGTAAT | 20596 |
| bags35g06 | GTCTCTCCATCAACCTCAATG<br>GTCTCTCCATTAACCTCAATG | 20598 |

TABLE 26-13

| Clones | Haruna Nijo H602 | SEQ ID NO: |
|---|---|---|
| bags35g06 | GATCCCAGGCATGGAAGTTGT<br>GATCCCAGGCTTGGAAGTTGT | 20599 |
| bags37b01 | GAACTGCCTCTGAGCTCTTTA<br>GAACTGCCTCAGAGCTCTTTA | 20600 |
| bags37b01 | GGTCGCCGTCATCAGGTGTTG<br>GGTCGCCGTCGTCAGGTGTTG | 20601 |
| BaAL19F02 | CCAAGCAACAGTTATCTCCAC<br>CCAAGCAACATTTATCTCCAC | 20602 |
| BaAL19F02 | TCAAAACCTTCCTGACTTATG<br>TCAAAACCTTTCTGACTTATG | 20603 |
| BaAL19F02 | TGCTGAATTTGCTTGGAAAGA<br>TGCTGAATTTACTTGGAAAGA | 20604 |
| BaAL19F02 | TTTACAGATAGAACTTGCCTC<br>TTTACAGATACAACTTGCCTC | 20605 |
| BaAL19F02 | CTAGCCTTCCTCCTGATTTTA<br>CTAGCCTTCCACCTGATTTTA | 20606 |
| baal4d09 | ATTGTACCAAATTGGGTAAGT<br>ATTGTACCAAGTTGGGTAAGT | 20607 |
| bags27f15 | CCAGCAGTTACATATGACATG<br>CCAGCAGTTATATATGACATG | 20610 |
| bags27f15 | ATCATGCTAGCCATTTTGGGC<br>ATCATGCTAGTCATTTTGGGC | 20611 |
| bags10k14 | ACCACAAAATGGATTTATGTT<br>ACCACAAAATTGATTTATGTT | 20612 |
| bags10k14 | AGTTTGATAGTTCACTGGCTA<br>AGTTTGATAGATCACTGGCTA | 20613 |
| baak38n21 | CGATAGTGGACGGCCGGAAGA<br>CGATAGTGGATGGCCGGAAGA | 20615 |
| baak38n21 | ACATTGTCAATCTCCAGGCCT<br>ACATTGTCAACCTCCAGGCCT | 20616 |
| baak38n21 | TTCAAGTTGCAAAGCAAGCCG<br>TTCAAGTTGCGAAGCAAGCCG | 20617 |
| baak38n21 | TCCAGCCAGGAAAAACACCGTT<br>TCCAGCCAGGGAAAACACCGTT | 20618 |
| baale38n21 | ACTTATTCATTGTGGATACGT<br>ACTTATTCATCGTGGATACGT | 20619 |
| baak30e05 | GGTCTGAATTGTGGGCAGGCA<br>GGTCTGAATT-TGGGCAGGCA | 20620<br>20621 |
| bastl04a0101 | TACGACGACGGGCAGCCTTGG<br>TACGACGACGCGCAGCCTTGG | 20622 |
| baak28p18 | ATAGGCTTTTCTCCTGCCCAA<br>ATAGGCTTTTGTCCTGCCCAA | 20623 |
| BaGS34E01 | AAGACGGGCAAAACAAGAGGT<br>AAGACGGGCAGAACAAGAGGT | 20624 |
| BaH54H04 | AGTCTTGATATGATGAAACTT<br>AGTCTTGATACGATGAAACTT | 20625 |
| bah13o19 | TTGGTATTAGGGTTTCAAAAA<br>TTGGTATTAGAGTTTCAAAAA | 20626 |
| baht3o19 | AAATTCCCCAGTGGGAAAACA<br>AAATTCCCCAATGGGAAAACA | 20627 |

TABLE 26-14

| Clones | Haruna Nijo H602 | SEQ ID NO: |
|---|---|---|
| BaSD27A15 | AGCAACTCCAGCATAGCGTTT<br>AGCAACTCCAACATAGCGTTT | 20631 |
| BaSD27A15 | CTAATATAATCTGGTGCGCAG<br>CTAATATAATTTGGTGCGCAG | 20632 |
| BaSD27A15 | AATGCCCTCGCCTTCCAGCCC<br>AATGCCCTCGGCTTCCAGCCC | 20633 |
| BaSD27A15 | TGCTGTCCAGGAGCGTCTCCT<br>TGCTGTCCAGTAGCGTCTCCT | 20634 |
| BaSD27A15 | CCATCCTGCAAAATTCCTGTC<br>CCATCCTGCAGAATTCCTGTC | 20635 |
| BaSD27A15 | CGGTAATAATTGATGCTGTCC<br>CGGTAATAATCGATGCTGTCC | 20636 |
| BaSD27A15 | GCGTGGTAGGCGAGTTCTGAT<br>GCGTGGTAGGAGAGTTCTGAT | 20637 |
| bags9n02 | AGCACATACAGACCCCTCGGA<br>AGCACATACATACCCCTCGGA | 20639 |
| bastl30A0202 | CTGAGTGCAATAAACATAACA<br>CTGAGTGCAAGAAACATAACA | 20642 |
| bastl30A0202 | TGGAAGAAAATACAACAAAAT<br>TGGAAGAAAAAACAACAAAAT | 20643 |
| bastl30A0202 | TGGACGAACGTAACTGCGGCG<br>TGGACGAACGCAACTGCGGCG | 20644 |
| bags22k12 | CACTTTGGACCCTAAATGCCC<br>CACTTTGGACACTAAATGCCC | 20646 |
| bags22k12 | ACATTAATACGATGATCAGCT<br>ACATTAATACTATGATCAGCT | 20647 |
| bags22k12 | CGAAATCACAGGATAGATGAA<br>CGAAATCACATGATAGATGAA | 20640 |
| baak13g12 | GGACGGGTACATCTTCCTCAG<br>GGACGGGTACTTCTTCCTCAG | 20649 |
| baak13g12 | CGGCGGCTCCGAACACGGAGC<br>CGGCGGCTCCAAACACGGAGC | 20650 |
| baak13g12 | CGACGCGGCCGCGTCGATGGT<br>CGACGCGGCCACGTCGATGGT | 20651 |
| bags17j17 | AGGTCTTTGCATCACGCCTGG<br>AGGTCTTTGC-TCACGCCTGG | 20654<br>20655 |
| bags17j17 | CGTCTTTGTAGAAGGCACAGC<br>CGTCTTTGTA-AAGGCACAGC | 20656<br>20657 |
| baal12j15 | TACTAACTTCTTACATGGCAA<br>TACTAACTTCCTACATGGCAA | 20658 |
| baal12j15 | ATGGCAATCTCCAAGCAGTGT<br>ATGGCAATCTTCAAGCAGTGT | 20659 |
| baal12j15 | AAAGGGGCGGCGGGTTGACA<br>AAAGGGGCGGACGGGTTGACA | 20660 |
| bah34j11 | CTTCTCTCCGAAGGGCGTCAA<br>CTTCTCTCCGGAGGGCGTCAA | 20662 |
| bah34j11 | CTGATGATGTCTTGGCAAGGA<br>CTGATGATGTTTTGGCAAGGA | 20663 |
| BaGS30I11 | GGAGTGCCTCTGGTACCTCGT<br>GGAGTGCCTCCGGTACCTCGT | 20664 |

TABLE 26-15

| Clones | Haruna Nijo H602 | SEQ ID NO: |
|---|---|---|
| BaGS30I11 | CCATCCTCCTCTTCGTGGCT<br>CCATCCTCCTATTCGTGGCT | 20665 |
| BaGS30I11 | TCTACCGAGAGGAATGGATCG<br>TCTACCGAGACGAATGGATCG | 20666 |
| baal18m24 | CTGCAGCCCCCTGCCTNCAGA<br>CTGCAGCCCC-TGCCTNCAGA | 20668<br>20669 |
| baal18m24 | TGCTCCAGCGGCTTGACCACC<br>TGCTCCAGCGNCTTGACCACC | 20670 |
| baal18m24 | TTGAGCTTGGCCACCTCGATG<br>TTGAGCTTGGGCACCTCGATG | 20671 |
| baak15l06 | TGCGGGAGGCACGCGTGAGGA<br>TGCGGGAGGCGCGCGTGAGGA | 20672 |
| baak15l06 | CATTATTCTTATCATCAAATC<br>CATTATTCTTTTCATCAAATC | 20673 |
| bald18o14 | GATGCTTCTCTCCTGGCTGTA<br>GATGCTTCTCACCTGGCTGTA | 20674 |
| bald18o14 | ATGGGTTGGCAAGCAATCTTT<br>ATGGGTTGGCGAGCAATCTTT | 20675 |
| bags24p22 | GCATTTGGTGGCATTGAGCTG<br>GCATTTGGTGACATTGAGCTG | 20676 |
| bags24p22 | GCACTCCTATGACAGCACACA<br>GCACTCCTATCACAGCACACA | 20677 |
| bags24p22 | GGAGAAGAACAACAAAAAGCA<br>GGAGAAGAACGACAAAAAGCA | 20678 |
| baal37a09 | TGTTGCTGTTAGTTTCAGAGC<br>TGTTGCTGTTGGTTTCAGAGC | 20679 |
| bags5l01 | TTTAGGTCAACAATCATCTAA<br>TTTAGGTCAATAATCATCTAA | 20680 |
| bags5l01 | TCTGCTTTTCGAAGAGATGGT<br>TCTGCTTTTCAAAGAGATGGT | 20681 |
| BaAK12P03 | GGCATGCGACGTCACTCCCGT<br>GGCATGCGACATCACTCCCGT | 20682 |
| BaAK12P03 | CCACCAGCTGCTTTCCGACGT<br>CCACCAGCTGTTTTCCGACGT | 20683 |
| baak21 f10 | CGGAAAATGCAGGANCNAGGA<br>CGGAAAATGCNGGANCNAGGA | 20684 |
| bastl30e0410 | ATGGAAATTCTCCCACATCTT<br>ATGGAAATTCGCCCACATCTT | 20685 |
| kr25c0206 | CAATGGCGAAGACTCTGCCAT<br>CAATGGCGAAAACTCTGCCAT | 20686 |
| kr25c0206 | AAAAAGCTGATAAAGCGCCAG<br>AAAAAGCTGACAAAGCGCCAG | 20687 |
| bah54n06 | TTTCCCAAAAGAAACGCCAAA<br>TTTCCCAAAACAAACGCCAAA | 20690 |
| bast22F0311 | ATGAAATGACCTGACCAGCTA<br>ATGAAATGACGTGACCAGCTA | 20692 |
| bast22F0311 | ACTGCAATCGATAGTACTACA<br>ACTGCAATCGGTAGTACTACA | 20693 |
| bast22F0311 | TCGGAGGCTCATCAGATCAGA<br>TCGGAGGCTCGTCAGATCAGA | 20694 |

TABLE 26-16

| Clones | Haruna Nijo H602 | SEQ ID NO: |
|---|---|---|
| basd1 m04 | CGCATCTTCCACACGGCGGAA<br>CGCATCTTCCGCACGGCGGAA | 20695 |
| basd1 m04 | AGTAGAGTGCAAAGTCCTCGC<br>AGTAGAGTGCCAAGTCCTCGC | 20696 |
| basd1 m04 | TTTCTTACTCCTATGTCGGTG<br>TTTCTTACTCATATGTCGGTG | 20697 |
| baak41 d01 | GATAGTTACT-TCTGTTATAG<br>GATAGTTACTGTCTGTTATAG | 20699<br>20700 |
| baak41 d01 | TCTTANGAGCAAATATCTTCA<br>TCTTANGAGCNAATATCTTCA | 20701 |
| baak41 d01 | TTTGGCTATGGTCCACTCCAT<br>TTTGGCTATGATCCACTCCAT | 20702 |
| baak13j10 | TGTTATACACGCGACAAAGAA<br>TGTTATACACGCGACAAAGAA | 20704 |
| baak44h11 | AACTGTAATCGGAGAGATGCA<br>AACTGTAATCAGAGAGATGCA | 20705 |
| baal19j09 | GAAAGTCAGANGAGACCATCA<br>GAAAGTCAGAGGAGACCATCA | 20706 |
| baal19j09 | GGTTCTTGGCAGACTCCGGAC<br>GGTTCTTGGC-GACTCCGGAC | 20707<br>20708 |
| baet37C1105 | ATGCTTGTTATTGAAGCTAGA<br>ATGCTTGTTACTGAAGCTAGA | 20709 |
| baet37C1105 | CCTCCCTGTCGACCGGCATGT<br>CCTCCCTGTCTACCGGCATGT | 20710 |
| basd23f10 | AAAGGAACTGCTACGGCGTCA<br>AAAGGAACTGTTACGGCGTCA | 20712 |
| basd23f10 | TCCAGTATGGTCGGTACTTGG<br>TCCAGTATGGGCGGTACTTGG | 20713 |
| bah41 p07 | TGAGAACCTCGACGATCTCGC<br>TGAGAACCTCAACGATCTCGC | 20714 |
| bah41 p07 | CCACAGAGGCTACCTCGGTCT<br>CCACAGAGGCCACCTCGGTCT | 20715 |
| baak1g13 | TACACTCTAAAGATGTCTACT<br>TACACTCTAAGGATGTCTACT | 20716 |
| baak1g13 | CCGCAATTGAGATAGGGCTCC<br>CCGCAATTGAAATAGGGCTCC | 20717 |
| baak1g13 | ATAAATGTGCACTAGGAAATT<br>ATAAATGTGCGCTAGGAAATT | 20718 |
| baak1g13 | TGCGACTCGGTTCCTATGGTG<br>TGCGACTCGGCTCCTATGGTG | 20719 |
| baak1g13 | AGTTATGTGACAAGAAAAGGA<br>AGTTATGTGAGAAGAAAAGGA | 20720 |
| baak1g13 | AGTGCTCACAACAACTCTCCG<br>AGTGCTCACATCAACTCTCCG | 20721 |
| bags22l14 | GCTCACTCTCACGCCAAGCT<br>GCTCACTCTCGCGCCAAGCT | 20723 |
| bags22l14 | TCAAGAAGCAAAGCGGAAGTA<br>TCAAGAAGCAGAGCGGAAGTA | 20724 |
| bags22l14 | TCTTCTTCCCGGGGACGTGGA<br>TCTTCTTCCCAGGGACGTGGA | 20725 |

TABLE 26-17

| Clones | Haruna Nijo H602 | SEQ ID NO: |
|---|---|---|
| bags22114 | ATGAACAGCATACTCATCACA<br>ATGAACAGCA<u>A</u>ACTCATCACA | 20726 |
| bast26E1210 | AGCTCCTGCC<u>A</u>CATTATTGCC<br>AGCTCCTGCC<u>G</u>CATTATTGCC | 20727 |
| baet25f0911 | ACTTGCCGGGG<u>A</u>CGAAGTTGG<br>ACTTGCCGGGG<u>A</u>ACGAAGTTGG | 20728 |
| baet25f0911 | TGGTGGCGAA<u>G</u>GCCCAGGCGT<br>TGGTGGCGAA<u>A</u>GCCCAGGCGT | 20729 |
| BaAK32N13 | TCACATGCAA<u>C</u>ATCTATCAGT<br>TCACATGCAA<u>A</u>ATCTATCAGT | 20730 |
| BaAK32N13 | ACTTGCCGGG<u>G</u>ACGAAGTTGG<br>ACTTGCCGGG<u>A</u>ACGAAGTTGG | 20731 |
| BaAK32N13 | TGGTGGCGAA<u>G</u>GCCCAGGCGT<br>TGGTGGCGAA<u>A</u>GCCCAGGCGT | 20732 |
| BaAK32N13 | CGAAGAAGCC<u>A</u>AACATGGAGA<br>CGAAGAAGCC<u>G</u>AACATGGAGA | 20733 |
| bags31p01 | AGCCTCCGAA<u>G</u>CCGTAGAGGG<br>AGCCTCCGAA<u>T</u>CCGTAGAGGG | 20734 |
| bags31p01 | TGAGCACGCC<u>C</u>CGGGTCTCCT<br>TGAGCACGCC<u>G</u>CGGGTCTCCT | 20735 |
| bags31p01 | CGTCCATGGC<u>G</u>GTGACGGTCT<br>CGTCCATGGC<u>T</u>GTGACGGTCT | 20736 |
| bags31p01 | GGCGCTTGGC<u>G</u>CCGCCCTTGC<br>GGCGCTTGGC<u>A</u>CCGCCCTTGC | 20737 |
| baak30m11 | CTACGCCTA<u>C</u>TAATGTTCCAT<br>CTACGCCTA<u>C</u>CAATGTTCCAT | 20738 |
| baak30m11 | TGTTCCATCC<u>A</u>TTCATTCTTG<br>TGTTCCATCC<u>G</u>TTCATTCTTG | 20739 |
| baak30m11 | GTACAATTGT<u>T</u>TGGATCAGTG<br>GTACAATTGT<u>G</u>TGGATCAGTG | 20740 |
| bast146f1012 | TGCAGCCCAA<u>T</u>GTTTGGCATC<br>TGCAGCCCAA<u>G</u>GTTTGGCATC | 20741 |
| bast146f1012 | ACACTCATCA<u>C</u>CCCTACCGACA<br>ACACTCATCA<u>C</u>AACCTACCGACA | 20742 |
| bags3e06 | TCCCAAAGAA<u>G</u>AAGAGGGCCT<br>TCCCAAAGAA<u>A</u>AAGAGGGCCT | 20743 |
| bags3e06 | ATATGACACA<u>T</u>TAGGCATCAC<br>ATATGACACA<u>C</u>TAGGCATCAC | 20744 |
| baak46o19 | CAATGCTCAC<u>T</u>TTATCTATGT<br>CAATGCTCAC<u>C</u>TTATCTATGT | 20749 |
| baak46o19 | GCAGCTGCAG<u>C</u>AAGCCATCTT<br>GCAGCTGCAG-AAGCCATCTT | 20750<br>20751 |
| baak46o19 | GTACCCTTTT<u>N</u>CATATGTTGG<br>GTACCCTTTT<u>C</u>CATATGTTGG | 20752 |
| basd3c19 | ACGACAATGG<u>C</u>AACCAACTTT<br>ACGACAATGG<u>G</u>AACCAACTTT | 20753 |
| basd3c19 | GAATCAATGG<u>G</u>AACCAACTTT<br>GAATCAATGG<u>T</u>AACCAACTTT | 20754 |
| bags30f01 | CATCACCATC<u>G</u>TCACTCCCTG<br>CATCACCATC<u>A</u>TCACTCCCTG | 20755 |

TABLE 26-18

| Clones | Haruna Nijo H602 | SEQ ID NO: |
|---|---|---|
| bags30f01 | CCTCAGGGTCGTCGTCCTCAT<br>CCTCAGGGTC<u>A</u>TCGTCCTCAT | 20756 |
| bags32d08 | CAACAGGGGC<u>C</u>TGATCCCCAC<br>CAACAGGGGC<u>A</u>TGATCCCCAC | 20758 |
| bags32d08 | ATCATCGGT<u>T</u>TGTCATAAACT<br>ATCATCGGT<u>T</u>CGTCATAAACT | 20759 |
| BaAK23M23 | GCACGCCACA<u>C</u>AGTCCATATG<br>GCACGCCACA<u>G</u>AGTCCATATG | 20760 |
| BaAK23M23 | GGCTCATCAC<u>A</u>CACAGGATAC<br>GGCTCATCAC<u>G</u>CACAGGATAC | 20761 |
| bah21a16 | GGTGCTCCTC<u>T</u>GACCACCACG<br>GGTGCTCCTC<u>C</u>GACCACCACG | 20762 |
| baal3m08 | GGCTCATCACACACAGGATAC<br>GGCTCATCACGCACAGGATAC | 20763 |
| BaAK21I09 | TATTTGAATC<u>G</u>CAAACAAACA<br>TATTTGAATC<u>A</u>CAAACAAACA | 20764 |
| baet33a0301 | GCCGGCATGA<u>G</u>AAGCTTCCCC<br>GCCGGCATGA<u>A</u>AAGCTTCCCC | 20765 |
| baet33a0301 | TATTGAAATTCTAAAAATGTG<br>TATTGAAATT<u>T</u>TAAAAATGTG | 20766 |
| baet33a0301 | CCGCTTATT<u>T</u>ATTTTTTCTCC<br>CCGCTTATT<u>T</u>TTTTTTTCTCC | 20767 |
| baet33a0301 | ACACACAAAC<u>G</u>AGTGCCGGTT<br>ACACACAAAC<u>A</u>AGTGCCGGTT | 20768 |
| baet33a0301 | TGGCCATGAC<u>G</u>ATGTTATCGG<br>TGGCCATGAC<u>A</u>ATGTTATCGG | 20769 |
| baet33a0301 | TCAGTCTTCAGAGCGCGGCTT<br>TCAGTCTTCA<u>A</u>AGCGCGGCTT | 20770 |
| baet33a0301 | TCTCCTCCAC<u>G</u>AACTTGTCCA<br>TCTCCTCCAC<u>A</u>AACTTGTCCA | 20771 |
| baak24k02 | TCAAATGATT<u>T</u>CTAAACTAAC<br>TCAAATGATT<u>C</u>CTAAACTAAC | 20772 |
| baak24k02 | TGCCATGCTC<u>G</u>CTGAACAGCT<br>TGCCATGCTC<u>A</u>CTGAACAGCT | 20773 |
| bast75d1208 | GTGTGGCAGC<u>A</u>GCACTGGAGG<br>GTGTGGCAGC<u>G</u>GCACTGGAGG | 20775 |
| bag34f06 | ACATTATGGT<u>G</u>TGCCGGCAAC<br>ACATTATGGT<u>A</u>TGCCGGCAAC | 20776 |
| bags34f06 | GTGTGGCAGCGGCACTGGAGG<br>GTGTGGCAGCAGCACTGGAGG | 20777 |
| bags6f09 | CACCGTGCCT<u>C</u>ATTGTACACT<br>CACCGTGCCT<u>G</u>ATTGTACACT | 20778 |
| bags6f09 | AGGGCCTCTA<u>T</u>TATGGCATCT<br>AGGGCCTCTA<u>C</u>TATGGCATCT | 20779 |
| bags6f09 | ACAGAAAAGA<u>C</u>AATCAGCCTT<br>ACAGAAAAGA<u>T</u>AATCAGCCTT | 20780 |
| bags6f09 | TCTTCTCTCA<u>A</u>AGAACTGCCA<br>TCTTCTCTCA<u>G</u>AGAACTGCCA | 20781 |
| bags6f09 | TCTGATAGCT<u>T</u>AAAAAATGTA<br>TCTGATAGCT<u>G</u>AAAAAATGTA | 20782 |

TABLE 26-19

| Clones | Haruna Nijo H602 | SEQ ID NO: |
|---|---|---|
| bags6f09 | TCAAAGACATCGAGCCTTGTT<br>TCAAAGACATAGAGCCTTGTT | 20783 |
| bags7b10 | GAGATTCTTGTGATCCCCTCT<br>GAGATTCTTGCGATCCCCTCT | 20784 |
| bags7b10 | TGATTAAACAAAATATCAGTA<br>TGATTAAACAGAATATCAGTA | 20785 |
| bags7b10 | AAAGTTTCCATAATAACAACA<br>AAAGTTTCCACAATAACAACA | 20786 |
| bags7b10 | TCTACAAAGTTCACTATCCAT<br>TCTACAAAGTCCACTATCCAT | 20787 |
| bags7b10 | GTGGCTAATCCCTAATCCTGC<br>GTGGCTAATCACTAATCCTGC | 20788 |
| bags37e01 | AGCTCTGGGGTGCAGATTTCC<br>AGCTCTGGGGCGCAGATTTCC | 20791 |
| bags37e01 | GTCATTCATCTTCTCTTTTGA<br>GTCATTCATCCTCTCTTTTGA | 20792 |
| BaGS24M06 | GTTTGCCGACCATACCTCTTG<br>GTTTGCCGACAATACCTCTTG | 20794 |
| BaGS24M06 | CGTCATCCTCATCATCGTCGG<br>CGTCATCCTCGTCATCGTCGG | 20795 |
| BaGS24M06 | ACCTTCTTGTGAACTGCTTCC<br>ACCTTCTTGTAAACTGCTTCC | 20796 |
| BaGS24M06 | GCTAACAACAGGGTTGAAACA<br>GCTAACAACAAGGTTGAAACA | 20797 |
| bags22m23 | AATGCCTAGCAATCAGAATCA<br>AATGCCTAGCCATCAGAATCA | 20798 |
| bags22m23 | TCTGCAAGAATTGTATTTCTA<br>TCTGCAAGAACTGTATTTCTA | 20799 |
| bags22m23 | TTAAGTTCCGTAAAAATGTAC<br>TTAAGTTCCGCAAAAATGTAC | 20800 |
| bags22m23 | TGGCTGGCGTTTGACATATCC<br>TGGCTGGCGTCTGACATATCC | 20801 |
| bags22 m23 | CCCATGAAAGCAGCTCCAGTC<br>CCCATGAAAGAAGCTCCAGTC | 20802 |
| basd18d18 | AGTAAATGCAGACTTCTGATA<br>AGTAAATGCAAACTTCTGATA | 20803 |
| basd18d18 | GCATTAAGCACACCTCTCCCG<br>GCATTAAGCAAACCTCTCCCG | 20804 |
| basd18d18 | GGATTAGCAACCGAACACGAT<br>GGATTAGCAAGCGAACACGAT | 20805 |
| bast106F0212 | CCAGATCATCGACTTCAGCGG<br>CCAGATCATCAACTTCAGCGG | 20806 |
| BaH49O16 | TACTAGTTTTGTATATAAAAC<br>TACTAGTTTTTTATATAAAAC | 20807 |
| BaH49O16 | ATATAAACGTTCACGTAGCA<br>ATATAAACGGTCACGTAGCA | 20808 |
| BaH49O16 | AGGTCATTGCGCGGCCCTTCG<br>AGGTCATTGCACGGCCCTTCG | 20809 |
| BaH38 N06 | TTGAGACGGAGGAAGTATTAC<br>TTGAGACGGATGAAGTATTAC | 20811 |

TABLE 26-20

| Clones | Haruna Nijo H602 | SEQ ID NO: |
|---|---|---|
| BaH38N06 | ACTTATATAGCACTCCCTCCG<br>ACTTATATAGTACTCCCTCCG | 20812 |
| bah56p16 | AACTGAAAACTCCAGCCTTCC<br>AACTGAAAACCCCAGCCTTCC | 20813 |
| basd13o13 | ACTGTGATGGCTCAGCAGCCT<br>ACTGTGATGGTTCAGCAGCCT | 20814 |
| bah34f11 | TCATACGACCCGACACCTAAA<br>TCATACGACCTGACACCTAAA | 20816 |
| bags37g04 | TTGCTCTTACAATCGTATTTA<br>TTGCTCTTACTATCGTATTTA | 20817 |
| bags37g04 | CGAGCTGCTTCGTCCAGTCGA<br>CGAGCTGCTTAGTCCAGTCGA | 20818 |
| baak43o03 | CGGGGATGATGTAGTCTTTAT<br>CGGGGATGATATAGTCTTTAT | 20820 |
| BaAL4J21 | GGCAATGCTGTTCTTTGTAGT<br>GGCAATGCTGCTCTTTGTAGT | 20821 |
| BaH51J22 | GCCCAGACGTCCCCCAACACG<br>GCCCAGACGTTCCCCAACACG | 20822 |
| BaH51J22 | TTTTATCTGGGGAAGGATAAA<br>TTTTATCTGGAGAAGGATAAA | 20823 |
| BaH51J22 | CTGAGCTGAAAGTGCAGCAGC<br>CTGAGCTGAAGGTGCAGCAGC | 20824 |
| BaH51J22 | GTTCCTTGGTAGTCAATCGTC<br>GTTCCTTGGTCGTCAATCGTC | 20825 |
| bah58l03 | TAGCACCAACGCGGCCATTCG<br>TAGCACCAACACGGCCATTCG | 20826 |
| BaGS21M18 | TCAGGTTGTCACCGAACGTCT<br>TCAGGTTGTCGCCGAACGTCT | 20827 |
| bags31k06 | AAAGATCTGGAGGCGAGGCTC<br>AAAGATCTGGGGGCGAGGCTC | 20828 |
| bags31k06 | TAGTATAGCCACACTACTGAC<br>TAGTATAGCCCCACTACTGAC | 20829 |
| bags31k06 | TGTCCCTTGCAAAGCAGGCTG<br>TGTCCCTTGCGAAGCAGGCTG | 20830 |
| bags31k06 | GGACACCACACAGAGTTAGAT<br>GGACACCACAGAGAGTTAGAT | 20831 |
| baal4o01*VRN 2(sh2) | CTCTCGCCTGCCGCCGCTGGG<br>CTCTCGCCTGTCGCCGCTGGG | 20832 |
| baal4o01*VRN 2(sh2) | ACACCAATTCAAAAGATGGTT<br>ACACCAATTCGAAAGATGGTT | 20833 |
| baal4o01*VRN 2(sh2) | CCATCCACAGTGGAAGCGCCG<br>CCATCCACAGGGGAAGCGCCG | 20834 |
| baal4o01*VRN 2(sh2) | ACTACTTTAGTAATCTAAACG<br>ACTACTTTAGCAATCTAAACG | 20835 |
| baal4o01*VRN 2(sh2) | CTGCGACAGGCGGAGCATCCC<br>CTGCGACAGGGGGAGCATCCC | 20836 |
| bah39o04 | CCGTGTAGATACCGTCGCGCT<br>CCGTGTAGATGCCGTCGCGCT | 20837 |
| bah39o04 | CCACGATCTGCCCCTCGGAGA<br>CCACGATCTGGCCCTCGGAGA | 20838 |

TABLE 26-21

| Clones | Haruna Nijo / H602 | SEQ ID NO: |
|---|---|---|
| bah39o04 | GTAGATCACATAAATTTTGTT<br>GTAGATCACACAAATTTTGTT | 20839 |
| bast14h0416 | CATCATGATACATGTCTTGGT<br>CATCATGATATATGTCTTGGT | 20841 |
| bast144H115 | GCCGGCCCGACGGAGCTCGTC<br>GCCGGCCCGATGGAGCTCGTC | 20843 |
| bags23f02 | CGCAGAAACGGCTCTAACAAC<br>CGCAGAAACGACTCTAACAAC | 20849 |
| bast140e1010 | GGTTCAGAACGGTGGAGGATT<br>GGTTCAGAACCGTGGAGGATT | 20850 |
| bah15e16 | CATGGTCAAACCTTTGTGCCC<br>CATGGTCAAAACTTTGTGCCC | 20856 |
| basd27o16 | TCGCTCACCCTGCGGAACATC<br>TCGCTCACCCGGCGGAACATC | 20858 |
| basd27o16 | TCCATCTCGTACATGCCCTCG<br>TCCATCTCGTCCATGCCCTCG | 20859 |
| basd27o16 | ACTCGGCGACAAGGTCGTTCA<br>ACTCGGCGACGAGGTCGTTCA | 20860 |
| bald 27o16 | GAGCGAGCGAATCCGTTGCC<br>GAGCGGAGCGCATCCGTTGCC | 20061 |
| basd27o16 | CATATAGCTGAACGGAGCGGA<br>CATATAGCTGCACGGAGCGGA | 20862 |
| kr66g0713 | TTTATGATCATGAATTTACAA<br>TTTATGATCACGAATTTACAA | 20863 |
| kr66g0713 | TATCTTGAAGGGTCCCAAATT<br>TATCTTGAAGTGTCCCAAATT | 20864 |
| baak46c17 | GAAGCCATGAGTTCATTCATT<br>GAAGCCATGATTTCATTCATT | 20865 |
| baak46c17 | AATACCTTGTCTACAGAGTAC<br>AATACCTTGTTTACAGAGTAC | 20866 |
| baet19C1206 | TACACAAACAGACACAAGGCT<br>TACACAAACAAACACAAGGCT | 20867 |
| BaGS26G20 | GCAATGAACAATGCCAGTGCC<br>GCAATGAACACTGCCAGTGCC | 20870 |
| BaGS26G20 | AGAGGATCTTTTCAGGCACAC<br>AGAGGATCTTCTCAGGCACAC | 20871 |
| bags28c14 | GGCCATCACACGATGAATGCC<br>GGCCATCACAGGATGAATGCC | 20872 |
| bags28c14 | GAATAAAAAGTCTCAGTCCAA<br>GAATAAAAAGGCTCAGTCCAA | 20873 |
| bags28c14 | TGCTCTCTCACTCGGGGTGAT<br>TGCTCTCTCAGTCGGGGTGAT | 20874 |
| kr61g1214 | AAGATTTCGTCGAATAGCCTG<br>AAGATTTCGTTGGATAGCCTG | 20875 |
| kr61g1214 | GATTTCGTCGAATAGCCTGAA<br>GATTTCGTTGGATAGCCTGAA | 20876 |
| bags9g08 | CAAATATATGTGATTGATGCA<br>CAAATATATGGGATTGATGCA | 20877 |
| bags9g08 | TGAAGATGCACATATTACTAA<br>TGAAGATGCAAATATTACTAA | 20878 |

TABLE 26-22

| Clones | Haruna Nijo / H602 | SEQ ID NO: |
|---|---|---|
| bags9g08 | GGGAAAGAGCGGCCAAAAGTT<br>GGGAAAGAGCAGCCAAAAGTT | 20879 |
| bags5p01 | CTGGAGATCAACATGAATGAT<br>CTGGAGATCAGCATGAATGAT | 20880 |
| bags5p01 | AGATATCTGTGTTCTTGACAT<br>AGATATCTGTATTCTTGACAT | 20881 |
| bags5p01 | AGTTTTTTCAAGAGCTGCGAC<br>AGTTTTTTCAGGAGCTGCGAC | 20882 |
| bags5p01 | TGGAAGTTCACATCAAGGACA<br>TGGAAGTTCAAATCAAGGACA | 20883 |
| baal4d04 | CGGGGAAAACAACCGTGAAGT<br>CGGGGAAAACCACCGTGAAGT | 20884 |
| baal4d04 | CACTGGTCCAGGCTCAGCGAG<br>CACTGGTCCAAGCTCAGCGAG | 20885 |
| baal4d04 | GCTCCATGTCCGTGTACTGCG<br>GCTCCATGTCTGTGTACTGCG | 20886 |
| baal4d04 | CAATGTCTATGTCGTAGGCCA<br>CAATGTCTATATCGTAGGCCA | 20887 |
| baal4d04 | GCTGCTGCTGCTGCCTCCGCA<br>GCTGCTGCTGTTGCCTCCGCA | 20888 |
| bah11e02 | CGGGGAAAACAACCGTGAAGT<br>CGGGGAAAACCACCGTGAAGT | |
| bah11e02 | AGAGGTCGTCGGCCTTCCGCT<br>AGAGGTCGTCAGCCTTCCGCT | 20891 |
| bah11e02 | CACTGGTCCAGGCTCAGCGAG<br>CACTGGTCCAAGCTCAGCGAG | 20892 |
| bah11e02 | TCAGTTTGAATATATACCAAA<br>TCAGTTTGAACATATACCAAA | 20893 |
| bast41f0311 | TGCTGTTGCTCTTGTTGGTGT<br>TGTTGTTGCTTTTGTTGGTGT | 20894 |
| bast41f0311 | GCTGTTGTTGCTGTTGCTCTT<br>GCTGTTGTTGTTGTTGCTCTT | 20895 |
| bast154d0307 | CAGACTAGCTCAAATGGTGAA<br>CAGACTAGCTGAAATGGTGAA | 20896 |
| kr33h0816 | GGTAAACTAAACGGGGCATAT<br>GGTAAACTAAGCGGGGCATAT | 20899 |
| kr33h0816 | TTGCCTTGCCGTGCTGTTAGA<br>TTGCCTTGCCTTGCTGTTAGA | 20900 |
| BaH38F16 | GCTCTCATGCTGNGACCTCAA<br>GCTCTCATGCGNNGACCTCAA | 20901 |
| BaGS21P09 | TAAATCAAGCAGACGAGGCTC<br>TAAATCAAGCGGACGAGGCTC | 20902 |
| BaGS21P09 | CGGCAGCCCAGATGTACTCAT<br>CGGCAGCCCACATGTACTCAT | 20903 |
| BaGS21P09 | ATCAGATTCAGGAACAGGTTG<br>ATCAGATTCATGAACAGGTTG | 20904 |
| basd21g02 | GGCGACGGTGACGGCGGTGAT<br>GGCGACGGTGGCGGCGGTGAT | 20909 |
| bah22m17 | TTGTTCATTACACATACTAAC<br>TTGTTCATTATACATACTAAC | 20910 |

TABLE 26-23

| Clones | Haruna Nijo H602 | SEQ ID NO: |
|---|---|---|
| bah22m17 | TCAAGAACCCAACCTGGAGAA<br>TCAAGAACCCGACCTGGAGAA | 20911 |
| bah22m17 | ATCATGCTGCGACGGTCAGCT<br>ATCATGCTGCAACGGTCAGCT | 20912 |
| bah22m17 | TGTTTCCGGTATCTCTGCTGC<br>TGTTTCCGGTGTCTCTGCTGC | 20913 |
| BaGS9H19 | ATTATCACTTTAGTGGATAGT<br>ATTATCACTTAAGTGGATAGT | 20914 |
| BaGS9H19 | ATAGTGAATGAATGCGCAAAG<br>ATAGTGAATGTATGCGCAAAG | 20915 |
| BaGS9H19 | TGAGTGAGTTACTGAGATAAA<br>TGAGTGAGTTGCTGAGATAAA | 20916 |
| bah26m24 | ATTTTGAATTGTTTAAAATAT<br>ATTTTGAATTATTTAAAATAT | 20917 |
| BaH56D01 | AGCCATATCCGTCTGCAGTCA<br>AGCCATATCCATCTGCAGTCA | 20918 |
| BaH56D01 | GCGTACCATACAGGCGAGGCG<br>GCGTACCATATAGGCGAGGCG | 20919 |
| BaH56D01 | GATAATAGCCACCAACAGGAG<br>GATAATAGCCGCCAACAGGAG | 20920 |
| BaH56D01 | GGAGGTACACATGCAAAACCT<br>GGAGGTACACGTGCAAAACCT | 20921 |
| BaH56D01 | CTACACGCTTCCGTGTCAGCG<br>CTACACGCTTTCGTGTCAGCG | 20922 |
| baal9m13 | GTACACCTATGCTACAAGGAC<br>GTACACCTATACTACAAGGAC | 20926 |
| baak21k16 | CCTCNACGGCGCCCATGAGCA<br>CCTCNACGGCACCCATGAGCA | 20927 |
| baak21k16 | CNGGGTCGTCNGCAAGNCCGA<br>CNGGGTCGTCGGCAAGNCCGA | 20928 |
| baak21k16 | CTGGGTATAGNGGGTCAACAA<br>CTGGGTATAGCGGGTCAACAA | 20929 |
| baak21k16 | GAGCTCAGCAGAATGCCTCNG<br>GAGCTCAGCA-AATGCCTCNG | 20930<br>20931 |
| baak21k16 | GTGGTCCTCCGGCAATGCGGT<br>GTGGTCCTCCAGCAATGCGGT | 20932 |
| bags19o14 | ACGGCATGCGGTCAGTGTCTC<br>ACGGCATGCGTTCAGTGTCTC | 20935 |
| bags19o14 | CCTTTGAGTTTGCCATACACT<br>CCTTTGAGTTGGCCATACACT | 20936 |
| baak35m03 | CTACGTATCTATCCTCGTACC<br>CTACGTATCTTTCCTCGTACC | 20937 |
| baak35m03 | TCAGCAGACAATGCGTGTACG<br>TCAGCAGACAGTGCGTGTACG | 20938 |
| baak35m03 | TGCCTCCTCTGGCGAGAGATC<br>TGCCTCCTCTTGCGAGAGATC | 20939 |
| baak35m03 | GTGCATTGTCACCCCGCCTTG<br>GTGCATTGTCACCCCGCCTTG | 20940 |
| baak35m03 | GCTACACTTTTTTGTTACAAA<br>GCTACACTTTGTTGTTACAAA | 20941 |

TABLE 26-24

| Clones | Haruna Nijo H602 | SEQ ID NO: |
|---|---|---|
| baak35m03 | TCCTTACTTAAACATAATGAA<br>TCCTTACTTAGACATAATGAA | 20942 |
| baak33 o23 | GATCATGGACGCAACATAAAC<br>GATCATGGACACAACATAAAC | 20943 |
| kr57F1012 | TACAACATGGTATCGTATCCT<br>TACAACATGGCATCGTATCCT | 20944 |
| bags22l16 | TTTAGCAGACCAAGTGAAGAG<br>TTTAGCAGACAAAGTGAAGAG | 20945 |
| bags22l16 | AAACATCGGCAGTCATGAACT<br>AAACATCGGCGGTCATGAACT | 20946 |
| baet43C0505 | TGTACGATGCATGTTAGAACG<br>TGTACGATGCGTGTTAGAACG | 20947 |
| bastl22E1010 | CCTTGGTCTTATTCGAATATA<br>CCTTGGTCTTCTTCGAATATA | 20949 |
| BaH53N24 | TACAGCAACCAAAGCTGGGCC<br>TACAGCAACCGAAGCTGGGCC | 20950 |
| baal8e24 | GGGGCTCTCATGGATGTCGGT<br>GGGGCTCTCACGGATGTCGGT | 20951 |
| baal8e24 | TCAGTTTCCACTAGAGGCCC<br>TCAGTTTCCCCTAGAGGCCC | 20952 |
| BaH62H21 | AGCTAGGAAGTAAATATGTGT<br>AGCTAGGAAGCAAATATGTGT | 20953 |
| BaH62H21 | GCCGGACCGGATGTGGAAGCC<br>GCCGGACCGGCTGTGGAAGCC | 20954 |
| bah42k01 | TGAAACTTAATTGAGGTAGAC<br>TGAAACTTAACTGAGGTAGAC | 20955 |
| bah42k01 | AGTAAATAAAACAGAATGCCT<br>AGTAAATAAATCAGAATGCCT | 20956 |
| bah42k01 | CATACTGCAGAGCCTATTTTA<br>CATACTGCAGGGCCTATTTTA | 20957 |
| basd26p09 | CCAGTCATCAACTATGTCTAT<br>CCAGTCATCA-CTATGTCTAT | 20958<br>20959 |
| basd26p09 | ATCTATCCACCACCCAGTCAT<br>ATCTATCCAC-ACCCAGTCAT | 20960<br>20961 |
| basd26p09 | GGTCCCGAGAATAGTGCGGAT<br>GGTCCCGAGA-TAGTGCGGAT | 20962<br>20963 |
| bags4p18 | CAGGGTGGCTGTGTCCAGCTT<br>CAGGGTGGCTATGTCCAGCTT | 20964 |
| bags4p18 | AATGAAGATCACTCACAAGAA<br>AATGAAGATCGCTCACAAGAA | 20965 |
| bags4p18 | AACTGAGAAGTATGTTGGTTT<br>AACTGAGAAGCATGTTGGTTT | 20966 |
| bast70d1107 | ACCGGAGAAGCAGCAGCTGCG<br>ACCGGAGAAGAAGCAGCTGCG | 20967 |
| bast70d1107 | CCACTTCACCATTCTAATTAA<br>CCACTTCACCCTTCTAATTAA | 20968 |
| bah26i23 | CCTCGTAATCACGGCTTTCTG<br>CCTCGTAATCGCGGCTTTCTG | 20969 |
| baal39g02 | TCCTTGCTCAGCCTGCCCTTG<br>TCCTTGCTCATCCTGCCCTTG | 20970 |

TABLE 26-25

| Clones | Haruna Nijo / H602 | SEQ ID NO: |
|---|---|---|
| baal39g02 | TTCTGGCCGGTGGTCTTGTCC<br>TTCTGGCCGGAGGTCTTGTCC | 20971 |
| baal39g02 | TTGTCGTTGGTGATGGTGATC<br>TTGTCGTTGGAGATGGTGATC | 20972 |
| baal39g02 | ACTTCTCTGCGTCCTGGACCA<br>ACTTCTCTGCATCCTGGACCA | 20973 |
| baal39g02 | TCATGTTGTAGGCGTAGTTCT<br>TCATGTTGTAAGCGTAGTTCT | 20974 |
| baal39g02 | GAGACGTTCAGGATACCGTTG<br>GAGACGTTCAAGATACCGTTG | 20975 |
| bags22c13 | TCCGTAGCTCGGGCAGGCCAA<br>TCCGTAGCTCAGGCAGGCCAA | 20977 |
| bags22c13 | TCTTATGGCAGAATAAAAATA<br>TCTTATGGCAAAATAAAAATA | 20978 |
| bags22c13 | GGCCAACCAATCTTTGAAGAT<br>GGCCAACCAACCTTTGAAGAT | 20979 |
| baal16h03 | GATCCTCTTCCGAGTTCTGCC<br>GATCCTCTTCTGAGTTCTGCC | 20981 |
| bags18o20 | AGATCTGGCCAAAGCCACCAC<br>AGATCTGGCCGAAGCCACCAC | 20984 |
| bags18o20 | CAACTCGTGATTCGTCAGAA<br>CAACTCGTGACTCTGTCAGAA | 20985 |
| bags19c02 | TTATGCCACACCACACGAATA<br>TTATGCCACATCACACGAATA | 20991 |
| bah52e20 | AGNACCCTAAGCTGATCTTGA<br>AGAACCCTAACCTGATCTTGA | 20992 |
| baal4n05 | TGTCCTCAAA-TCAGATAGAG<br>TGTCCTCAAAATCAGATAGAG | 20993<br>20994 |
| bags7p06 | GTCCTATCCAGCCAGATAAAA<br>GTCCTATCCAACCAGATAAAA | 20995 |
| bast70c0905 | AGATAGATTGCGGGGTTACAG<br>AGATAGATTGGGGGGTTACAG | 20996 |
| basd15j01 | TGTACAAAGTAGGGGAGATGA<br>TGTACAAAGTGGGGGAGATGA | 20997 |
| basd15j01 | TGACCGCCACGATGTACTTGG<br>TGACCGCCACAATGTACTTGG | 20998 |
| BaH56H18 | AACAGAATCAGAAGTTCAGAG<br>AACAGAATCAAAAGTTCAGAG | 20999 |
| BaGS4N04 | GTTTGCAGCCATAGTCCATTC<br>GTTTGCAGCCGTAGTCCATTC | 21000 |
| bags31o13 | TTGTGCAAAGGAAGGACAACT<br>TTGTGCAAAGCAAGGACAACT | 21001 |
| bags31o13 | ACTAGCGGGTTGCTACACCGG<br>ACTAGCGGGTCGCTACACCGG | 21002 |
| bags31o13 | GCTAACTATATCATACAAGAG<br>GCTAACTATAGCATACAAGAG | 21003 |
| bags31o13 | CCGACGTCGTCGGCGGAGGA<br>CCGACGTCGTTGGCGGAGGA | 21004 |
| bags7h14 | TTGTTCATTACTTAATTGTTA<br>TTGTTCATTAGTTAATTGTTA | 21006 |

TABLE 26-26

| Clones | Haruna Nijo / H602 | SEQ ID NO: |
|---|---|---|
| bags7h14 | CCACGGCCGGAAGTGGCCGAT<br>CCACGGCCGGCAGTGGCCGAT | 21007 |
| bags7h14 | ACTGTGGGACGATGCCCTCCT<br>ACTGTGGGACAATGCCCTCCT | 21008 |
| bags7h14 | ATTGAGGGGAAAACGATCCG<br>ATTGAGGGGGAAAACGATCCG | 21009 |
| bags7h14 | GTATGGCCGCGCCACTCGACG<br>GTATGGCCGCCCCACTCGACG | 21010 |
| bags5n14 | CACACTGGGGAAAGGCCTGGC<br>CACACTGGGGGAAGGCCTGGC | 21011 |
| bags5n14 | CCGTCACAAGCGTCGCAGACT<br>CCGTCACAAGAGTCGCAGACT | 21012 |
| bast132h0816 | CGCACCCAGAGCGAGATGCC<br>CGCACCCAGATGCGAGATGCC | 21013 |
| bast132h0816 | GTGCTGCCACTCAAGGCTAGC<br>GTGCTGCCACCCAAGGCTAGC | 21014 |
| bast132h0816 | GCCAGCAAAGGTTAGATACAT<br>GCCAGCAAAGATTAGATACAT | 21015 |
| baak31p06 | AAACAGAGGCTGATTTTTGT<br>AAACAGAGGC-GATTTTTGT | 21016<br>21017 |
| baak31p06 | TTGGTAAGACGTGCTGCTTAT<br>TTGGTAAGACATGCTGCTTAT | 21018 |
| baak44j08 | TGATGGTATTGTTGCTCCCCG<br>TGATGGTATTATTGCTCCCCG | 21021 |
| baak44j08 | TGTGGAAGCTTCCGGATACAT<br>TGTGGAAGCTCCCGGATACAT | 21022 |
| baak18g16 | CTGATATCCGGCTCAGCTCGT<br>CTGATATCCGACTCAGCTCGT | 21023 |
| baak18g16 | TGAACATCGGGGATGCCTGCT<br>TGAACATCGGTGATGCCTGCT | 21024 |
| baak18g16 | CGCGCCGCTAGACGCGAAGCA<br>CGCGCCGCTACACGCGAAGCA | 21025 |
| baak18g16 | CCTTGGAGCACCTTTGAAGCC<br>CCTTGGAGCATCTTTGAAGCC | 21026 |
| baak11a11 | GCCCACCAAGTAATTGTGAGC<br>GCCCACCAAGCAATTGTGAGC | 21027 |
| baal9n02 | ACTCCAGAGGGGCTCGCCCTT<br>ACTCCAGAGGTGCTCGCCCTT | 21029 |
| baal9n02 | GCGAGAAAGAAAAGGTGTTTC<br>GCGAGAAAGACAAGGTGTTTC | 21030 |
| baal9n02 | GCGGGCTCAGGGAACGCGTCC<br>GCGGGCTCAGTGAACGCGTCC | 21031 |
| baal9n02 | ATGAGCTACGTGCGGGCTGGC<br>ATGAGCTACGGGCGGGCTGGC | 21032 |
| baal9n02 | ACTCCGGGGAGACATGGAATA<br>ACTCCGGGGAAACATGGAATA | 21033 |
| bags20f08 | AGGAAACAGCGAGCTCAGGCT<br>AGGAAACAGCAAGCTCAGGCT | 21034 |
| bags20f08 | AATACTAAACGACACAAAGA<br>AATACTAAATGACACAAAGA | 21035 |

TABLE 26-27

| Clones | Haruna Nijo H602 | SEQ ID NO: |
|---|---|---|
| bags20f08 | GGAATATGCAATAACATATAC<br>GGAATATGCAGTAACATATAC | 21036 |
| bags9c24 | ACAGCAGTTGCATCAGTGGAT<br>ACAGCAGTTGGATCAGTGGAT | 21037 |
| BaGS22O02 | TGTCCTTCTCCGCCAGCACAG<br>TGTCCTTCTCTGCCAGCACAG | 21038 |
| BaGS22O02 | CCAGCACGCCGAAGAAGATGG<br>CCAGCACGCCAAAGAAGATGG | 21039 |
| BaGS22O02 | CGCCGGGACCTTCCTCTCTCA<br>CGCCGGGACCATCCTCTCTCA | 21040 |
| bah41b17 | AGGTCATGAATGTAATCACAG<br>AGGTCATGAACGTAATCACAG | 21042 |
| bah41b17 | TAGTCTCTGCAGGCCTGATGT<br>TAGTCTCTGCGGGCCTGATGT | 21043 |
| bah63m11 | AAATAGACGGCTGAAATTAAT<br>AAATAGACGGGTGAAATTAAT | 21044 |
| bags28p07 | TTTTTCATGCTCCATGCCCTT<br>TTTTTCATGCACCATGCCCTT | 21045 |
| bags28p07 | CTTTCAATCATACGACTGACT<br>CTTTCAATCACACGACTGACT | 21046 |
| bast03d0408 | AAGCAGATTCCTTCATTAGCC<br>AAGCAGATTCTTTCATTAGCC | 21049 |
| baal17g06 | CAAACTGGTTTCCGAAGAGCC<br>CAAACTGGTTCCCGAAGAGCC | 21050 |
| baal17g06 | AGACCCTTGCCACGCCGCCGG<br>AGACCCTTGCGACGCCGCCGG | 21051 |
| baal17g06 | ACAGTACAACTTATTATCCAC<br>ACAGTACAACGTATTATCCAC | 21052 |
| baal17g06 | ACACAAATACCTACTAGTACA<br>ACACAAATACATACTAGTACA | 21053 |
| bags4p17 | GCATCCGTTGTTGGAGTCGCA<br>GCATCCGTTGCTGGAGTCGCA | 21055 |
| bags4p17 | GGCGGCCGCCCCCGTACCAGC<br>GGCGGCCGCCTCCGTACCAGC | 21056 |
| bags4p17 | ATCATCTTCCAGCACCGGCGG<br>ATCATCTTCCCGCACCGGCGG | 21057 |
| bags4p17 | CTGCTCGCTGCTGATGCGGAT<br>CTGCTCGCTGGTGATGCGGAT | 21058 |
| bags4p17 | GTGTTGAGCCCGAGAGCCTTC<br>GTGTTGAGCCTGAGAGCCTTC | 21059 |
| bags4p17 | CGGGGACCTCGCCGATGTCGG<br>CGGGGACCTCCCCGATGTCGG | 21060 |
| bags4p17 | GTCCACGATGTTGTCCTTGCA<br>GTCCACGATGCTGTCCTTGCA | 21061 |
| baal31o21 | AGGGGTAGGAGAAAATGATGC<br>AGGGGTAGGAAAAAATGATGC | 21062 |
| baal31o21 | CCATGCCACAGGAGATAGACA<br>CCATGCCACAAGAGATAGACA | 21063 |
| baal31o21 | GGTGGTCCGCAGTGGCTGGCT<br>GGTGGTCCGCGGTGGCTGGCT | 21064 |

TABLE 26-28

| Clones | Haruna Nijo H602 | SEQ ID NO: |
|---|---|---|
| bags4d11 | TCTTCTTCCCAAATTTCAGCA<br>TCTTCTTCCCGAATTTCAGCA | 21068 |
| basd13n18 | AGATAATCAATAAACAAAGTG<br>AGATAATCAACAAACAAAGTG | 21067 |
| basd0a08 | AGACCCTTGCGACGCCGCCGG<br>AGACCCTTGCCACGCCGCCGG | 21068 |
| basd0a08 | ACAGTACAACGTATTATCCAC<br>ACAGTACAACTTATTATCCAC | 21069 |
| basd0a08 | CAAACTGGTTCCCGAAGAGCC<br>CAAACTGGTTTCCGAAGAGCC | 21070 |
| basd0a08 | ACACAAATACGTACTAGTACA<br>ACACAAATACCTACTAGTACA | 21071 |
| bags32p24 | CTTAAACATACGCATCATATG<br>CTTAAACATATGCATCATATG | 21072 |
| kr06h0315 | ACCANACTCTCCTGAGCAGAC<br>ACCAGACTCTGCTGAGCAGAC | 21074 |
| baal26b09 | GACCGAGACCGTGTCCGTGTC<br>GACCGAGACCATGTCCGTGTC | 21075 |
| kr32c1105 | TATACACATACGAGTAGGATT<br>TATACACATAGGAGTAGGATT | 21076 |
| kr32c1105 | TTGTGGTTGTCGTTGTAGGTA<br>TTGTGGTTGTGGTTGTAGGTA | 21077 |
| kr32c1105 | ACTTTCTTTCTTTCTTTCTTT<br>ACTTTCTTTCCTTCTTTCTTT | 21078 |
| bah53b15 | ATTGCCAGAGGCAGAAATGCA<br>ATTGCCAGAGACAGAAATGCA | 21079 |
| bags13h04 | CAAGCCCTGCGTCAACGACAA<br>CAAGCCCTGCATCAACGACAA | 21080 |
| baal15i11 | AACCACCCTGAAAGAAAACTC<br>AACCACCCTGGAAGAAAACTO | 21081 |

TABLE 27-1

| Clones | Haruna Nijo H602 | SEQ ID NO: |
|---|---|---|
| BaH30E11 | TTCTTGGCCTCGGATTCGGAC<br>TTCTTGGCCTTGGATTCGGAC | 21084 |
| BaH30E11 | GGAATAATCCCCCTCATAACA<br>GGAATAATCCACCTCATAACA | 21085 |
| BaH59J05 | ATTACAGTTTTTTCGTCTACG<br>ATTACAGTTTCTTCGTCTACG | 21086 |
| BaH59J05 | AAAACATGGGAACTACATATA<br>AAAACATGGGCACTACATATA | 21087 |
| BaAL39O22 | AGTTGCGGCAGCGGCAATATG<br>AGTTGCGGCATCGGCAATATG | 21088 |
| BaAL39O22 | AACAGGCGTTTTCTGGTTAGT<br>AACAGGCGTTGTCTGGTTAGT | 21089 |
| BaAL39O22 | ATTCCAGACAAACATTTTTAT<br>ATTCCAGACACACATTTTTAT | 21090 |
| BaAL39O22 | GCCGGGAATACAACCATCAG<br>GCCGGGAATGCAACCATCAG | 21091 |

TABLE 27-1-continued

| Clones | Haruna Nijo H602 | SEQ ID NO: |
|---|---|---|
| baal16i24 | ATCCATCATGGCAGCTCATAC<br>ATCCATCATGCCAGCTCATAC | 21092 |
| baak43j24 | GCCAGTTGATCCCTGCCAACA<br>GCCAGTTGATGCCTGCCAACA | 21097 |
| baak43j24 | CCACACTGAAATTCATACCTC<br>CCACACTGAATTTCATACCTC | 21098 |
| bags3m02 | GCGCAGCACCACCGGACCCGA<br>GCGCAGCACCGCCGGACCCGA | 21109 |
| bags3m02 | CTTCTCTCTCTTCCCTTCCTT<br>CTTCTCTCTCCTCCCTTCCTT | 21110 |
| baal36l08 | ACCTACCACCAATCGCAAAGC<br>ACCTACCACCCATCGCAAAGC | 21111 |
| baal36l08 | CAGCTCTTCGCCATCAAGCAC<br>CAGCTCTTCGGCATCAAGCAC | 21112 |
| baet19e0309 | TTACAGTGACCCGGGCGCCGG<br>TTACAGTGACACGGGCGCCGG | 21113 |
| bast48d0307 | CCATGTAGGCGCCCGGTCTCC<br>CCATGTAGGCACCCGGTCTCC | 21114 |
| kr55D0707 | GGTTGACCGGCGCTGGTGGAA<br>GGTTGACCGGTGCTGGTGGAA | 21115 |
| kr55D0707 | CTGCCAGCGCCGACGCCACGG<br>CTGCCAGCGCAGACGCCACGG | 21116 |
| BaGS24F04 | TAACTAACCACAAGACTGCTC<br>TAACTAACCAAAAGACTGCTC | 21119 |
| BaGS24F04 | GGCGACTTGGTCTCCTTCTCG<br>GGCGACTTGGCCTCCTTCTCG | 21120 |
| bags26p07 | TCTCCCGGGAGGTGATGGTGG<br>TCTCCCGGGACGTGATGGTGG | 21122 |
| bags26p07 | CGTGCTTGGCGAGCTCGCCGG<br>CGTGCTTGGCCAGCTCGCCGG | 21123 |
| bags12f11 | TGGCCTTCCCGTCCAGCGGT<br>TGGCCTTCCCATCCAGCGGT | 21124 |
| bags20o14 | CTAAAGAACAGAATTATTCAC<br>CTAAAGAACAAAATTATTCAC | 21127 |

TABLE 27-2

| Clones | Haruna Nijo H602 | SEQ ID NO: |
|---|---|---|
| bags20o14 | CATGGAAAGAGATATGCATAT<br>CATGGAAAGAAATATGCATAT | 21128 |
| bags20o14 | AAATGGGGTTGTTAATGACGG<br>AAATGGGGTTCTTAATGACGG | 21129 |
| bags20o14 | AAAACTATCATGGGCACTGAC<br>AAAACTATCAGGGGCACTGAC | 21130 |
| bags20o14 | GCACTGACCAGCTTGCTTGAC<br>GCACTGACCATCTTGCTTGAC | 21131 |
| bags20o14 | TCTGTGGAAGCTGGTCTTCAC<br>TCTGTGGAAGTTGGTCTTCAC | 21132 |
| baak36d08 | GGAAGACGGCAGGGTGGAATG<br>GGAAGACGGCGGGGTGGAATG | 21133 |

TABLE 27-2-continued

| Clones | Haruna Nijo H602 | SEQ ID NO: |
|---|---|---|
| baak36d08 | TGGCGGTTGGAGGCAACCAGT<br>TGGCGGTTGGGGGCAACCAGT | 21134 |
| bast75h0616 | ATATATTTTCCAAGCAAGAGG<br>ATATATTTTCAAAGCAAGAGG | 21135 |
| bast75h0616 | TGGCGGTTGGGGGCAACCAGT<br>TGGCGGTTGGAGGCAACCAGT | 21136 |
| basd16g17 | CTAGCCGCCTTGCAGCCCCAC<br>CTAGCCGCCTCGCAGCCCCAC | 21137 |
| BaH21K13 | AACAAATTTCCGTACACAACA<br>AACAAATTTCTGTACACAACA | 21143 |
| BaH21K13 | AAGAGAGGAGACAACAAATTT<br>AAGAGAGGAGGCAACAAATTT | 21144 |
| baak14j02 | ACAGCCTTACATCGGGGAACT<br>ACAGCCTTACGTCGGGGAACT | 21145 |
| baak14j02 | TGAAGCCGACGGTTCTGTCCA<br>TGAAGCCGACCGTTCTGTCCA | 21146 |
| bah22c08 | CCACTCCCATGGTTAAATGTA<br>CCACTCCCATAGTTAAATGTA | 21147 |
| bah22c08 | TTCTGTGTTAAAGCTTCTTAC<br>TTCTGTGTTACAGCTTCTTAC | 21148 |
| bah22c08 | AAATGTAATACGAAATAATGA<br>AAATGTAATATGAAATAATGA | 21149 |
| bah22c08 | CCACATACCCTATCCAGAACA<br>CCACATACCCGATCCAGAACA | 21150 |
| bah22c08 | CTTATAAAAGGAAAACTCATA<br>CTTATAAAAGAAAAACTCATA | 21151 |
| bah22c08 | TCACCTTGATCTCAAGAATGT<br>TCACCTTGATTTCAAGAATGT | 21152 |
| bah22c08 | ATATCATTCGTGGGCACAAAA<br>ATATCATTCGCGGGCACAAAA | 21153 |
| bah12n12 | TGGGCGTCTTGAAGTACAAAT<br>TGGGCGTCTTAAAGTACAAAT | 21157 |
| baak32l04 | ATTCATAACAGGAGCATCCTT<br>ATTCATAACAAGAGCATCCTT | 21161 |
| baak32l04 | CATGCTGGGC-GGGAAGGCCC<br>CATGCTGGGCAGGGAAGGCCC | 21162<br>21163 |
| baak32l04 | CCCTCCGCGTCGCCACCGGGG<br>CCCTCCGCGTTGCCACCGGGG | 21164 |

TABLE 27-3

| Clones | Haruna Nijo H602 | SEQ ID NO: |
|---|---|---|
| baak32l04 | TCTGCCCTTCGCCGTAGCCAA<br>TCTGCCCTTCTCCGTAGCCAA | 21165 |
| BaAL7C19 | GTACCTTGGATATGGTGAGGG<br>GTACCTTGGAGATGGTGAGGG | 21167 |
| BaAL7C19 | GGAGTAGTAGATAGACAAGAT<br>GGAGTAGTAGGTAGACAAGAT | 21168 |
| BaAK23F04 | CTCCATCGCTTGCTTCGAGCC<br>CTCCATCGCTCGCTTCGAGCC | 21169 |

TABLE 27-3-continued

| Clones | Haruna Nijo H602 | SEQ ID NO: |
|---|---|---|
| basd0g08 | ATATATCTCCGAGCACCCCTT<br>ATATATCTCCAAGCACCCCTT | 21171 |
| basd0g08 | GAACTGTACAGTACTCCTGGT<br>GAACTGTACATTACTCCTGGT | 21172 |
| basd0g08 | GTTGCCCGTCCCAGGAGAAGC<br>GTTGCCCGTCTCAGGAGAAGC | 21173 |
| basd0g08 | TCAATATGGATTTGCCCTGTG<br>TCAATATGGACTTGCCCTGTG | 21174 |
| baal21b21 | CGACGACGACTACGACGGGCG<br>CGACGACGACGACGACGGGCG | 21176 |
| baal21b21 | GACCGACGACGCGACAGGGGA<br>GACCGACGACACGACAGGGGA | 21177 |
| baal21b21 | CTTGGAGCAGGTGCCGCTGCG<br>CTTGGAGCAGATGCCGCTGCG | 21178 |
| bags30e05 | ACTGTGTACTACATTGTTTCT<br>ACTGTGTACTGCATTGTTTCT | 21179 |
| bags30e05 | CTTGCACACTGCAAAGAACTG<br>CTTGCACACTACAAAGAACTG | 21180 |
| bags30e05 | AGCCATTACTGTAAACTCACC<br>AGCCATTACTTTAAACTCACC | 21181 |
| bags30e05 | GTCGAACAAGACTGGGCCGTC<br>GTCGAACAAGGCTGGGCCGTC | 21182 |
| bags30e05 | ACTTCCCTCCGGTAAGATAAA<br>ACTTCCCTCCCGTAAGATAAA | 21183 |
| bags30e05 | CATGGATGAGAACTTGCACAC<br>CATGGATGAGGACTTGCACAC | 21184 |
| bals30e05 | GGCAAATGTGTCTGACAGCCA<br>GGCAAATGTGCCTGACAGCCA | 21185 |
| baak13g04 | CACTGACACCGTCCGATCCAG<br>CACTGACACCCTCCGATCCAG | 21186 |
| bags9a04 | GCCCTTCCTTGTGGCCCATCC<br>GCCCTTCCTTATGGCCCATCC | 21187 |
| bags9a04 | AGTTCCTGTTCGTCGTTGATA<br>AGTTCCTGTTTGTCGTTGATA | 21188 |
| bags9a04 | TCCCCAATCATAAGGATGTGG<br>TCCCCAATCAGAAGGATGTGG | 21189 |
| bags9a04 | TCGCTCCTCTGAACTAGCAAC<br>TCGCTCCTCTAAACTAGCAAC | 21190 |
| bags9a04 | CTGCTAAGCATCAACAAATAA<br>CTGCTAAGCAGCAACAAATAA | 21191 |
| baak23m11 | GGCGAGCACTCGTCCTCTTCA<br>GGCGAGCACTAGTCCTCTTCA | 21193 |

TABLE 27-4

| Clones | Haruna Nijo H602 | SEQ ID NO: |
|---|---|---|
| baak41p21 | TGGAGGAGACCGTGTCAGCAA<br>TGGAGGAGACGGTGTCAGCAA | 21194 |
| baak41p21 | TGTAGATCTCATCAATAAGAG<br>TGTAGATCTCGTCAATAAGAG | 21195 |

TABLE 27-4-continued

| Clones | Haruna Nijo H602 | SEQ ID NO: |
|---|---|---|
| baak26j14 | GGAGTCCCCGACGCAATCTTT<br>GGAGTCCCCGCCGCAATCTTT | 21199 |
| baak26j14 | GTCACCTGTCGGTCACTCTGT<br>GTCACCTGTCAGTCACTCTGT | 21200 |
| BaAK37E04 | CGAAGAATGAAGGGGGGAAAA<br>CGAAGAATGATGGGGGGAAAA | 21204 |
| BaAK37E04 | GTGTTCATCTTAAAACAACAC<br>GTGTTCATCTAAAAACAACAC | 21205 |
| BaAK37E04 | CCTTCCTATGACTTCTCGGAT<br>CCTTCCTATGGCTTCTCGGAT | 21206 |
| bast131A0901 | TAGAAACCAACTGGCGAGTTT<br>TAGAAACCAATTGGCGAGTTT | 21210 |
| bah48o03 | CGCAGCAGTCTGCTATCGCGC<br>CGCAGCAGTCGGCTATCGCGC | 21211 |
| bah48o03 | TCGCGCCGTAAGCCTCGGTGC<br>TCGCGCCGTAGGCCTCGGTGC | 21212 |
| bah48o03 | GATCAGTAAGCAGGAAGAAGC<br>GATCAGTAAGTAGGAAGAAGC | 21213 |
| bah20k22 | TATAGGGAACACATTTTCCGT<br>TATAGGGAACGCATTTTCCGT | 21214 |
| bah47a17 | TGCCTCACCATGTGACCAGCC<br>TGCCTCACCAGGTGACCAGCC | 21217 |
| BaH56C11 | TGTCATCCTTTTCATCCTCCT<br>TGTCATCCTTCTCATCCTCCT | 21218 |
| basd15e10 | TGAGCACAACCTGGCATGCCC<br>TGAGCACAACTTGGCATGCCC | 21219 |
| BaH18C17 | GAAGTGTTGTCAACTTCAAAG<br>GAAGTGTTGTAAACTTCAAAG | 21220 |
| BaH18C17 | TTACACCTTTTACCGTCTGAG<br>TTACACCTTTCACCGTCTGAG | 21221 |
| BaH18C17 | CAGCATCTCCTGATGGACAGA<br>CAGCATCTCCAGATGGACAGA | 21222 |
| BaGS20G24 | AAGAATCAGTATATTAGGTGG<br>AAGAATCAGTCTATTAGGTGG | 21223 |
| BaGS20G24 | ATAAAGACCTGGGAAACAAAG<br>ATAAAGACCTAGGAAACAAAG | 21224 |
| bah52h21 | AGCCTCGGGCGTTGCACATGC<br>AGCCTCGGGCATTGCACATGC | 21227 |
| bah52h21 | GGAGGGCCTACCCCGGCCGTG<br>GGAGGGCCTATCCCGGCCGTG | 21228 |
| bah52h21 | AACCACGCTGGCGCTGGAGGG<br>AACCACGCTGACGCTGGAGGG | 21229 |
| bah52h21 | GACGCCACACTATACTGTGTG<br>GACGCCACACGATACTGTGTG | 21230 |
| bah52h21 | GCGGGGGCGGATAGCTGGACC<br>GCGGGGGCGGGTAGCTGGACC | 21231 |

TABLE 27-5

| Clones | Haruna Nijo H602 | SEQ ID NO: |
|---|---|---|
| basd18c12 | ACATCTGGGGGAGCCAAACAG<br>ACATCTGGGGCAGCCAAACAG | 21233 |
| basd18c12 | TCGGCGTTTCATTCGCGTAG<br>TCGGCGTTTCGTTCGCGTAG | 21234 |
| baak23k07 | CAGCTTGACGGCATCAGGCAG<br>CAGCTTGACGACATCAGGCAG | 21235 |
| baak23k07 | AAAAATACACCAGCAGATCTG<br>AAAAATACACAAGCAGATCTG | 21236 |
| BaSD15O17 | ACATCTGACGAGAACAACACA<br>ACATCTGACGGGAACAACACA | 21237 |
| bags16j16 | TAGTACTCTATAGGATTTGAG<br>TAGTACTCTACAGGATTTGAG | 21238 |
| bags16j16 | ATTAGCAGGGTTATCAAATTG<br>ATTAGCAGGGCTATCAAATTG | 21239 |
| bags16j16 | ATAAAGAGAAATTCCTCCAGA<br>ATAAAGAGAATTTCCTCCAGA | 21240 |
| BaGS4N23 | TCGGCAGGTCGTAGTTGATGA<br>TCGGCAGGTCATAGTTGATGA | 21243 |
| basd13i08 | ACTCACTACTGCTGCTCTGCG<br>ACTCACTACTGCTGCTCTGCG | 21246 |
| basd17p01 | ACTCACTACTGCTGCTCTGCG<br>ACTCACTACTACTGCTCTGCG | 21247 |
| baak13d19 | TTACAAGTCAGAGAGAAAATG<br>TTACAAGTCAAAGAGAAAATG | 21248 |
| baak13d19 | ATAGTGTTAAGCATTAACACA<br>ATAGTGTTAAACATTAACACA | 21249 |
| baal3h14 | CACACAAAAGGGGAACCTAGG<br>CACACAAAAGAGGAACCTAGG | 21250 |
| baal3h14 | ATGCAACTAAGATATTGTCAG<br>ATGCAACTAAAATATTGTCAG | 21251 |
| bags33j18 | GCGGTTGCAATGCTCCACGTG<br>GCGGTTGCAACGCTCCACGTG | 21252 |
| baak21n07 | AGCACCTACACTGATCAGTGT<br>AGCACCTACATTGATCAGTGT | 21254 |
| bah53f05 | CATGTATCCAGTTCCATGCTG<br>CATGTATCCACTTCCATGCTG | 21256 |
| bah53f05 | CAAACTATTAGCAAACCTGCA<br>CAAACTATTACCAAACCTGCA | 21257 |
| baak12d02 | CATCGTTCGAGGCAATGACAC<br>CATCGTTCGACGCAATGACAC | 21258 |
| baet01F1212 | CGAACCCGAGCGGGTTGAAGA<br>CGAACCCGAGTGGGTTGAAGA | 21259 |
| bags11h12 | TATGATAGCAAATTGCTTGTA<br>TATGATAGCATATTGCTTGTA | 21260 |
| bags11h12 | GCAACTAGTCTTCTTTATGAT<br>GCAACTAGTCCTCTTTATGAT | 21261 |
| bags11h12 | AATGCTCAGAATTTCCGTAAG<br>AATGCTCAGATTTTCCGTAAG | 21262 |
| bags11h12 | GGCTAGGCCTTGAAGCGCTTG<br>GGCTAGGCCTCGAAGCGCTTG | 21263 |

TABLE 27-6

| Clones | Haruna Nijo H602 | SEQ ID NO: |
|---|---|---|
| baak17l11 | AATGCCACGGTTACTCATTGA<br>AATGCCACGGATACTCATTGA | 21264 |
| baak17l11 | GCCTGGAAAACGCAGTTTTCC<br>GCCTGGAAAAGGCAGTTTTCC | 21265 |
| basd20e17 | GGAGCCAGCGACCGGGAGAGC<br>GGAGCCAGCGGCCGGGAGAGC | 21266 |
| bags30o05 | TTGGAGGAACCTGCGGGTCGA<br>TTGGAGGAACTTGCGGGTCGA | 21267 |
| bags30o05 | AAAGATCGCACGCCACACCAT<br>AAAGATCGCATGCCACACCAT | 21268 |
| bah29p24 | TCTCATACCCTGAACCGTCTT<br>TCTCATACCCCGAACCGTCTT | 21269 |
| kr68d0208 | ATCACTAGTAATGTACATGTT<br>ATCACTAGTAGTGTACATGTT | 21270 |
| bags37l11 | CAGCCATCAACGCAACAAGTG<br>CAGCCATCAATGCAACAAGTG | 21272 |
| bags37l11 | TCATACAGTAGTGTTTTCAAG<br>TCATACAGTAATGTTTTCAAG | 21273 |
| bags37l11 | AACTTCATATGATCGCAAGGT<br>AACTTCATATAATCGCAAGGT | 21274 |
| BaH58I23 | AAAGCAAAGCATTCTTTGAAG<br>AAAGCAAAGCGTTCTTTGAAG | 21275 |
| bags39l04 | GGTCATCCTCGGGGTCTGTCC<br>GGTCATCCTCAGGGTCTGTCC | 21276 |
| bags39l04 | TTCCTCACAATCAGCGCTATG<br>TTCCTCACAAACAGCGCTATG | 21277 |
| bags39l04 | CTTTCCGCTGCAAGGCGGACA<br>CTTTCCGCTGAAAGGCGGACA | 21278 |
| bags39l04 | ATTGAACAGATCGAGTAGAGT<br>ATTGAACAGACCGAGTAGAGT | 21279 |
| bah60p09 | TACACACCAGTGGTCTGAAGA<br>TACACACCAGCGGTCTGAAGA | 21283 |
| bah60p09 | GTTGCCAGAAGATCACAATAA<br>GTTGCCAGAAAATCACAATAA | 21284 |
| bah60p09 | TACCTAGGGGCAGCTTGTTGA<br>TACCTAGGGGTAGCTTGTTGA | 21285 |
| bah22o14 | AGAAGTCTGCGGCAAACCTCA<br>AGAAGTCTGCAGCAAACCTCA | 21289 |
| bah22o14 | GATATTCTTGCGGTTATCTTC<br>GATATTCTTGTGGTTATCTTC | 21290 |
| bah22o14 | TCACGCTGTTTAGGGTAGGCT<br>TCACGCTGTTCAGGGTAGGCT | 21291 |
| bah14l20 | TATATAGTACNCCCTCTGTTC<br>TATATAGTACTCCCTCTGTTC | 21292 |
| bah42p22 | TCCGAAGTGGTTGGCCTTTCA<br>TCCGAAGTGGCTGGCCTTTCA | 21293 |
| bah42p22 | CTTATGCCCAGATTAAAATAC<br>CTTATGCCCACATTAAAATAC | 21294 |
| baak21g03 | CACGTACCCCGTCCTCTTGCT<br>CACGTACCCCATCCTCTTGCT | 21295 |

315

TABLE 27-7

| Clones | Haruna Nijo / H602 | SEQ ID NO: |
|---|---|---|
| baak21g03 | GAATTTTTCAGGTTATATATG<br>GAATTTTTCAAGTTATATATG | 21296 |
| baak21g03 | GCGTGCAGATCATTGAATGTG<br>GCGTGCAGATAATTGAATGTG | 21297 |
| baak21g03 | ATTTAGCACACGATGAAGGGT<br>ATTTAGCACATGATGAAGGGT | 21298 |
| baal35d24 | CTCTCCCGCTGGATAGCGCGC<br>CTCTCCCGCTAGATAGCGCGC | 21299 |
| baal35d24 | AAGAGAGCTGTGGTCATCACG<br>AAGAGAGCTGCGGTCATCACG | 21300 |
| baak45h14 | GGGGACAAGTGGGGTGAGTTT<br>GGGGACAAGTCGGGTGAGTTT | 21301 |
| baak45h14 | GGACCCTGGGTGGGGCTTTG<br>GGACCCTGGCTGGGGCTTTG | 21302 |
| baak45h14 | GCTTTGGGGGCTCCCCTTTCC<br>GCTTTGGGGGGTCCCCTTTCC | 21303 |
| baak45h14 | TTTTTTTTGTCCAAAGGATTT<br>TTTTTTTTGTACAAAGGATTT | 21304 |
| BaAK31P07 | AAACATGACACACCATATATG<br>AAACATGACATACCATATATG | 21305 |
| BaAK31P07 | AAAAATATACTATCACAAATC<br>AAAAATATACAATCACAAATC | 21306 |
| BaAK31P07 | AATCCACAGGTTTTATCTTCG<br>AATCCACAGGGTTTATCTTCG | 21307 |
| bags28o05 | CTTTGTGCACGAGGGCATTAA<br>CTTTGTGCACAAGGGCATTAA | 21308 |
| bah36c06 | CAAGACGCCCGGTCCGGCCAG<br>CAAGACGCCCAGTCCGGCCAG | 21309 |
| bags37h24 | AACTGTCATCGTCAGTCTCAT<br>AACTGTCATCATCAGTCTCAT | 21310 |
| bast65b0303 | AGCAGCAGCAGCAACAACAAC<br>AGCAGCAGCAACAACAACAAC | 21311 |
| BaGS39K23 | ATCTGCGCGCCCGGCCTTTTG<br>ATCTGCGCGCGCGGCCTTTTG | 21312 |
| BaGS39K23 | AAGAACTGACAGAGGACACGA<br>AAGAACTGACGGAGGACACGA | 21313 |
| bah51a22 | TACCCAGTTGCTTCGATGTTT<br>TACCCAGTTGGTTCGATGTTT | 21314 |
| BaH57F12 | CTGCAGGTTGACGGTGCTGGT<br>CTGCAGGTTGTCGGTGCTGGT | 21315 |
| BaH57F12 | TCATCTGAAGGTTCAGTTCCG<br>TCATCTGAAGCTTCAGTTCCG | 21316 |
| BaH57F12 | ATTGTGTGGCGAAACCATCCG<br>ATTGTGTGGCAAAACCATCCG | 21317 |
| basd14o12 | TTATCTACATACCTAGATTTG<br>TTATCTACATCCCTAGATTTG | 21318 |
| basd14o12 | CACCTTTGCATTGGCTCACCA<br>CACCTTTGCAGTGGCTCACCA | 21319 |
| BaAL40N06 | ATCTCCAAACGAACAGCCTCT<br>ATCTCCAAACAAACAGCCTCT | 21321 |

316

TABLE 27-8

| Clones | Haruna Nijo / H602 | SEQ ID NO: |
|---|---|---|
| BaAL40N06 | ACTTGTTTGACAGATTAACTA<br>ACTTGTTTGATAGATTAACTA | 21322 |
| bah11b14 | TTAAAACTAGATAACTGAAAT<br>TTAAAACTAGGTAACTGAAAT | 21323 |
| bah15j14 | AGCACTCCTG-ACTAAAAAGT<br>AGCACTCCTGCACTAAAAAGT | 21324<br>21325 |
| basd21l07 | CAGCAGCTGGCTGTACACCTC<br>CAGCAGCTGGTTGTACACCTC | 21330 |
| bah42d07 | AGAGGTGAAGGACACCGGACG<br>AGAGGTGAAGAACACCGGACG | 21331 |
| bah42d07 | AGCTACCACAGAAGTCCTTTC<br>AGCTACCACAAAAGTCCTTTC | 21332 |
| bah42d07 | CCCATGTCTGGACAACAAAAG<br>CCCATGTCTGCACAACAAAAG | 21333 |
| BaAK24L01 | CTTGCTTAGAGGGACCGATGT<br>CTTGCTTAGATGGACCGATGT | 21334 |
| BaAK24L01 | ATCGAGCTGTGGGCGACGAGG<br>ATCGAGCTGTAGGCGACGAGG | 21335 |
| bags23k24 | TCTTGATGTCGGTCAGTGAAA<br>TCTTGATGTCAGTCAGTGAAA | 21336 |
| BaAL11H22 | TGATGACATCATGCTCCTCTC<br>TGATGACATCGTGCTCCTCTC | 21337 |
| baal6m22 | CAGATGTACACATGGAATGGA<br>CAGATGTACATATGGAATGGA | 21339 |
| basd20p03 | CCCATTTACGAGGGAAGTTCA<br>CCCATTTACGGGGAAGTTCA | 21340 |
| kr59H0416 | CACATGACATAAAATCGCTAA<br>CACATGACATGAAATCGCTAA | 21341 |
| bah19b13 | TACAACATCCGAAGCAGCCAC<br>TACAACATCCAAGGCAGCCAC | 21342 |
| bah19b13 | CAACATCCGAAGCAGCCACAT<br>CAACATCCAAGGCAGCCACAT | 21343 |
| BaGS14A02 | AATGTAAACCGCAGGCTGCTT<br>AATGTAAACCACAGGCTGCTT | 21344 |
| bah61o16 | TATAAGTCCCGTGACACTGCA<br>TATAAGTCCCATGACACTGCA | 21345 |
| bah34p05 | TAATGCATCAGCTACACACTT<br>TAATGCATCAACTACACACTT | 21346 |
| bah24n07 | CCACGAGCACGAAAAGTAGCG<br>CCACGAGCACAAAAAGTAGCG | 21348 |
| bah54b04 | TGCGGCTTCTGCGCCTCCTCA<br>TGCGGCTTCTACGCCTCCTCA | 21349 |
| bah54b04 | GCTTGCTATTCCGAAGTCACT<br>GCTTGCTATTACGAAGTCACT | 21350 |
| bah54b04 | AATAATGACTGCAGACAAAAT<br>AATAATGACTACAGACAAAAT | 21351 |
| baal11h20 | ATGACTCTGGTCCATATTTGT<br>ATGACTCTGGCCCATATTTGT | 21352 |
| basd20m23 | CGTATGTAGATATCTAGTGAA<br>CGTATGTAGACATCTAGTGAA | 21354 |

TABLE 27-9

| Clones | Haruna Nijo / H602 | SEQ ID NO: |
|---|---|---|
| basd20m23 | AGTATAGATTTATTCATTTTG<br>AGTATAGATTCATTCATTTTG | 21355 |
| basd20m23 | ATATAAGTCTCTCTAGAGGTT<br>ATATAAGTCTTTCTAGAGGTT | 21356 |
| basd20m23 | AGGACCTGCTCTTGTTGAACG<br>AGGACCTGCTTTTGTTGAACG | 21357 |
| baal15d09 | GGTTGATCTCCGCTTGGCTTC<br>GGTTGATCTCTGCTTGGCTTC | 21358 |
| baak39n20 | TGACATCCTCGAACCCTGCCT<br>TGACATCCTCAAACCCTGCCT | 21359 |
| bah43n16 | AACTCCTCTTCCTCGGATACG<br>AACTCCTCTTTCTCGGATACG | 21361 |
| basd22c03 | TGTATGTAAGCAGCTTGTTCC<br>TGTATGTAAGTAGCTTGTTCC | 21363 |
| kr47F0511 | CATAACATCAATGATAAACGA<br>CATAACATCAGTGATAAACGA | 21364 |
| kr47F0511 | AGCTTCTTGTCCCCTCCTCCT<br>AGCTTCTTGTTCCCTCCTCCT | 21365 |
| bast77a0402 | ATCATCTAACCCATATAACCA<br>ATCATCTAACGCATATAACCA | 21366 |
| bah58f04 | CACTCTCCTCGAGATTAAATA<br>CACTCTCCTCAAGATTAAATA | 21367 |
| kr39G1113 | GTGTTTTTGGATATGATCTGA<br>GTGTTTTTGGGTATGATCTGA | 21368 |
| baak30109 | TGCCCATCATGATTCATCAGA<br>TGCCCATCATCATTCATCAGA | 21369 |
| baak1c16 | TCCGCAAAAAACACACTATA<br>TCCGCAAAAACACACTATA | 21370 |
| BaAK12F18 | AATTCTTAGCCATGAATACAA<br>AATTCTTAGCAATGAATACAA | 21371 |
| BaAK12F18 | CCTTGGGGTCAATGCCGTCGA<br>CCTTGGGGTCCATGCCGTCGA | 21372 |
| BaAK12F18 | GGTGCAGCCAAGCTGACGCAG<br>GGTGCAGCCACGCTGACGCAG | 21373 |
| BaAK12F18 | TCTTAAGCGGAGATCTCAACC<br>TCTTAAGCGGGGATCTCAACC | 21374 |
| BaAK12F18 | TATAAGTCACACCATCCCTAA<br>TATAAGTCACGCCATCCCTAA | 21375 |
| BaAK12F18 | GGGCTAGCATGAGCATACAAT<br>GGGCTAGCATAAGCATACAAT | 21376 |
| basd20e05 | ATTCAGAGAGGGAGATGCAGT<br>ATTCAGAGAGAGAGATGCAGT | 21377 |
| basd20e05 | AGCAGAAATATCATCAACTGG<br>AGCAGAAATACCATCAACTGG | 21378 |
| basd20e05 | TTAGCGTCATCGTGTTCCCTT<br>TTAGCGTCATAGTGTTCCCTT | 21379 |
| baal17d05 | TATCACAACTCGATATTCCAT<br>TATCACAACTGGATATTCCAT | 21382 |
| baal17d05 | CATGTATACTCTCTGCATGCA<br>CATGTATACTTTCTGCATGCA | 21383 |

TABLE 27-10

| Clones | Haruna Nijo / H602 | SEQ ID NO: |
|---|---|---|
| baal17d05 | AAGACTGACTCACTTAGAAAA<br>AAGACTGACTGACTTAGAAAA | 21384 |
| bast70d0107 | TAATAATGTTCAACTTCAATA<br>TAATAATGTTGAACTTCAATA | 21385 |
| baak46g03 | TGGCAAACACAGATTATAAC<br>TGGCAAACACGGATTATAAC | 21386 |
| bah63m17 | TGAGCAGTTACACTAAAGAGA<br>TGAGCAGTTATACTAAAGAGA | 21387 |
| bah63m17 | TCTCACGTGGACTGAGATAAC<br>TCTCACGTGGGCTGAGATAAC | 21388 |
| bah15l15 | AGACAACCACGTGAGAGCAGC<br>AGACAACCACATGAGAGCAGC | 21389 |
| bah15l15 | TGATCCCGTTCGCGTCGAGGT<br>TGATCCCGTTGGCGTCGAGGT | 21390 |
| bags19n01 | GCAAAATTCACGATTTTAAGA<br>GCAAAATTCAGGATTTTAAGA | 21391 |
| bags19n01 | AAGAGAAAAACATTACAAGCT<br>AAGAGAAAAAGATTACAAGCT | 21392 |
| bags19n01 | CGTAGTACAAAAGTATCAAGA<br>CGTAGTACAACAGTATCAAGA | 21393 |
| baak32p07 | AACAATGACAGCTTTGGCTGG<br>AACAATGACACCTTTGGCTGG | 21394 |
| baak32p07 | CAGAAAATGGCTTTATTGATT<br>CAGAAAATGGATTTATTGATT | 21395 |
| bags14l13 | AAATGAGTAGCGACATGCCAG<br>AAATGAGTAGGGACATGCCAG | 21396 |
| bags14l13 | TAAGAAGGCAAATAACTGGTA<br>TAAGAAGGCAGATAACTGGTA | 21397 |
| bags14l13 | TACCCGCGGTTGCAAGCTCCT<br>TACCCGCGGTCGCAAGCTCCT | 21398 |
| bags14l13 | GACAGAAAGATGTTCATGGTT<br>GACAGAAAGACGTTCATGGTT | 21399 |
| bags37o24 | ACACAAAACAGAGCAAATGTG<br>ACACAAAACAAAGCAAATGTG | 21400 |
| bags37o24 | TTAAGTTCTAGCTGATTGAAA<br>TTAAGTTCTATCTGATTGAAA | 21401 |
| bags37o24 | CGGACATGTAGCTGTATCAAC<br>CGGACATGTAACTGTATCAAC | 21402 |
| baal27m03 | AAACAGGGGANAGGGACAACC<br>AAACAGGGGAGAGGGACAACC | 21406 |
| baal27m03 | CTTTCACCGTCTGAGGGCATG<br>CTTTCACCGTTTGAGGGCATG | 21407 |
| baal27m03 | GCTCAGCTGCNAGGAAAATAA<br>GCTCAGCTGCAAGGAAAATAA | 21408 |
| baal27m03 | GGGCATCAGCNGATCGAGCTA<br>GGGCATCAGCCGATCGAGCTA | 21409 |
| baal27m03 | TCATATCACTGATTGGGAAC<br>TCATATCACTTATTGGGAAC | 21410 |
| BaAK1C18 | ACTATGCACTGGTATATAACT<br>ACTATGCACTAGTATATAACT | 21411 |

TABLE 27-11

| Clones | Haruna Nijo H602 | SEQ ID NO: |
|---|---|---|
| BaAK1C18 | GCGACCCTTGTTGGGGGCAAC<br>GCGACCCTTGCTGGGGGCAAC | 21412 |
| bah52b11 | TCTATGGAAA-TACATGGAAG<br>TCTATGGAAAATACATGGAAG | 21416<br>21417 |
| bah27f05 | CGAGATGTACGCTCTGCCGAC<br>CGAGATGTACCCTCTGCCGAC | 21419 |
| bah59c10 | ACGAGAAACTAAATGAAATC<br>ACGAGAAACCAAATGAAATC | 21420 |
| basd14e01 | CCTCGCCGTAGGCCGCGATGT<br>CCTCGCCGTAAGCCGCGATGT | 21421 |
| basd14e01 | TGATGTCGGCCGTCTCGTGCT<br>TGATGTCGGCTGTCTCGTGCT | 21422 |
| basd14e01 | CACACGGCGATCGGAGCTTCA<br>CACACGGCGACCGGAGCTTCA | 21423 |
| bags38j06 | GTTTCCTCTACTGTAACGGAT<br>GTTTCCTCTAGTGTAACGGAT | 21424 |
| bags38j06 | AATAGATTGTGTGAATTTGTG<br>AATAGATTGTTTGAATTTGTG | 21425 |
| basd18e06 | CCTCTTTATTCTCATCTCCTC<br>CCTCTTTATTTTCATCTCCTC | 21429 |
| basd18e06 | TGGTGTTGACAGCGAGCTTGA<br>TGGTGTTGACGGCGAGCTTGA | 21430 |
| basd18e06 | AGTAGAGCCGTCGGAACTCAA<br>AGTAGAGCCGGCGGAACTCAA | 21431 |
| baak16e08 | AAGGGGAAGGTTCACGTGCAG<br>AAGGGGAAGGCTCACGTGCAG | 21432 |
| basd2o16 | TCAAAACAAACAAGCTCCGTC<br>TCAAAACAAAGAAGCTCCGTC | 21433 |
| basd2o16 | GGACAGGGTAGAAGGGTAGAG<br>GGACAGGGTACAAGGGTAGAG | 21434 |
| basd2o16 | TTGAAGGGGATCTGCTTCTTG<br>TTGAAGGGGAACTGCTTCTTG | 21435 |
| basd2o16 | CTTGAAACGGATCCGGAACAG<br>CTTGAAACGGTTCCGGAACAG | 21436 |
| bags18h01 | GAAACAGATTGTTAAAAGATT<br>GAAACAGATTTTTAAAAGATT | 21437 |
| bags18h01 | CGATTTAGTATTTCCCTGGT<br>CGATTTAGTAATTCCCTGGT | 21438 |
| bags18h01 | ACACACAAAACAGAAAACAAC<br>ACACACAAAAAAGAAAACAAC | 21439 |
| bags4l20 | GGAAATTTTACCTGCCTCGAT<br>GGAAATTTTATCTGCCTCGAT | 21441 |
| bah30j08 | TTATTGTCTGTTTGTCACATG<br>TTATTGTCTGCTTGTCACATG | 21450 |
| bah30j08 | GGATTTCTGTCCTCATGAAAG<br>GGATTTCTGTGCTCATGAAAG | 21451 |
| bah30j08 | AGGGAACATTGGAATCAGCCA<br>AGGGAACATTAGAATCAGCCA | 21452 |
| bah30j08 | TGAATTAACCATACGGCTAAT<br>TGAATTAACCGTACGGCTAAT | 21453 |

TABLE 27-12

| Clones | Haruna Niio H602 | SEQ ID NO.: |
|---|---|---|
| bah30j08 | GCATTCTCGGTCACCGCCTTG<br>GCATTCTCGGGCACCGCCTTG | 21454 |
| bah30j08 | GCTTCGCTGCGTCTGAATTAA<br>GCTTCGCTGCCTCTGAATTAA | 21455 |
| bast22G0313 | TTCTAGTTACAGGTCTTCAGC<br>TTCTAGTTACGGGTCTTCAGC | 21456 |
| bags33n21 | CACCTGCGCTCTAACATCCTT<br>CACCTGCGCTGTAACATCCTT | 21458 |
| bags33n21 | AAACAAGTAATTGATACAGTC<br>AAACAAGTAACTGATACAGTC | 21459 |
| bags33n21 | CAAACTTTCCAGGGGGGCAAA<br>CAAACTTTCCCGGGGGGCAAA | 21460 |
| baak33c11 | ATCTATTCCTTCAAATTTTGA<br>ATCTATTCCTTCAAATTTTGA | 21461 |
| baak33c11 | TCCATCACTCGGAGCATATTC<br>TCCATCACTCCGAGCATATTC | 21462 |
| BaH36P06 | CATCTCCGGCAGTCTCAACAG<br>CATCTCCGGCCGTCTCAACAG | 21464 |
| BaH36P06 | GATATGAATCGGGAGTTGTTG<br>GATATGAATCAGGAGTTGTTG | 21465 |
| BaH36P06 | TGTTTCTTTTCGATTAAATCA<br>TGTTTCTTTTTGATTAAATCA | 21466 |
| BaH36P06 | GTACCATCCGGGCAAGAATCG<br>GTACCATCCGAGCAAGAATCG | 21467 |
| baet25H0115 | TCTCAGCGGCTCCATGGTGTG<br>TCTCAGCGGCCCCATGGTGTG | 21468 |
| bald12l01 | CGCTTCACAGACGCAAAACAC<br>CGCTTCACAGGCGCAAAACAC | 21469 |
| basd12l01 | TGCCCGACGCTTCCAAGATCT<br>TGCCCGACGCATCCAAGATCT | 21470 |
| BaAK29I15 | CCGTGCCGACGTGTGCTTGCT<br>CCGTGCCGACATGTGCTTGCT | 21474 |
| BaAK29I15 | TCCGGTGTGTCCGTGCTGCCC<br>TCCGGTGTGTACGTGCTGCCC | 21475 |
| bast62B0404 | GGCGGGTACAGACAAGCAACC<br>GGCGGGTACATACAAGCAACC | 21476 |
| bast62B0404 | ATCTCCATCTTATTATTCTGC<br>ATCTCCATCTCATTATTCTGC | 21477 |
| bast62B0404 | AAGTTTCAAGTAGCTGCCGCT<br>AAGTTTCAAGCAGCTGCCGCT | 21478 |
| baak18i01 | AAGAAATGATACCCAAATTGA<br>AAGAAATGATCCCCAAATTGA | 21479 |
| baak18i01 | AATGATTAGGCGGCTATCAGG<br>AATGATTAGGGGGCTATCAGG | 21480 |
| bah25l03 | CTGCGAGCTCAACCGATGATT<br>CTGCGAGCTCGACCGATGATT | 21482 |
| bah25l03 | TGTGAGCCTCGCTGCCTTTAC<br>TGTGAGCCTCACTGCCTTTAC | 21483 |
| bah25l03 | AAACCAAAGAAGCGGCACAC<br>AAACCAAAGCAGCGGCACAC | 21484 |

TABLE 27-13

| Clones | Haruna Niio H602 | SEQ ID NO: |
|---|---|---|
| bah25l03 | TTGATCAATAGTAGAAACTCA<br>TTGATCAATACTAGAAACTCA | 21485 |
| bah25l03 | AACATGTATATGAAAGATCA<br>AACATGTATACGAAAGATCA | 21486 |
| bah25l03 | ATGATTACAAGAAGATCGGAG<br>ATGATTACAAAAAGATCGGAG | 21487 |
| bah25l03 | TCGCATGATCGTTAAGAATGA<br>TCGCATGATCATTAAGAATGA | 21488 |
| baa1n11 | GCAAGCCCTTGCAATACCGTA<br>GCAAGCCCTTTCAATACCGTA | 21489 |
| baak16l07 | TTCCTTATGGGCAGTGAGCAG<br>TACGTTATGGACAGTGAGCAG | 21490 |
| baal13c18 | TTACTTTGCATCGTTGATGAC<br>TTACTTTGCACCGTTGATGAC | 21494 |
| baal13c18 | GAGCGCTGGTGTTAGACGA<br>GAGCGCTGGTATTGTAGACGA | 21495 |
| baal13c18 | GAACAAATGACAGAATTTTC<br>GAACAAATGAAAGAATTTTC | 21496 |

TABLE 27-13-continued

| Clones | Haruna Niio H602 | SEQ ID NO: |
|---|---|---|
| baal13c18 | CATGCACATTGTAGCTACGTA CATGCACATTATAGCTACGTA | 21497 |
| baal13c18 | TGACGGCCCATATAAGAAGCC TGACGGCCCAGATAAGAAGCC | 21498 |
| baal13c18 | TGAGTCCACTGTCAGTGAAAA TGAGTCCACTTTCAGTGAAAA | 21499 |
| baak29k23 | ACCTCCTTTTGAAATTCATAT ACCTCCTTTTCAAATTCATAT | 21500 |
| baak29k23 | GAGCGCTGGTGTTGTAGACGA GAGCGCTGGTGTATTGTAGACGA | 21501 |
| baak29k23 | CATGCACATTGTAGCTACGTA CATGCACATTATAGCTACGTA | 21502 |
| bags7d17 | CATGGTGTCAGCTTTAATATA CATGGTGTCAGCTTTAATATA | 21503 |
| bags7d17 | GCAAGCTTGTTAGGTTAAACT GCAAGCTTGTCAGGTTAAACT | 21504 |
| bags7d17 | ACTTGTACAAAGGCAAGCTTG ACTTGTACAAAGGGCAAGCTTG | 21505 |
| bags7d17 | CTTTAATATACGCTCGAAGCA CTTTAATATATGCTCGAAGCA | 21506 |
| bags7d17 | CTATCATCTCGGAAATGTTTG CTATCATCTCAGAAATGTTTG | 21507 |
| bags7d17 | TTGCCTGTGAAGTCTATCTTG TTGCCTGTGAAGTCTATCTTG | 21508 |
| bags7d17 | CTAATCTGCAGCTCTGCTTTG CTAATCTGCAGCTCTGCTTTG | 21509 |
| bags7d17 | GAAATGTTTGCTGGCAGCATG GAAATGTTTGGCTGGCAGCATG | 21510 |
| baal9c20 | CACACAAAATCTCACGATGTC CACACAAAATTTCACGATGTC | 21511 |
| baal9c20 | GTATGGGGCAAGGAGGGAAGA GTATGGGGCATGGAGGGAAGA | 21512 |

TABLE 27-14

| Clones | Haruna Niio H602 | SEQ ID NO: |
|---|---|---|
| baal9c20 | TGTTACCGTGATTTCTCATCT TGTTACCGTGGTTTCTCATCT | 21513 |
| bags20j08 | TGTTTGTATCATTACTTGTAG TGTTTGTATCCTTACTTGTAG | 21514 |
| bags20l05 | TAACGAGTCATCCACCGACGG TAACGAGTCAGCCACCGACGG | 21515 |
| bags20l05 | TTGTAAGTTCGACAGGTTACT TTGTAAGTTCCACAGGTTACT | 21516 |
| bags20l05 | CCAGTACAAACGGGAAGTTAG CCAGTACAAAAGGGAAGTTAG | 21517 |
| bags20l05 | CACCTGATGCGACAGGATGCT CACCTGATGCAACAGGATGCT | 21518 |
| baal15j23 | AAGTCATCAGTTGCTTACCAG AAGTCATCAGATGCTTACCAG | 21520 |
| baal15j23 | CATAACATTTGATTTGAACAA CATAACATTTTATTTGAACAA | 21521 |
| baal15j23 | TGTGTGTGTGTGCGCGCTTGG TGTGTGTGTGCGCGCGCTTGG | 21522 |
| baal15j23 | CGTATTGGATTTGGTCAGAGT CGTATTGGATGTGGTCAGAGT | 21523 |
| baal15j23 | TAACATGAGAAAGGATATATT TAACATGAGAGAGGATATATT | 21524 |
| BaGS37E11 | GACGGTCACCAAGGGGAAACT GACGGTCACCAGGGGGAAACT | 21528 |
| bah50l14 | GCTCCTGGCCCGTTCGCTGCA GCTCCTGGCCCTGTTCGCTGCA | 21529 |
| BaSD27E20 | GCTCCATGGCAGTGTTCACGT GCTCCATGGCCGTGTTCACGT | 21530 |
| BaSD27E20 | CGGCGTTGTCGAGGGTATTGC CGGCGTTGTCAAGGGTATTGC | 21531 |
| basd17f18 | TATATATACCGTAGTTTGTAA TATATATACCATAGTTTGTAA | 21532 |
| basd17f18 | ATCCCTAAAAAGGGATAATTT ATCCCTAAAATGGGATAATTT | 21533 |
| basd17f18 | CACCGCCGCTGTTCCCCGCAG CACCGCCGCTGTTCCCCGCAG | 21534 |

TABLE 27-14-continued

| Clones | Haruna Niio H602 | SEQ ID NO: |
|---|---|---|
| basd17f18 | GAAATACTCAGAAATAAACCA GAAATACTCAAAAATAAACCA | 21535 |
| basd17f18 | GAGATTGTGTTGACAGAAATA GAGATTGTGTCGACAGAAATA | 21536 |
| basd17f18 | AACAGGTGACTAATGAGATTG AACAGGTGACCAATGAGATTG | 21537 |
| BaSD12L12 | CCGACCATGTTGATAATGANN CCGACCATGTGNATAATGANN | 21538 |
| baal32m04 | TGTTACCGTAGATGTTACCTC TGTTACCGTAAATGTTACCTC | 21539 |
| baal32m04 | TTCACTTGGGAAGACATCTC TTCACTTGGGGAAGACATCTC | 21540 |
| baal32m04 | AGGAGTTGATCATCTGTCAGG AGGAGTTGATGATCTGTCAGG | 21541 |

TABLE 27-15

| Clones | Haruna Niio H602 | SEQ ID NO: |
|---|---|---|
| baal32m04 | CTGCGTGCCAGATCCTGCTCT CTGCGTGCCAGATCCTGCTCT | 21542 |
| baal32m04 | CTGCTCTAGTAATAACAGGGT CTGCTCTAGTCATAACAGGGT | 21543 |
| BaAK24G10 | ATGCTTAACACAAGTCATATC ATGCTTAACATAAGTCATATC | 21547 |
| bah50f16 | ATCTCACTGTCATATATCTTT ATCTCACTGTTATATATCTTT | 21549 |
| bah50f16 | CAACAAAGCAAATTGCCTGTG CAACAAAGCATATTGCCTGTG | 21550 |
| bah50f16 | CCTTCGGCCTACTAGGTATAT CCTTCGGCCTGCTAGGTATAT | 21551 |
| bah50f16 | AGCTTGGTGCGCCAAAATCCC AGCTTGGTGCACCAAAATCCC | 21552 |
| basd17d11 | ACCACCTCAAGAGAACGCGCA ACCACCTCAATAGAACGCGCA | 21553 |
| basd17d11 | ATGCTTGAGAATTGTAACCGT ATGCTTGAGACTTGTAACCGT | 21554 |
| bah37p24 | GCATTGGTAGTCAAATGTCAT GCATTGGTAGCCAAATGTCAT | 21555 |
| bah37p24 | AGCAGAGCAGCTTACGGAAGA AGCAGAGCAGATTACGGAAGA | 21556 |
| baet45C1105 | CAGGATGGACGGTGAAACATA CAGGATGGACTGTGAAACATA | 21557 |
| baet45C1105 | AGAAAAAGAAGAACTTTCAGA AGAAAAAGAAAAACTTTCAGA | 21558 |
| baet45C1105 | ATTATCTGTACGTACATAACG ATTATCTGTATGTACATAACG | 21559 |
| baet45C1105 | GAAACCGAAGGGCGGCTAGTC GAAACCGAAGTGCGGCTAGTC | 21560 |
| baet45C1105 | ATTTGTCCTCAGGGTTCATCT ATTGTCCTCGGGGTTCATCT | 21561 |
| bah47l21 | TTGCCTTGAAGGCAAACCTTG TTGCCTTGAATGCAAACCTTG | 21562 |
| bah47l21 | CATTCTCTTCGTGCGAAACTA CATTCTCTTCATGCGAAACTA | 21563 |
| bah47l21 | TCCACCCGTCGGTCCTTTGCT TCCACCCGTCTGTCCTTTGCT | 21564 |
| bah47l21 | ACACCTCGCCATCGTCGCCGC ACACCTCGCCGTCGTCGCCGC | 21565 |
| baak14b08 | TGTGACATGATAGCTCACCTC TGTGACATGAGAGCTCACCTC | 21569 |
| baak14b08 | CACAATCTGCGTCATACAGAA CACAATCTGCATCATACAGAA | 21570 |
| baak14b08 | AGCCTTTTGTATTTCATAGAA AGCCTTTTGTGTTTCATAGAA | 21571 |
| baak14b08 | GAGAGTAGAAGAGAGAGAGCA GAGAGTAGAAAAGAGAGAGCA | 21572 |
| bah54n10 | CCGTGGCGTAACGGCACCTTT CCGTGGCGTAGCGGCACCTTT | 21573 |

TABLE 27-16

| Clones | Haruna Niio H602 | SEQ ID NO: |
|---|---|---|
| bah54n10 | CAGTTTGGTTACGAAAGGTAA<br>CAGTTTGGTTTCGAAAGGTAA | 21574 |
| bags34p08 | CGCGGTTGCCATGCAACATGT<br>CGCGGTTGCCGTGCAACATGT | 21576 |
| bags34p08 | ACCGGCCAGAAAAAAAATCCC<br>ACCGGCCAGGGAAAAAATCCC | 21577 |
| baal1e06 | ATCATCACCTCGTAGCAGGAT<br>ATCATCACCTTGTAGCAGGAT | 21578 |
| baal1e06 | GAGCACAGGCCAGANAATTAC<br>GAGCACAGGCNAGANAATTAC | 21579 |
| baak14k12 | GCATCCGCTGAGGCTGGTCA<br>GCATCCGCTGGGGCTGGTCA | 21581 |
| baak14k12 | GCACCCTTGTTATCGTCCAAC<br>GCACCCTTGTCATCGTCCAAC | 21582 |
| baal6a21 | ACCCGATCGGAAGCGGCGCCA<br>ACCCGATCGGCAGCGGCGCCA | 21588 |
| baal29l09 | CCACTGCCAAATTTCAAGAAG<br>CCACTGCCAAGTTTCAAGAAG | 21593 |
| baal29l09 | TAAGAAGACTTCATCCACAGT<br>TAAGAAGACTGCATCCACAGT | 21591 |
| bastl47C0606 | ATTTCTGAATTCCTCTTCCTC<br>ATTTCTGAATGCCTCTTCCTC | 21592 |
| kr66d1107 | TAATTTCAATGTCACATCCAG<br>TAATTTCAATTTCACATCCAG | 21593 |
| bah50m03 | TGGGCGTGGTGGGCAACCCGT<br>TGGGCGTGGTCGGCAACCCGT | 21594 |
| basd27k17 | GTGAGCGATAGGCATGAGCAT<br>GTGAGCGATATGCATGAGCAT | 21595 |
| basd27k17 | AGGATCACCCGGGCTTTCCTC<br>AGGATCACCCCGGCTTTCCTC | 21596 |
| basd27k17 | ACCTCCATGTCTGACCTGACA<br>ACCTCCATGTGTGACCTGACA | 21597 |

TABLE 28-1

| Clones | Haruna Niio H602 | SEQ ID NO: |
|---|---|---|
| basd2p19 | ATAGCAGCAGGATCACTTCAC<br>ATAGCAGCAG-ATCACTTCAC | 21598<br>21599 |
| bags6f02 | CTGAGACTGCGGGCGACACAC<br>CTGAGACTGCAGGCGACACAC | 21601 |
| bags6f02 | CGACACACGCGACAAGAACAG<br>CGACACACGCAACAAGAACAG | 21602 |
| bags6f02 | GGGTCCGCCGCCGCAGCCCCC<br>GGGTCCGCCGTCGCAGCCCCC | 21603 |
| bags6f02 | CACGCCCACCGGGCTCTGCAG<br>CACGCCCACCAGGCTCTGCAG | 21604 |
| baak39j07 | CGTCCATGGATACAGAACATG<br>CGTCCATGGACACAGAACATG | 21605 |
| BaAK1L23 | AANATGTGATTCCTATANNNN<br>AANATGTGAT-CCTATANNNN | 21606<br>21607 |
| BaAK1L23 | CCACTCTTGANCACATCTTCA<br>CCACTCTTGAGCACATCTTCA | 21608 |
| BaAK1L23 | TCTTGATGACAATCATGTGTT<br>TCTTGATGACGATCATGTGTT | 21609 |
| baak17e10 | CCAGCATGATGTTGATGGAGG<br>CCAGCATGATATTGATGGAGG | 21610 |
| baak17e10 | TTTGGTGTAAGAAGGAAGAAA<br>TTTGGTGTAACAAGGAAGAAA | 21611 |
| baak17e10 | TGCAGGTGCCGCCCAGCATGA<br>TGCAGGTGCCTCCCAGCATGA | 21612 |
| bah50h08 | TGCTGGTTCCCGGGATCGAGC<br>TGCTGGTTCCGGGGATCGAGC | 21613 |
| bah50h08 | CTCCGTGCGGCGGCTGGTCAG<br>CTCCGTGCGGTGGCTGGTCAG | 21614 |
| baall7e10 | TCATGCTCGTTTACGAGTATC<br>TCATGCTCGTCTACGAGTATC | 21615 |
| basd17c05 | ATTTCATTTACAAAAACATAC<br>ATTTCATTTATAAAAACATAC | 21616 |
| basd17c05 | ACCTCTGTACCATAATATAAG<br>ACCTCTGTACCATAATATAAG | 21617 |
| basd17c05 | AAAGAACACAGACAAAAAACC<br>AAAGAACACATACAAAAAACC | 21618 |

TABLE 28-1-continued

| Clones | Haruna Niio H602 | SEQ ID NO: |
|---|---|---|
| basd17c05 | GAAGCATTGATTCAAAGCCTG<br>GAAGCATTGAATCAAAGCCTG | 21619 |
| basd17c05 | AGGCGTGTCACAGAGAAGCAT<br>AGGCGTGTCATAGAGAAGCAT | 21620 |
| bags14p02 | CCCCCGCCGCGGCATAGATGG<br>CCCCCGCCGCTGCATAGATGG | 21621 |
| bags14p02 | TTGTTGAACAGGTAGACCCCC<br>TTGTTGAACAAGTAGACCCCC | 21622 |
| bastl42H0115 | TTGTTCATCCCATCACATCCC<br>TTGTTCATCCAATCACATCCC | 21623 |
| bastl42H0115 | CCGACATCATATTATTTATCT<br>CCGACATCATGTTATTTATCT | 21624 |
| baak19c08 | TTGTTGTAAGTGATCAGTCTA<br>TTGTTGTAAGCGATCAGTCTA | 21625 |

TABLE 28-2

| Clones | Haruna Niio H602 | SEQ ID NO: |
|---|---|---|
| baak19c08 | CGCCCATCACGAAGCTCTGCA<br>CGCCCATCACAAAGCTCTGCA | 21626 |
| bastl40h1115 | GCTCACCGCCGTGACGAAAAC<br>GCTCACCGCCATGACGAAAAC | 21627 |
| bastl40h1115 | CTTGAAATGCGTAGATTTGTG<br>CTTGAAATGCATAGATTTGTG | 21628 |
| BaAK21P12 | GGATCGCCCCGCCCTCTGGAA<br>GGATCGCCCCACCCTCTGGAA | 21632 |
| bast79C0406 | AATCAAACTCCAGAGAAGGAA<br>AATCAAACTCAAGAGAAGGAA | 21635 |
| bah45m08 | TAGGCGGCGATGCTGCAACAT<br>TAGGCGGCGACGCTGCAACAT | 21636 |
| kr28a0301 | CTATTCAGTCCCTCCTACAA<br>CTATTCAGTCACCTCCTACAA | 21637 |
| kr28a0301 | TTTGGTTCTGCCTTTGTTTA<br>TTTGGTTCTCACCTTTGTTTA | 21638 |
| kr28a0301 | CCAGTTTTAGCTTCTCATGTG<br>CCACTTTTAGGTTCTCATGTG | 21639 |
| kr28a0301 | CTCCCCTGTCGGTGGATTATA<br>CTCCCCTGTCAGTGGATTATA | 21640 |
| kr28a0301 | TTGTGTTGTTATGTTAGGATT<br>TTGTGTTGTTGTGTTAGGATT | 21641 |
| kr28a0301 | GGCATGTTTTGAATGTGAAAA<br>GGCATGTTTTCAATGTGAAAA | 21642 |
| baak21l22 | AACAGCTAAGCGTATTTGGGC<br>AACAGCTAAGGGTATTTGGGC | 21646 |
| baak21l22 | TTTCAGAAGCGGATTGAAACT<br>TTTCAGAAGCAGATTGAAACT | 21647 |
| baak21l22 | CTTTAGAAGAGCTACCTCACC<br>CTTTAGAAGAACTACCTCACC | 21648 |
| baak21l22 | TTCAGGCACAGACATCAGGTA<br>TTCAGGCACAAACATCAGGTA | 21649 |
| basd15h01 | GGTTGATGGCGACCCACAGCA<br>GGTTGATGGCAACCCACAGCA | 21650 |
| basd15h01 | GGCCCTTGGCGAACGGGTACA<br>GGCCCTTGGCCAACGGGTACA | 21651 |
| basd15h01 | AGTTCTGGGATGGCGGGTTGA<br>AGTTCTGGGACGGCGGGTTGA | 21652 |
| basd15h01 | CGGCGAACTCATCGTTTTCGT<br>CGGCGAACTCGTCGTTTTCGT | 21653 |
| bah19o11 | CAGCAGACAAGATGGGGAAG<br>CAGCAGACAATATGGGGAAG | 21654 |
| bah19o11 | TGACGAGGGGAGCGGGCTCAG<br>TGACGAGGGCAGCGGGCTCAG | 21655 |
| bah19o11 | ATCATCATCACCATCAATCTC<br>ATCATCATCATCATCAATCTC | 21656 |
| bags39l05 | ACTGCGAGGATCTTAGCAGTA<br>ACTGCGAGGACTTAGCAGTA | 21658 |
| bags39l05 | CTGATAGATAGGGAGTTTACC<br>CTGATAGATATGGAGTTTACC | 21659 |

TABLE 28-3

| Clones | Haruna Niio H602 | SEQ ID NO: |
|---|---|---|
| bags39l05 | CAAGCAAACAGCCAATGGTCA CAAGCAAACAACCAATGGTCA | 21660 |
| bags39l05 | AGCAGAAAAACAATGTTTAAT AGCAGAAAAATAATGTTTAAT | 21661 |
| BaH58P03 | TTGTTGTTGTCCACGGAAGAA TTGTTGTTGTACACGGAAGAA | 21663 |
| BaH58P03 | ATCAAGATTGTTAGCAGGACG ATCAAGATTGGTAGCAGGACG | 21664 |
| BaH58P03 | ACCACTTGAAATATCTTACTT ACCACTTGAAGTATCTTACTT | 21665 |
| BaAL4O04 | TTATTGTGGTTGGGGTGGTGG TTATTGTGGTCGGGGTGGTGG | 21667 |
| BaAL4O04 | GATGGATGGCGGAAGGGCGGG GATGGATGGCAGAAGGGCGGG | 21668 |
| BaAL4O04 | CACAACACAAACGATGAAAGA CACAACACAAGCGATGAAAGA | 21669 |
| baak14c23 | AGTAGGCCATACTGGCTGGCG AGTAGGCCATGCTGGCTGGCG | 21671 |
| baak14c23 | TCCAGTTTGCGAAGGACGGCT TCCAGTTTGCCAAGGACGGCT | 21672 |
| kr61A1101 | CTATAAACACAAACAAGACTC CTATAAACACGAACAAGACTC | 21673 |
| kr61A1101 | TCGCAAATATAAGAAAGAAGC TCGCAAATATTAGAAAGAAGC | 21674 |
| BaH42J17 | GATGGATGGCGGAAGGGCGGG GATGGATGGCAGAAGGGCGGG | 21675 |
| BaH42J17 | TTATTGTGGTTGGGGTGGTGG TTATTGTGGTGGGGTGGTGG | 21676 |
| BaH42J17 | CGAGCTTCCTGTGGAGGAGAG CGAGCTTCCTTTGGAGGAGAG | 21677 |
| bah58h08 | TGTTGGACAGGAAATCGTACG TGTTGGACAGCAAATCGTACG | 21678 |
| bah58h08 | GTACGTGACAGCTGACAAGAC GTACGTGACAACTGACAAGAC | 21679 |
| bast78a0202 | GCGCTCTCCCGGAGCTCCAGC GCGCTCTCCCAGAGCTCCAGC | 21680 |
| BaSD18O16 | TGCTTCTGCATATATGTCTTA TGCTTCTGCACATATGTCTTA | 21682 |
| baak22j11 | GCTCACATCAGTGACCGCCGC GCTCACATCAATGACCGCCGC | 21683 |
| baak22j11 | GTGGAGGCGGTGCTCCATGGC GTGGAGGCGGGGCTCCATGGC | 21684 |
| baak22j11 | CCGCCTCCGTCTTCTCGGCCA CCGCCTCCGTTTTCTCGGCCA | 21685 |
| baak22j11 | CCCGCTCGTGCGCCAGCTCAC CCCGCTCGTGAGCCAGCTCAC | 21686 |
| baak20k04 | GGCTCGCAATGCCCAGGTACC GGCTCCCAATTCCCAGGTACC | 21687 |
| baak20k04 | ATCAAGCCGGACAGCAGCCAG ATCAAGCCGGCCAGCAGCCAG | 21688 |

TABLE 28-4

| Clones | Haruna Niio H602 | SEQ ID NO: |
|---|---|---|
| bags29l11 | CCTCCTCTTCATCATCATCAA CCTCCTCTTCATCATCATCAA | 21689 |
| bags29l11 | TAAACAAAAATCAAAAGGGTA TAAACAAAAACAAAAGGGTA | 21690 |
| baak14o13 | ACAGATCAGGTAAGGCATTT ACAGATCAGGTTAAGGCATTT | 21691 |
| baak14o13 | CAATTTACAACCTTCCAAAGA CAATTTACAACATCTTCCAAAGA | 21692 |
| baak14o13 | GGGGCATGACCAATATGAACA GGGGCATGACTAATATGAACA | 21693 |
| bags28k04 | CAGCGTGCGGTATGCCACATC CAGCGTGCGGGATGCCACATC | 21696 |
| bags28k04 | CATCCTTTTATGTTGATTCAT CATCCTTTTACGTTGATTCAT | 21697 |
| bags28k04 | TGCTTGCCCAGCAGCAGCGCC TGCTTGCCCAACAGCAGCGCC | 21698 |
| BaGS37M03 | AAAATAGCTCACACCAGTGATT AAAATAGCTCATACCAGTGATT | 21701 |

TABLE 28-4-continued

| Clones | Haruna Niio H602 | SEQ ID NO: |
|---|---|---|
| bags18c14 | CATGGTTTGCCATGTTAGATA CATGGTTTGCTATGTTAGATA | 21702 |
| bast23G0214 | TAATTTGCAAATCCCAAGTGA TAATTTGCAAGTCCCAAGTGA | 21703 |
| bast23G0214 | GGGTGACGACGCGTGAAAAAC GGGTGACGACTCGTGAAAAAC | 21704 |
| bast23G0214 | ACACATGCATGCGCATCCTGG ACACATGCATACGCATCCTGG | 21705 |
| bah47p02 | TCATCTGGGCGCCTCTATGCC TCATCTGGGCACCTCTATGCC | 21706 |
| bah47p02 | CAACTTCTACTTACATACTTG CAACTTCTACGTACATACTTG | 21707 |
| kr66h0216 | AAAAAAAAAAAAAAAAAAAAAA AAAAAAAAAACAAAAAAAAAA | 21712 |
| kr66h0216 | TTTTACAACTCGCAACACAAT TTTTACAACTGGCAACACAAT | 21713 |
| BaG323D15 | ACCCACAAATCCTCCAATTA ACCCACAAAAGCCTCCAATTA | 21714 |
| BaGS23D15 | GCGTTTAGAGTATTTACACCA GCGTTTAGAGCATTTACACCA | 21715 |
| BaG323D15 | ACAAATGTAAGCAAAAACCAG ACAAATGTAATCAAAAACCAG | 21716 |
| baal22c17 | ACATTGTTTAITGTGACAAAT ACATTGTTTAATGTGACAAAT | 21717 |
| baal22c17 | ACCCACAAAAGCCTCCAATTA ACCCACAAAATCCTCCAATTA | 21718 |
| bags34l17 | ATGTAACTCTACATGGCAAAG ATGTAACTCTGCATGGCAAAG | 21720 |
| bags34l17 | GGTTGACTAATAGAACTCCAG GGTTGACTAACAGAACTCCAG | 21721 |
| bags34l17 | CTAATGCTACCTTAAGTCCCA CTAATGCTACATTAAGTCCCA | 21722 |

TABLE 28-5

| Clones | Haruna Niio H602 | SEQ ID NO: |
|---|---|---|
| bags34l17 | CCAGAGATTACCAGCCAAATT CCAGAGATTAGCAGCCAAATT | 21723 |
| bags34l17 | TTAAGTCCCATGTAAGCCCTT TTAAGTCCCAGGTAAGCCCTT | 21724 |
| bah14j16 | GCAGAGAGCAGAAATAGGTGC GCAGAGAGCAAAAATAGGTGC | 21726 |
| BaAK21B17 | TCCTTTTGATACCGAGGTCGG TCCTTTTGATGCCGAGGTCGG | 21727 |
| baak21m13 | TGGCTCTATGAAGGAATCTTC TGGCTCTATGTAGGAATCTTC | 21729 |
| baak21m13 | ATTTAGATGAGTCGACTATAC ATTTAGATGAATCGACTATAC | 21730 |
| baak21m13 | CATTCCTCATGTACCATTTAG CATTCCTCATATACCATTTAG | 21731 |
| baak21m13 | AAAATAATTCTGTACTTCTGG AAAATAATTCAGTACTTCTGG | 21732 |
| baak21m13 | GTTTACCTGGTGCGGCCCTT GTTTACCTGTTGCGGCCCTT | 21733 |
| baak21m13 | ATGAGTTTAGGGCGTCGAGCT ATGAGTTTAGTGCGTCGAGCT | 21734 |
| baak21m13 | TAAGGAAAAATTCGCACTTG TAAGGAAAATTTCGCACTTG | 21735 |
| BaH38E01 | TGGTCACCTTGACACATGTCTG TGGTCACCTTACACATGTCTG | 21736 |
| bast03G0313 | GATCGCAAGACGCGAACTGCT GATCGCAAGATGCGAACTGCT | 21737 |
| bast03G0313 | GCGCTACAGAGACAGCCGGCG GCGCTACAGATACAGCCGGCG | 21738 |
| basd18g06 | TCGCTCTAGGACTAGGACTAG TCGCTCTAGGTCTAGGACTAG | 21739 |
| basd18g06 | ACTAGGACAGGATGGCCGGGT ACTAGGACAGAATGGCCGGGT | 21740 |
| baak40i22 | AGGTTGGTACAAAATTTTGAA AGGTTGGTACGAAATTTTGAA | 21741 |
| baak40i22 | CTGTGTTGGGGGATATACATG CTGTGTTGGGTGATATACATG | 21742 |

TABLE 28-5-continued

| Clones | Haruna Niio H602 | SEQ ID NO: |
|---|---|---|
| baal2n12 | CGACGACGACGATGAGGTTTT<br>CGACGACGACAATGAGGTTTT | 21743 |
| baal2n12 | ATGCATGCACGGACTGAGGTG<br>ATGCATGCACAGACTGAGGTG | 21744 |
| baal2n12 | ATAATAATAACATAATGATAA<br>ATAATAATAATATAATGATAA | 21745 |
| BaSD3C24 | CGCGATGTCACAATCTCGTCA<br>CGCGATGTCATAATCTCGTCA | 21746 |
| baak46m07 | ACAAAACTGGAATTAGAATGT<br>ACAAAACTGGGATTAGAATGT | 21747 |
| baak46m07 | CTAGACCGCTGATCTCAGTTT<br>CTAGACCGCTCATCTCAGTTT | 21748 |
| baak46m07 | TCTTCTGTTCCATGACCGCCT<br>TCTTCTGTTCAATGACCGCCT | 21749 |

TABLE 28-6

| Clones | Haruna Niio H602 | SEQ ID NO: |
|---|---|---|
| baak46m07 | TGGAGAAGCCTGTTCACTATG<br>TGGAGAAGCCAGTTCACTATG | 21750 |
| BaGS17N04 | TTCTTAAGAAGGTAGTCGGTG<br>TTCTTAAGAATGTAGTCGGTG | 21751 |
| BaGS17N04 | CTCTACCAATGCCTAGGGGCC<br>CTCTACCAATACCTAGGGGCC | 21752 |
| BaGS17N04 | GACATTCCGATGGAACTAGCC<br>GACATTCCGAGGGAACTAGCC | 21753 |
| bags12d09 | TAGGTACATCTATACGCAACT<br>TAGGTACATCGATACGCAACT | 21754 |
| basd20c08 | GGAACCGCCCGTCCGAGGAGT<br>GGAACCGCCCATCCGAGGAGT | 21755 |
| basd20c08 | GACACCGTCCAGGTGCCACGC<br>GACACCGTCCGGGTGCCACGC | 21756 |
| basd20c08 | GTCCCACACCTGGCAGGTCTT<br>GTCCCACACCGGGCAGGTCTT | 21757 |
| baak15p03 | GACGAGGTGAGGGCTACTGGT<br>GACGAGGTGATGGCTACTGGT | 21759 |
| baak15p03 | TACTGGTCAGGGTCTGAACTC<br>TACTGGTCATCGTCTGAACTC | 21760 |
| baal18g11 | GTCCATTGGACTTCGATTGAA<br>GTCCATTGGATTTCGATTGAA | 21761 |
| baak40g02 | GTTTCAGGAAATTCTACAGTT<br>GTTTCAGGAAGTTCTACAGTT | 21764 |
| BaH26B16 | CGAAGATGATTGCCGCACATC<br>CGAAGATGATCGCCGCACATC | 21765 |
| baal5n08 | TCGGGACATAGCTGGTGGCGG<br>TCGGGACATATCTGGTGGCGG | 21766 |
| baal5n08 | TTTTTACAGGGGACTTGCTTC<br>TTTTTACAGGTGACTTGCTTC | 21767 |
| bags9c08 | CATCTGCAAGTATAAAGACAA<br>CATCTGCAAGCATAAAGACAA | 21768 |
| bags9c08 | ATAAAGACAACGGTCAGTCAA<br>ATAAAGACAATGGTCAGTCAA | 21769 |
| basd1j22 | ATGCACACTGGATGAAGGATG<br>ATGCACACTGCATGAAGGATG | 21772 |
| basd1j22 | AGGTAAATAGGGTGTGCGAGT<br>AGGTAAATAGAGTGTGCGAGT | 21773 |
| basd1j22 | TTGAAACCAGTGAGTGTGTTT<br>TTGAAACCAGGGAGTGTGTTT | 21774 |
| basd1j22 | AGCTAAGGGCAGTCTACTTCT<br>AGCTAAGGGCGGTCTACTTCT | 21775 |
| BaH23N03 | ACTTTTATTACGGAATTGAGA<br>ACTTTTATTATGGAATTGAGA | 21776 |
| bast46d0808 | ATGCTCAGATGATGAGCATTT<br>ATGCTCAGATCATGAGCATTT | 21777 |
| bast22a0802 | TCTTGTGCCTTCCACCTCGCC<br>TCTTGTGCCTCCACCTCGCC | 21778 |
| bast34d0808 | TCTACACACACAAAAAATACT<br>TCTACACACAAAAAAAATACT | 21779 |

TABLE 28-7

| Clones | Haruna Niio H602 | SEQ ID NO: |
|---|---|---|
| bast48e0509 | ATGACACAGACGGATTCAACA<br>ATGACACAGATGGATTCAACA | 21780 |
| bast48e0509 | AGTTGGATAATGTGTTCATGA<br>AGTTGGATAACGTGTTCATGA | 21781 |
| bast26f1012 | AGAAAGAATGGACACATGTAT<br>AGAAAGAATGGACACATGTAT | 21782 |
| baal30e07 | TCTCCATTACGAGCTTCATGT<br>TCTCCATTACCAGCTTCATGT | 21783 |
| baal30e07 | CCTCTTCACTAGGATCTCCAC<br>CCTCTTCACTGGGATCTCCAC | 21784 |
| baal30e07 | TAGTCTTCATGGCCTCTGACT<br>TAGTCTTCATAGCCTCTGACT | 21785 |
| baal30e07 | TATTTAAGCACTCATGTGATC<br>TATTTAAGCAGTCATGTGATC | 21786 |
| bags18i05 | TGGTTTGCTCATGCAATTCTA<br>TGGTTTGCTCGTGCAATTCTA | 21787 |
| bags8o06 | CGATCACTCGTCCTTTGGTTA<br>CGATCACTCGCCCTTTGGTTA | 21793 |
| baak46e14 | ACCTGCACGGAAGATGCGCCG<br>ACCTGCACGGCAGATGCGCCG | 21794 |
| baak46e14 | TAGCGGCGTCGTCACGTGATC<br>TAGCGGCGTCATCACGTGATC | 21795 |
| baak46e14 | GTGTAAGCAACTTACTGTTAT<br>GTGTAAGCAAGTTACTGTTAT | 21796 |
| baak46e14 | CAGGACATAGTCCCTCATGAG<br>CAGGACATAGGCCCTCATGAG | 21797 |
| BaGS38N08 | TCTGTAAAACCAACATCAGGT<br>TCTGTAAAACTAACATCAGGT | 21798 |
| BaH49P17 | TAGGATCCTGCGTGTAGAAGG<br>TAGGATCCTGTGTGTAGAAGG | 21799 |
| BaH49P17 | GGGGTATCTGCCTGCGGCCAT<br>GGGGTATCTGTCTGCGGCCAT | 21800 |
| bags21d11 | GTAAGAAAGAAGATTGTCACT<br>GTAAGAAAGAGGATTGTCACT | 21805 |
| bags21d11 | TTTTATTTCCTGCTTTGTAAG<br>TTTTATTTCCCGCTTTGTAAG | 21806 |
| kr39H0816 | TCGTGCAGGCCTGAACAGGTG<br>TCGTGCAGGCTTGAACAGGTG | 21807 |
| kr39H0816 | GTCTCGTCTCCCCCATCCTGC<br>GTCTCGTCTCCCCCATCCTGC | 21808 |
| kr39H0816 | CCCTGGACTAGTGAGGAAGAC<br>CCCTGGACTACTGAGGAAGAC | 21809 |
| kr67d0208 | CAAATTCAGCATAAGGCGGTA<br>CAAATTCAGCGTAAGGCGGTA | 21814 |
| baak1h16 | TTCGTGTAGTAGCGAGATGTG<br>TTCGTGTAGTGGCGAGATGTG | 21815 |
| BaH26F10 | GACGCTTAGCCTCTCTCTCCG<br>GACGCTTAGCTTCTCTCTCCG | 21816 |
| bags14n02 | AGTCAACCGAGACGCACACAA<br>AGTCAACCGAAACGCACACAA | 21817 |

TABLE 28-8

| Clones | Haruna Niio H602 | SEQ ID NO: |
|---|---|---|
| bah36f01 | CAGTTCCTCTAGAACAGAGCT<br>CAGTTCCTCTGGAACAGAGCT | 21818 |
| bah36f01 | CGGGTGTAGTTGCACCAGCCG<br>CGGGTGTAGTGGCACCAGCCG | 21819 |
| bast79d1107 | ATGTTCATGCGTCTCTCTATA<br>ATGTTCATGCATCTCTCTATA | 21820 |
| bast79d1107 | TCTATATACAGACTAAATGTC<br>TCTATATACAAACTAAATGTC | 21821 |
| bast79d1107 | ACTTGAAAAAGAAAATGTGAT<br>ACTTGAAAAAAAAAATGTGAT | 21822 |
| bast79d1107 | CTTACCTCCAGACCGCAGTCA<br>CTTACCTCCATACCGCAGTCA | 21823 |
| bast79d1107 | GTACAAAGTCTGAATGTTCAT<br>GTACAAAGTCCGAATGTTCAT | 21824 |
| BaGS26O20 | CAACAGATCAAGCTTTCGTAG<br>CAACAGATCATGCTTTCGTAG | 21825 |
| BaGS26O20 | GCGCAGCTGAGAAATGACATT<br>GCGCAGCTGACAAATGACATT | 21826 |

TABLE 28-8-continued

| Clones | Haruna Niio H602 | SEQ ID NO: |
|---|---|---|
| BaGS26O20 | AAGCTCAACCCATAGCCTTCTT AAGCTCAACCCTAGCCTTCTT | 21827 |
| BaGS26O20 | GGGCTTCATACCATCAAGCTC GGGCTTCATAACATCAAGCTC | 21828 |
| BaGS26O20 | CCAACATCAAAGTGTGGTTCG CCAACATCAAGGTGTGGTTCG | 21829 |
| BaGS26O20 | CATCGAGGCAAACTTCTTAAA CATCGAGGCAGACTTCTTAAA | 21830 |
| bags22h11 | TATTTCAACATGCAGTGCAAC TATTTCAACACGCAGTGCAAC | 21832 |
| bags22h11 | GAAATATTACCAATAGCACAC GAAATATTACGAATAGCACAC | 21833 |
| baet19D0608 | CGGCTAGGCCGAGTGGGTCAA CGGCTAGGCCAAGTGGGTCAA | 21834 |
| bags23a14 | TCGCTCCCACATCTGAAGTTC TCGCTCCCACGTCTGAAGTTC | 21835 |
| bags23a14 | CAGGTGCTGGTTCAGTGCTCA CAGGTGCTGGGTCAGTGCTCA | 21836 |
| bags37c09 | CATCGTCAAAGTTATTAAACA CATCGTCAAAATTATTAAACA | 21837 |
| bags37c09 | AAAAGTGAGTGACAAGATTTC AAAAGTGAGTTACAAGATTTC | 21838 |
| bags20a01 | TGATTGGGCGTTTCAAGTGGG TGATTGGGCGCTTCAAGTGGG | 21839 |
| bags20a01 | CATCAAATATGGTCTGATCAG CATCAAATATTGTCTGATCAG | 21840 |
| bags20a01 | GCCGGTAGGCAATGTGCTGGA GCCGGTAGGCGATGTGCTGGA | 21841 |
| bags20a01 | GGCATACCGCGGACGACCGGC GGCATACCGCTGACGACCGGC | 21842 |
| bags20a01 | AGAAAAGGACGCGGCATACCG AGAAAAGGACGCGGCATACCG | 21843 |

TABLE 28-9

| Clones | Haruna Niio H602 | SEQ ID NO: |
|---|---|---|
| bah53m11 | GCGCGTCGCAGACGAACTCCC GCGCGTCGCATACGAACTCCC | 21844 |
| bah53m11 | CGAAGAAGTTGGTCTTGCCCT CGAAGAAGTTTGTCTTGCCCT | 21845 |
| bah53m11 | ATCACTCCGTCTAACTGTCAC ATCACTCCGTGTAACTGTCAC | 21846 |
| bags26l01 | GACTCAAGACGCAGATAAATT GACTCAAGACACAGATAAATT | 21847 |
| bags26l01 | TTATTGACGGGCAAGCGAAGC TTATTGACGGCCAAGCGAAGC | 21848 |
| bags21p23 | AACACACCTTGCACATTCATT AACACACCTTCCACATTCATT | 21849 |
| baak24b01 | ACTTACAGCGCCTACAGAATG ACTTACAGCGGCTACAGAATG | 21850 |
| bast156C0105 | TTAATCTGGAGTTTTTGAAGG TTAATCTGGATTTTTTGAAGG | 21852 |
| bast156C0105 | CTGATTACAACGCACCAATTA CTGATTACAAGGCACCAATTA | 21853 |
| bags28d11 | TCGGGCATCACCAGTCACAGC TCGGGCATCAACAGTCACAGC | 21855 |
| bags28d11 | AAACCTGATATCCAAATGAGG AAACCTGATAGCCAAATGAGG | 21856 |
| bags28d11 | AGAAGAAATCGAGTCGTCTTG AGAAGAAATCAAGTCGTCTTG | 21857 |
| baak11d12 | AGAGTTTTACGAGATACCCAT AGAGTTTTACAAGATACCCAT | 21858 |
| BaH42A07 | CAACTCTACAGTTTTTTGTA CAACTCTACATTTTTTTGTA | 21859 |
| BaH42A07 | ACCTAACAGTTGGCGCCAACG ACCTAACAGTGGGCGCCAACG | 21860 |
| bah60f18 | CTACCATCCATCCAACAATAT CTACCATCCATCCAACAATAT | 21863 |
| bah60f18 | TCATTGATCAACTCCTTCACC TCATTGATCAGCTCCTTCACC | 21864 |
| bah60f18 | TAGCACAATCAATTACCACAT TAGCACAATCTATTACCACAT | 21865 |

TABLE 28-9-continued

| Clones | Haruna Niio H602 | SEQ ID NO: |
|---|---|---|
| bah60f18 | AATATTTTCCGCACTTTTAAG AATATTTTCCACACTTTTAAG | 21866 |
| baal2n10 | GTCAATAGAT-CACGGCGTGG GTCAATAGATACACGGCGTGG | 21867 |
| baal2n10 | TGTGGGAGGATGCGTCTTCCT TGTGGGAGGACGCGTCTTCCT | 21869 |
| baak32c23 | CTGGACCATCGATAGACCATA CTGGACCATCAATAGACCATA | 21876 |
| baak32c23 | GAATTTCTCACAGCATACGGT GAATTTCTCAAAGCATACGGT | 21877 |
| baak32c23 | ATGCAGCGTCCGAGGGGTTGG ATGCAGCGTCGGAGGGGTTGG | 21878 |
| baak32c23 | AATTGTAGTCTCAGAGATGTG AATTGTAGTCCCAGAGATGTG | 21879 |

TABLE 28-10

| Clones | Haruna Niio H602 | SEQ ID NO: |
|---|---|---|
| baal9e06 | ACCATCTATAGAGTTTCCTTA ACCATCTATATAGTTTCCTTA | 21880 |
| baal9e06 | TACTTATGCGCGCGTAGATTA TACTTATGCGAGCGTAGATTA | 21881 |
| bast147E0309 | CCCAAAGCCGTCGCTCTGGCA CCCAAAGCCGCCGCTCTGGCA | 21883 |
| bast147E0309 | CAACCGAAGCAGACACCCTAC CAACCGAAGCTGACACCCTAC | 21884 |
| bast147E0309 | ATCTCCGAAGCCGTCACTTCG ATCTCCGAAGTCGTCACTTCG | 21885 |
| bast147E0309 | CCCTGCTGTCTAAGCAACCGA CCCTGCTGTCCAAGCAACCGA | 21886 |
| baak30o08 | GGGTCAGAAGAAGCATTCATA GGGTCAGAAGGAGCATTCATA | 21887 |
| baet44C0606 | TGACCATGACGTCCTGCTTCA TGACCATGACATCCTGCTTCA | 21888 |
| baet44C0606 | CCTTGAGGAGGAACGGCTTGA CCTTGAGGAGAAACGGCTTGA | 21889 |
| baet44C0606 | TGTCCTTGAGCGTCGTCTCCT TGTCCTTGAGAGTCGTCTCCT | 21890 |
| bags39g18 | GCTGATCGCATGTTTTGCGGT GCTGATCGCACGTTTTGCGGT | 21891 |
| bags38m06 | AGCATGTATCGATGCAGCACA AGCATGTATCAATGCAGCACA | 21893 |
| bags38m06 | CATGGTGGTTTACACTTAGAT CATGGTGGTTCACACTTAGAT | 21894 |
| bags38m06 | TATGAAACATAGGATATACAT TATGAAACATGGGATATACAT | 21895 |
| bags38m06 | AGAGAATGTCTTAGTGACCAG AGAGAATGTCATAGTGACCAG | 21896 |
| bags3i04 | TCGAATCTGCCATCCGTAATC TCGAATCTGCAATCCGTAATC | 21897 |
| bags3i04 | TTCAAAAAATTATGTCCACGT TTCAAAAAATCATGTCCACGT | 21898 |
| bags3i04 | ACATGGAATGATACCCTCCAT ACATGGAATGTTACCCTCCAT | 21899 |
| baal1a11 | TTTCAACATCGCTTACCTCCC TTTCAACATCACTTACCTCCC | 21900 |
| basd2m23 | CTCACAAACAGTTTGCACAAA CTCACAAACAATTTGCACAAA | 21901 |
| basd12k23 | ACATGAACCTTGCATTGCACA ACATGAACCTCGCATTGCACA | 21905 |
| basd12k23 | GTCTGGAGCTACCGGTTGCTG GTCTGGAGCTCCCGGTTGCTG | 21906 |
| basd12k23 | ATTCATAGCAGCTTGAAGATT ATTCATAGCAACTTGAAGATT | 21907 |
| bast22c0105 | AAAAAACTTCGCTTCCAAAAG AAAAAACTTCCCTTCCAAAAG | 21908 |
| bast22c0105 | ACCTCCTTAGTGCCACCACGA ACCTCCTTAGGGCCACCACGA | 21909 |

TABLE 28-11

| Clones | Haruna Niio H602 | SEQ ID NO: |
|---|---|---|
| BaGS38H20 | AGTGCAACTGCACATAAAAAT AGTGCAACTGTACATAAAAAT | 21910 |
| BaGS38H20 | TATACATTCCTTACAATGTGT TATACATTCCATACAATGTGT | 21911 |
| bah61p21 | GCTATGCTTGCAACACAACGC GCTATGCTTGTACACAACGC | 21912 |
| basd11h13 | AGGGTGAAAATAAAGGTCAAG AGGGTGAAAACAAAGGTCAAG | 21913 |
| basd11h13 | ACTGAAAATGCTGCAGGGTGA ACTGAAAATGTTGCAGGGTGA | 21914 |
| basd11h13 | ATATTTGCCGGTCCTTCGCTC ATATTTGCCGCTCCTTCGCTC | 21915 |
| basd11h13 | GTTGCCATCACCCTGACTGTG GTTGCCATCAGCCTGACTGTG | 21916 |
| basd11h13 | GTCATAGATGCTGAATGTCAA GTCATAGATGTTGAATGTCAA | 21917 |
| baal0f04 | GGGCAGCAGCAATGCCACCTT GGGCAGCAGCGATGCCACCTT | 21918 |
| baal0f04 | ATGTACAGCACAAACGTGAAT ATGTACAGCAAAAACGTGAAT | 21919 |
| baal0f04 | TGGAAAAATCACAACATCGCA TGGAAAAATCGCAACATCGCA | 21920 |
| baal0f04 | CACCTTCTTTCGTAGCAACTG CACCTTCTTTTGTAGCAACTG | 21921 |
| kr18e0810 | CATTTTTTGCGATAAATTGCA CATTTTTTGCAATAAATTGCA | 21922 |
| bags24f02 | TTATGAATTAATAATGAATAG TTATGAATTAGTAATGAATAG | 21924 |
| bags24f02 | CCTAGAAATCTTCATGTTTTC CCTAGAAATCGTCATGTTTTC | 21925 |
| bags24f02 | GTGTGGTCTACAATAGAAAAT GTGTGGTCTAGAATAGAAAAT | 21926 |
| baal19m12 | CAAGGTACGTNACATGAGAAT CAAGGTACGTGACATGAGAAT | 21927 |
| baal19m12 | GAATGATGGCNATGAATGACG GAATGATGGCAATGAATGACG | 21928 |
| baak2e06 | AACTTTTTTCTTAATCAATTA AACTTTTTTCGTAATCAATTA | 21929 |
| baak2e06 | ATTTCTGTAAGTAACTAATCC ATTTCTGTAAATAACTAATCC | 21930 |
| baak12l16 | AATCATAATCATTGCTATAAC AATCATAATCGTTGCTATAAC | 21932 |
| baak29d01 | TGTCACAGACATGCGGATCTT TGTCACAGACGTGCGGATCTT | 21933 |
| baak19n06 | TAGTGATATCAGTGTGCATAT TAGTGATATCTGTGTGCATAT | 21934 |
| baak19n06 | CATCCCTCCTCCCAATCATAT CATCCCTCCTCCCAATCATAT | 21935 |
| baak4i02 | CCACCACCTCCATCAGCTTAC CCACCACCTCAATCAGCTTAC | 21936 |

TABLE 28-12

| Clones | Huruna Niio H602 | SEQ ID NO: |
|---|---|---|
| bah49k10 | CACCAAATCAGTATCATTCAC CACCAAATCACTATCATTCAC | 21937 |
| bah49k10 | AAAGACCCAAGGGCAGATCA AAAGACCCAAGGGGCAGATCA | 21938 |
| baal2o03 | TCCGCGTCCAATGGCTCAACC TCCGCGTCCAGTGGCTCAACC | 21939 |
| baak28g14 | CATTCTCAGTGAATGCCCAGC CATTCTCAGTAAATGCCCAGC | 21940 |
| baak28g14 | ACTTGACGCATAGATAAAACA ACTTGACGCAAAGATAAAACA | 21941 |
| baak28g14 | AGAAAGATGAGCAGCCACTGG AGAAAGATGAACAGCCACTGG | 21942 |
| baak28g14 | ACTGGTTCATAAAAAGGCTAC ACTGGTTCATTAAAAGGCTAC | 21943 |
| baak28g14 | AATCGAGGATGTGAATCACAA AATCGAGGATGTGAATCACAA | 21944 |
| bags16e11 | TCTGGAGAGAAGAAAGCGGGG TTGGAGAGATGAAAGCGGGG | 21946 |

TABLE 28-12-continued

| Clones | Huruna Niio H602 | SEQ ID NO: |
|---|---|---|
| bags16e11 | ACTGCGCACTAAATCGAAATA ACTGCGCACTTAATCGAAATA | 21947 |
| bags16e11 | CCGTAGGGCTAAATAAACCT CCGTAGGGCTGAAATAAACCT | 21948 |
| bags23g13 | CCGCCGTGAGGGACAGCTTCT CCGCCGTGAGAGACAGCTTCT | 21949 |
| bags23g13 | TATCCTGCAATGTCGCGTGCA TATCCTGCAACGTCGCGTGCA | 21950 |
| bags23g13 | GTATGTGACATTAGTTCTCGA GTATGTGACAGTAGTTCTCGA | 21951 |
| bags23g13 | TTTCGGGCGGACACGATGACT TTTCGGGCGGTCACGATGACT | 21952 |
| basd23c05 | GCACAGACTCAAGACCTCTGA GCACAGACTCCAGACCTCTGA | 21953 |
| basd23c05 | TGACCCCATCCAGAAAATGGG TGACCCCATCTAGAAAATGGG | 21954 |
| basd23c05 | GCAGAATTTGTTGAATATGTT GCAGAATTTGCTGAATATGTT | 21955 |
| bah19f17 | GAGGAGAATTGAACAGAGAAT GAGGAGAATTAAACAGAGAAT | 21956 |
| bah19f17 | TGCTGTAAATTATCTACTCCA TGCTGTAAATCATCTACTCCA | 21957 |
| bags26g17 | GGTCAAATTTTCCCACCTACG GGTCAAATTTGCCCACCTACG | 21963 |
| bags26g17 | TGTATTTTGTGAGGGGGTTTC TGTATTTTGTAAGGGGGTTTC | 21964 |
| baal6j16 | GCTGAGAAAGGAAACAGTTTC GCTGAGAAAGAAAACAGTTTC | 21965 |
| bags29b09 | TATCATAATTGGGGCTTGCAT TATCATAATTTGGGCTTGCAT | 21966 |
| bags29b09 | TAGTGTCGCAGTAGATGCTGC TAGTGTCGCACTAGATGCTGC | 21967 |

TABLE 28-13

| Clones | Haruna Niio H602 | SEQ ID NO: |
|---|---|---|
| bags29b09 | ATCCAAGTATAAGAGCCACCA ATCCAAGTATGAGAGCCACCA | 21968 |
| baal20e03 | GGGATATCAGACTCTGAATCA GGGATATCAGTCTCTGAATCA | 21969 |
| bags9123 | CAAATATACTGATACACATAG CAAATATACTTATACACATAG | 21970 |
| bags9123 | ATAGTCAAGAAAAACTTTCAT ATAGTCAAGAGAAACTTTCAT | 21971 |
| bags9123 | CAGAATAACACATTAGTGAAA CAGAATAACAAATTAGTGAAA | 21972 |
| bah32e22 | GGATGGTTACCTCTCATCACT GGATGGTTACGTCTCATCGCT | 21973 |
| bah32e22 | ACCTCTCATCACTCCCAATTT ACGTCTCATCGCTCCCAATTT | 21974 |
| baak17o14 | CGACTGTTCAATGTTACTAGT CGACTGTTCAGTGTTACTAGT | 21975 |
| baak17o14 | GATACCTGACGTCAGCCTTGG GATACCTGACATCAGCCTTGG | 21976 |
| BaH42O04 | GAACAGGCTCGCCTCCTTTCC GAACAGGCTCACCTCCTTTCC | 21981 |
| bast74F0111 | CAAGGAAGGAAACCCTAGATA CAAGGAAGGAGACCCTAGATA | 21982 |
| BaSD21F13 | GTTCAGGGCCGGCCCAGCAGA GTTCAGGGCAGCCCAGCAGA | 21983 |
| baal29l08 | CTTTGGTCCGTGAGTTTGCTC CTTTGGTCCGCGAGTTTGCTC | 21986 |
| baak21a04 | TTTGAGCATAGCTAACAGTGA TTTGAGCATATCTAACAGTGA | 21988 |
| baak21a04 | GGGGAGGTCCGGCGCACCCTC GGGGAGGTCCAGCGCACCCTC | 21989 |
| bags37f18 | TATACTGTTACTGACACTGAG TATACTGTTAATGACACTGAG | 21990 |
| baal12h12 | ATCATGGAGATACTGCAAGGT ATCATGGAGAAACTGCAAGGT | 21991 |
| BaAK26F12 | TGAGACCTCGTGCAGCGCCCT TGAGACCTCGGGCAGCGCCCT | 21994 |

TABLE 28-13-continued

| Clones | Haruna Niio H602 | SEQ ID NO: |
|---|---|---|
| bags12b05 | CGGAGAGGTCATGGTCAGGCT<br>CGGAGAGGTCGTGGTCAGGCT | 21995 |
| bags12b05 | TCAGCTGAGAAAAACCCTGC<br>TCAGCTGAGAGAAAACCCTGC | 21996 |
| baal12h24 | TGATTGACACACATCTGATCA<br>TGATTGACACGCATCTGATCA | 21997 |
| baal12h24 | TAGGTGATATATTCCTTTTGG<br>TAGGTGATATCTTCCTTTTGG | 21998 |
| baal35j16 | TGTCGGCTGCGCGGCAGCCCG<br>TGTCGGCTGCACGGCAGCCCG | 21999 |
| bags37c07 | CGAAGTTGTAATTGCTCTTGG<br>CGAAGTTGTAGTTGCTCTTGG | 22000 |
| bags37c07 | AGACTGAGATTTCTGGAGAGC<br>AGACTGAGATATCTGGAGAGC | 22001 |

TABLE 28-14

| Clones | Haruna Niio H602 | SEQ ID NO: |
|---|---|---|
| baak45d23 | GTGATGGACCCGAGGGCGACA<br>GTGATGGACCAGAGGGCGACA | 22002 |
| bah42g09 | GGGGGGGGGGGGAGGGGGGGGG<br>GGGGGGGGGGGGAGGGGGGGGG | 22003 |
| bah42g09 | GGCAAGTTCTTAGGAGCAAAG<br>GGCAAGTTCTCAGGAGCAAAG | 22004 |
| bah42g09 | ACATCGAGTCGTCAGGAATCC<br>ACATCGAGTCATCAGGAATCC | 22005 |
| baal40p01 | TTCCGGGCTGACGTCTGGACG<br>TTCCGGGCTGTCGTCTGGACG | 22006 |
| baal40p01 | ATGCCTTGAGAGATATATATA<br>ATGCCTTGAGGGATATATATA | 22007 |
| baal40p01 | ACAGTGAATAGCCCGATCGTG<br>ACAGTGAATATCCCGATCGTG | 22008 |
| baal40p01 | ATTAATCAGAACATCGAGTGG<br>ATTAATCAGACCATCGAGTGG | 22009 |
| baal40p01 | TAAGCAATCAGTGAAATAAAG<br>TAAGCAATCAATGAAATAAAG | 22010 |
| baal40p01 | TTTAACATACTGATAATTTA<br>TTTAACCATATTGATAATTTA | 22011 |
| baal40p01 | CACTTGAAATGATTCAATGAT<br>CACTTGAAATAATTCAATGAT | 22012 |
| baal40p01 | ATAAAATAGCTGGTGGTTAAT<br>ATAAAATAGCAGGTGGTTAAT | 22013 |
| baal40p01 | GCTCCTCTCCCAACACGCCAT<br>GCTCCTCTCCAAACACGCCAT | 22014 |
| baal40p01 | CCATTTCCCACAGGAATAGAT<br>CCATTTCCCATAGGAATAGAT | 22015 |
| baal40p01 | TGGCCCAGACCATAGCGAGGG<br>TGGCCCAGACAATAGCGAGGG | 22016 |
| baal40p01 | TCTCACATGGATGCTGTCTTT<br>TCTCACATGGCTGCTGICTIT | 22017 |
| kr61a0901 | GTCTATAATCGTTTTTGATGT<br>GTCTATAATCTTTTTTGATGT | 22018 |
| kr61a0901 | TTTATTTTACCAAGTAACAAT<br>TTTATTTTACGAAGTAACAAT | 22019 |
| kr61a0901 | TATTAATATAGACCTCTATAA<br>TATTAATATAAACCTCTATAA | 22020 |
| kr61a0901 | CAGTTAGTAATCACGCCTGCA<br>CAGTTAGTAACCACGCCTGCA | 22021 |
| bah44b17 | AAGACAGTGCGTCACTCACTG<br>AAGACAGTGC-TCACTCACTG | 22027<br>22028 |
| basd2k11 | ATATTGAGTCTGAGGTAACAA<br>GAATTGAGTC-GAGGTAACAA | 22029<br>22030 |
| bags23e20 | TGAAATCCTCCTCTTGCATTT<br>TGAAATCCTCGTCTTGCATTT | 22032 |
| bags33i10 | AACCAAGAAACATTATTAGTG<br>AACCAAGAAATATTATTAGTG | 22033 |
| bags35k06 | GAGAAGGAGGTTTGCTGATGG<br>GAGAAGGAGGGTTGCTGATGG | 22034 |

TABLE 28-15

| Clones | Haruna Niio H602 | SEQ ID NO: |
|---|---|---|
| bags35k06 | CTAAGGAAAAACATACCTAGT<br>CTAAGGAAAAGCATACCTAGT | 22035 |
| BaGS22M17 | AACCACACAA-CGAAGGGCTA<br>TACCACACAAGCGAAGGGCTA | 22037<br>22038 |
| baak21j24 | GAGAACAAACGAGCAGACAGG<br>GAGAACAAACAAGCAGACAGG | 22039 |
| baal16o08 | TCAGTTCATCGCTAGCATAGA<br>TCAGTTCATCACTAGCATAGA | 22042 |
| baal16o08 | CCTTTGTCACAGCAACCGGGT<br>CCTTTGTCACGGCAACCGGGT | 22043 |
| baal27n7 | TGGTGTTCACGGGCGCGCTGG<br>TGGTGTTCACCGGCGCGCTGG | 22044 |
| baal27n7 | CGATCTCCTCTAGCTTGGAGA<br>CGATCTCCTCCAGCTTGGAGA | 22045 |
| baal27n7 | TAACCTGCCCGGCGATCTCCT<br>TAACCTGCCCCGCGATCTCCT | 22046 |
| baet31B1103 | GCCTCCTGCAGTTGAGCCTGA<br>GCCTCCTGCAATTGAGCCTGA | 22047 |
| baet31B1103 | CTGACCAGCGCGTCCTGCGAC<br>CTGACCAGCGAGTCCTGCGAC | 22048 |
| BaGS24K08 | CAATAGGAAAACAGTAGGAAG<br>CAATAGGAAAGCAGTAGGAAG | 22051 |
| BaGS24K08 | TCACTGAGGTTGGAGTGGAT<br>TCACTGGAGGATGGAGTGGAT | 22052 |
| bah16c17 | TCGTGCTTATCACATCAACCT<br>TCGTGCTTATTACATCAACCT | 22053 |
| bah16c17 | ACATCAACCTAGTATCGTGTG<br>ACATCAACCTCGTATCGTGTG | 22054 |
| bah16c17 | ACGGGAGATGATGGGATTCAC<br>ACGGGAGATGCTGGGATTCAC | 22055 |
| bags28l21 | CTACTCCTACACCAGTGCCTC<br>CTACTCCTACGCCAGTGCCTC | 22056 |
| bags28l21 | GCCTGTTAGCATTAGGCATGA<br>GCCTGTTAGCGTTAGGCATGA | 22057 |
| bags28l21 | CAAGTTGGGCAGCGGAGAGGC<br>CAAGTTGGGCTGCGGAGAGGC | 22058 |
| bags28l21 | AGATTTACTTGGGACGCTTGC<br>AGATTACTTTGGGACGCTTGC | 22059 |
| bah31m22 | TGGATCATCAATTTCATCACA<br>TGGATCATCAGTTTCATCACA | 22060 |
| bah31m22 | CGGGGTCTTGTTCGGGGATGT<br>CGGGGTCTTGCTCGGGGATGT | 22061 |
| bah31m22 | GTAGAGCTCTTGCTGGAAGGA<br>GTAGAGCTCTAGCTGGAAGGA | 22062 |
| bah31m22 | GTCTACATGCAAAGAACCCTG<br>GTCTACATGCGAAGAACCCTG | 22063 |
| baal30c17 | GTTAACTGTGGCACGCGTCTG<br>GTTAACTGTGACACGCGTCTG | 22064 |
| baak37n01 | GTCGATCTCCTGCATACGGTT<br>GTCGATCTCCCGCATACGGTT | 22066 |

TABLE 28-16

| Clones | Haruna Niio H602 | SEQ ID NO: |
|---|---|---|
| BaGS24O11 | GAAAGTATGCAACAGGAGGAT<br>GAAAGTATGCCACAGGAGGAT | 22067 |
| BaGS24O11 | TGCCAGCTAAGAAAATAACT<br>TGCCAGCTAATAAAAATAACT | 22068 |
| BaGS24O11 | AGGCAGAAAATGTGAATTGTA<br>AGGCAGAAAACGTGAATTGTA | 22069 |
| bah50i23 | ATTCCAAGTTCGCACCACACA<br>ATTCCAAGTTTGCACCACACA | 22073 |
| bah50i23 | AGGTAGCAGAAAAGAGGTGAT<br>AGGTAGCAGATAAGAGGTGAT | 22074 |
| bah50i23 | GCTTGCATGCTAATGCCATCG<br>GCTTGCATGCCAATGCCATCG | 22075 |
| bah50i23 | TTTGGAGAACCATGAGATTAA<br>TTTGGAGAACTATGAGATTAA | 22076 |
| BaH56D06 | TTTCCACTTGGGCACTTCTCG<br>TTTCCACTTGAGCACTTCTCG | 22077 |
| BaAK39M05 | GCTGTGAATGAGTTTCCAGCT<br>GCTGTGAATGTGTTTCCAGCT | 22078 |

TABLE 28-16-continued

| Clones | Haruna Niio H602 | SEQ ID NO: |
|---|---|---|
| BaAK39M05 | TCCATCTGACCATGAGTTCCC TCCATCTGACCATGAGTTCCC | 22079 |
| bah11m16 | TATATATACCGTGCTTGCTAT TATATATACCATGCTTGCTAT | 22080 |
| bah49d03 | ACCCGAAGCATCGGTCGCATA ACCCGAAGCAACGGTCGCATA | 22081 |
| bah49d03 | CCACCTCAAAGATGAATGACT CCACCTCAAAAATGAATGACT | 22082 |
| bah49d03 | TTCCCCTGATTTCTGCGATCG TTCCCCTGATGTCTGCGATCG | 22083 |
| bah49d03 | ATGAATGACTGGGTGGGATCA ATGAATGACTTGGTGGGATCA | 22084 |
| bah49d03 | ACGTAGAACAGCGAATGACCA ACGTAGAACATCGAATGACCA | 22085 |
| bah49d03 | GCAACCCGGTGCTTCAAGTCC GCAACCCGGTACTTCAAGTCC | 22086 |
| bah62l23 | ATTTGCCTATGCAAGAAAGAT ATTTGCCTATACAAGAAAGAT | 22087 |
| bah62l23 | CCACAATTGCGAATTTGCCTA CCACAATTGCGAATTTGCCTA | 22088 |
| BaAK38J13 | TACTGACTGCGATGTACCGTC TACTGACTGCGATGTACCGTC | 22089 |
| BaAK38J13 | AACAGGTTACGTTCAAGTTAC AACAGGTTACATTCAAGTTAC | 22090 |
| BaAK38J13 | GCCAGATGCTTTGTAGGATTC GCCAGATGCTGTGTAGGATTC | 22091 |
| BaH37N04 | GAGATAATGTAAACGCTAGAA GAGATAATGTAAACGCTAGAA | 22092 |
| BaH37N04 | TGTGACCCAGTAAGAAGGGGC TGTGACCCAGAAAGAAGGGGC | 22093 |
| BaH37N04 | ATTGTTGCATGAGTAAAAAGA ATTGTTGCATTAGTAAAAAGA | 22094 |

TABLE 28-17

| Clones: | Haruna Niio H602 | SEQ ID NO: |
|---|---|---|
| BaH37N04 | GTACAACAGCGAAAAGTTAAC GTACAACAGCAAAAAGTTAAC | 22095 |
| basd27c06 | GCCGAGGCGCCTGTGCCGTGC GCCGAGGCGCGTGTGCCGTGC | 22096 |
| bah39g10 | TGGAGAATGTTCAAGACACCG TGGAGAATGTACAAGACACCG | 22097 |
| bah39g10 | GATACGAAAAAGACGAGAATG GATACGAAAAGGACGAGAATG | 22098 |
| bags20a13 | TGTCTCCAATTGTCTTCTCTA TGTCTCCGATGGTCTTCTCTA | 22099 |
| bags20a13 | GATAAACGTACTTGCATTTAT GATAAACATAGTTGCATTTAT | 22100 |
| bags20a13 | CACTGTCTCCAATTGTCTTCT CACTGTCTCCGATGGTCTTCT | 22101 |
| bags20a13 | AAAGATAAACGTACTTGCATT AAAGATAAACATAGTTGCATT | 22102 |
| BaH27L15 | CCGTTTCCTCGGAGATCGCAT CCGTTTCCTCAGAGATCGCAT | 22104 |
| bah59f07 | CCAGACTCAGCGTCCCTACTG CCAGACTCAGTGTCCCTACTG | 22105 |
| bah59f07 | TGGACAGCAACCCCAGACTCA TGGACAGCAAGCCCAGACTCA | 22106 |
| bags9l05 | ATACAGAGAAACAAATGATAT ATACAGAGAAGCAAATGATAT | 22107 |
| bags9l05 | GCCTCAGCAGGAGCTCCACCT GCCTCAGCAGCAGCTCCACCT | 22108 |
| bags9l05 | CACCAGCAGCAGCACCACCAC CACCAGCAGCGGCACCACCAC | 22109 |
| bags9l05 | CACCACCACCAATCGGACCAG CACCACCACCGATCGGACCAG | 22110 |
| bags9l05 | CCACCTGCTCAAGTTTCAGA CCACCTGCATCAAGTTTCAGA | 22111 |
| bags9l05 | GTAATGGTCCATTAGTTCAGC GTAATGGTCCCTTAGTTCAGC | 22112 |
| bah53j21 | TTTCAAGCACCCTCTTGTTCA TTTCAAGCACGCTCTTGTTCA | 22116 |

TABLE 28-17-continued

| Clones: | Haruna Niio H602 | SEQ ID NO: |
|---|---|---|
| bah53j21 | AATGTATGCCGAAATTTGATT AATGTATGCCAAAATTTGATT | 22117 |
| bah53j21 | CCGCAGCAGAAATGATGAGCT CCGCAGCAGAGATGATGAGCT | 22118 |
| bah21f16 | GATTCATAGGAATAGGAAAAA GATTCATAGGTATAGGAAAAA | 22119 |
| bah21f16 | TAAAACATAAGAACAAGAAA TAAAACATAGGAACAAGAAA | 22120 |
| baet39E0309 | TGCTTCAGGCTGATCGGTCGG TGCTTCAGGCAGATCGGTCGG | 22121 |
| baet39E0309 | TTCGTTCTCCAACGGCGGATG TTCGTTCTCCAACGGCGGATG | 22122 |
| bags5l04 | TCACATACCCGGCACCGGGAA TCACATACCCAGCACCGGGAA | 22123 |

TABLE 28-18

| Clones | Haruna Niio H602 | SEQ ID NO: |
|---|---|---|
| bags5l04 | TCCGCCATTTTGTTCGAATGC TCCGCCATTTGGTTCGAATGC | 22124 |
| bags5l04 | AGCACCCGCATCATTTAGCAG AGCACCCGCAGCATTTAGCAG | 22125 |
| bags7g10 | TGTAGGTTTCCGCCTCATCAG TGTAGGTTTCTGCCTCATCAG | 22126 |
| bags7g10 | AACAATACACAACCCTATTIG AACAATACACGACCCTATTTG | 22127 |
| bags9d22 | ATATGTTCTCGACAGCCCGC- ATATGTTCTCGACAGCCCGCA | 22128 22129 |
| bah18j14 | GGAAAAAATTGCTTGTCAAAT GGAAAAAATTTCTTGTCAAAT | 22132 |
| bah18j14 | TTCCCAACATAATTGCAATGT TTCCCAACATGATTGCAATGT | 22133 |
| bags37k14 | GACCGAATGATAGATCTCATA GACCGAATGAGAGATCTCATA | 22134 |
| bags37k14 | GCATTGATTTAATCTATGTTA GCATTGATTTGATCTATGTTA | 22135 |
| bah42k03 | CATAGCCCGATGCCACGACAT CATAGCCCGACGCCACGACAT | 22136 |
| bah42k03 | TAAAGGGCAGGGGAAAATATC TAAAGGGCAGGGAAAATATC | 22137 |
| bags12i02 | CGACTCTATGGGCAGCCACCG CGACTCTATGAGCAGCCACCG | 22139 |
| bags12i02 | CCACGTAAGGCAAATCTCCTG CCACGTAAGGGAAATCTCCIG | 22140 |
| bags12i02 | CAGACAGCAGCTCTTAGTCGA CAGACAGCAGTTCTTAGTCGA | 22141 |
| bags12i02 | CACTATACAGATTGTAAAACC CACTATACAGTTTGTAAAACC | 22142 |
| bags12i02 | ATGACGCCATAATATAAATCA ATGACGCCATTATATAAATCA | 22143 |
| baet25b0604 | GCGCTTGCTCGATGGAGGATG GCGCTTGCTCAATGGAGGATG | 22145 |
| baet25b0604 | TGCAGTAGTTATAGATCATGT TGCAGTAGTTGTAGATCATGT | 22146 |
| baak46e21 | ACTAATCTACGAATATTTGCC ACTAATCTACGAATATTTGCC | 22147 |
| baak46e21 | GCATTCTGTGGCCTAACTAAA GCATTCTGTGCCCTAACTAAA | 22148 |
| bags37j12 | ATGGAGGGTTTGTTGGAGGCT ATGGAGGGTTCGTTGGAGGCT | 22149 |
| bags37j12 | CATACACACTGCTTCATGCAT CATACACACTTCTTCATGCAT | 22150 |
| bags37j12 | ATACGGCATGCGATTAAACAG ATACGGCATGTGATTAAACAG | 22151 |
| baak30b08 | AAACAGTGTGCCCATCAGGCA AAACAGTGTGTCCATCAGGCA | 22153 |
| baak20o12 | ATGCATCTAGGTTCTAGATAC ATGCATCTAGATTCTAGATAC | 22155 — |

TABLE 28-19

| Clones | Haruna Niio H602 | SEQ ID NO: |
|---|---|---|
| baak20o12 | GCCTGATCGTCCTGGAGCGTC<br>GCCTGATCGTGCTGGAGCGTC | 22156 |
| baak20o12 | CCACGCTCCCGATGAAGAAGA<br>CCACGCTCCCCATGAAGAAGA | 22157 |
| baak20o12 | TAGATGCTAGCCATGCATCTA<br>TAGATGCTAGTCATGCATCTA | 22158 |
| basd14k23 | CTGCTCATGCTGAGAAGGCTG<br>CTGCTCATGCCGAGAAGGCTG | 22159 |
| BaAK23L05 | GCTTACCAGCGAAGATCAGGC<br>GCTTACCAGCAAAGATCAGGC | 22160 |
| BaAK23L05 | CCACCTCCAAGGTGATGGTCT<br>CCACCTCCAAGGTGATGGTCT | 22161 |
| BaAK23L05 | CACCACGAAGGCGGAGGACAA<br>CACCACGAAGGCAGGAGGACAA | 22162 |
| BaAK23L05 | TCGCCTTCACGTTGTCAATGG<br>TCGCCTTCACATTGTCAATGG | 22163 |
| bags33o01 | TGTGCTTGGATTTCAAGTTCA<br>TGTGCTTGGACTTCAAGTTCA | 22165 |
| bags33o01 | GGTATATATGCGAGTGTGCAA<br>GGTATATATGTGAGTGTGCAA | 22166 |
| bah24d24 | ACCCAATGGCGGGCAGTTTGG<br>ACCCAATGGCAGGCAGTTTGG | 22168 |
| bah24d24 | TGCAGGGAATTCTCAGCAAGG<br>TGCAGGGAATTCCTCAGCAAGG | 22169 |
| bags12f09 | CCACTCGTAGTAGCGTGTGTT<br>CCACTCGTAGCAGCGTGTGTT | 22170 |
| baak33h23 | ACGATCATATGGCACTTATAT<br>ACGATCATATTGCACTTATAT | 22171 |
| baak33h23 | TTTTACAAGCAACATAAGGAA<br>TTTTACAAGCGACATAAGGAA | 22172 |
| baak33h23 | CTTGTTCACAGGAAGTCTACT<br>CTTGTTCACACGAAGTCTACT | 22173 |
| bah47p03 | TTTTTAGGACACTCATAGCCT<br>TTTTTAGGACGCTCATAGCCT | 22174 |
| bah47p03 | AAAATCAGAAGGAGAATTTGA<br>AAAATCAGAAAGAGAATTTGA | 22175 |
| bah47p03 | CTGACTAATCTTCCGGGGTAG<br>CTGACTAATCGTCCGGGGTAG | 22176 |
| basd14f09 | GCTTACCAGCAAAGATCAGGC<br>GCTTACCAGCGAAGATCAGGC | 22177 |
| BaSD22F10 | GCAAAGATTAGGCGCTGCTGG<br>GCAAAGATTAAGCGCTGCTGG | 22179 |
| BaSD22F10 | TCAACCTCCAGTGTGATGGTC<br>TCAACCTCCAATGTGATGGTC | 22180 |
| BaSD22F10 | GCTGGTCCGGGGGGATGCCCT<br>GCTGGTCCGGAGGGATGCCCT | 22181 |
| BaSD22F10 | TGGTCTTGCCGGTGAGAGTCT<br>TGGTCTTGCCGGTGAGAGTCT | 22182 |
| BaSD22F10 | GCTTACCAGCAAAGATCAGGC<br>GCTTACCAGCGAAGAT-CAGGC_ | 22183 |

TABLE 28-20

| Clones | Haruna Niio H602 | SEQ ID NO: |
|---|---|---|
| bags27o20 | GTTGATCTAAAGGCAGATCCA<br>GTTGATCTAAGGGCAGATCCA | 22186 |
| bags27o20 | GGTCGTCTGACGAGGACTGT<br>GGTCGTCTGATGGAGGACTGT | 22187 |
| bags27o20 | CTCTTTTCGGGTTCATCGCCAG<br>CTCTTTTCGGGGTCATCGCCAG | 22188 |
| baak31o10 | AATCAGCACTCAACTGACCTT<br>AATCAGCACTGAACTGACCTT | 22189 |
| baak31o10 | GAAATCGTGAGGCCTAACGCC<br>GAAATCGTGAGGCCTAACGCC | 22190 |
| bags10f16 | CAAAGGACTCAATGACGGGGA<br>CAAAGGACTCGATGACGGGGA | 22191 |
| bags10f16 | TGCTTGAGAATCCAAAGGACT<br>TGCTTGAGAACCCAAAGGACT | 22192 |
| BaGS9H02 | GTCGGCAACCGCATTTCCCTT<br>GTCGGCAACCACATTTCCCTT | 22194 |
| kr66C0705 | GTGTGCACATCGTCTGATCAG<br>GTGTGCACATTGTCTGATCAG | 22197 |

TABLE 28-20-continued

| Clones | Haruna Niio H602 | SEQ ID NO: |
|---|---|---|
| kr66C0705 | CTTTTGGGAATGTTAACTGAT<br>CTTTTGGGAACGTTAACTGAT | 22198 |
| kr66C0705 | GGTGATCCGAACGTGTGAATA<br>GGTGATCCGAGCGTGTGAATA | 22199 |
| kr66C0705 | CTTTGATCTGGGCAGTAGTCG<br>CTTTGATCTGTGCAGTAGTCG | 22200 |
| BaGS33M05 | CCATGCCCTCCCCTGTGTACC<br>CCATGCCCTCGCCTGTGTACC | 22201 |
| BaGS33M05 | CTATCACCACGTGACAGCACC<br>CTATCACCACCTCACAGCACC | 22202 |
| baal24b02 | CCTAGAGCATAATATGCGGGT<br>CCTAGAGCATGATATGCGGGT | 22208 |
| baal24b02 | CTCCATGCCTAAACCAGCAAC<br>CTCCATGCCTGAACCAGCAAC | 22209 |
| bags34f08 | CAGATATATCTTTGCCAAATC<br>CAGATATATCATTGCCAAATC | 22210 |
| bags34f08 | CAGTGTTTCAAACTATTGTTA<br>CAGTGTTTCAGACTATTGTTA | 22211 |
| bags34f08 | GGCTTATTTTGATCTGCCACA<br>GGCTTATTTTCATCTGCCACA | 22212 |
| bast36D1208 | GCCGTCGCTACCCAAGCTCCC<br>GCCGTCGCTATCCAAGCTCCC | 22213 |
| kr25b1103 | ACTGCCCACCGGTCGTCCCCA<br>ACTGCCCACCAGTCGTCCCCA | 22214 |
| kr25b1103 | AGGGCTGCGGCCCCTACTGCC<br>AGGGCTGCGGTCCCTACTGCC | 22215 |
| kr25b1103 | GATCAACACGCTGAAGCTGGG<br>GATCAACACGTTGAAGCTGGG | 22216 |
| baal19g05 | ACACCAGCTGGCTGACTGACT<br>ACACCAGCTGACTGACTGACT | 22217 |
| baal19g05 | TCTACATACAGTTCGCTAACC<br>TCTACATACAATTCGCTAACC | 22218 |

TABLE 28-21

| Clones | Haruna Niio H602 | SEQ ID NO: |
|---|---|---|
| baal19g05 | GATGCCCGTCGGAGTCAGGCG<br>GATGCCCGTCAGAGTCAGGCG | 22219 |
| baal19g05 | TTCGCTAACCGCAAGAACAAG<br>TTCGCTAACCACAAGAACAAG | 22220 |
| bags19c10 | ACGCAAAAAAAGAGTAATAA<br>ACGCAAAAAGAGAGTAATAA | 22222 |
| bags19c10 | TACAACAGTGTATAAGAAGGC<br>TACAACAGTGCATAAGAAGGC | 22223 |
| bags19c10 | TTCTTCTTAGGGGCTAAATGA<br>TTCTTCTTAGCGGCTAAATGA | 22224 |
| bags19c10 | ACTTTAAGCATATGTGCTTAG<br>ACTTTAAGCAGATGTGCTTAG | 22225 |
| bags19c10 | TGCAAGCCATCATAGATCTAT<br>TGCAAGCCATTATAGATCTAT | 22226 |
| bags29k01 | CTCATAAAGTTGACATTCAGG<br>CTCATAAAGTGGACATTCAGG | 22227 |
| bags29k01 | AAGCTTAAGAAAGACAAACTC<br>AAGCTTAAGACAGACAAACTC | 22228 |
| bags29k01 | CTCCTCATCAATCCCAATGGC<br>CTCCTCATCAGTCCCAATGGC | 22229 |
| bags29k01 | CAGGAGATGTTACAAACAAAT<br>CAGGAGATGTGACAAACAAAT | 22230 |
| bags29k01 | TCATCGTCCCGAAGAATCGATC<br>TCATCGTCCCAAGAATCGATC | 22231 |
| bags29k01 | ACTTGCCGGCAGAGTATCAGG<br>ACTTGCCGGCGGAGTATCAGG | 22232 |
| bags29k01 | TGAGTGCTTCTTTCTCAGGCT<br>TGAGTGCTTCCTTCTCAGGCT | 22233 |
| bags29k01 | GGCTAACATCGACACTGAAAG<br>GGCTAACATCTACACTGAAAG | 22234 |
| bags29k01 | TGAAAGGCCCAACAAGTGTGA<br>TGAAAGGCCCGACAAGTGTGA | 22235 |
| bags29k01 | AAACAAATCAACCTACATTTC<br>AAACAAATCATCCTACATTTC | 22236 |
| bastl54G0414 | TATCTAGAAGACCAGAACATA<br>TATCTAGAAGGCCAGAACATA | 22237 |

TABLE 28-21-continued

| Clones | Haruna Niio H602 | SEQ ID NO: |
|---|---|---|
| bast15400414 | CTACTCCTTCGGACATTCCCC<br>CTACTCCTTCCGACATTCCCC | 22238 |
| bags34b15 | AGCCCCTTGT-CAGACCGCTG<br>AGCCCCTTGTACAGACCGCTG | 22240<br>22241 |
| bah31l17 | AAAATAATAAGAGGAACCCAC<br>AAAATAATAAAAGGAACCCAC | 22244 |
| bah31l17 | TTGATCAAATAAGGCCAAAAT<br>TTGATCAAATGAGGCCAAAAT | 22245 |
| bah31l17 | AGTCAAACTGATTGCACATTT<br>AGTCAAACTGGTTGCACATTT | 22246 |
| bah31l17 | ATCAAAACAGTATAGAACTT<br>ATCAAAACATTATAGAACTT | 22247 |
| bah31l17 | AGGATGCCACAGCCTTTTGTA<br>AGGATGCCACGGCCTTTTGTA | 22248 |

TABLE 28-22

| Clones | Haruna Niio H602 | SEQ ID NO: |
|---|---|---|
| baak32a05 | GACCATGCACAATCTCTTCCA<br>GACCATGCACTATCTCTTCCA | 22249 |
| baak32a05 | TCCCCTCCTTTCCCACAGTCA<br>TCCCCTCCTTGCCCACAGTCA | 22250 |
| bags30n22 | CACCTAATGTAGATGGAGCCA<br>CACCTAATGTTGATGGAGCCA | 22251 |
| bags30n22 | CACTGGCATTTTGCCATGGT<br>CACTGGCATTTTTGCCATGGT | 22252 |
| bags30n22 | ACTCTTATCGTCAGTAGCTGA<br>ACTCTTATCGGCAGTAGCTGA | 22253 |
| BaH27L17 | AGCCCTCGACGCCGATGATGT<br>AGCCCTCGACTCCGATGATGT | 22258 |
| BaH27L17 | TCGAGCAATCGAGCGCGATGA<br>TCGAGCAATCAAGCGCGATGA | 22259 |
| BaH27L17 | TTCTGTTTGCGGGTGTGTTGA<br>TTCTGTTTGCTGGTGTGTTGA | 22260 |
| BaH27L17 | GCAACTCTATGCCCCAACGAA<br>GCAACTCTATTCCCCAACGAA | 22261 |
| basd17e11 | ATATGGTCTCGAAGAGTTCCT<br>ATATGGTCTCAAAGAGTTCCT | 22262 |
| basd17e11 | TGTATTAAGAAGTGCATGCTA<br>TGTATTAAGAGGTGCATGCTA | 22263 |
| basd17e11 | GGTACTCCTGGCCACTGTTTA<br>GGTACTCCTGTCCACTGTTTA | 22264 |
| basd17e11 | ACTTCGGTCGGTGICCTGCAA<br>ACTTCGGTCGCTGTCCTGCAA | 22265 |
| basd17e11 | TGTCCTGCAACCCCAAAGGAC<br>TGTCCTGCAAACCCAAAGGAC | 22266 |
| bags15i06 | TCGAACTCCTCTGGTCGCTAG<br>TCGAACTCCTITGGTCGCTAG | 22267 |
| bags15i06 | ACTGCAGGACAAGCTGCTTCA<br>ACTGCAGGACGAGCTGCTTCA | 22268 |
| bags15i06 | CTGCTCCTGGTACTGCAGGAC<br>CTGCTCCTGGGACTGCAGGAC | 22269 |
| bags15i06 | AGTAGATTTTCAGTTCAGAT<br>AGTAGATTTTGCAGTTCAGAT | 22270 |
| bags15i06 | CAGCGCGTAGTTGTTGATCTG<br>CAGCGCGTAGGTGTTGATCTG | 22271 |
| bags15i06 | CGCCCTATCCCACGGCCAACA<br>CGCCCTATCCGACGGCCAACA | 22272 |
| bags15i06 | ACTCTCAATCACCAAGGGCCA<br>ACTCTCAATCTCCAAGGGCCA | 22273 |
| baak36f09 | CGATGGCGGCTCCGTAGTGCG<br>CGATGGCGGCGCCGTAGTGCG | 22274 |
| baak36f09 | CGGGCACGCGTGTGAGGTAGA<br>CGGGCACGCGGGTGAGGTAGA | 22275 |
| bast57a0101 | TTCTCCATTACAAACCTATTA<br>TTCTCCATTAIAAAACCTATTA | 22276 |
| basd13b15 | GGTGAGGCTCGCGTCTTCGCT<br>GGTGAGGCTCACGTCTTCGCT | 22278 |

TABLE 28-23

| Clones | Haruna Niio H602 | SEQ ID NO: |
|---|---|---|
| basd13b15 | TCAGCTGCGCGTTGTCGATGA<br>TCAGCTGCGCATTGTCGATGA | 22279 |
| bags9d11 | ACAATCATCAGATATGAGTGG<br>ACAATCATCATATATGAGTGG | 22280 |
| bags9d11 | GGGCCCATAGTTAACCCAACT<br>GGGCCCATAGGTAACCCAACT | 22281 |
| bags9d11 | CTAAGTTGTTGTATAGGCATC<br>CTAAGTTGTTGTATAGGCATC | 22282 |
| bags9d11 | TAACCCAACTTCTTGGGGGAA<br>TAACCCAACTCCTTGGGGGAA | 22283 |
| bags9d11 | TGTTCCATATTTGATCGATGA<br>TGTTCCATATCTGATCGATGA | 22284 |
| bags9d11 | GTTTTGCCGCGCGATATAGTG<br>GTTTTGCCGCACGATATAGTG | 22285 |
| bags9d11 | GTAATAAATTGAATGCTCTTC<br>GTAATAAATTAAATGCTCTTC | 22286 |
| bags9d11 | TGTCTTAATTGTTAGTCTTCA<br>TGTCTTAATTATTAGTCTTCA | 22287 |
| bags9d11 | AAACTAAAACTTACCTGTGGG<br>AAACTAAAACATACCTGTGGG | 22288 |
| bags9d11 | ATTTCAGCCTGTTAAAAAACC<br>ATTTCAGCCTATTAAAAAACC | 22289 |
| kr30f1212 | TTCGACAAGAGAGCCACAAAC<br>TTCGACAAGAAAGCCACAAAC | 22290 |
| bast145b0903 | CAGTCCAACACTTCTTTCTAA<br>CAGTCCAACACTTTCTTTCTAA | 22291 |
| BaGS32I12 | CCTTGGCCGCCGCAGATGCGT<br>CCTTGGCCGCTGCAGATGCGT | 22292 |
| BaGS32I12 | CACAGCCATCGTATGGCATGT<br>CACAGCCATCITATGGCATGT | 22293 |
| BaGS32I12 | CCGAGCAAACTACATTTTGCT<br>CCGAGCAAACCACATTTTGCT | 22294 |
| baak27p06 | AGTGACAATGCCATGCTTTTG<br>AGTGACAATGTCATGCTTTTG | 22296 |
| baak27p06 | CAAGAAAAATTTCCTAAAAGG<br>CAAGAAAAATGTCCTAAAAGG | 22297 |
| baak27p06 | CAAGTACCTCAGTAAAATCAT<br>CAAGTACCTCGGTAAAATCAT | 22298 |
| baak27p06 | CATCACCAAGCAGGGGGTTCC<br>CATCACCAAGTAGGGGATTCC | 22299 |
| baak27p06 | CTGGGTCTCAAAAGTGACAAT<br>CTGGGTCTCAGAAGTGACAAT | 22300 |
| bags21m21 | TCCCCTGGAAAACCTCGCCGC<br>TCCCCTGGAAAGACCTCGCCGC | 22301 |
| basd16e11 | TAGGTTCATACATTCACGTAT<br>TAGGTTCATACATTCACGTAT | 22304 |
| basd16e11 | TGCTCGCGCACCTCTCCACCA<br>TGCTCGCGCATCTCTCCACCA | 22305 |
| basd16e11 | TCAAAGAACACAGGAAGGATG<br>TCAAAGAACAGAGGAAGGATG | 22306 |

TABLE 28-24

| Clones | Haruna Niio H602 | SEQ ID NO: |
|---|---|---|
| basd16e11 | CAGTCTCTATTCTTTGATCCA<br>CAGTCTCTATGCTTTGATCCA | 22307 |
| baak21n09 | ATCCATAACTTTTGGCCACCC<br>ATCCATAACTGTTGGCCACCC | 22308 |
| baak21n09 | CCACTTCCTCATCCGCATTTG<br>CCACTTCCTCGTCCGCATTTG | 22309 |
| baak21n09 | CTTGCAAGCTATCGAACTGGC<br>CTTGCAAGCTGICGAACTGGC | 22310 |
| baak1g17 | ACATGAAACAAACTCAGACCT<br>ACATGAAACAGACTCAGACCT | 22311 |
| baak1g17 | AACAGAGCACTGTTCGTTTCA<br>AACAGAGCACCGTTCGTTTCA | 22312 |
| baak1g17 | GTGGTTTTTTCCGCTACTTCA<br>GTGGTTTTTTGCGCTACTTCA | 22313 |
| baal35f12 | AGCTTATTATGCTCATGTTCA<br>AGCTTATTATTCTCATGTTCA | 22315 |
| baal35f12 | AGTTGGATACNAGAGACACTA<br>AGTTGGATACAAGAGACAGTA | 22316 |

TABLE 28-24-continued

| Clones | Haruna Niio H602 | SEQ ID NO: |
|---|---|---|
| baa135f12 | GACCACCTCTGCATGATAGAG GACCACCTCTACATGATAGAG | 22317 |
| bah29b02 | ACTTCTTGCCATCAGTGCTTG ACTTCTTGCCGTCAGTGCTTG | 22320 |
| bah29b02 | TTAAGCCAAGTTCAGTACTGG TTAAGCCAAGGTCAGTACTGG | 22321 |
| bah29b02 | ATCTGCTGACTGATTCACCAA ATCTGCTGACCGATTCACCAA | 22322 |
| bah29b02 | AGCATACCAAAATTTTTAGGT AGCATACCAAGATTTTTAGGT | 22323 |
| kr61C0305 | CCGGGCAAAAGCATGTTGTTT CCGGGCAAAAACATGTTGTTT | 22325 |
| kr61C0305 | ATAATATGCAAGAACACTTGT ATAATATGCAGGAACACTTGT | 22326 |
| kr61C0305 | CCTTTGATATATCTGCATGCA CCTTTGATATGTCTGCATGCA | 22327 |
| BaH23B08 | ACAATCCAAGGCACCTTCATA ACAATCCAAGACACCTTCATA | 22328 |
| bah51g17 | CAAATCAATTACACAAATAGT CAAATCAATTACACAAATAGT | 22330 |
| bah51g17 | TAGAGAGCTGCAACGCCACAT TAGAGAGCTGAAACGCCACAT | 22331 |
| bah51g17 | CATGTTAAAATTTGTAGGGAA CATGTTAAAACTTGTAGGGAA | 22332 |
| basd22e19 | TGCCGGGCGCTTAGCAGCAGC TGCCGGGCGCATAGCAGCAGC | 22333 |
| basd22e19 | CTTGCATATTGTGTCGGAGCC CTTGCATATTATGTCGGAGCC | 22334 |
| basd22e19 | TATTAGTCCATAAGACAATAC TATTAGTCCACAAGACAATAC | 22335 |
| basd22e19 | TAATATGATTAAAGTTTTGAG TAATATGATTGAAGTTTTGAG | 22336 |

TABLE 28-25

| Clones | Haruna Niio H602 | SEQ ID NO: |
|---|---|---|
| basd22e19 | GAGAATATAAAATGTATGTTT GAGAATATAAGATGTATGTTT | 22337 |
| basd22e19 | CCATTTCTTCAATCTTAGCAA CCATTTCTTCCATCTTAGCAA | 22338 |
| basd22e19 | TAGCAGTGCAGGCATATCATT TAGCAGTGCAGGCATATCATT | 22339 |
| basd22e19 | ATTGTAGGTACACATTAACAT ATTGTAGGTAAACATTAACAT | 22340 |
| basd22e19 | CATTCAACAACTTATTGTAGG CATTCAACAATTTATTGTAGG | 22341 |
| basd22e19 | TTTTGCATGGAAAGAGAATAT TTTTGCATGGGAAGAGAATAT | 22342 |

As described above, a gene polymorphism detection instrument according to the present invention is realized with a support immobilized thereon polynucleotides that comprise part of the base sequences of amplified DNA fragments that have polymorphism between different varieties. The amplified DNA fragments with polymorphism are not limited to those shown in Table 8-1 through Table 14-9, as long as they are DNA fragments that have polymorphism between different varieties and that have been amplified, using the genomic DNA of Triticeae species as a template, with a primer set that comprises a combination of two primers arbitrarily selected from (i) primers that have been designed based on the base sequence of SEQ ID NO: n (where n is an odd number), and (ii) primers that have been designed based on the base sequence of SEQ ID NO: (n+1), from among the base sequences of SEQ ID NO: 1 through 5780. In the case of SNP, part of amplified DNA fragments is a polynucleotide that comprises the base sequence of a region including a SNP base. In fragment length polymorphism, part of amplified DNA fragments is a polynucleotide that includes, or does not include, the base sequence of a region, if specified, causing a fragment length difference (a base sequence portion that is present in one of the varieties but not in the other). A polynucleotide that includes such base sequence portion, and a polynucleotide that does not include such base sequence portion may be used together.

In the case where a gene polymorphism detection instrument according to the present invention is used for detection of single nucleotide polymorphism (SNP), the polynucleotide immobilized on the support is preferably a synthetic oligonucleotide. Many SNP detecting arrays currently available use synthetic oligonucleotides, and these techniques can be used for the present invention. The polynucleotide immobilized on the support may have any number of bases as long as it can detect gene expression. For example, in the case where only one synthetic oligonucleotide is immobilized in each region, an oligonucleotide with at least 50 bases is considered to be sufficient for detection of gene expression. When more than one synthetic nucleotide is immobilized in each region as in the Affymetrix system, an oligonucleotide with about 25 bases is sufficient.

[Gene Polymorphism Detection Instrument with the Polynucleotides Immobilized in Regions that are Arranged in the Chromosomal Order]

As described above, the chromosomal order of polynucleotides on barley chromosomes (1H, 2H, 3H, 4H, 5H, 6H, or 7H) (distance from the short arm end of each chromosome) has been specified in clones that have the base sequences of SEQ ID NO: n (where n is an odd number) and SEQ ID NO: n+1 from among the base sequences of SEQ ID NO: 1 through SEQ ID NO: 5780. Thus, if the polynucleotides comprising part of the DNA fragments amplified with the primers that have been designed based on the respective base sequences were placed, for example, according to the order of the polynucleotides, as represented in Table 1-1 through Table 7-9, having the reference base sequences of the primers, it would be possible to place the polynucleotides according to the order in which these polynucleotides are arranged from the short arm end of 1H chromosome to the long arm end of 7H chromosome, i.e., chromosomal order. For clones that have the same order from the short arm end, the order by which these clones are placed is not particularly limited. Once the precise order of these clones were specified by a future study, these clones will be able to be placed accordingly. Note that, the reference point (origin) on the chromosome is not just limited to the short arm end of 1H chromosome. Any position on a chromosome can be used as a reference point. If the polynucleotides immobilized on the support have overlapping portions, one closest to the 5' end is placed first. When there is more than one polynucleotide having the same 5' end position, these polynucleotides are placed contiguously in any order relative to one another.

With the polynucleotides immobilized on a support in the order they are arranged on the chromosomes, the value of a gene polymorphism detection instrument according to the present invention can be greatly improved in crossbreeding of Triticeae species. More specifically, by using a gene polymorphism detection instrument according to the present invention for comprehensive investigation of gene polymorphism of Triticeae species, the genotype of a target gene of breeding can be determined. Further, the location and extent of recombination on chromosomes can be checked to see if unnecessary recombination has occurred. That is, the genotypes of the parents are directly inherited as the haplotype in portions of the chromosomes where no recombination has occurred. As a result, the genotype of a trait conferred to the selected individuals can be easily determined, with the result that the efficiency of breeding is improved.

[Gene Polymorphism Detection Instrument with the Polynucleotides Immobilized in Regions appended with Chromosomal Order Information]

The regions in which the polynucleotides are immobilized (spots) may be appended with information indicative of the order in which the polynucleotides are arranged on barley chromosomes. The spots may be arranged in any way as long as they are appended with the order information. With the order information added to the spots, the data obtained from the spots can be rearranged in the chromosomal order even when the spots are randomly placed on a support. In this way, a gene detection instrument according to the present invention can improve the efficiency of breeding. Note that, the order information added to the spots can follow the foregoing criteria used to place the polynucleotides.

Adding order information enables the spots to be arranged in an arbitrary order in a gene polymorphism detection instrument of an array type, in which more than one polynucleotide is immobilized on a support such as a membrane or a glass slide. Further, the chromosomal order information of individual polynucleotides can also be added in a gene polymorphism detection instrument that employs a collection of beads (bead array) in which the polynucleotide is immobilized on each bead serving as a support.

[Examples of a Gene Polymorphism Detection Instrument according to the Present Invention]

Various conventional techniques that are designed for detection of gene polymorphism, particularly single nucleotide polymorphism (SNP) can be suitably used for a gene polymorphism detection instrument according to the present invention.

A representative example of such conventional techniques is GeneChip array for DNA analysis (Affymetrix). In this array, total genomic DNA is excised with restriction enzyme, and adapters that recognize cohesive ends of 4 bases are ligated. The adapters can be ligated to all fragments of any size generated by the restriction enzyme treatment. From these fragments, fragments of 250 to 1000 bp are selectively amplified by PCR and hybridized with an array that has been designed to cause a match or mismatch with SNP portions. Many other conventional SNP detecting arrays have been commercially marketed, which are also applicable to a gene polymorphism detection instrument according to the present invention. The present invention can also employ the techniques disclosed in Non-Patent Publications 1 and 2.

Alternatively, an array system can be realized with use of Gene Silicon of TOYO KOHAN. Gene Silicon is a multipurpose chip made of a DLC (diamond like carbon)-coated semiconductor silicon substrate with an activated ester-bearing carboxyl group introduced on the surface. With the activated ester-bearing carboxyl group, Gene Silicon can immobilize DNA or proteins on the substrate.

For example, a plurality of primer sets is designed that serves as genetic markers for distinguishing barley variety A and barley variety B, and that can cause amplification in only one of the varieties when PCR is performed with the genomic DNA of these two varieties as templates. Specifically, the primers are preferably designed based on polymorphic sites of the both varieties.

One of the primers from each primer set is placed and immobilized on Gene Silicon in the chromosomal order. The array is then hybridized with genomic DNA prepared from the hybrid of a cross between variety A and variety B, and PCR reaction is performed in a reaction solution containing Cydye-dNTP.

The presence or absence of amplification in each spot can easily be confirmed by observing fluorescence emitted by the incorporation of Cydye-dNTP. Specifically, whether the genomic DNA that resides in portions of chromosomes where the genetic markers (amplified fragments) are mapped originates in which of the parents (variety A or variety B) is confirmed according to the presence or absence of amplification. In this way, locations of recombination can be found easily.

(3) Polypeptide-Interacting Substance Detection Instrument According to the Present Invention A polypeptide-interacting substance detection instrument according to the present invention is an instrument for detecting substances that interact with proteins encoded by genes that reside in the genomes of Triticeae species, or substances that interact with polypeptides that constitutes part of the proteins. The organisms to which a polypeptide-interacting substance detection instrument of the invention is applicable may be any Triticeae species, among which barley, wheat, and rye are preferable. As will be described later, a polypeptide-interacting substance detection instrument according to the present invention includes a support on which polypeptides encoded by polynucleotides that constitute part of DNA of barley chromosomes (1H, 2H, 3H, 4H, 5H, 6H, and 7H chromosomes) are immobilized. The polypeptides immobilized on the support may solely be polypeptides encoded by polynucleotides constituting part of barley chromosomal DNA, or other polypeptides may additionally be immobilized on the support. Such additional polypeptides are not particularly limited. For example, the additional polypeptides may be those encoded by polynucleotides with the base sequences originating in non-barley organisms, or those with arbitrary amino acid sequences that have been artificially synthesized.

In the case where the polypeptides are immobilized in more than one region of the support, the polypeptides immobilized in these regions may have non-overlapping amino acid sequences or partially overlapping amino acid sequences. Alternatively, polypeptides of the same amino acid sequence may be immobilized in these different regions of the support. In the case where the polypeptides have overlapping base sequences, the polypeptides may have partially overlapping amino acid sequences, or the amino acid sequence of one of the polypeptides may be a partial sequence of the other polypeptide.

Further, the polypeptide immobilized in each region is not necessarily required to be of the same kind. More than one kind of polypeptide may be immobilized in each region.

The support is not particularly limited as long as it can immobilize polypeptides, and it may have any shape and may be made of any material. Examples of a support material generally include: inorganic materials such as glass and silicon wafer; natural polymers such as paper; synthetic polymers such as nitrocellulose and nylon; and gels using synthetic polymers or natural polymers. The shape of the support is not particularly limited as long as it provides enough area to support the polypeptides. Generally, those with a two-dimensional plane, for example, such as a substrate with little or no flexibility, a flexible membrane, or a flexible substrate with intermediate flexibility can be preferably used. The thickness of the substrate or membrane is not particularly limited either, and it can be suitably set according to the material or use of the substrate or membrane. Various types of beads may be used as supports.

[Polypeptides Immobilized on a Support of the Polypeptide-Interacting Substance Detection Instrument]

In a polypeptide-interacting substance detection instrument according to the present invention, at least one polypeptide encoded by the following polynucleotides (a) or (b) is immobilized on a support.

(a) Polynucleotides with base sequences constituting part of barley chromosomal DNA, or variants thereof with the substitution, deletion, insertion, and/or addition of one or more bases.

(b) Polynucleotides with a combination of base sequences constituting part of barley chromosomal DNA, or variants thereof with the substitution, deletion, insertion, and/or addition of one or more bases.

As used herein, a polynucleotide with a base sequence constituting part of barley chromosomal DNA is not particularly limited as long as it is a polynucleotide with a base sequence constituting part of the entire base sequences of chromosomal DNA of barley 1H, 2H, 3H, 4H, 5H, 6H, and 7H chromosomes, and including a protein-coding region. Further, a polynucleotide with a combination of base sequences constituting part of barley chromosomal DNA refers to a polynucleotide in which a base sequence constituting part of the entire base sequences of chromosomal DNA of barley 1H, 2H, 3H, 4H, 5H, 6H, and 7H chromosomes is joined to non-continuous base sequences constituting other parts of these chromosomes, and in which a protein-coding region is contained. For example, base sequences from two different parts of the chromosomes may constitute the polynucleotide, or three or more base sequences may join together to form the polynucleotide. Specifically, for example, cDNA with a plurality of exons from a protein-coding gene on barley chromosomal DNA can be regarded as a polynucleotide with a combination of base sequences constituting part of barley chromosomal DNA. However, the polynucleotide is not just limited to this specific example.

A variant with the substitution, deletion, insertion, and/or addition of one or more bases in the polynucleotide with a base sequence, or a combination of base sequences, constituting part of barley chromosomal DNA may be a polynucleotide that has been mutated on purpose, or a polynucleotide that exists in nature. For example, think of a base sequence of chromosomal DNA in a specific variety of barley. Comparing this base sequence with those of other varieties, no sequence is completely identical. Rather, these sequences are variants with the substitution, deletion, insertion, and/or addition of one or more bases. The polypeptide encoded by a polynucleotide with such variant base sequence may have the same amino acid sequence as the polypeptide encoded by a polynucleotide with a non-variant base sequence. Further, the polypeptides encoded by the polynucleotides with variant and non-variant base sequences may differ from each other with the substitution of some of the amino acids, or most of or all of the amino acid sequences may be different between these polypeptides.

Polynucleotides that encode polypeptides immobilized on a support of a polypeptide-interacting substance detection instrument according to the present invention are preferably polynucleotides with the base sequences of SEQ ID NO: 1 through 5780, or variants with the substitution, deletion, insertion, and/or addition of one or more bases in the polynucleotides with the base sequences of SEQ ID NO: 1 through 5780. (Such polynucleotides and variants will be referred to as polynucleotides or the like with the base sequences of SEQ ID NO: 1 through 5780.)

The base sequences of SEQ ID NO: 1 through 5780 are base sequences of the barley EST (expressed sequence tag) independently developed by the inventors. The inventors have previously confirmed that a polynucleotide with the base sequences of SEQ ID NO: 1 through 770, a polynucleotide with the base sequences of SEQ ID NO: 771 through 1754, a polynucleotide with the base sequences of SEQ ID NO: 1755 through 2642, a polynucleotide with the base sequences of SEQ ID NO: 2643 through 3324, a polynucleotide with the base sequences of SEQ ID NO: 3325 through 4320, a polynucleotide with the base sequences of SEQ ID NO: 4321 through 4962, and a polynucleotide with the base sequences of SEQ ID NO: 4963 through 5780 are mapped on 1H, 2H, 3H, 4H, 5H, 6H, and 7H chromosomes, respectively.

It follows from this that the base sequences of SEQ ID NO: 1 through 5780 are partial sequences of barley cDNA. Thus, if polynucleotides with the base sequences of SEQ ID NO: 1 through 5780 contained protein-coding regions, polypeptides encoded by these polynucleotides can be immobilized on the support. Further, variants with the substitution, deletion, insertion, and/or addition of one or more bases in the base sequences of SEQ ID NO: 1 through 5780 constitute variant base sequences of barley cDNA. Thus, if these polynucleotides with variant base sequences contained protein-coding regions, polypeptides encoded by these polynucleotides can be immobilized on the support. The polynucleotides with variant base sequences may be polynucleotides that have been mutated on purpose, or polynucleotides that exist in nature.

Polynucleotides that encode polypeptides immobilized on a support of a polypeptide-interacting substance detection instrument according to the present invention may be a part of the polynucleotides or the like with the base sequences of SEQ ID NO: 1 through 5780. Since the base sequence of such partial polynucleotide is a partial base sequence of barley cDNA, a polypeptide encoded by such partial polynucleotide can be immobilized on the support if the partial polynucleotide contains a protein-coding region.

Further, polynucleotides that encode polypeptides immobilized on a support of a polypeptide-interacting substance detection instrument according to the present invention may be polynucleotides whose partial sequence comprises all of or part of the base sequences of SEQ ID NO: 1 through 5780. The remaining base sequences of the polynucleotides are not limited. For example, since the base sequences of SEQ ID NO: 1 through 5780 are partial sequences of barley cDNA, these base sequences do not have the sequences on either end as originally found in the full length cDNA. Thus, a polynucleotide whose partial sequence comprises all of or part of the base sequences of SEQ ID NO: 1 through 5780, and which additionally includes the cDNA sequences on the both ends or one end as originally found in the full length cDNA can be regarded as a polynucleotide whose partial sequence comprises all of or part of the base sequences of SEQ ID NO: 1 through 5780. Further, vectors such as plasmids and BACs (bacterial artificial chromosomes) that have incorporated all of or part of the polynucleotides or the like with the base sequences of SEQ ID NO: 1 through 5780, and polynucleotides in which the partial sequence is ligated to arbitrary base sequences can also be regarded as polynucleotides whose partial sequence comprises all of or part of the base sequences of SEQ ID NO: 1 through 5780. Such polynucleotides at least include all of or part of the polynucleotides or the like with the base sequences of SEQ ID NO: 1 through 5780, i.e., part of barley cDNA. Therefore, polypeptides encoded by such polynucleotides can be immobilized on the support if the polynucleotides contain a protein-encoding region.

Further, polynucleotides that encode polypeptides immobilized on a support of a polypeptide-interacting substance detection instrument according to the present invention may be polynucleotides or the like whose partial sequences comprise all of or part of the base sequence, or a variant thereof, of SEQ ID NO: n (where n is an odd number), and all of or part of the base sequence, or a variant thereof, of SEQ ID NO: n+1, from among the base sequences of SEQ ID NO: 1 through 5780. As described above, the base sequences of SEQ ID NO: 1 through 5780 are EST sequences of barley, and comprise sequences that can be read by sequencing the cloned cDNA from the both ends only once. In other words, the base sequences of SEQ ID NO: n (where n is an odd number) and SEQ ID NO: n+1 among the base sequences of SEQ ID NO: 1 through 5780 are base sequences that are read from the both ends of the cDNA of the same clone. As such, these base sequences can realize a full length cDNA base sequence, which corresponds to all of or part of the full length cDNA. Thus, polynucleotides or the like whose partial sequences comprise all of or part of the base sequence, or a variant thereof, of SEQ ID NO: n (where n is an odd number), and all of or part of the base sequence, or a variant thereof, of SEQ ID NO: n+1, from among the base sequences of SEQ ID NO: 1 through 5780 can be regarded as polynucleotides with full length cDNA that comprises the base sequences of SEQ ID NO: n (where n is an odd number) and SEQ ID NO: n+1, or polynucleotides that comprise part of the full length cDNA. Further, the polynucleotides may be polynucleotides in which vector sequences or arbitrary base sequences for example are ligated to the both ends or one end of the full length cDNA or a polynucleotide that comprises part of the full length cDNA. Further, the polynucleotides may be variants that have a base substitution or other mutations in sequences other than the base sequences of SEQ ID NO: 1 through 5780, i.e., a middle section of the total cDNA unspecified by SEQ ID NO: n (where n is an odd number) and SEQ ID NO: n+1. Such polynucleotides include the full length or part of barley cDNA, enabling polypeptides encoded by the polynucleotides to be immobilized on the support. In particular, when the polynucleotides are full length cDNA or include full length cDNA, the entire proteins encoded by the genes located on the barley chromosomes can be immobilized on the support.

[Peptide-Interacting Substance Detection Instrument with the Polypeptides Immobilized in Regions that are Arranged in the Chromosomal Order]

As described above, the chromosomal order of polynucleotides on barley chromosomes (1H, 2H, 3H, 4H, 5H, 6H, or 7H) (distance from the short arm end of chromosome) has been specified in clones that have the base sequences of SEQ ID NO: n (where n is an odd number) and SEQ ID NO: n+1 from among the base sequences of SEQ ID NO: 1 through SEQ ID NO: 5780. Thus, if the polypeptides encoded by the polynucleotides with the base sequences of SEQ ID NO: 1 through SEQ ID NO: 5780 were placed according to the order, as represented in Table 1-1 through Table 7-9, of the polynucleotides encoding the polypeptides, it would be possible to place the polypeptides according to the order from the short arm end of 1H chromosome to the long arm end of 7H chromosome, i.e., chromosomal order. For clones that have the same order from the short arm end, the order by which these clones are placed is not particularly limited. Once the precise order of these clones were specified by a future study, these clones will be able to be placed accordingly. Note that, the reference point (origin) on the chromosome is not just limited to the short arm end of 1H chromosome. Any position on a chromosome can be used as a reference point.

With the polypeptides immobilized on a support in the order they are arranged on the chromosomes, the location and extent of recombination on chromosomes can be checked for genes from which the expressed proteins originate. That is, the genotypes of the parents are directly inherited as the haplotype in portions of the chromosomes where no recombination has occurred. As a result, the genotype of a trait conferred to the selected individuals can be easily determined, with the result that the efficiency of breeding is improved.

[Polypeptide-Interacting Substance Detection Instrument with the Polypeptides Immobilized in Regions Appended with Chromosomal Order Information]

The regions in which the polypeptides are immobilized (spots) may be appended with information indicative of the order in which the polynucleotides encoding the polypeptides are arranged on barley chromosomes. The spots may be arranged in any way as long as they are appended with the order information. With the order information added to the spots, the data obtained from the spots can be rearranged in the chromosomal order even when the spots are randomly placed on a support. Note that, the order information added to the spots can follow the foregoing criteria used to place the polypeptides.

Adding order information enables the spots to be arranged in an arbitrary order in a polypeptide-interacting substance detection instrument of an array type, in which more than one polypeptide is immobilized on a support such as a membrane or a glass slide. Further, the chromosomal order information of individual polypeptides can also be added in a polypeptide-interacting substance detection instrument that employs a collection of beads (bead array) in which the polypeptide is immobilized on each bead serving as a support.

[Examples of a Polypeptide-Interacting Substance Detection Instrument According to the Present Invention]

Various conventional techniques that are designed for detection of protein (polypeptide)-interacting substances can suitably be used in a polypeptide-interacting substance detecting instrument according to the present invention.

For example, a biological chip, one kind of protein chip, has been commercially available from Ciphergen Biosystems, Inc. This biological chip has an activated group such as carbonyl diimidazole or epoxy on a surface of a substrate (support), allowing a user to freely immobilize target proteins or antibodies. This technique is therefore applicable to a polypeptide-interacting substance according to the present invention. Since the activated group such as carbonyl diimidazole or epoxy can immobilize antibodies or polynucleotides, the biological chip can be used for the fabrication of other detection instruments of the present invention.

(4) Polypeptide Detection Instrument according to the Present Invention

A polypeptide detection instrument according to the present invention is an instrument for detecting proteins encoded by genes that reside in the genomes of Triticeae species, or polypeptides that constitutes part of the proteins. The organisms to which a polypeptide detection instrument of the invention is applicable may be any Triticeae species, among which barley, wheat, and rye are preferable. As will be described later, a polypeptide detection instrument according to the present invention includes a support on which polypeptides encoded by polynucleotides that constitute part of DNA of barley chromosomes (1H, 2H, 3H, 4H, 5H, 6H, and 7H chromosomes) are immobilized. The polypeptides immobilized on the support may solely be antibodies against the polypeptides encoded by polynucleotides constituting part of barley chromosomal DNA, or other antibodies may additionally be immobilized on the support. Such additional antibodies are not particularly limited. For example, antibodies encoded by polynucleotides with the base sequences originating in non-barley organisms may be immobilized.

As used herein, the term "antibodies" refers to immunoglobulins that can recognize and bind to specific antigens. However, the term does not necessarily mean antibody molecules as a whole, but also refers to part of antibody molecules including antigen binding sites.

It is preferable that the support include a plurality of immobilizing regions, and that different kinds of antibodies be immobilized in these regions. Further, the antibodies immobilized in each region are not necessarily required to be of the same kind. More than one kind of antibodies may be immobilized in each region.

The support is not particularly limited as long as it can immobilize antibodies, i.e., proteins, and it may have any shape and may be made of any material. Examples of a support material generally include: inorganic materials such as glass and silicon wafer; natural polymers such as paper; synthetic polymers such as nitrocellulose and nylon; and gels using synthetic polymers or natural polymers. The shape of the support is not particularly limited as long as it provides enough area to support the polynucleotides. Generally, those with a two-dimensional plane, for example, such as a substrate with little or no flexibility, a flexible membrane, or a flexible substrate with intermediate flexibility can be preferably used. The thickness of the substrate or membrane is not particularly limited either, and it can be suitably set according to the material or use of the substrate or membrane. Various types of beads may be used as supports.

[Antibodies Immobilized on a Support of the Polypeptide Detection Instrument]

In a polypeptide detection instrument according to the present invention, at least one antibody against a polypeptide encoded by a polynucleotide selected from the following polynucleotides (a) or (b) is immobilized on a support.

(a) Polynucleotides with base sequences constituting part of barley chromosomal DNA, or variants thereof with the substitution, deletion, insertion, and/or addition of one or more bases.

(b) Polynucleotides with a combination of base sequences constituting part of barley chromosomal DNA, or variants thereof with the substitution, deletion, insertion, and/or addition of one or more bases.

As used herein, a polynucleotide with a base sequence constituting part of barley chromosomal DNA is not particularly limited as long as it is a polynucleotide that has a base sequence constituting part of the entire base sequences of chromosomal DNA of barley 1H, 2H, 3H, 4H, 5H, 6H, and 7H chromosomes, and that includes a protein-coding region. Further, a polynucleotide with a combination of base sequences constituting part of barley chromosomal DNA refers to a polynucleotide in which a base sequence constituting part of the entire base sequences of chromosomal DNA of barley 1H, 2H, 3H, 4H, 5H, 6H, and 7H chromosomes is joined to non-continuous base sequences constituting other parts of these chromosomes, and in which a protein-coding region is contained. For example, base sequences from two different parts of the chromosomes may constitute the polynucleotide, or three or more base sequences may join together to form the polynucleotide. Specifically, for example, cDNA with a plurality of exons from a protein-coding gene on barley chromosomal DNA can be regarded as a polynucleotide with a combination of base sequences constituting part of barley chromosomal DNA. However, the polynucleotide is not just limited to this specific example.

A variant with the substitution, deletion, insertion, and/or addition of one or more bases in the polynucleotide with a base sequence, or a combination of base sequences, constituting part of barley chromosomal DNA may be a polynucleotide that has been mutated on purpose, or a polynucleotide that exists in nature. For example, think of a base sequence of chromosomal DNA in a specific variety of barley. Comparing this base sequence with those of other varieties, no sequence is completely identical. Rather, these sequences are variants with the substitution, deletion, insertion, and/or addition of one or more bases. The polypeptide encoded by a polynucleotide with such variant base sequence may have the same amino acid sequence as the polypeptide encoded by a polynucleotide with a non-variant base sequence. Further, the polypeptides encoded by the polynucleotides with variant and non-variant base sequences may differ from each other with the substitution of some of the amino acids, or most of or all of the amino acid sequences may be different between these polypeptides.

Polynucleotides that encode polypeptides used for production of antibodies immobilized on a support of a polypeptide detection instrument according to the present invention are preferably polynucleotides with the base sequences of SEQ ID NO: 1 through 5780, or variants with the substitution, deletion, insertion, and/or addition of one or more bases in the polynucleotides with the base sequences of SEQ ID NO: 1 through 5780. (Such polynucleotides and variants will be referred to as polynucleotides or the like with the base sequences of SEQ ID NO: 1 through 5780.)

The base sequences of SEQ ID NO: 1 through 5780 are base sequences of the barley EST (expressed sequence tag) independently developed by the inventors. The inventors have previously confirmed that a polynucleotide with the base sequences of SEQ ID NO: 1 through 770, a polynucleotide with the base sequences of SEQ ID NO: 771 through 1754, a polynucleotide with the base sequences of SEQ ID NO: 1755 through 2642, a polynucleotide with the base sequences of SEQ ID NO: 2643 through 3324, a polynucleotide with the base sequences of SEQ ID NO: 3325 through 4320, a polynucleotide with the base sequences of SEQ ID NO: 4321 through 4962, and a polynucleotide with the base sequences of SEQ ID NO: 4963 through 5780 are mapped on 1H, 2H, 3H, 4H, 5H, 6H, and 7H chromosomes, respectively.

It follows from this that the base sequences of SEQ ID NO: 1 through 5780 are partial sequences of barley cDNA. Thus, if polynucleotides with the base sequences of SEQ ID NO: 1 through 5780 contained protein-coding regions, antibodies against polypeptides encoded by these polynucleotides can be immobilized on the support. Further, variants with the substitution, deletion, insertion, and/or addition of one or more bases in the base sequences of SEQ ID NO: 1 through 5780 constitute variant base sequences of barley cDNA. Thus, if these polynucleotides with variant base sequences contained protein-coding regions, antibodies against polypeptides encoded by these polynucleotides can be immobilized on the support. The polynucleotides with variant base sequences may be polynucleotides that have been mutated on purpose, or polynucleotides that exist in nature.

Polynucleotides that encode polypeptides used for production of antibodies immobilized on a support of a polypeptide detection instrument according to the present invention may be part of the polynucleotides or the like with the base sequences of SEQ ID NO: 1 through 5780. Since the base sequence of such partial polynucleotide is a partial base sequence of barley cDNA, antibodies against polypeptides encoded by such partial polynucleotides can be immobilized on the support if the partial polynucleotides contained a protein-coding region.

Further, a polynucleotide that encodes a polypeptide used for production of an antibody immobilized on a support of a polypeptide detection instrument according to the present invention may be a polynucleotide whose partial sequence comprises all of or part of the base sequences of SEQ ID NO: 1 through 5780. The remaining base sequences of the polynucleotide are not limited. For example, since the base sequences of SEQ ID NO: 1 through 5780 are partial sequences of barley cDNA, these base sequences do not have the sequences on either end as originally found in the full length cDNA. Thus, a polynucleotide whose partial sequence comprises all of or part of the base sequences of SEQ ID NO: 1 through 5780, and which additionally includes the cDNA sequences on the both ends or one end as originally found in the full length cDNA can be regarded as a polynucleotide whose partial sequence comprises all of or part of the base sequences of SEQ ID NO: 1 through 5780. Further, vectors such as plasmids and BACs (bacterial artificial chromosomes) that have incorporated all of or part of the polynucleotide or the like with the base sequences of SEQ ID NO: 1 through 5780, and polynucleotides in which the partial sequence is ligated to arbitrary base sequences can also be regarded as polynucleotides whose partial sequence comprises all of or part of the base sequences of SEQ ID NO: 1 through 5780. Such polynucleotides at least include all of or part of the polynucleotide or the like with the base sequences of SEQ ID NO: 1 through 5780, i.e., part of barley cDNA. Therefore, antibodies against polypeptides encoded by such polynucleotides can be immobilized on the support if the polynucleotides contained a protein-encoding region.

Further, polynucleotides that encode polypeptides used for production of antibodies immobilized on a support of a polypeptide detection instrument according to the present invention may be polynucleotides or the like whose partial sequences comprise all of or part of the base sequence, or a variant thereof, of SEQ ID NO: n (where n is an odd number), and all of or part of the base sequence, or a variant thereof, of SEQ ID NO: n+1, from among the base sequences of SEQ ID NO: 1 through 5780. As described above, the base sequences of SEQ ID NO: 1 through 5780 are EST sequences of barley, and comprise sequences that can be read by sequencing the cloned cDNA from the both ends only once. In other words, the base sequences of SEQ ID NO: n (where n is an odd number) and SEQ ID NO: n+1 among the base sequences of SEQ ID NO: 1 through 5780 are base sequences that are read from the both ends of the cDNA of the same clone. As such, these base sequences can realize a full length cDNA base sequence, which corresponds to all of or part of the full length cDNA. Thus, polynucleotides or the like whose partial sequences comprise all of or part of the base sequence, or a variant thereof, of SEQ ID NO: n (where n is an odd number), and all of or part of the base sequence, or a variant thereof, of SEQ ID NO: n+1, from among the base sequences of SEQ ID NO: 1 through 5780 can be regarded as polynucleotides with full length cDNA that comprises the base sequences of SEQ ID NO: n (where n is an odd number) and SEQ ID NO: n+1, or polynucleotides that comprise part of the full length cDNA. Further, the polynucleotides may be polynucleotides in which vector sequences or arbitrary base sequences for example are ligated to the both ends or one end of the full length cDNA or polynucleotides that comprise part of the full length cDNA. Further, the polynucleotides may be variants that have a base substitution or other mutations in sequences other than the base sequences of SEQ ID NO: 1 through 5780, i.e., a middle section of the total cDNA unspecified by SEQ ID NO: n (where n is an odd number) and SEQ ID NO: n+1. Such polynucleotides include the full length or part of barley cDNA, and therefore antibodies against polypeptides encoded by the polynucleotides can be produced. In particular, when the polynucleotides are full length cDNA or include full length cDNA, antibodies against the entire proteins encoded by the genes located on the barley chromosomes can be produced.

[Peptide Detection Instrument with the Antibodies Immobilized in Regions that are Arranged in the Chromosomal Order of the Polynucleotides Encoding Polypeptides Used for Production of the Antibodies]

As described above, the chromosomal order of polynucleotides on barley chromosomes (1H, 2H, 3H, 4H, 5H, 6H, or 7H) (distance from the short arm end of chromosome) has been specified in clones that have the base sequences of SEQ ID NO: n (where n is an odd number) and SEQ ID NO: n+1 from among the base sequences of SEQ ID NO: 1 through SEQ ID NO: 5780. Thus, if antibodies against the polypeptides encoded by the polynucleotides with the base sequences of SEQ ID NO: 1 through SEQ ID NO: 5780 were placed according to the order, as represented in Table 1-1 through Table 7-9, of the polynucleotides encoding the polypeptides, it would be possible to place the polypeptides according to the order from the short arm end of 1H chromosome to the long arm end of 7H chromosome, i.e., chromosomal order. For clones that have the same order from the short arm end, the order by which these clones are placed is not particularly limited. Once the precise order of these clones were specified by a future study, these clones will be able to be placed accordingly. Note that, the reference point (origin) on the chromosome is not just limited to the short arm end of 1H chromosome. Any position on a chromosome can be used as a reference point.

With the antibodies immobilized on a support in the order the polynucleotides encoding the polypeptides used for production of the antibodies are arranged on the chromosomes, the location and extent of recombination on chromosomes can be checked for genes from which the expressed proteins originate. That is, the genotypes of the parents are directly inherited as the haplotype in portions of the chromosomes where no recombination has occurred. As a result, the genotype of a trait conferred to the selected individuals can be easily determined, with the result that the efficiency of breeding is improved.

[Polypeptide Detection Instrument with the Antibodies Immobilized in Regions appended with Chromosomal Order Information of the Polynucleotides Encoding Polypeptides Used for Production of the Antibodies]

The regions in which the antibodies are immobilized (spots) may be appended with information indicative of the order in which the polynucleotides encoding the polypeptides used for production of the antibodies are arranged on barley chromosomes. The spots may be arranged in any way as long as they are appended with the order information. With the order information added to the spots, the data obtained from the spots can be rearranged in the chromosomal order even when the spots are randomly placed on a support. Note that, the order information added to the spots can follow the foregoing criteria used to place the antibodies.

Adding order information enables the spots to be arranged in an arbitrary order in a polypeptide detection instrument of an array type, in which more than one antibody is immobilized on a support such as a membrane or a glass slide. Further, the chromosomal order information of individual antibodies can also be added in a polypeptide detection instrument that employs a collection of beads (bead array) in which the antibody is immobilized on each bead serving as a support.

[Examples of a Polypeptide Detection Instrument according to the Present Invention]

Various conventional techniques that are designed for detection of protein (polypeptide) using antibodies can suitably be used in a polypeptide detecting instrument according to the present invention.

As an example of a peptide detection instrument according to the present invention, the following describes an antibody array of a bead type. The substance immobilized on the beads serving as supports is not limited to antibody. Other polypeptides or polynucleotides may be immobilized as well. As such, a gene detection instrument, a gene polymorphism detection instrument, and a polypeptide-interacting substance detection instrument according to the present invention can also be realized as bead arrays.

In an antibody array of a bead type, it is preferable that one kind of antibody be immobilized on each bead, and that each bead be appended with barley chromosomal order information of polynucleotides encoding polypeptides used for production of the antibodies. For example, by using each well of a micro titer plate as a small vessel, a plurality of beads with identification code (information of the immobilized antibodies, position information on the chromosomes, etc.) is placed in each well. By reading the identification code, information regarding identity of the immobilized antibodies can be specified. With use of a two-wavelength laser beam, 100 kinds of beads can be quantified. Further, since the technique allows for detection in a liquid phase, it is particularly effective in efficiently quantifying proteins. A representative example is Luminex, which is a fluorescent micro beads array system manufactured by HitachiSoft.

(5) Use of a Detection Instrument according to the Present Invention

Use of a detection instrument according to the present invention is not particularly limited. For example, the detection instrument can be suitably used to identify chromosome fragments including a target trait (identification of genotype), from hybrids obtained by crossing Triticeae species. Further, the detection instrument can be suitably used to screen for a variety with a target trait, from hybrids obtained by crossing Triticeae species for variety improvement. For these purposes, it is preferable that the polynucleotides or other substances immobilized on the support such as an array be arranged in the chromosomal order.

In conventional arrays, the polynucleotides or other substances immobilized on the support are randomly arranged. This enables the expression level or other profiles of the immobilized polynucleotides etc. to be individually analyzed. In hybrids, individual genes are inherited in units of blocks, from a point of cross over to the next point of cross over, on the chromosomes. Therefore, for the genotype identification or selection in variety improvement, etc., it is necessary to determine the location and extent of recombination and the presence or absence of unnecessary recombination, in addition to finding individual traits. Thus, conventional arrays with randomly arranged DNA fragments cannot be used efficiently for the screening in variety improvement, etc.

On the other hand, in a detection instrument of the present invention, the polynucleotides or other substances immobilized on the support are arranged in the chromosomal order. Thus, with a detection instrument of the present invention, the locations of recombination on the chromosomes can be found, if any, with a single round of testing. This allows for accurate selection of individuals with desirable traits from a segregating population of hybrid individuals. Further, with a detection instrument according to the present invention, chromosomal recombinations in the hybrid generation can easily be estimated. This allows a group of genes to be introduced in units of blocks, or genes in the blocks to be modified.

Further, with a detection instrument according to the present invention, the recombination patterns, i.e., the location and type of recombination on the chromosomes can be accurately grasped. Thus, by identifying conserved regions of chromosomes where recombination frequency is small in the population of hybrids or natural population, recombination can be efficiently promoted only in these regions of the chromosomes.

Figure 2:
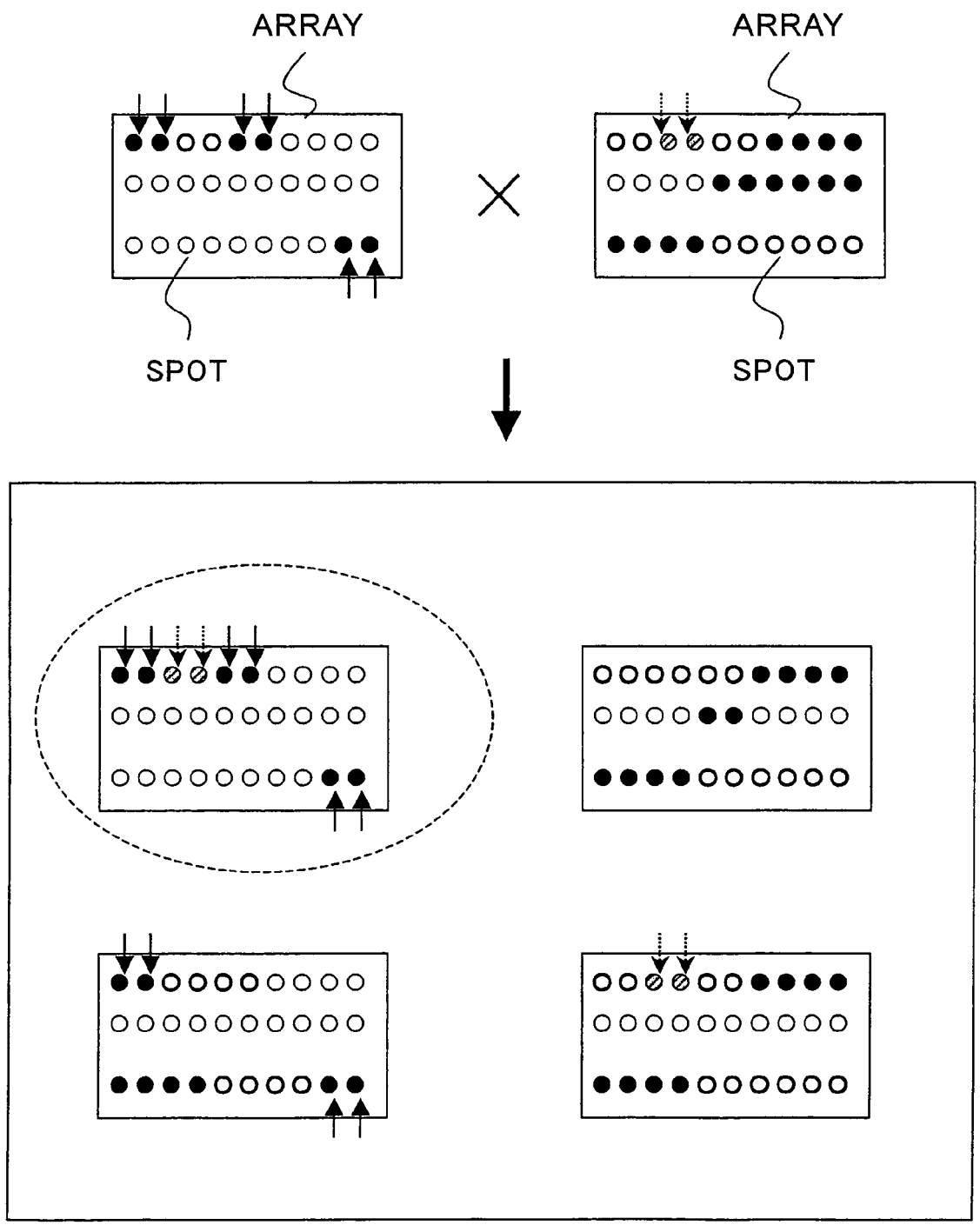
FIG. 2 is a schematic view illustrating expression of genes conferring certain characteristics in a segregating population obtained from a cross between varieties that showed the gene expression represented in FIGS. 1(a) and 1(b), and in specific varieties selected from the segregating population.

Referring to FIG. 1 and FIG. 2, the following briefly describes an example of a method by which target traits are screened for using a detection instrument according to the present invention. For example, a DNA micro array was used in which polynucleotides with partial base sequences of chromosomal DNA of barley were placed and immobilized on a support in the chromosomal order. In the DNA micro array, solid spots X in FIG. 1($a$) indicate that genes that confer brewing characteristics are expressed, and hatched spots Y in FIG. 1($b$) indicates expression of genes that confer disease-resistance.

In the DNA micro array, the spots are arranged in a chromosomal order, and therefore the positions of spots X and Y are fixed. For example, in FIG. 1($a$), the spots X are fixed at the first, second, fifth, and sixth positions of the first row, and at the ninth and tenth positions of the bottom row. The spots Y are fixed at the third and fourth positions of the first row, as shown in FIG. 1($b$).

It is assumed here that segregating populations as represented by four micro arrays in the bottom of FIG. 2 were obtained from a cross between a variety expressing the brewing genes as indicated by spots X (corresponding to the upper left DNA micro array in FIG. 2) and a variety expressing the disease-resistant genes as indicated by spots Y (corresponding to the upper right DNA micro array in FIG. 2), for example. From the result of analysis using these DNA micro arrays, varieties expressing both the brewing genes and disease-resistant genes can be screened for from the segregating populations (variety corresponding to the upper left DNA micro array circled by a dotted line in the lower portion of FIG. 2).

Further, whether the chromosome fragments have derived from which parent can easily be determined also for other regions of the genome. Thus, a backcross, for example, between a hybrid and the variety shown in FIG. 1($a$) easily allows for selection and development of varieties having all of the expressed spots as illustrated in FIG. 1($a$), i.e., the first, second, fifth, and sixth spots of the first row, and the ninth and tenth spots of the bottom row, as well as the third and fourth spots of the first row as shown in FIG. 1($b$).

In using a detection instrument according to the present invention for genotyping (whether chromosome sites originated from which parent) or detection of traits (quantitative and qualitative) linked to the genetic markers, the accuracy of data can be improved by increasing the density of the genetic markers with increased numbers of polynucleotides, polypeptides, or antibodies immobilized on a support of a detection instrument according to the present invention.

The density of polynucleotides, polypeptides, or antibodies (a distance between adjacent polynucleotides etc.) immobilized on the support is preferably no greater than 30 cM, more preferably no greater than 15 cM, or particularly preferably no greater than 10 cM, in order to confirm linkage between two adjacent markers.

For the entire barley genome, the number of polynucleotides, polypeptides, or antibodies immobilized on the support is preferably no less than 50, more preferably no less than 100, and particularly preferably no less than 150. When performing genotyping for a Mendelian segregating population of barley with a resolution as high as 1 cM, the number of polynucleotides, polypeptides, or antibodies immobilized on the support is preferably no less than 1500.

Example

With the polynucleotides immobilized on a support of a detection instrument according to the present invention, assessment was made as to whether the genotype of each parent occurs in which part of 1H chromosome in 5 lines of hybrids (DHHS1, DHHS2, DHHS3, DHHS4, and DHHS5) obtained from a cross between malting barley (Haruna Nijo), and wild type barley (H602). That is, locations of recombination were determined.

[Genetic Markers]

Nine genetic markers mapped on 1H chromosome of barley were used. Clones: bah47d23, baa119i12, bah45i3, bags30g20, BaGS13F08, baet45e0410, bah16m01, BaH56B06, and BaH39L18.

[Primers]

Table. 29 below shows the primers used in this experiment.

A, a purine, G, was selected (and vice versa), and when the base in the original sequence was C, a pyrimidine, T, was selected (and vice versa).

For the designing of forward primers, the base sequences in the vicinity of the SNPs of the SNP markers, shown in Tables 22-1 through 22-20, mapped on 1H chromosome were used. Specifically, the forward primers (SEQ ID NO: 22343 (Haruna Nijo) and SEQ ID NO: 22344 (H602)) for bah47d23 had the base sequence of SEQ ID NO: 17380. The forward primers (SEQ ID NO: 22345 (Haruna Nijo) and SEQ ID NO: 22346 (H602)) for baa119i12 had the base sequence of SEQ ID NO: 17419. The forward primers (SEQ ID NO: 22347 (Haruna Nijo) and SEQ ID NO: 22348 (H602)) for bah45i13 had the base sequence of SEQ ID NO: 17556. The forward primers (SEQ ID NO: 22349 (Haruna Nijo) and SEQ ID NO: 22350 (H602)) for bags30g20 had the base sequence of SEQ ID NO: 17669. The forward primers (SEQ ID NO: 22351 (Haruna Nijo) and SEQ ID NO: 22352 (H602)) for BaGS13F08 had the base sequence of SEQ ID NO: 17723. The forward primers (SEQ ID NO: 22353 (Haruna Nijo) and SEQ ID NO: 22354 (H602)) for baet45e0410 had the base sequence of SEQ ID NO: 17742. The forward primers (SEQ

TABLE 29

| Clones | Forward Primer Haruna Nijo<br>Forward Primer H602 | SEQ ID<br>NO: | Reverse Primer | SEQ ID<br>NO: |
|---|---|---|---|---|
| bah47d23 | AGATGGAGGGGCCCTGTGCAT<br>TAGATGGAGGGGCCCTGTGTAT | 22343<br>22344 | CTGTGGGAAAGCCTACATCC | 5880 |
| baa119i12 | TCAGAGAGGTGAATCTGGGTCAA<br>TTCAGAGAGGTGAATCTGGGTTAA | 22345<br>22346 | GAACTGAGGCGTGCACATAA | 6012 |
| bah45i13 | CCATGACCAGCAAAAGCAGTCC<br>CCATGACCAGCAAAAGCAGCCC | 22347<br>22348 | GCAAATCAGTTGCTGGAACA | 6340 |
| bags30g20 | GGACTACGTACGGACTGAAATAG<br>GGACTACGTACGGACTGAAACAG | 22349<br>22350 | GGTTCCATTCCTGCAGATGT | 6632 |
| BaGS13F08 | TCACAAGGTAACCAAAACAATTCGA<br>ATCACAAGGTAACCAAACAATTTGA | 22351<br>22352 | CTCAGGCAATGCATCAAATG | 6760 |
| baet45E0410 | CCGGACTTGACAAGCGGTAATTG<br>CGGACTTGACAAGCGGTAAGTG | 22353<br>22354 | CGGCTCTCCATAGACTGCTC | 6800 |
| bah16m01 | CATGGGGGAGGTTTTGGCTCTTT<br>ATGGGGGAGGTTTTGGCTCGTT | 22355<br>22356 | AAGACCTCACTCCAAAGCGA | 6904 |
| BaH56B06 | CTTTTTGGTCCTCAGTCCTCATTG<br>TTTTTGGTCCTCAGTCCTCACTG | 22357<br>22358 | AGATCCGCTACTGCTTGGAA | 7064 |
| BaH39L18 | GCTTCTAGACGCAGACAAGCTG<br>AGCTTCTAGACGCAGACAAGTTG | 22359<br>22360 | GTATGCTTGCAGGAAGGCTC | 7316 |

As the reverse primers, the primers used to find polymorphism in 1H chromosomes, shown in Tables 8-1 through 8-8, were used. Specifically, bah47d23, baa119i12, bah45i13, bags30g20, BaGS13F08, baet45e0410, bah16m01, BaH56B06, and BaH39L18 are primers with the base sequences of SEQ ID NO: 5880, SEQ ID NO: 6012, SEQ ID NO: 6340, SEQ ID NO: 6632, SEQ ID NO: 6760, SEQ ID NO: 6800, SEQ ID NO: 6904, SEQ ID NO: 7064, and SEQ ID NO: 7316, respectively.

The forward primers were designed based on SNP-containing portions of the base sequences. Specifically, the third base from the 3' end of the primer sequence was designated as a base characterizing "Haruna Nijo" or "H602". For the first and second bases on the 3' end, the same kind of base but different from one found in the original base sequence was used. Specifically, when the base in the original sequence was ID NO: 22355 (Haruna Nijo) and SEQ ID NO: 22356 (H602)) for bah16m01 had the base sequence of SEQ ID NO: 17785. The forward primers (SEQ ID NO: 22357 (Haruna Nijo) and SEQ ID NO: 22358 (H602)) for BaH56B06 had the base sequence of SEQ ID NO: 17860. The forward primers (SEQ ID NO: 22359 (Haruna Nijo) and SEQ ID NO: 22360 (H602)) for BaH39L18 had the base sequence of SEQ ID NO: 17958.

[PCR Reaction]

From each of the 5 lines of barley hybrids, genomic DNA was prepared and used as a template. Table 30 shows the composition of the PCR reaction solution. The reaction was performed under the following conditions.
94° C. for 2 minutes
Start of 5 cycles consisting of:
  94° C. for 30 seconds;
  65° C. for 30 seconds (−1° C./cycle); and 72° C. for 1 minute
Start of 30 cycles consisting of:
  94° C. for 30 seconds;
  60° C. for 30 seconds; and
  72° C. for 1 minute
72° C. for 7 minutes
End of Reaction

TABLE 30

Composition of PCR reaction solution

| | (×1) |
|---|---|
| mQH$_2$O | 6.86 |
| 10X Blend Taq buffer | 1.00 |
| dNTPs (2.0 mM) | 1.00 |
| Primer fwd. (50 μM) | 0.02 |
| Primer rev. (50 μM) | 0.02 |
| Blend Taq (2.5 U/μl) | 0.10 |
| DNA (10 ng/μl) | 1.00 |
| Total (μl) | 10.00 |

[Result]

Figure 3:
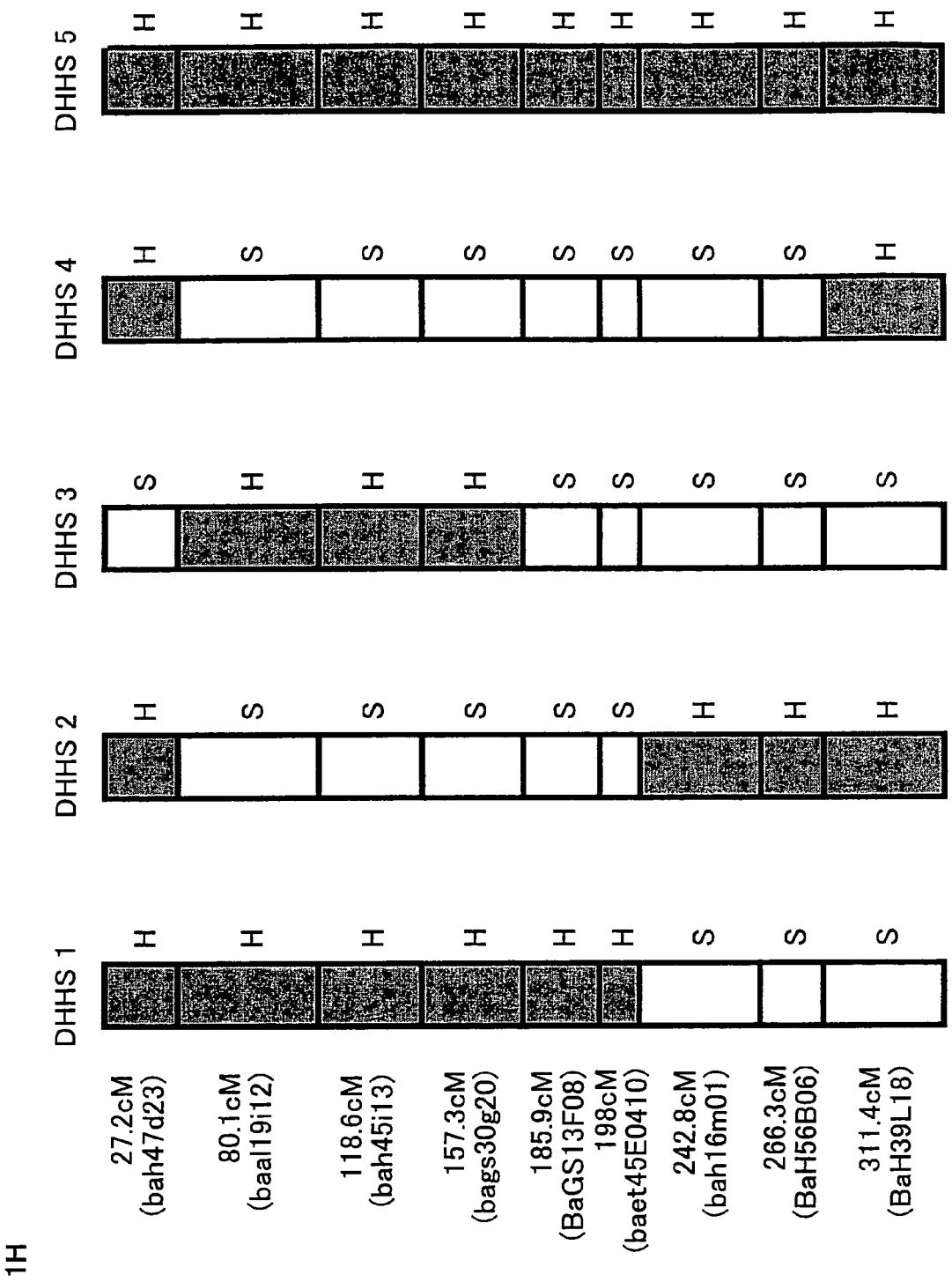
FIG. 3 is a view showing a result of analysis on genotypes (recombination sites) of barley hybrids that were subjected to PCR in which polynucleotides immobilized on a support of a gene polymorphism detection instrument according to the present invention were used as primers, and genomic DNA of the barley hybrids was used as a template.

FIG. 3 shows the result. In FIG. 3, regions indicated by "H" (black) are regions originating in Haruna Nijo, and regions indicated by "S" (blank) are regions originating in H602. As can be seen in FIG. 3, in DHHS1, bah47d23 through BaGS13F08 were amplified by the forward primers based on the base sequences of Haruna Nijo, and baet45e0410 through BaH39L18 were amplified by the forward primers based on the base sequence of H602. In other words, in DHHS1, there were recombinations between the genetic markers based on BaGS13F08 and the genetic markers based on baet45e0410.

Similarly, in DHHS2, two recombinations were observed: one between bah47d23 and baa119i12, and one between BaGS13F08 and baet45e0410. In DHHS3, two recombinations were observed: one between bah47d23 and baa119i12, and one between bags30g20 and BaGS13F08. In DHHS4, two recombinations were observed: one between bah47d23 and baa119i12, and one between BaH56B06 and BaH39L18.

In DHHS5, all clones had the genotype of H602, suggesting that the entire 1H chromosome of these individuals is very likely to be of the H602 origin.

The polynucleotides used in this Example were not immobilized on a support. However, the forward primers and reverse primers used in this Example may be immobilized, for example, on the Gene Silicon in the chromosomal order, so as to fabricate a detection instrument according to the present invention. It should be apparent to a person ordinary skill in the art that the result obtained in this Example can also be obtained with such a detection instrument.

The embodiments and concrete examples of implementation discussed in the foregoing detailed explanation serve solely to illustrate the technical details of the present invention, which should not be narrowly interpreted within the limits of such embodiments and concrete examples, but rather may be applied in many variations within the spirit of the present invention, provided such variations do not exceed the scope of the patent claims set forth below.

INDUSTRIAL APPLICABILITY

A detection instrument according to the present invention uses polynucleotides that can be used as genetic markers mapped on barley chromosomes. The detection instrument can be used to quickly and comprehensively detect gene expression, gene polymorphism, proteins (polypeptides), and protein (polypeptide)-interacting substances in Triticeae species. This greatly improves the efficiency of screening and breeding of Triticeae species. If the detection instrument were able to grow useful Triticeae species of various characteristics in a short time period, it would be possible to offer a solution to food problems.

Taken together, a detection instrument according to the present invention can be suitably used for breeding of Triticeae species, and is applicable to a wide range of agricultural fields. A detection instrument of the present invention can also be used for the basic research in agriculture and other fields of biology.

SEQUENCE LISTING (22360 sequences)

SEQ ID NO: 1 - DNA, 549 bp, Hordeum vulgare
ttcccgggctgcagggaattctttacgaggccggcacgggtcttctgaccgtggcgagtgatgatgatggaagcggcggggaggtcgttgttgttgctacggcttataaggttttctgttaccgtaaagtatccgcagtggaacagatcaaggcatcattacgaataaagagttatacagaggctgtttctttgctggaagagtttgaatctgatggtgaaatctcgaatgatatgatttcctttgtgcatgcacaatttggattcttgttattctttgacttgcgttttgaggatgctgttaatcatttcttgctgtcggagactatgcaaccagcagaaatatttccattcatcatgcgggatcctaatcgttggtcagatctggtgccaagaaagcgttattggggcttgcatcctccccctaagcccctcgaagaagttattgacgatggactagaaacacttcaacgtgcattgtttctcaaaaaggcaggtgtggacacagttgtggatgaagatttcctttcaaatcctccagctagagctg

SEQ ID NO: 2 - DNA, 545 bp, Hordeum vulgare
ttggtgttatgattccacttgtcgatatagtcatttctacccctcagcacagcaattacaaccaccatttacagtgttaccgctaacaaactattcctgcaagttacatcccattttcatgtgctctgggagaaaaaggaaatgaatcgagttcctcaacattttccgggataagagtgtgcaagccagcccctagggccatcgcatacacatggcagactgtcgcccgcccggataaatgaaattaatagcgcatcggggaagccccccgatgatgttgcacgatttagagcatttcgaaggaactgttgcaggatcatgtaccttgaaccgcaagggcggtatgcataacctttctccattgttcatgtcaaaaaaagtgtctgtaccagttttgctggtcaacctttgctatctactgacgagccaactttgtttgaatatagcatctttcctgaagttacggcctcgtcctgaaacagaatcgccttggtttcggtagcacctgtagcaaacaaccgagtcgattgggtacatgacgaata

SEQ ID NO: 3 - DNA, 517 bp, Hordeum vulgare
gcacgacatggatagtgccacaaaaggcactcggtgtggtggctacattggtggctctgcagctgctcctggcagctccgatggccatggcccgctcaccgccggctctagaagaaatggcacagtctgccaagatagcaattgaacgcctcattctggaaacaccggtagaaagccgccgttgtggcagcaaggaaacatgctatactggtatgtgctacacccctggttgctattgtgagtaccctctctgtgtgaggccttcagcggttgctgcttgaagctacttcctcggctcttccatccttggacccctaataagatgtgaatgttggaacgatgtacctcgtggttgctttctttctgaagaaatatgctgagtgcgaactatgtacctggagatgtgggtaagggcggtgttgtgctactatacctacgtttgaggaataaataaatgacatatgtgtgggagatgtgtgtatttgtactaccatgccgctatataatatgtatctct

SEQ ID NO: 4 - DNA, 557 bp, Hordeum vulgare
  UNSURE (19),(147): n stands for any base
caatttttcttccattttncttaatactcatgcatgcatgattttccctttcagttgaccacatagtcttaattaaagatgaaaaaagtaggcaatgtacatcagagatacatattatatagcggcatggtagtacaaatacacacnatctcccacacatatgtcatttatttattcctcaaacgtaggtatagtagcacaacaccgcccttacccacatctccaggtacatagttcgcactcagcatatttcttcagaaagaaagcaaccacgaggtacatcgttccaacattcacatcttattaggggtccaaggatggaagagccgaggaagtagcttcaagcagcaaccgctgaaggcctcacacagagagggtactcacaatagcaaccaggggtgtagcacataccagtatagcatgtttccttgctgccacaacggcggctttctaccggtgtttccagaatgaggcgttcaattgctatcttggcagactgtgccatttcttctagagccggcggtgagcgggccatggccatcggagctgccaggagc

SEQ ID NO: 5 - DNA, 494 bp, Hordeum vulgare
ccgcacccacgcacggttatggaggaagccgcggtgcaagaatctcaagcaccgcagcccaacgcgacggccatggaggaagccgcggtgcaggaatctcaagcaccgcagcccaacgcgacggccatggaggaagccgcggtgcagaaatctcaagcaccgcagcccaacgcgacggccatggaggaaggcgcggtgccgaaatctcaagcaccgcagcccaacgcaacggccatggaggaaggcgcggtgccgaaatctcaagcaccgcagcccaacgcaacggccatggaggaagccgcggtgcagaaatctcaagcaccgcagcccaacgcaacggtcatggaggaagacacggtgcaaaaatctcaagcaccgcagcacaacgcaacggtcatggaggaagccgcggtgcagaaatctcaagcaccgcagcccaacacaacggccatggaggaagccgcggtgcagaaatctcaagcaccgcagcccaa

SEQ ID NO: 6 - DNA, 547 bp, Hordeum vulgare
tagtggcttattacccgggaagtaacaaacgtgttctcatacatactacatagttggaatggatacggacaatttggttgtttccattatttccaataacaaacaagtgcatcatcatggttcagcgagtcgcataattaacgctcaccacgccatgaaaaatggcatccgtgttaggcggccgtgctagagacttgcgcatcagagtgggctggtcggtcgcgcgagcttacatcctggaatcttctgcggaagatacacgatgaccgttgcgttgggctgcggtgcttgagatttttgcatcgtgtcctcctccatggccgttgcgttgggctgcggtgcttgagatttctgcaccgcggcttcctccatggccgttgtgttgggctgcggtgcttgagatttctgcaccgcggcttcctccatgaccgttgtgttgggctgcggtgcttgagatttttgcaccgtgtcttcctccatgaccgttgcgttgggctgcggtgcttgagatttctgcatcgtgtcctcctccatggccgttgcgttg

SEQ ID NO: 7 - DNA, 468 bp, Hordeum vulgare
  UNSURE (20): n stands for any base
gtacccccgggcctgcaggncgagggccgctggcatacagcagcggtgttgtggaaaggccgccgcctcaacgccagtgggttccccctcagcctccaggtgttgccatgccagaagcagcggctgccatccgtcaacagaattcccttgcaaagcaatcttcaagcgacacgtccgtggccgctagtgaggtgcaggtgaacggcgccgcgagctcgccttccgtcgccgtcgccgaggtgccggttaacggcagtgccgcaagcgatgctggacgcagcgagatggaagagcaggcggaagccgtctaagcaccagcctgacgaccatccgacaagggcaacacaatctaagttgtataagccggatcctggtacatatggcagtttgtcataaatttgtgatcaatgtttggattgccgcctagagatggaataaagaacaagtcacacttaaaaaaaaaaaaaa

SEQ ID NO: 8 - DNA, 435 bp, Hordeum vulgare
  UNSURE (27): n stands for any base
ggtgtcgacttggttctttacttcatnctctaggcggcaatcccaacattgatcacaaatttatgacaaactgccatatgtaccaggatccggcttatacaacttagattgtgttgcccttgtcggatggtcgtcaggctggtgcttagacggcttccgcctgctcttccatctcgctgcgtccagcatcgcttgcggcactgccgttaaccggcacctcggcgacggcgacggaaggcgagctcgcggcgccgttcacctgcacctcactagcggccacggacgtgtcgcttgaagattgctttgcaagggaattctgttgacggatggcagccgctgcttctggcatggcaacacctggaggctgagggggaacccactggcgttgaggcggcggcctttccacaacaccgctgctgtatgccagcggcctcg

SEQ ID NO: 9 - DNA, 518 bp, Hordeum vulgare
aagagacctcgtcgggatctcatctccaacctctgctctgctccaccgtcgacaaccaaccagccgaccaagcagaagcagggcaagggcagcgaggatgacgttcgacaaggtggaggagctccggccgggcacctacggccacaacctccagctcagggtcctcagctccaagcccgtcgtcctccacaggcagcaccagggcggaagggccggcaacaacatgcgcatcgcagagtgcatcgtcggcgacgacaccggggtcgtcgtattcacagcacgcaacgagcaagtggatatcatgaagcccggggccgtcgtggaggcgaggaaggcgagggtggacatgtacaaggggtcgatgcgcctggccgtggacaagtgggggacgctcaaggccgccgagagcccggcggacttcaaggtcaaggaggacaacaacgtgtccttgatcgagtttgagctcatgaccgttctgcagtgaagcaattgaagaagcctcctcctcgcctaggagg

SEQ ID NO: 10 - DNA, 495 bp, Hordeum vulgare
tcaccaggtctaacacaaagggagaggactcactcacacctgacctggtgccacaacacaatctgattggatacatcatctcatcaacatactcatcacaggactagtaacaatcgatccaagatagcagcactaacaaaacttcagttaaaaacagagagagaaaagagaaaacatgagccatgattggccggcttattgctttgctcagcctaacagctgctgagcatcatcctctgcctcctcctcctaggcgaggaggaggcttcttcaattgcttcactgcagaacggtcatgagctcaaactcgatcaaggacacgttgttgtcctccttgaccttgaagtccgccgggctctcggcggccttgagcgtcccccacttgtccacggccaggcgcatcgaccccttgtacatgtccaccctcgccttcctcgcctccacgacggccccgggcttcatgatatccacttgctcgttgcgtgctgtgaatac

SEQ ID NO: 11 - DNA, 515 bp, Hordeum vulgare
gcagcatgactcccgaccagctgctgctatcgcctccctgccctacctcgccgccgccggcgccgcctccagctcgctccggcgaccccgcccatcctgctccttccctctccgacgccctccgcccatatacctcacctgcgccgccttcccttgcacccctcctccgcgcgccgccacggcgtggccggcccccgccggcgatggacaacacatgctccgtggccctccccagccacgatgctccaacgtggaagcggtcggcgacgtggcagcagcggtgcccgaagattatatagaggacacgccgtcaagcagtgggtatgcgaatggccatatggccaccgcttcatcgcaccaagaccatcctgaaggaagcgcgggcaaggctactactgccgacgtcaaccaaaaaatggtcaagatatctgacaagttgattggcgtgttcatggtcgacaagcctaccccgacggattggaggaagctgctggcgttcagcagggagtgggaca

SEQ ID NO: 12 - DNA, 542 bp, Hordeum vulgare
cagtattaatccttttatgtctatcgtgatacaataaagtgctgtcatcttcagattctgcctgagcagaaggcaatctgcatacactatctaattatctatggggaggttgggggagtaagacatacaatctaagtgaaacctacatccatacatcacatgctacaatcacttatgcgccgtacaatccagatttagcccgtgaagtatcgcattcttcgttcccagctgccatcgacaggagctccgctgcgcagcaagcagagcgccatcctgttgttcagatgataatacttgtagcgcaatcactaggagcgtgagaccacaatctttccgatggctgagattcagagtcagaggtattgatccttgatcgtcttcacaagctcttcaaccctctttataattttagggttcatcaagtcccttgcctgcccaaggagagtgccttccctgctgctgtaatacgcatcgattatggcgcttgcccaagtgtgcaacacctcaggactcgtgaataatgtatcgacattctcgccctg

SEQ ID NO: 13 - DNA, 516 bp, Hordeum vulgare
  UNSURE (455): n stands for any base
aaggaacaatggcctccggagtgtttggtatccccatttcaatgcagacggtgatagccactggagagtataaagaacccgtcacccaaaaagatgttgccgactataccatgaagatgatcaacgcgggtggcaaggatattgacgcacaacaattcgtcgacaacctgaagatcaagtacggtaatggaatatctgtaaaatgcctcatctacaatgctaccggtaccaatctgagtttcgtcacgtacaagaattggattggcagtatctttgatacaccctacccatcggatattcagaatggacaatggggggcatttctccacgtcaaaccaagagcagctgcgaaaggttcaactgccgctgttgtgtatcgtagcaggatcccgtccagcagcagctcctgcgactggttattcacttggtctgtcccattcattggcaacaacggnggtgtacacggaaatccgtgagcaaggacacttccctaagcactgggattatatctacaat

SEQ ID NO: 14 - DNA, 558 bp, Hordeum vulgare
ttctgtacaaccttgatagcaagaaagtacacaatataatttttttgtcatctccttccatctattattcgcggaccaaccgaaacccaaggacagcaaggaaatggacttgcaacggctttgaagaccactataaccactccctgcagctagcaatgagatctagtagggaagctggaaaactgcacgtgcgttcatggtagtgccttcaccgatgttagccctcgaaacatatccgtagttgctatcagttgagtggagatttgaatttgccagcctcacattgtagatataatcccagtgcttagggaagtgtccttgctcacggatttccgtgtacaccccgttgttgccaatgaatgggacagaccaagtgaataaccagtcgcaggagctgctgctggacgggatcctgctacgatacacaacagcggcagttgaacctttcgcagctgctcttggtttgacgtggagaaatgccccccattgtccattctgaatatccgatgggtagggtgtatcaaagatactgccaatccaattcttgtacgtgacgaa

SEQ ID NO: 15 - DNA, 128 bp, Hordeum vulgare
tttttttttttttttttttttttttttttacttttttttttttttttttttttttttttttttttttttttttttttttttttttttttttttttttttttttttttttttttttttttttttttttt

SEQ ID NO: 16 - DNA, 276 bp, Hordeum vulgare
ctgtgatcatcttcttcctcaccatcgcgtcactcaagcaccaagcattccgtaaagatggcgaggtcatagacctgtcgatcctcggcgcgaccgcctacacgtgcgttgtctgggccgtcaacatgcagatggcgatcacagtgaactacttcaccctcgtccagcacatctgcatctggagcggcatctttctatggtacctgttcctcataatctacggtgcaatcacgccgtcgttctcgaccacattcttcatggtgttctcggaggcgc

SEQ ID NO: 17 - DNA, 521 bp, Hordeum vulgare
aggcaggaccaagactccgcctttgctccctcccgatttcatccccaatcctgcagcaaatccgccctcgcaagcaatccagcctcgattaccatcaaccgagagagagagatagaggcgattcgattccatctgattcgacctcgcgcggcgcagaggaggaggaggaggaggagcgatgaagaagatctttggggccaagaagagccaggacccgccgccgtccatccaggacgccaccgaccggatatacaagcggggggacacggtggacgagaagatcaagaagctggacgcggagctggcgcgctacaaggagcagatcaagaagaccaggccgggccccgcgcaggaggccgtcaaggcccgcgccatgaggatcctcaagcagcgcaagatgtatgaaggacagcgcgacatgctgtacaaccaaacttataatcttgaccaagttgcttttgcgtcggagggaattaaagatgctcaacagactatgactgcaatgaaggctgccaataaag

SEQ ID NO: 18 - DNA, 531 bp, Hordeum vulgare
  UNSURE (2),(10),(12): n stands for any base
cncatacagngnaacacttccctttatcactcactattactccacacaatgcggaggagacattccatcgttcaacgaattgcagtggtatatgaggcaagatacaatgaatttgtccatgcataaacaaagtgcggaccatttacaacgagatcaaacctacaccatagcttttttgttaatttcaggtacgaattgacgcgtgcggcacagtaggcagtcccatttcatcctcctgctgccggttcgccgggactgctgcatgaccacttggtgcagcaggtaagttaagctcagaatcaagatcagtctccttgtctggttggaggtacgatgggactgaattcgattcaaagtccatatcggcttccaaagcatcaagctcgcccataagttcctcctcgtcgatgtcatctgggacattgtagcttctaccaagagtttcttgtatttcattgctcacatccataagatccatcatctcgtcttgcatgctatctatatcttcaatcctgacagtcttcatcatcc

SEQ ID NO: 19 - DNA, 912 bp, Hordeum vulgare
tgcaggaattcggcacgagggggatgcaccaggcgactacgacccaccgcaacggccccaagacggtcctccgacggctgccagacgtggcaggacggatttcgagctgacgccccccctggacgccgacgccagggcgatggagggcaccactgagctccactttttcccggtttgcggggccctgggcgaggtgagcattcggcttctgaggatctacgttagtaccgcaaggtgctggagggaatcgctggaatcggaggctagagattgagcatctactgcatggactttttgcgtcttgacacaccgaccacccaggagtatctcccttatacggagagagaaggggggcgtttagagaggttatattgagcatgttgctctttcgctccaccatacaccgttttttttgtctccaccgttttgttcctcttggcttttcccggttctccttgatagtgcggcccttacccggtccttgtttaccacgccccccgcgatttttgatcctatgacttttactttcagagatgttccttccttttgctcccccaaagaccccctccgctttgtcttctcttcccttgattccccttacctcgttttttcaatttctcccgttcgcgatcatcttttcttttcccctccccccctcattaacaactttataatttcccacccacacttttcttatatcgctccttccgtcacccatgtttccttgaattattcgattccttacaaatactctttccttcccgcatcccgccgccgcttttacccacttctgcctgccccccctattcgctttttcccccgctctttaaacttttctccgtctgtccccccctattctttattccgaccgcttcctcggcccttgaaatcgacacgctttttacccacttt

SEQ ID NO: 20 - DNA, 502 bp, Hordeum vulgare
gattaacaataataacctccctccctacatcatggataacacgacgtcacattctcttctgggcatacataacattaataatatacacatttccagcagcgacggcggcatcgcatcatcgtcgggtaacaacttaacaagactgcctacacatgctttgctttggttggtatttaccacctccagcggtcctctccgcaccacatcatcttcttccattccaaaaaggctaggctgtaccaaaaaggttgggaagcagcttcggtttcccacccgccgcatttgttcaaagaacgtcggccggcgtcgtctcgggattagatgataccatggcagaatctgcagcatggccctaggacctggacagaaggaatttatgaaaccgttgtgctttcacggcatcagctggcttgacaaaatcagccttgccaggtgccggggttgttgcaccagatgagattctcctcctgttcctcatacggaataaaaagtcttctgtatc

SEQ ID NO: 21 - DNA, 551 bp, Hordeum vulgare
  UNSURE (11): n stands for any base
gtcctccgggnctgcaggaaattcggcacgaggcgagaacttccgtgcactttgcactggggagaaagggtttggatacaagggatcaagtttccaccgtgtcatcaaggacttcatgattcagggaggagactttgacaagggcaacggtactggagggaaaagcatatatggccgtaccttcaaggatgagaacttccaattggttcatactggacctggagtgctcagcatggctaatgctggaccgaacaccaacggcagccaattcttcatctgcacagtcaagactccgtggctggacgggagacacgttgtctttggccaggttcttgaaggcatggacatcgtaaggatgatagagtcatctgagactgacagaggtgaccgcccgaagaagaaggtggtcattagtgagtgcggggagcttccagtggtctgagtttcatctagatggctatcatcttgcatccccgcatctggattttgctctggacttgttacaggtctttcccctagtagttagagaccgtgctgagttgaagccaaga

SEQ ID NO: 22 - DNA, 559 bp, Hordeum vulgare
attcgcatttttatttccgggcaaaaagtagttgaatgtcgtatgcctcagatatgaaatcttggcttcaactcagcacggtctctaactactaggggaaagacctgtaacaagtccagagcaaaatccagatgcggggatgcaagatgatagccatctagatgaaactcagaccactggaagctccccgcactcactaatgaccaccttcttcttcgggcggtcacctctgtcagtctcagatgactctatcatccttacgatgtccatgccttcaagaacctggccaaagacaacgtgtctcccgtccagccacggagtcttgactgtgcagatgaagaattggctgccgttggtgttcggtccagcattagccatgctgagcactccaggtccagtatgaaccaattggaagttctcatccttgaaggtacggccatatatgcttttccctccagtaccgttgcccttgtcaaagtctcctccctgaatcatgaagtccttgatgacacggtggaaacttgatcccttgtatccaaaccctttctccccagtgcaa

SEQ ID NO: 23 - DNA, 403 bp, Hordeum vulgare
gattgggacgagctcgtcgattttgccaaaccgttcagcagaaccgtccttgacgggcaccactacctggtgttcgaacccaagttggacaaatccaatgtgcagcagaacatcgatttcgtcaacaaagagatcgccggtaatttgagcactatgacaaagccagatggccctcccacttttgttggtgaatgggtagctgagtggaaggtaaagggtgcttccaaggaagacttccaacggtgtgcaaatgctcagatggctgtgtatcggaaagccacgtttggatgggcttactggtcgtacaagcatgttagcaaccactggagcatggagtggatgatcaacaacggatacatctccttaaaaaatgcttgaggcaactaaattcgcaactatgaac

SEQ ID NO: 24 - DNA, 319 bp, Hordeum vulgare
ttttttttttttttttttttttttttttttggcgtgaaacaaattattggctcatgtggtgaataaagtcacaaatactacttaaatcattaaacagcataatcatatatattacattaataatatcttgaggtgccaagtgctcatcagttccctctcatacatttttttttctccaatacttggcagctcttccgttcatagttgcgaatttagttgcctcaagcattttttaaggagatgtatccgttgttgatcatccactccatgctccagtggttgctaacatgcttgtacgaccagtaagcccatccaaacg

SEQ ID NO: 25 - DNA, 552 bp, Hordeum vulgare
ccggggctgcagggaattcggcacgaggctttcctccctctgcctcgagaagccggctagccggagagggaacgtacgtggtcgccggcgtcggagaagaggaaggaagagggtgagggaggatgtcggactgggggccggtggtgatcgcggtggtgctgttcgtgctgctgtccccggggctgctgctgcagctccccgggaagcaccacttcgtggagttcggcaacatgcacaccagcgccatggccatcctcgtccacgccatcatctacttcgccctcatcgctctctttgtcatcgtcatcggcgtgcacatcaccacggactagtccgatcgatcccccggccagctccaattaagctgctctccttcctcttctgcttctttctttacttttgtttttggctgactcttgcctctgttcttgctggtgcagcaaccactgtagtatgtgatgatgtttctttgttgccctgcgtaattaatcgctcgtatgtagccgcctgattaataaagagatgtttacttggttttaaaaaaaaaaaaaa

SEQ ID NO: 26 - DNA, 498 bp, Hordeum vulgare
cagtacatctctttttataggcggctcatacgagcgattaattacgcagggcaacaaagaaacatcatcacatactacagtggttgctgcaccagcaagaacagaggcaagagtcagccaaaaacaaaagtaaagaaagaagcagaagaggaaggagagcagcttaattggagctggccgggggatcgatcggactagtccgtggtgatgtgcacgccgatgacgatgacaaagagagcgatgagggcgaagtagatgatggcgtggacgaggatggccatggcgctggtgtgcatgttgccgaactccacgaagtggtgcttcccggggagctgcagcagcagccccggggacagcagcacgaacagcaccaccgcgatcaccaccggcccccagtccgacatcctccctcaccctcttccttcctcttctccgacgccggcgaccacgtacgttccctctccggctagccggcttctcgaggcagagggaggaaag

SEQ ID NO: 27 - DNA, 450 bp, Hordeum vulgare
ctttgcctgagcgccattttcaccataccaccaattcaccattgaccattagcgccattttgcacccctccccccaccccagcctcccaacatgtaaattttccgcccctgagatacagctagcccctttaatcctaagctaagctagcagtacctattcgagtcgagtttatttagttgagttgagttgagttgagtcgaggtgagtcctcgtagtcgcccgtctggttgtcgcttttgaaactgcgcaatcgcagagagctttcggttatgtacataggcgaggtctccggtccgttgtgtcctgtatctacacctttgtaatgtgtgtgtgtgttgtgtctagcaggtgtcccagtccatgggtgtggtcagtctgtaaatatccgtctgtcctgcattcagatgcataattaagaaactattatattattataaaaaaaaaaaaaa

SEQ ID NO: 28 - DNA, 437 bp, Hordeum vulgare
taataatataatttagtttcttaattatgcatctgaatgcaggacagacggatatttacagactgaccacacccatggactgggacacctgctagacacaacacacacacacattacaaaggtgtagatacaggacacaacggaccggagacctcgcctatgtacataaccgaaagctctctgcgattgcgcagtttcaaaagcgacaaccagacgggcgactacgaggactcacctcgactcaactcaactcaactcaactaaataaactcgactcgaataggtactgctagcttagcttaggattaaaggggctagctgtatctcaggggcggaaaatttacatgttgggaggctggggtggggggaggggtgcaaaatggcgctaatggtcaatggtgaattggtggtatggtgaaaatggcgctcaggcaaag

SEQ ID NO: 29 - DNA, 502 bp, Hordeum vulgare
tcttggccgcgtcaatcgtccgttcgctggtccgcccgtccgtccgtccgcccgccccgaagcctctcgccgccctctccgccggagcgccggcgagcaaacaaccgtccttctcctcccggtttgttgtctgccatgggtgactacacaatccggataagcaccagcttgatcgaacagctcgcgcgcgatgacgagaagcaggtgaaaaggaggaccaggaaacccaagccgaagaaggtcgtggagcaacaagaggagcctcaggacaatgggagggaacttccaactgaacccaagagcagccctgctcctgggtggtcactgccaccccccatgtacctaccagtgacccctgctgctccactgcccccgccggtcatccaggaggtggaagccatacgcactgtggtggcggagagcgagaaggtgctggagaagctgcagaagaaggaggcgacgatgcgcgatgagctcaccaagagggccaaggagctgcacg

SEQ ID NO: 30 - DNA, 549 bp, Hordeum vulgare
cccgcattacgtttgatattgcagcagaatgtagtatgtaaggtaacagggaacccccaaatccaggacactcgggcctcgcccagactggtgcaatcccataacagaattaatctacaactgatggtgtttcaggtctcatcgaaaatccctgcaggttattcaatcaatcatcccgacagaagcaaaatcgtgtctacgacacctcgctcactcagctccgactcacaacccctcctccagcgctactactgagcagctcccatggcaccaccgctccgcctcgccatgcggacgcacgcctcgaacctcttcaccgcctcggcgcacttgagcgggtcctgcacattgctcctgtagcactcggcgcacccagccctctcgtcggtgcacggcgaggggttctggtacggcagcttgaactccttgtcgtgcagctccttggccctcttggtgagctcatcgcgcatcgtcgcctccttcttctgcagcttctccagcaccttctcgctctccgccaccacagtgcgtatggcttccacctcctgg

SEQ ID NO: 31 - DNA, 196 bp, Hordeum vulgare
accaaacacaccgaaccccagctagcttgcttagcttaagccccccacgcacccgttagccatggccgctacaaacccttcctactaccagagtggtgtttgtcaagacatcaaacaaaaggagcatctcttccacttatacatgaaccagatatttgatggtccgggtgttaccaacggcaaccaactcagtgtt

SEQ ID NO: 32 - DNA, 301 bp, Hordeum vulgare
tttttttttttttttttttttttttttttgacaaggaaaagccttctccatctgcttattgaccgttgcaatgctggaaacgaaagtggggcatcgaccacgcaagaagatgcttattcaagaacaaaacacatgcattgtgctaaattgggcacgcgtaaacgccaagtgcattgacagactccccagcacgcgcatagaatcccccaatgttgttaccatctggaacctggctgctaaaagggctgccgtttgcttttccaaatggcccatatgttgtaatgctgctgaccaaggtaag

SEQ ID NO: 33 - DNA, 444 bp, Hordeum vulgare
  UNSURE (443): n stands for any base
cgggtgctccaagtgggccatttttggtaagcagaactggcgatgcgggatgaaccggaagccgggttacggtgcccaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgagcgccatgccccgatgagtaggagggcgcggcggccgctgcaaaacccggggcgcgagcccgggcggagcggccgtcggtgcagatcttggtggtagtagcaaatattcaaatgagaactttgaaggccgaagaggagaaaggttccatgtgaacggcacttgcacatgggtaagccgatcctaagggacggng

SEQ ID NO: 34 - DNA, 422 bp, Hordeum vulgare
ttttttttttttttttaattaactgaaatagtcttttctgttttctgccagctgaatccaacccaacacatcacaagacaaggcagagaaacacaacacggagaggccagaaagtaactgaagccgcaagaacacgccgggctgcttttatttccttgtcaccatcctaatcaagacacggaacagacagacaacggcacaacgcaagaccaagacaactgctcagcagtcccgctcgcagtagcacttgcgagcggcgtagtgcgtgctgcagtggccgcgggggaagtcctccgtgcggcagacgctggcgcagttggtgtcgctgaagcaggcgcccttgaacttgtggctctgcgactcgcacgtccgggcctccgccgtcttccccatctcggtggcggcgacgaggaggagcagga

SEQ ID NO: 35 - DNA, 518 bp, Hordeum vulgare
cctcgtgccgaatcggcacgaggcttgtacattgcactgcatagggctgtaaaacttggaaagtttctgaggcaagcagcagcagcagccatggagcctgctagtgctagtttggtctccttgagagcatccactgccacgaaccgtagctgcttcttgtgtcggcagccagtgacgcccaagaccaggatgcttccggccatggcgtccaagtccggggcgagactggtggcttcaggctgcaagacatgcagggggaagggtgcagtggaatgcgaaggctgcaaggggactggcaggaacaagaagaacggcaacatcttcgagagatggaagtgcttcgactgccaggggtttgggatgaggaagtgccccacctgtggcaagggaggcctcacgccggagcagagaggagaaaggtagaagaaacatcaagcatccatccatccatggcagcaccaggcagatgcactctccaatgtcgtatttatcatgctcaactctgctcgaattctgac

SEQ ID NO: 36 - DNA, 526 bp, Hordeum vulgare
aaaaaatacttacaacatatagattcaaaagcatccaacccagtcaatacgtgcagaaaccagttgatttcctcacaacattctgcttgtttctcaaaccaattatgtgtatcaccatattcggttttcgatatttgtttggcgattctggttgatacttacttctagatagtagtcagaattcgagcagagttgagcatgataaatacgacattggagagtgcatctgcctggtgctgccatggatggatggatgcttgatgtttcttctacctttctcctctctgctccggcgtgaggcctcccttgccacaggtggggcacttcctcatcccaaacccctggcagtcgaagcacttccatctctcgaagatgttgccgttcttcttgttcctgccagtccccttgcagccttcgcattccactgcacccttccccctgcatgtcttgcagcctgaagccaccagtctcgccccggacttggacgccatggccggaagcatcctggtcttgggcgtcactggct

SEQ ID NO: 37 - DNA, 518 bp, Hordeum vulgare
gctttctgtctgtgcgacatacggagccagggtggtgatagatacctcctcctctggtctggagttccaagccaccggctgcagccagtggaatttggaaagatgtctttctaatgtcaagtcttcaaagccctcgttctccgttgtcctgctcggagagctgtcctttgagctgaccacggctgggcttgatttcgggtttctggttatgagcgactcgtccttggttgacacattttacagtttcccaagcttgagtcggccacacagcacgttgaagtacactttcaggaagctgttgggtcttaagaaccagaaggatcagcatttctctgatctcatccttgagcagaaggagacgttgaagaatcgtgccgaccagttgatcaagacgcttgagagctgcggctggaacgctgtgggctgccatggcggcatctcgatgcttgcaaaaccgaccgcctacattggcaaatcgctcaaggtggacggctttgagggcaagctggacagccaca

SEQ ID NO: 38 - DNA, 542 bp, Hordeum vulgare
ttaacgcttttattccttttttgattcgaaacaaagttgttcaaacaggcaaagaaagataagagttggttccccttcaggttttacagtttcttcacccacttgacccacccaacaacccctagttgctaccattcaccttagcacccccaccaaggaccagctccctgaaccgggcgatgcactccatggcccggtcgaagtcgccactctccagagcaaagctgaagcggcagtagtccgccacccctgtccacccgctgctgctaatgcacagcccggtggacctcaggagggcttccctcatgttgtggctgtccagcttgccctcaaagccgtccaccttgagcgatttgccaatgtaggcggtcggttttgcaagcatcgagatgccgccatggcagcccacagcgttccagccgcagctctcaagcgtcttgatcaactggtcggcacgattcttcaacgtctccttctgctcaaggatgagatcagagaaatgctgatccttctggttcttaagacccaacagcttcctgaaa

SEQ ID NO: 39 - DNA, 517 bp, Hordeum vulgare
agaaagctttatggggaaccccggtgcatttcatcgttctattaccctgcaatccttaactgtcttctccctcgttgcagttcttgcagcagatcatgtccaaggactagacgatgggtgcacacctttctcctgtgggcatctgcaagacatacgacctccttttcgtcggcgaggtgatcctggtgagtgtggtgttgaagcatacgagctgggttgcaccagtagcaaggctgcaattcacatcaacacaggaacatactatgtgattgccatcaactacaccggttcctacttctgggtcatggatcccaacttcgataccatcagcagctgtcctcttccattgtggaatcaccttccttactttcgatactttggatactcttataccttgggcggaattgattcagtttcaccacctggctttcgttatttggtcactcaaagctactacagcgcatgttttgctaattgttcacgagcagtagcgaagaatagtgcatacaagcccgtt

SEQ ID NO: 40 - DNA, 541 bp, Hordeum vulgare
acttatttgatgaagttgctccgcacagaaagcaaggcagtttgtacagagcatctatactgggttggtattgttacaacaataacttttacagataagtgcatcactccaggatacatacatatacacatacatacatacatacatacatacatacataataagttaataccacatattgtatctatacctcacacatcgtcttcctctgacaccacactcaatccctcctccgagaccgccgtcagctcggaggtgaaatggtaagagtcctccacatggatgtgtccttcgtcacagaaaaacggccttgaaggcatctgtaggtcatcaaccccagcctccaggatctcaatgacctcgctcatcgttggccgatcacgagacctcatctgaatacaccataatccgacaacacacagcttcttctccagctcgtgcatgtcggcaacaactggagatatctcgcccgcttcctcccgggtcagctggtcgtacacccatgacggatagtacgcctggcttgaggaccccatgtttg

SEQ ID NO: 41 - DNA, 518 bp, Hordeum vulgare
cccggggcaaacgggtacatcatcgagcagtttcttaaggatagtgccaacgaccgcaccgacgagtatggtggcggtctcgagaacaggtgtcgcttcgctcttgaggtggtcgatgctgttgtgaaggaggtcggcggccaccgtgtgggcatccgcctctcccccttcaccgactacatggactgccatgactccgacccccactcccttgcgctctacatgtccacaaagctcaacgaccacgacatcctgtacatccacatgatagagccgaggatggccatcgtggacggccgacgagtggtgccaaagcggttgctgccgtacagggaggccttcaatggtaccttcatagccaatggtgggtacgaccgcgaggaagggggcaaggtgatcaccgagggatacaccgacctagtgtcctttggacgactattcctggcaaacccagacctgccaaagcggtttgaggttggcgcagagctgaacaagtacgataggatgaccttctacac

SEQ ID NO: 42 - DNA, 541 bp, Hordeum vulgare
acacctcttttctttttaatgaaccgtaggacacccctgccctctcgatgaggttcttcaacatacgtttcattacgacctgcgatagtcgaaggaagaatctacatatatgatcattcgaggaaggggtaatcggtgtatccaacgatggggtccgaggtgtagaaggtcatcctatcgtacttgttcagctctgcgccaacctcaaaccgctttggcaggtctgggtttgccaggaatagtcgtccaaaggacactaggtcggtgtatccctcggtgatcaccttgcccccttcctcgcggtcgtacccaccattggctatgaaggtaccattgaaggcctccctgtacggcagcaaccgctttggcaccactcgtcggccgtccacgatggccatcctcggctctatcatgtggatgtacaggatgtcgtggtcgttgagctttgtggacatgtagagcgcaagggagtgggggtcggagtcatggcagtccatgtagtcggtgaagggggagaggcggatgcccacacggtggccgc

SEQ ID NO: 43 - DNA, 516 bp, Hordeum vulgare
aagaagatgagctcaccatgagcagcgaggagttgctccaagctcagttcgacctctaccaccactgcttcgtctatgtgaagtccatggcgctcggtgccgccaccgatctgcgcattcccgacgccatccacctcagggggggtgctgccaccttgtcggatcttgccgccgatacagggatctacccgacgaagctctcccacctccggtggctcatgcgcgtgctcaccacctcgggtgtcttctccgccgatgtcaacgctagtggcgacacaacatacaagctcacccgggtctctcgcctcctcgtgggtgctggcggcgagagctcacgccgccatgacctctcgccgatggtgggcttgtttgtcaaccctgtccccatcactgctctcttcagcatacgcgagtggttcaccgacgaaaagagcaccgcctcatcgtctctctttgaggtggcgcacggctgtacacgatgggagatgatagcaaaggacgccggtgacgaccgct

SEQ ID NO: 44 - DNA, 552 bp, Hordeum vulgare
gcgtaagtgataatgatatgattataaaggtaccacttacatacaacaatgcatcaaaatccataacatgaagtctgaagatttatatttaagggtagacttcaataattgagcgaatcccggtcacgggagtaatcttgtagtcgctaaacccagcttcaaagaaaatcttcctccactcatgctcctctcgctggatcccgtcgatgtacatcatgaagacatcgaacaaaacctccgcctccttcgacacggtttcctgttgcggccctacagaaccgaccaccatatccatgattatcacctttcctccagcgtcccttaccgggatggctttcttgcactgacgcagtatcttgatgcaatcttcgtctggccaatcatgcaaaatgcacttgagtaaaacggtgtccgccggtgggatggactcgaacatgtcgccggggacgaagattacattatcaagggcaggagctccggcgacgacgcgagggaggtccagcacggtgcacttgacgtgtgggaatgccttggcgatgatcgcagtagcgg

SEQ ID NO: 45 - DNA, 519 bp, Hordeum vulgare
gtcattcatttctatcaccgtgtgtgaaagaattgaacatggctatgagaggcaacaatgtcaagaccttggccatgatactcctagttctgggtcttgtggccatggagcgaacccagcaagcgcaagcctcccattgctgttgtcatctagactcggtccctacctattttgactgccgcgccaaatctgatagcactgtctcagagtgctgcggtgtttccgccggctatatatcaaacgacgctggaactgaatgcaagtccggttatattgatatagagaaagtttcactacaagcagtcaactactgcaagttggggtgcacggcttccttgtgtaacaaagtaactccatctgggaacgatgccatggaacgctgcaccagtgaatgccacgatctgtgcaccaagaacggtgtggaaattgcacaagtcgtcgtggcttaactagttatggcaaggagctgcatcggacaagcccgccaaggagtgtttgtgttgccttcaataactggat

SEQ ID NO: 46 - DNA, 551 bp, Hordeum vulgare
taaatatgctttgacaatgtcatacgcaaggatacaacaaaaacatctaatatgatgagcactatatatcctcgcgggaggatgcgtcatacatctcatgagccttattggagctaaaattgcaacacaagtaacatttgacatatactggtcttggatgcgacatccagttattgaaggcaacacaaacactccttggcgggcttgtccgatgcagctccttgccataactagttaagccacgacgacttgtgcaatttccacaccgttcttggtgcacagatcgtggcattcactggtgcagcgttccatggcatcgttcccagatggagttactttgttacacaaggaagccgtgcaccccaacttgcagtagttgactgcttgtagtgaaactttctctatatcaatataaccggacttgcattcagttccagcgtcgtttgatatatagccggcggaaacaccgcagcactctgagacagtgctatcagatttggcgcggcagtcaaaataggtagggaccgagtctagatgacaacagcaatggg

SEQ ID NO: 47 - DNA, 280 bp, Hordeum vulgare
gccgagatattctgtaggaaatggctgacggtgaggacatccagccccttgtctgcgacaatggaaccggaatggtcaaggctggtttcgctggagatgatgcgccaagggctgttttccctagcatagttggtcgccctcggcacactggtgtcatggtagggatggggcagaaggatgcttatgttggtgatgaggcgcagtccaagagaggtatcctcacgctcaagtaccccatcgagcacggtatcgtaagcaactgggatgacatggagaaaat

SEQ ID NO: 48 - DNA, 558 bp, Hordeum vulgare
  UNSURE (27),(28),(46),(47): n stands for any base
ttagtaagcatattaaaaatacatagnncaaaaaccatgagctatnntacagacaattcccaacaacaaatcaagccaacccaagtttgacaactgatcccacaaacacactgacaatgcacaaacatagatagtgtacttgcacttgcaccatggagccgccacgtatataggtggcgtatcccaagagtacccacgtcacgtctggaaaaaaacatagcttgcaaatacgcaatacatttctagaagaatgaaccaaacataaccgaagactagatgataacagcagtggagcgctcgtggagatcagaagcacttcctgtggacgatcgctgggccagactcgtcgtactcatccttggatatccacatctgttggaaagtgctgagtgaggctaggatggaccctccgatccagacactgtacttcctctcaggtggagcgacgaccttgatcttcatgctgctcggagcaagggcggtgatctccttgctcatacggtcagcgatacctgggaacatagttgtgccaccactgagcacgatgtttccatacaa

SEQ ID NO: 49 - DNA, 516 bp, Hordeum vulgare
ccgcgcaaggtcgagcccgcccggagatcctcttcctctgcagctacgacaactgcggcaagaccttcgtcgacgtggcggccttgaggaagcacgcccacgtgcacggcgagcggcagtatgtttgccaggagcccggctgtgggaagaaatttgtagacagctcaaagttgaagaggcaccaccttactcacacaggacaaaaggattttgtttgcccacatccaggctgtggtaaggccttctcattggattttaacttgcgtgcacacctcaaaacacatgctgtggaaaattatcatatatgcccctttccagcatgtggcaaaagatttacaagcgacttcaaattaaaatgccatattaagacacatgaaaagactggatctcctattgcagtgcagcatacaccaccagcagaaaaaccacaaaacaccataaagccttccatacaagcaaccccaaagccttctgcacccacaccaccaagcttttcctctgagcgcccttatgtct

SEQ ID NO: 50 - DNA, 553 bp, Hordeum vulgare
tccacaagggtggagtgcagatatatattacataatgggaccatctcaacaaaatgaccaaacaacatcagtaagtgtctgctcatatgcgcgcaatctaattctaccataactataacacccacttagtttcattcattgctagttttcagcatacacgaaacttactaaaaggaagcagacaaccacatctaaacaacctagggcacacgctccagcggaatgtcagtaaacaggaaaggcggaatgtccagctaatcttcatcttcttctgtttcctcatcatcggcgttctggttaccgtatctccagccatcttgtacgttgttaccaccaggatcttcctcggtctcttcgctgtcatcgtcatacatacccttgcctggccactggttcttcacaccactggtatcaacgcccatcctgctggaaaccttgacattgtaggcgttagatggaggggccctgtgtgcttggtttgtcttgctccttttcgggtttggcgcaatgtcaccggcgtcagcatagttatactccgctgcaggtgtggcga

SEQ ID NO: 51 - DNA, 517 bp, Hordeum vulgare
agatagcatagtgtttgtccaggttcctagagattgaaaatgtgcaaatctgaaagcaaacatggaagtggtgatttagttagtgcatttggagaggcttttggatgtggtctaacctctcatagtcagaagtcctttgttaagcgccctaaagagttttggccgccttacacttctggtttcttattgtggattactactggtttcttctatttggagacactggccatatctgctttgactaccatgaccatcctctggtctcagttatgacaagtcatgttattttagtttgcatgcatcatacagggttttgcttgtcacttaactagattccccagtggccctgctttaataaatttatcaagggttgcattctgaatcttctattactcctgttttccttgcactttgagctttgttgaacaccaggtatgttctggaggggggaatcggtacaatcgtgttgtagccagtggctcactttttatttctttcggttgtcaatatgttttat

SEQ ID NO: 52 - DNA, 541 bp, Hordeum vulgare
  UNSURE (48): n stands for any base
ggtgaactggtctgctttgctattactacccgtccaaacggctatcgncgtttattccaatataaatacacaggtgctaagtacgagtagatcaagtagctttgcgttgccggatagaataaaattacagatggagggcgtggaaatccctatgatcccacccacattatgttcctccgccgaggagcatgaacacaaaagaaggaaccacagcataatgccaaacaagtctctaggaagaaataaaccctttgcaacataatacaatggtggaccgtgtgctccttgcttgcaagcgctttgttctagtcggcgcgggattggccggcacgcgaggagaggatgatgccgacaatgaggccgtacagggcaagggcttcggcaaagatgaggatgaggatcattccgacgaacagcttgggctgctgtgcgttggccctgcagaggaggtaaaacaacagaatcaaatcagtacttcaacaacttccagacaaaaaggttgttgtccatagaaagattgatctaccactaccagaaggta

SEQ ID NO: 53 - DNA, 524 bp, Hordeum vulgare
ggacgatgtcaatgtgctgaacgaggtgagggagaggataagggagcaagggagggtgtggtgggcgctggaggcgagcaagggcgcaaactggtacctccagccgaggatctcctccaacggtggccagggcgtgattagtgtcacgtcgctcaagctatcggtgctcaccaatacagttacattgaggaggctgattaggaagggggtgccgccagcgctgaggccgaaggtatggatgtcggtgtcgggtgcagccaagaaacgatcgacagttcctgagacatactatgacgagctgatcagggccacagaggggaaaaccacgccggccactcgccaaattgaccatgatctccctcgcaccttcccctgccatccctggttgaacagcgaggaaggtcaggcatctcttcgacgtgtacttgttgggtactcattccgtgattcagaagttggatattgccagggtttaaattatgtagctgctctgttattgctcgttatgaagacagaggaagatg

SEQ ID NO: 54 - DNA, 551 bp, Hordeum vulgare
gaagaaactttttttagctcattttacacgtacaacaaatcgatcggtactacaaatcaagcaaatgcacagaaaagattcgtacaggtttcaaccagcagcagaacctgccaccacggcatcgtgcacacgcacagaaacacacaatatgaaggtccagaaaaacaaacccacattgcagttttggcaactccccataatacatttcctgtttcggcggacctcgagcgggttttttactcgtcgcagaatccagtctggccaggaaccgagtgcaaactcaccgtgtctcgcctttcttcaaaacacacagggcttcagccaagcctctcaacatgttttttctatgcatcatgcatccatcttgagtgagcccagccgtctggtcctttggtcgagctctgccatgaccaccatctcgtgccgtttcctttcttttgtgatcgtgttcgttgtcatggagccaatcttgtcgaacgcaaacgtgagcagctcatcaggctcgtataggtggtgtgcagttgtctgcagaacatcaattacatcaccaa

SEQ ID NO: 55 - DNA, 516 bp, Hordeum vulgare
cggcacgagggataatatgggggttccgcccgagccctatgactggcccaacatctgcccgctccctgggtcgtctagagatacaggttggcgtgcgatctttactggcaccaggcctaccagctgaatcaagtctctgagacttgcctgcctcctatgcggtatactcgatgttgcagtgtagcttcaactgggcagcaaaggtgttttcacaagccacgccctatacttcaactcttttctaccatggtgcatacctttctgaaagattgcaccagatcagtcgaggtatacggttatattgcggtccgagatggcgaggattatcgccgcaattatcttttcaaccgatcccgagatgacccgcttactatcaattcggccagcgactatctgcgcttgttgagccccaaaagaggcatctcgatgaaatttgattgcctagttgaagtggatattaggacaaaggcatcgccgggtgatacagatgataaaaatcttgttgatggatgcttc

SEQ ID NO: 56 - DNA, 551 bp, Hordeum vulgare
ttcctctgaaatattattgaattaacctccacatacatatattccttagtagaggactgtcgaccaagacactttcacagacaccacagcactattacagaaatgatattctttttcttcactgccatgaatatccgctttaaatgaaattggcatactcccctccataaaatcaataaacagtgtgtcctccatctgcacagctgctacaaaatattgtgaaaaactcccagccgaagacacgaagctattgcagtcgcattctttatcgtctatgaaggcatacatgttcttccaaatggcagtatacccacacatctttatatcaaagccatctccaggcacttccaaaaagttcatatgtatggttgcctcgacactgtctcgaaatatgataagattaaaaacaagagcaccatgttcaccttccattttgattctagaaaggacgtcgaaacgagaccggcgctcgattaagtcgaagcatccatcaacaagatttttatcatctgtatcacccggcgatgcctttgtcctaatatccacttcaa

SEQ ID NO: 57 - DNA, 517 bp, Hordeum vulgare
gacgaaattattgaattcctgaagtggatattgtaacaccatcccagaagctattagctaggaagctgtcatgcagtgtggtacaagggaaaagccttctcttgactggccccaatggtaccgggaagagctctgtttttagggtgctcagagatttatggcctgccttttctgggagagttaccaagccctctgaagggatgttccatgttcctcagagtccatacaccagcctgggaactcttagggatcagatcatataccctctgtcaagggaggaagcagagatgaagattctttcgttatataagtctagcaacaggtctagtgcccctgagttgctagacgatcacctgaagacggttcttgtgaatgttcggttggtctatcttctagagagggaaggctgggactctaccccaaactgggaagacgttttatcgctgggagaacagcagaggcttgggatggctcgtttgttcttccaccatcctaaattcggcatcctcgacgagtg

SEQ ID NO: 58 - DNA, 549 bp, Hordeum vulgare
tcttggtgatgtacacaactcttaacgtattccgtatttgcttccttttgtttacacatctttagatgacaaagacgaacgacaaagatgatggcaacaacagccaaatttattccatatgtactgcactagcatggaatcaatcaataataggtttgataattcacatcaacagctgctctgagagagattatgtactgctgttctacactctcatcctacttcacacctccaaatcgaaacacctctcaatcctaagcaaccagttttacctccgtcccctgctcattcagtttgttactaaatttggtataactagactgactgccatcttcagtgccgaatacctgatgaggattcacagttgtacatgctgctcctgcttccagatggtcgggagggcgacccgatatgaacaacttgctacagtagcgcatcttctgtatggcataagtgactgagagcagataaaaactctagctggtggtgtcaatcaatgttggatctcgcatagctcccagttcccctcaccatcgatgagtttaagct

SEQ ID NO: 59 - DNA, 497 bp, Hordeum vulgare
atcccactcctcggcctcttctcccccgatccgaacccattcccacctcctccgctccccgccggatctcgccaccaggatcgtccgtccgtcgacccgcaggcgaggcgatatggccaccttcgagctctacaggcggtccaccatcggcatgtgcctcaccgagacgctcgacgagatggtctccagcggcaccctcagccccgagctcgccatccaagtgctcgtccagttcgacaagtctatgacggaggcgctggaaaaccaagtgaagagcaaggttactgtcaagggccatctgcacacctacaggttctgcgacaacgtctggacgttcattctaactgacgcgcagttcaagaacgaggagatcaccgaacaggtgagcaaggtgaagatcgtggcctgcgactccaagctgctcagtcaataagcagctcggcgcgagctgactcccggaggcggggctcgaactcgttcgatccctacctcggcta

SEQ ID NO: 60 - DNA, 515 bp, Hordeum vulgare
acaagttaggtccggttgctggctgctacttactcatccagtcatcaccagttatgtagtatcaaaagttcagggaaacaacattacagcgaaacaaggatgggagaaggttctgcggatgcgatgccacgctctagcgttgcatggcatgagattctacaggtgcccatggaaggcgaaggcggcgatgtcggtggtggcgttcttctctagccgaggtagggatcgaacgagttcgagccccgcctccgggagtcagctcgcgccgagctgcttattgactgagcagcttggagtcgcaggccacgatcttcaccttgctcacctgttcggtgatctcctcgttcttgaactgcgcgtcagttagaatgaacgtccagacgttgtcgcagaacctgtaggtgtgcagatggcccttgacagtaaccttgctcttcacttggttttccagcgcctccgtcatagacttgtcgaactggacgagcacttggatggcgagctcggggctgagggtg

SEQ ID NO: 61 - DNA, 164 bp, Hordeum vulgare
accgctgtgagcacccgggtgtcgaatgagatcggggccggtaacgtggacagcgcaaagggcgcggtcatggtgacgatgaagctgtcagtgctcctcgccctctcattcatcctgctgctgatcgttggccacggcctctgggcgagcctcttcacggggag

SEQ ID NO: 62 - DNA, 358 bp, Hordeum vulgare
tttttttttttttttttttttttggtagtatttatacaacttcaagatccccgcaaaaagggaagacgcaggaactagtatttcccactttctcagtccactgttcctcattggtgtacattccagtcaaaaaaaaattaacgttgggaaatgccatctgttaggcagcctccatttttacagggtaaaatcaactcagagatacggtcaaaacttacaaatacaacagttacgtcgacaaatacaacaattggtgcatcttgaactagtagacaaacacaacaattggtgcatcttgaactagcacccaagttaagcatggatcgatcaagcgacatagccatcccggtttttctcc

SEQ ID NO: 63 - DNA, 1423 bp, Hordeum vulgare
  UNSURE (1)..(8),(17),(18),(20)..(25),(29)..(44),(48)..(66),(71)..(74),(78)..(82),(87)..(102),(105),(108),(110),(112),(123)..(125),(130)..(136),(138),(139)(141),(143)..(146),(148)..(156),(162)..(165),(168)..(175),(181)..(187),(238),(291),(351)..(353),(370),(371),(373)..(380),(422)..(425),(477),(479)..(483),(489)..(500),(519),(526),(527),(549),(553),(554),(556),(557),(563)..(565),(571)..(576),(580)..(582),(584),(586)..(588),(591),(592),(595)..(599),(607),(615)..(618),(621),(628),(630),(632)..(634),(641)..(643),(646),(650),(651),(653),(655),(656),(660)..(662),(666),(667),(671),(672),(677),(678),(684),(689),(690),(709),(716),(733),(746),(750),(752),(760),(771),(786),(799),(806),(816),(821)..(823),(826)..(830),(835),(838),(863),(864),(885),(901),(934),(935),(946),(1005)..(1008),(1038),(1057),(1058),(1104),(1106),(1107),(1168),(1169),(1300)..(1302),(1313),(1347): n stands for any base
nnnnnnnnccccccccnncnnnnnncccnnnnnnnnnnnnnnnntttnnnnnnnnnnnnnnnnnnntttgnnnngggnnnnnttgannnnnnnnnnnnnnnncgnggncncngttgtttcttnnnccctnnnnnnncnntncnnnntnnnnnnnnnaatggnnnnttnnnnnnnncccaannnnnnngagtatagtattatatagtagatggggttggagatcgttgattatgtaganatgagatccgagttctcgagatgcgtagatgattataattattagtcgacctncctgatgataggtgagatgatatatgtgagtagtgagagagagagtagatagatgagatnnnatagtagcgagaagganncnnnnnnnnaatatatgagagatataagaatatgagagatgagatagtatnnnntttgatcataataataagatgatgatatatatatagatatgatagtatatgngnnnnngggggnnnnnnnnnnnngggaaggtggagtgtgggncgcgggnngaggggggtaaatcactctccncggnngnnccttgnnnccggtnnnnnnattnnncngnnnccnncgnnnnnagtttttnttattgannnnccntgggggntngnnnattgggnnntangtcnncngnnacgnnnacgnncttnngcggnnacggtnccggnngcgttttgttttgtaaaanttccccngtttggtgttggggggnaattgggggccgncccnanaggagggnccggttgttgnttatccccctgtttnaatggctccgtgnttaaggnttttgttttntggannngtnnnnngaagntgntgtccctgagttccccggcgggggnncccccccacccatcaactcgnttggggggaggcacanacaggagggacccggggggaacactcctccccnncccccctcccntttgtgtgggggcgcaccggagggccccccacaccaccggggggaggcaccccccgccnnnntgttgttcccctaaaaatgtggaacccagngaggcgccccaccgcaggnnaattgtttttgggcgccctccctctcatttattttttatgtcgggngnngttgtgtgtggggagggggtttatttctctctcccccgcggggtttttgtgtgtgtgtaannaaacgataccccccccacaaagagaggggggttcggcgcaccctctccctggcgggggccccctctcttttggtggggaaattacttttattagagagcgccccccccgggggggggggttttgtttttgnnnttttttttttntgtgggtttttgtgtgggggaaaagggggaacancaccacccccccacccccccgcggggagggggggtgtggaggtgggtataaaaaaaataataagagaagggggcgg

SEQ ID NO: 64 - DNA, 552 bp, Hordeum vulgare
aaaatgtgttggacatcaaaatttgcggcacgagagctacatcatgagtggattcgttacaatttttgcgaaacatagggctgtccgtttgttataatcttgcaaatgatagagctgcgacagacatacgtcgttcagggttaacaaatgaattccaatgaattccttggttccaaggagacataagaagtcagattgcagattcacgtatcagcagcttgcaccacggccatgagcgaccagtgcatcggtccaccacatatgtgtggaaatagctgctctcggtcgcaatcttccaaagggcatggccaattctcataggtatcccttggtgatttgttcttgcagttcgtcgaagttccaagcgtcattgaccgaatagtcaccaattgagtccctccgaagggcggtcaaatgagcacagcttcgaagcgctttccccaggtctgcacagagggaccgaatgtatgttcctttcgagcaagtaactcgaaataccaaattttgcctgtcttctaaactgcgctcgatatcaaacttgtatattgatat

SEQ ID NO: 65 - DNA, 343 bp, Hordeum vulgare
caagctcggccagatcgacaaggtagccgcctcatccatcaacgtcctcctccgatcctccggccgccgtcccgtcgaccgatcgctccttcgtcttcctcctcctcctcctcacctgttctcgcagccgcatgcgtgggacgcaggaatcctacaggaactgaacgatccatacagagaagatggatcaaggtccggtagaattcccgggttcccagctgcaaatcctccaccgtgattcttccttctttatttcaccgcgttgcacttggtaaatgtgtgcctttgtgtaatgtaatgtatagatgtatatgctttgtgtaaaaaaaaaaaaaaaaaaaac

SEQ ID NO: 66 - DNA, 311 bp, Hordeum vulgare
atacattctatacattacattacacaaaggcacacatttaccaagtgcaacgcggtgaaataaagaaggaagaatcacggtggaggatttgcagctgggaacccgggaattctaccggaccttgatccatcttctctgtatggatcgttcagttcctgtaggattcctgcgtcccacgcatgcggctgcgagaacaggtgaggaggaggaggaggaagacgaaggagcgatcggtcgacgggacggcggccggaggatcggaggaggacgttgatggatgaggcggctacttgtcgatctggccgagcttg

SEQ ID NO: 67 - DNA, 524 bp, Hordeum vulgare
ttgcatcgtacggttggtttcaatcattcttacatatgcgatccccatgtgcaggccgtgttctctgtcaacttgacttgttaagctatccgaaggaggacagccatggctaccatctatgacattggcctcggggcggggttcaacatattgatggcgaccatcttcctgctcatattcgctttcctacggctacagcccatcaacgacaggatcttcttcccgaaatggtacctcaagggaatgcgggacagcccgtcctccgccggcgccgctgtcaccaagtatgtcaacctgaacgtgaggtcctacttgaagttcttaagctggatgccggctgctctcaagatgcccgaggaggagttgatcgagcatgcgggcctcgattccgttgtctatctacggatatacctcacaggactgaagatatttgttccgattacgattcttgctttcgctgttttggtccctgtgaactggaccaatgatacgctagaaggtttgaaggtagtccacagtgatat

SEQ ID NO: 68 - DNA, 544 bp, Hordeum vulgare
ggtgtatgaatgaactagatctttctccgaaaagaaatatctgagaaattaagatctttacagagggagtggtatttttgcacattgacaatcagtttctgacgaaattggccacacacaaacttctccagttcaaatactatacacctcccagtgccaaaccaagcaaatcctcactgcaatgtgcatctccgtatcgtgttcggttcaaatacctactagtggtaaaaacatcgtgtgcgttgcaagtttgcaagtgcggccaacatccccagccgtgtgacatccatcatcatcatcaaccagaattcaattcccccctctctgcctctctctctctctctctgtacacgctagcagcctaaagaaccaagatgcgctcctcccatggcggctggcaagcttgccggccggagcaggttgtgctacctttcgggtatggagtccggcaccgagaacctgtcggagccgtcgtacttgctcggcacgggcgtggtcctcctcgactgccgcttggtcgccacgatcacctcctccgcgccgg

SEQ ID NO: 69 - DNA, 520 bp, Hordeum vulgare
cggcacgagggagagagagagaactatgggaccttcgcgttggtaattgttccgacgcgagagctgtgcctccaggtttatgggattgcgcagcagttggtgcatcgttttcactggcttgtccctgggtatgtaatgggtggtgagagtagatcaaaagagaaagcaagactacggaaaggaatatcaatcctcattgccactcctgggcgccttctggaccacttgcagcatacttcatcatttgtttattcaaatttgcgctggatagttttcgatgaagctgacagcattcttgagcttggttttggaaaagcagtcgaggatattttagggctcttgggttccagaaatgatgcttctgatgagaataaaagcaaaaccgaccctatgcaaaggcaaaaccttctcttatcagcaactctgaacgaaaaggtgaaccgcttagccaacattagtttgaagaacccagtgatgattggacttgacgaacaaaagaagccttctgagaggtccagtg

SEQ ID NO: 70 - DNA, 550 bp, Hordeum vulgare
caaatccttgatttacagtaaattagctctctggcccctacataagttctttcgcaaagtcgccgctgttagtttcaaaagcatcaagcgggtaatgatccaccatggggaattcacttcttagtggggaattttctccgtttggtcggtccttgtccttcgcgtttctgttctttcttcctcttcttgagttgcacctggtgcgacctcccgaccaacgagggttgctccttcaacccgaagcttctcgccacatgtcccaggtggagcttcttcaccatgaagattttcttcagctcgcctcggtgggcggtgtaagcgcgaagccaggaacagaaggcatccctggcaagcttatttgttgtggcctcggatgcgacgtaattttccagagttcgctgtacagacagtatccacggatgcatatccaaagatattggcttcctcttgagaggcttctctccatttacagggaaaccgtctagcaccttctggaaggggtattctgtcagagatacaccatgcagctctaggtctctcaagtagtcga

SEQ ID NO: 71 - DNA, 526 bp, Hordeum vulgare
  UNSURE (26): n stands for any base
cttccgagggtggggctcgcctgcgngcctcctctggggcgccgtccccctcgtcggcgctgcctggatcgtcctgttcgtggccatttcctctggcataatttactggtactatgcgcaactattgaaggtcgatgaggaagagtttggaggccacggcgcgctgcttcaggaggggatgttcgcgtctttcacccttttcctgctttcatggatccttgtatacagcctggctcacttttgatgagaagatcctttgttgaacataccatgatgggacttccgccttcggatcgggtcggcctgaagggagttcaccagaacctctgtagattattaaagagccttagaacagcagcagtgtatcgaatcggttcaggcagtaatgttgttcctgaatcccggtgtaattttttatgagtatgggtaggtcaattcagcatgagctagaacattgcttaccatgtaactattgcacatcattatcttgcgtctgttgaataagaacgtttttgacatattatcg

SEQ ID NO: 72 - DNA, 521 bp, Hordeum vulgare
gtggaatcgatatatggtaaaaacgttcttattaacagacgcaagataatgatgtgcaatagttacatggtaagcaatgttctagctcatgctgaattgacctacccatactcataaaaaattacaccgggattcaggaacaacattactgcctgaaccgattcgatacactgctgctgttctaaggctctttaataatctacagaggttctggtgaactcccttcaggccgacccgatccgaaggcggaagtcccatcatggtatgttcaacaaaggatcttctcatcaaaagtgagccaggctgtatacaaggatccatgaaagcaggaaaagggtgaaagacgcgaacatcccctcctgaagcagcgcgccgtggcctccaaactcttcctcatcgaccttcaatagttgcgcatagtaccagtaaattatgccagaggaaatggccacgaacaggacgatccaggcagcgccgacgagggggacggcgccccagaggaggccgcaggcgagccccac

SEQ ID NO: 73 - DNA, 518 bp, Hordeum vulgare
cctcgtgccgatcaccgacgaccggcgtactgcgtctgcgccgtcggtggtggagtacggcacatctcctgggaactacacggcgtccgccgagggaagccatacgacgtaccgctgctcctcctactactcctccggcgcgatacatgaggtgacgatcggcccgctcaagcccagcaccacctactactaccggtgcgggaaggtcggcgacgccgacatgtccctcaggactcctccggcgaacctgcccatcgagttggttgtcatcggtgacctcgggcagacgggctggaccaagtcgacgctgtcgcacatccgcgacgcagactacgacatgctgctgctccccggcgacctatcgtacgcggacagggtgcagccgctgtgggactcgttcggtcgtctggttcagccgctggccagcgcccggccgtggatggtgacggagggtaaccatgagaatgagcatgaggatgggttcgtcgcctacaacaatcggtggcgcatgccgcacg

SEQ ID NO: 74 - DNA, 548 bp, Hordeum vulgare
gggagaacaacgtatttcttatcttattccgagtgactgtatattcaaatgtgttttcattgtgtgagcactaaagccatcgtcggcaacacaaatgtgatgtcatgtgaaaatatattgcgttcaaagcgtgtgttattttctcttccgttggaacacacgggctctttttttagttattaggtaaagatagtagtgaaccatccaattctgataggttgcagttaagccaacgtggatcgagtggtggcaccctgcaactcatctgtgcaacgaccggcgctgggttggtgtctttggagtagccaagctctccagccagacctcgtcggccacggtggcgaacttgtcgtcgttacggtgccacctccagacggcggttgtctcgtttacaatcctcagtcgcccgtgtccgaagctcgcctcacggaacaaggaaagcggcgccgacttgtgatccttgatgaatttggaagcaaggccttccctgttgccaccatcgccgatggtgatgtacactggaccccgggcgtcggccttgttgtcgt

SEQ ID NO: 75 - DNA, 432 bp, Hordeum vulgare
ggggccgtcgtgcctctacgtcgggcccatcgagaccgccagccaggagatgctcgaggcgctctaccgccaggccagggattcctactacagcggccagcctctgatcgtcgacgacatgttcgacaaagttgagttgaagctccgggtctacggctccccgtcggtcgtaaaatacccccgctgcagcctcaagcgacagtcggcgtacgcggacgccgagggcaggaggaccactcgatgtttatggcactatcgagcatctggacgctgctgctcctgttcggtacctcggcatttctggtcccgagcttctacactctgagcctggcgttcggggacgcgttcggagcaaggtctctcttctccggcgctaagtcccttgacgggataaccagggtgaaccacatggttttgattggattaggctat

SEQ ID NO: 76 - DNA, 546 bp, Hordeum vulgare
  UNSURE (14),(22),(23),(28),(43)..(45): n stands for any base
gcagcagctttggnatattctnncgggnaaggaatggtacagnnnatttataaaatgggcgtggttgaacaatgggaaaaaaggcaatatgcactacagagcaacaaggctactatcttcgggaggcgtttcaggctttcagcagataagaacacaacagatatggatctctttcttcaagagctatcactgtgtttctagtcttttatccatctccttttcctaggatgtccttgcttcaccatataaacacggccataaacccagcttcttctaggtccagacagagatctctcgactttagtacggtactccaatggacactcacagacatggcattctgccttgtggggtgctttaatggatttatccgtcttcacaaatgcaaatacctgctcaccgcaattggggcaagagccttttagtgcgaccacattgtttgtcaacaggccttgcagtgcaccaactgatgcggatgcaaccggatagccaatcagatagcctaatccaatcaaaaccatgtggttcaccctggttatcccgtca

SEQ ID NO: 77 - DNA, 518 bp, Hordeum vulgare
ccctcttccgctcgttgcctctcctcgtcctcctagtcgctctgtccagcaccacattaccttcctcccgttctacgtccgtcgatggagaccaccatgacctgctgatgctgggtaggttccaccgatggatgtcgtggcatggccggacgtatccgagtgccgccgagaagctgcggcggtttgaggcgtaccgtcgcaacgtggacctcatcgacgcctccaacagggacgccgagaggctgggctatgagctcggtgagaacgagttcaccgaccttaccaacgaggagttcatgacacggtatatcggtggagccggtgctggtggtggtctcatcactactttggccggagatgtcgtggaaggggtggtatcatccaagaacactatcgaggggggcggtaatttgacgatgtccacctccgaccctcctcggcagtttgactggagggagcatggcgctgtcacgcctgcaaagcaacaaggggcatgcggatgctgctgggcgtttgct

SEQ ID NO: 78 - DNA, 551 bp, Hordeum vulgare
tagtacaatatcgtatactctgtagataccggtcccaaagtaatttggcatagatggtaccggtgacatcatcgtccacacatccatgtatcgtgcacatgcattgatgcatcttattttaatagcacattacgttgcgcccataccatgatataatactaactacatgacgggataagcaccgtacatggccatgccacacagcccgcggggcccgtcggctcccctacgcatgaagaagaagccattctggccccacgtctggccccacgagttcttggcgatccagtactcttctccggcgccggtgaccccgtagccgaccaccgtcaccacgtggttctggctggtggtgcacggccccttgtacacgccggatttgtagttctgcagcacggagccgctcccgtcgatctggacggtcaccggcgtcctgagcacggccagcgccagcgcgttctcgttgctccccggctgcacgtcctggacgccggtgatcttgccgatgcgtcgggcagcgtcgtgcaccgtgcatctgcctcgcttggcca

SEQ ID NO: 79 - DNA, 964 bp, Hordeum vulgare
  UNSURE (554),(571),(620),(650),(696),(767),(793),(811),(822),(825),(827),(884),(905),(915),(916),(922),(934),(951): n stands for any base
gtcccccgggctgcaggaattcggcacgaggccggataaaggcacaggccttgtcaaatgctaagggattgagcagggctcaagctgaacgtgcagcggaagctgccgctcgcaatgtcaatgcctatgggcagaaggaagagggaccaagccgctggcaggagaggaaggaagccaagaggcagatgtatctgatgagtaccgagaaggctgtgaggctgggtgtgagaccaaatgctgaaccagcttctgcaactgctgggggccaatttcagaagtgcttccagcctgggcactggacatacgagtgcaagaatgaacgagtctatatatcgcggccctcgaggacggaccagcttaaggacccaaggctgaagaaggcgtggctgccggctccctcccagttcgtgaaccctgatctggagaaggagatggaggaagaaaggaagctgacgagagaaaagctgaagaaggagaagtctcagaaaaggaaggcaaggagcaagtcaaagagcaagaggaaacatcgcgcgcccggtgtctgactccgactncgactctgaatcatcanggactggctctgagtattcttctgagagcggcagctcaagctacagctnctcagactcggaggacaagaagaagcgccngagcaagacgaagcagaagaagagaaggcaccggaggacacgtcgncgtcgtcctctgatctgattctgagtcccagtctgattctgattctgatggcaagggcagccggaggaaancaaaaaacgtgtcacaagcaccgttnttgaagacccggggtacncgaccagggcnttnanatgtgatcaaattccccatacatatcacctattttattatagctgggattttcgggngaggggccctcaaaaaaaatnttccaaaggnntttggnggtttcctgacnctaaaaaatccccggtnttgttttcccctg

SEQ ID NO: 80 - DNA, 550 bp, Hordeum vulgare
gctcaaactggttagatacaagtctgtacataccaacactagaacctgcaaacgtatagacctaaatcacagccacaaaacattcacaaatccgatgcctcgtcgcagatcgcctctaaaaccctattgtcccatacatacattacacctgaactcaacggatctctctggcaggaccgatcaagccggcctcagcgaagcgggcctgttgttgctccctttggtcgacgacggtctcgagccggtcatgctccggctgctgctcggcttcctttgcagctgcgggtgagggctgttccctccctccttggcgtcgtggagctgctccagcgccacgacgacctgctccatgctcggcctgtgcctcgagtccgctgagaggcattgaagcgccagtgacgctgtcttctgggccttggcgagggagtactgcccgcccagacgggggtccagcacgcggaagatgcgccgcttgctcgtcaggtacggtcgcgcccactccaccaggttgtgctcgccggttggctggttcttgtccaccgcacgccgc

SEQ ID NO: 81 - DNA, 497 bp, Hordeum vulgare
cacatctcgtctcatcgccccttcgtatcatacttcatctcgtctcctcccacgcgactcgagaaccttcctcccctccgccactccccactcgcagccgccgccggcagccctccgtccgtccgtccggcagtcagattttggaggatcgcagaaggagagatggcaactctaaccagccttacctcaaatgcgaatccaaacaagtcatttgaggtcctgcctaatccaggcgactccctctcaagcctcagttttagccccaagagtaatcttctggtggcaacttcctgggataaccaggtgaggtgttgggagataggtaacggtaacagtcagccaaaggcatccatatcacatgatcagccagtgctctgctcagcctggaaagatgatggtaccactgtcttctctggaggctgtgataaacaggtcaaaatgtggcctctgctgtctggtgggcaggctcagacggttgcaatgcatgatgcacctgt

SEQ ID NO: 82 - DNA, 434 bp, Hordeum vulgare
  UNSURE (20): n stands for any base
ccaatgtcatgcccatattntcaaggacctacaccacttacaagacactgaagactttcacgttttgacaaaaggctacgcactgacctgactatatatcacaacacaataacacggggaaaccattccttcggacaactatgcaatacagaaacggctatgcgctacgacctacggctaagtaacctatcgctggctgctgggactaggcttatcatctaccaggtggcccaaccaagtaacaacatccagaggacacggcaaggcatggcccgagcgaaacaaggcccttgaatatacatgatctcttgcgcaactatccactttcttggcaggcaggatgccatcacttccgtcctgttgcgattcttggctttcctttcacctcggcttcctggggactgtggaggtagatggatgtctttgcgtttgca

SEQ ID NO: 83 - DNA, 10 bp, Hordeum vulgare
  UNSURE (1)..(10): n stands for any base
nnnnnnnnnn

SEQ ID NO: 84 - DNA, 473 bp, Hordeum vulgare
acatacggacgtcatggaagggcatgcatggacacccagaccgaatggatctatatgcacatccagtaatgaacgatagcatgcaccaactagctagcatttctcgtcgggatgcggttgctgctctgccttgctgccggcggccggcgtggcccacatggcgcataggaggtaagcggccaggttgagagcccctagaacggcgaggagccagtagaagtaatcgaggcggctgtgattgatggtgtcaccgagccatgtggttgcgcccctgacgagagagacgagggcactgctgaggaagaagccgagggagagcgtggtgaggaagaggccggtgctcatggtcttcatgcccttgggcgaccgcgtgatgaagaagtccagctgccccgtgtagatgaacgcctcgcccgcgcccaccagcaggaactgcggaatcagcatgaacacggtgatcggcagcgccgtgc

SEQ ID NO: 85 - DNA, 519 bp, Hordeum vulgare
ggcaactatctatcatctgtagtccactgatgtgatattctggttttttatgcagctgaagaaaatgtgcaaggagggtgcatattggggtaactaagtagaagaacatttctctattgtcttatttggctcaacaaatgtgttactaacataaatcattcatccattcttctagtttccgctgacagatttagatgtttttttgactaatctgcaggtgctgttgctggggtgtatgtaggcatggagtatggagtggaaagggtccgtggtgaccgtgactggaaaaatgcgttgataggaggcattgcaactggtgccctggtctctgctgcgagcaacaacaaagggaacaagatcgcccaggacgccatcaccggaggtgccatcgcgaccgccgtcgagttcatcaactacctcacctagctgtgaggccatatccgcggcgatgtttttatcggacaagactgaataagaacttcttgactgaagccatccaccctgtgtgttaataattgg

SEQ ID NO: 86 - DNA, 530 bp, Hordeum vulgare
gaggaaacggcttccattattaacaccagggtggatggcttcagtcaagaagttcttattcagtcttgtccgataaaaacatcgccgcggatatggcctcacagctaggtgaggtagttgatgaactcgacggcggtcgcgatggcacctccggtgatggcgtcctgggcgatcttgttccctttgttgttgctcgcagcagagaccagggcaccagttgcaatgcctcctatcaacgcatttttccagtcacggtcaccacggaccctttccactccatactccatgcctacatacaccccagcaacagcacctgcagattagtcaaaaaaacatctaaatctgtcagcggaaactagaagaatggatgaatgatttatgttagtaacacatttgttgagccaaataagacaatagagaaatgttcttctacttagttaccccaatatgcaccctccttgcacattttcttcagctgcataaaaaaccagaatatcacatcagtggactacagatgatagatagttgcc

SEQ ID NO: 87 - DNA, 544 bp, Hordeum vulgare
  UNSURE (16),(32): n stands for any base
gtcccccggctgcagnaattcgcaccggggtntcaccccgggctccggccacagctagtagcaaagcagctggagtccccggactgcaaccggccagccatcgacggcccaaccttcctcatcaccgtcgtggtcgacaacgctttccgcgccaggagcgtcgtccaatggcacggcttctgtcaggggccgccgactggcacctcaccggcggacggcatcgacggcgtgacgtccacgtactactactatgtggctgatcgttcatgctctggccgagacagtgctaccatgttcagtgccggccaaggaggagaggccggacccatcgctgacggccacgcgtgctgccgacgagccaacacctccgccggacatggtatcgccagtgtgccgctgaaagacgagggacggatgaacggcggttgcccgtgctgcaaaccaaattgtcccgtgcattctatagggcaggggccatatgcgtgctctgaagcgcaactcatggccaacagtcatgtcattcacctcgatgaagaaggagcga

SEQ ID NO: 88 - DNA, 429 bp, Hordeum vulgare
  UNSURE (58),(64): n stands for any base
tcaattatacaactacagtaacgaattcatatgtactatattacaaggaaaatacacntcgagnaaaaacttacaaactcagcataaatgaagcaatcacaaaaaaagagcacaaatgaaacggcaacgcccaaaaaatatcaaagtaaataatactaacaccaagcagaggaaagctcgaagcctgtgagacacatgaatttgcttgacctccaaacttgacgttgaatgcaaggaacgggcgacggatcaccggaagataacacggttatcggccatgagttacaattcagggcacacttagacatcacggtccttgcccccacatatagcagcaacccacaaggccgttgcctccaatgtcgcggcggaccaccggaggagtttctcgatcgctccttcttcatcgaggtgaatgacatgactgtt

SEQ ID NO: 89 - DNA, 554 bp, Hordeum vulgare
  UNSURE (20): n stands for any base
gtacccccgggcctgcaggnaattcggcacgaggggttgacaattccctcagtcctgcacacacactgctccaaattctttgtgttgatcagaagggtctcctttatgacatgttgaggacactcaaggactgcaacattaaggtcacttatgggcgattctggtcagacaagaaaggttttcgagaggtggatctctttatcaagcaagcagatggcaagaaggttattgatcctgagaaacaggatgctctgcggtctcgcatgaggtccgaaatgctccatcctcttagggtgatgattgtgaaccgtggacctgatacagaactccttgttgccaaccctgttgaactatccgggaagggccggccacgggtgttctatgatgctactttggccctgaaagcgcttggaatctgcattttctctgcagaaatcgggagacaggcagcgtcggagcgccaatgggaggtctaccgattcctcctggatgacagcaaagaatttcccttgtcaaacagcctaactcataggaaccgtgttgttgatagagtg

SEQ ID NO: 90 - DNA, 527 bp, Hordeum vulgare
tgtagcaataagtacagcactccttttttgttattacaactttgtacacatactctgcataaacaaagtgccttcttttcatatataataacatgcatggtgacaaggaaacactaagccctacatcaggaaacaggcctaatagtctattggcaaagcagtaatcatacaggaaggcaggaagggggcaggcaggtgaggcgggcagatagcacattctacattaatctacggcaaactgatgtaggatctgcgtcagcatccagcaatcccttgacccaaacaaagcacaatgattgagcctccaaccaaacatgttttttgggtggcaagagaccaatgcgggacggcggtggtgcgccagccttcatttcttgattcccactcgccatttacaacactgcccacaggaagatatttttgaggcatccaagggacatggttttgtcatgtgtccttcgcttgtttgttgaccatatattctcactggaactgatatcctgcaaacattgacgaagcccttctgc

SEQ ID NO: 91 - DNA, 552 bp, Hordeum vulgare
gtctccccgggtctgcaggcaattcggcacgaggctcctcttctttcccctcaccctccttcccgtccacgccgcaacgcaaccgaggagagagaagcagatccaatccaaggcggactcgaacccaatccgatccgatccaaggcggagatgaagttcttctcggccttcgacccgtggccggtgttcttccgccgggagtggggccgcacctggcccttcctcgccggattcgccaccacgggggccatcatcaccaagatcaccgccggattcaccgaggaggacctcaagaactccaagttcgtccaggcgcacaagggctccaagtgaccgcccccgccccgcccccgccgccaggtcacatgggcagcagctgagttaccggcatgtctccttgatgcggcgagccagtcctcaccctcagtattctgattgaattttctcttttcttgttcaaatccaactgcgtgcatttttgctgctctggtttgtaatgtaataagcgacatttgaatcgtcgaatccaagagaaaaacggcttcggataaa

SEQ ID NO: 92 - DNA, 526 bp, Hordeum vulgare
aaagcacagaaggtgcagaaccgaaacagagagtctttactgtgcattgacagagaaacccatagcagcatactttatccgaagccgtttttctcttggattcgacgattcaaatgtcgcttattacattacaaaccagagcagcaaaaatgcacgcagttggatttgaacaagaaaagagaaaattcaatcagaatactgagggtgaggactggctcgccgcatcaaggagacatgccggtaactcagctgctgcccatgtgacctggcggcgggggcggggcgggggcggtcacttggagcccttgtgcgcctggacgaacttggagttcttgaggtcctcctcggtgaatccggcggtgatcttggtgatgatggcccccgtggtggcgaatccggcgaggaagggccaggtgcggccccactcccggcggaagaacaccggccacgggtcgaaggccgagaagaacttcatctccgccttggatcggatcggattgggttcgagtccgccttggattggatc

SEQ ID NO: 93 - DNA, 498 bp, Hordeum vulgare
  UNSURE (11): n stands for any base
gtcctcccggngctgcagggaattcggcacgaggaggagacgaaggccatggcgggtccggccatggcagagggaggagccgtgctggagggcttctccccttcacgcgacggatggcgtcgccatgcggggtaccggctgttggccgatgccgccgctccacgaggagcctggtcgagggctgtcggcgtagccgcgccgtggtaatgcagccggaggccgtcggctcctggcgcctcaccccgtcattggaggatggagaccagccggaacgaccaaggttggtgattctcccatctacagcgagggcgaagcagccatgctccaagccaacctatcccggtagaatcaatggtgtgcaggaagcaatgaaaagaaaattaggtaatactagtagcacacgtgatgtcttgcatagcaattgaattaagactctgaatctgcttgagtgtcttcttatgcgctaatcaaattctttttttttaaaaaaaaaaaaaa

SEQ ID NO: 94 - DNA, 446 bp, Hordeum vulgare
aaaagaatttggattagcgcataagaagacactcaagcagattcagagtcttaattcaattgctatgcaagacatcacgtgtgctactagtattacctaattttcttttcattgcttcctgcacaccattgattctaccgggataggttggcttggagcatggctgcttcgccctcgctgtagatgggagaatcaccaaccttggtcgttccggctggtctccatcctccaatgacggggtgaggcgccaggagccgacggcctccggctgcattaccacggcgcggctacgccgacagccctcgaccaggctcctcgtggagcggcggcatcggccaacagccggtaccccgcatggcgacgccatccgtcgcgtgaaggggagaagccctccagcacggctcctccctctgccatggccggacccgccatggccttcgtctcct

SEQ ID NO: 95 - DNA, 539 bp, Hordeum vulgare
ggctgcaggattcggcacgaggccccacccccagcagccgccgccgcaacagagagcagagcaggaagcaaggaggagctctagaggcagggaaggcatcgaatccgtcacttcctccttcgcgcggtcgcctccgacatggcaaacgctgcgtcaggcatggctgtggacgacgaatgcaagctcaagttcctggagctgaaggcgaagcgaacccaccgcttcatcatctacaagatagatgacaagaagaagatggttgtggtggagaaggtcggcgagcctgccctgaactatgaggacttcgccgccagcctccccaccaatgaatgcagatacgcgatattcgactatgactttgtcactgaggagaactgccagaagagcaagatattcttcgttgcatggtctcctgacaccgcacgcgtgaggagcaagatgatctacgcgagctccaaggagaggttcaagagggagctcgatggcatccaagtagagctgcaggcgacagacccgaccgaggtcggctttgatgtcat

SEQ ID NO: 96 - DNA, 530 bp, Hordeum vulgare
acaccgaaggatcatttgtcgtcgcgccagtcatagcttacatcttccttaggtggtacattactggcaactcaaatcacaattgcctcatggtaaacagctcatgaccagcctcggcgagagcgctaaatcctcatcggagtctcatacttaaggtaagcagcagcacagccatgccgctcagttggcgcggccttggatgacatcaaagccgacctcggtcgggtctgtcgcctgcagctctacttggatgccatcgagctccctcttgaacctctccttggagctcgcgtagatcatcttgctcctcacgcgtgcggtgtcaggagaccatgcaacgaagaatatcttgctcttctggcagttctcctcagtgacaaagtcatagtcgaatatcgcgtatctgcattcattggtggggaggctggcggcgaagtcctcatagttcagggcaggctcgccgaccttctccaccacaaccatcttcttcttgtcatctatcttgtagatgatgaagcggtgggttcgct

SEQ ID NO: 97 - DNA, 544 bp, Hordeum vulgare
  UNSURE (32),(39): n stands for any base
gtcccccggctgcaggattcggcacgggtggncgccggnactcttctccctcctctcagcagggatcgcctccgtgatcccctcggtcaaattcgagcagcagccccttcccttccctagtgactaccccaaatgcgacccccgagtccccaggaagccgccgagccgccaaactcctccgagggatgaccggagcatcagcgcaggcaacgtccgacgcgccaccgctgtgaaggacgtcgccgtcgtcctggccatcgtcaggctccgtaaacccccgggatgggtgcgactggctcccctgagcacgccagtaggctgggcatcgccggaggtggctcgagtcaccggaacgaccggcggcaccaggggcgctcctctgctctgcttgcaacggcgggatgtggaagaaggagagaaaggagagagagagggacccgacaggtgggccccgaccccaccagtcggtgagagaggcaatagcgagctggttaagtggaaacggcccggctaggactacactttccctaagggaaaacgtact

SEQ ID NO: 98 - DNA, 545 bp, Hordeum vulgare
  UNSURE (2),(7),(23): n stands for any base
tnaccanagggttacgggctcgncgaggcgaaccgagggctttggaatcacctcaatcggagtcccgagcaaaaagaacaagcctttttctgtcacggacccatttggaaaaataatatttccacagtggcccctggcagctcagcgagacgtgctcttttgaagagtacgttttcccttagggaaagtgtagtcctagccgggccgtttccacttaaccagctcgctattgcctctctcaccgactggtggggtcggggcccacctgtcgggtccctctctctctcctttctctccttcttccacatcccgccgttgcaagcagagcagaggagcgcccctggtgccgccggtcgttccggtgactcgagccacctccggcgatgcccagcctactggcgtgctcaggggagccagtcgcacccatcccgggggtttacggagcctgacgatggccaggacgacggcgacgtccttcacagcggtggcgcgtcggacgttgcctgcgctgatgctccggtcatccctcggaggagtttggcggc

SEQ ID NO: 99 - DNA, 335 bp, Hordeum vulgare
cctcgtgccgaattcggcacgagggctccgagaacaccacccgttgtgccagtagtgatggcagtagtaaggcctcgtctgtagcttgggcgcatggtcgatctgggtttggaataatgcgagcgagcctctgctgtgtgctctgcctgtcgcaagcgcgcacttgctgcgtggactgtctgccccctgcctggcttgtgtgtgtgattgtggtgtgtgtgttctggtggtgcagtcaagggtgtgcatgtgttgtggtgtgaaccttttatcgtatgatggatggataaataatggagctgaataaaattcaaaaaaaaaaaaaaaaaaaaact

SEQ ID NO: 100 - DNA, 306 bp, Hordeum vulgare
ttattacgctccattatttatcactcctcatacgataaaaggttcacaccacaacacatgcacacccttgactgcaccaccagaacacacacaccacaatcacacacacaagccaggcagggggcagacagtccacgcagcaagtgcgcgcttgcgacaggcagagcacacagcagaggctcgctcgcattattccaaacccagatcgaccatgcgcccaagctacagacgaggccttactactgccatcactactggcacaacgggtggtgttctcggagccctcgtgccgaattcggcacgagg

SEQ ID NO: 101 - DNA, 221 bp, Hordeum vulgare
ttttttttttttttttttttttttttttttcttttttttagcaggggtctataggaaaagtggctaaaaaaatgagaaacaacacatggcagtccagcatcatcacttacaaggcaaatcagattctcatgatatgtcacagcttcagccacgacagcaggacatcacaccgaggttacagtacagggctagagcaatgaaggtactcccttggtaaacta

SEQ ID NO: 102 - DNA, 397 bp, Hordeum vulgare
acgttcctgaaccgacgcatccacgaacccacgtcgtcgtgtcaatacaagaagagtcaaaaacaaaacacaaatctcctttttttttccccctctgcccgccgctcacccgcaacctccccgtcgccgccgatctaccggagcctccgcacctacgctcgtcgcgccgctgatatcctcgtcctcgtcctcgtcctcctcgccggagacaacatgtcgacgcttgccgcggcgagggccgacaacttctactacccgcccgaatggagcccgaagaagggtgggctgaacaagttccacggccagcatgccctcagggagcgggcgaggaagctggaccagggcatcctgattataagatttgagatgcctttcaatgtctggtgtggtggatgta

SEQ ID NO: 103 - DNA, 517 bp, Hordeum vulgare
gctcggcttcgtctacgtcctgcagatcgtttgcatcgtgcttgtggcgttatgggggtgcttctcggcgtcctcatgttcatgttgaggcatcacttgatagtgctcgtcgtggcgtcgactccactcctcgctgcggccatcatcttcaccgtttacttctctttcctttgctccttgagcatcgtcgtggcggtggccgagcccggccgccacggcgcggcggcgttaggcgaagcgtggaggttggccaaggggaagaggaggcagatcgtgccgtacctcgccgctaccggtgccctggccgccgtcttatcgccggtgcacacgctcgcaagggcatgcgcgggtgataacaaggtggcgcttgggctgctcctgggtcttgtgtacgcggctctcatggcactggtgcaattgttcgccgtctgcgccatgacagccttctactatgagtgcaaagagaacagcgacaaccagctgcgggcggctactggatacgccaagttgtcatcgg

SEQ ID NO: 104 - DNA, 554 bp, Hordeum vulgare
ttcgtatgtagtatcttaatgaaacctttaaaaagagttatagtagaacaatctggcttgccccacaagtcgcagttaattacatggcaaccaatcggagaatgatcaagccgcggttgcttcttccgatgacaacttggcgtatccagtagccgcccgcagctggttgtcgctgttctctttgcactcatagtagaaggctgtcatggcgcagacggcgaacaattgcaccagtgccatgagagccgcgtacacaagacccaggagcagcccaagcgccaccttgttatcacccgcgcatgcccttgcgagcgtgtgcaccggcgataagacggcggccagggcaccggtagcggcgaggtacggcacgatctgcctcctcttccccttggccaacctccacgcttcgcctaacgccgccgcgccgtggcggccgggctcggccaccgccacgacgatgctcaaggagcaaaggaaagagaagtaaacggtgaagatgatggccgcagcgaggagtggagtcgacgccacgacgagcactatcaagtgatgcc

SEQ ID NO: 105 - DNA, 521 bp, Hordeum vulgare
gcccgtgtcagtggttgtgcaccacctcaaaaaaattccttgggcagatttacatccctgacatcaattgggtacttatgattctttgcattgctgtgactgctggatttaagaaccaaatccagatcggaaatgcatacggcacagcagttgtgatagttatgcttgtaacgacgttcctcatggtcccaataatgctgctagtatggaagagccactggatccttgttgtcacttttcttgtgctctcattgatggtggagtttccatatttcatagcctgcatcaataaggtggatgaaggtggttgggtcccacttgccgttgcaatcaccttctttatcatcatgtacgtgtggcatttctgcaccgtgaagcgctatgaatttgagatgcacagcaaggtttccatggcctggattctaggactcgggccgagcctcggtcttgttagggttcctgggatcggcttcgtatataccgagttggcaagtggtgttccacatatcttctcccatttc

SEQ ID NO: 106 - DNA, 553 bp, Hordeum vulgare
gcatgaacgaggctcgctcgataactggatcatttacaacgttcacgctgccctacacaagtacacagtactgctcactctgaatcagaaccaaaagaacagaagaagaaaaaaaatagttcatatatagtagatctggcctacgttgagaaggctttcatgaggaacattgaatatcacgctgtgttctctacagaccttcctgaggaaggcatacaggtgatccacaacaatcctcttgatgatccctgaatccctgcgggcacggacaatggtgttgccgaggatgtgcacgacacccgcgtccttgcagctgttgaggaactccagttcgtcgccgaatgtttggctggaataccttgttaggctgttgttccctgttggcgacttggccagcacaatggaggaatcatgtgatgagtagctcaggtcgcttccagccttttcgctcatcagcaacgcattggtggatctctggaccttttgctccgacatggtgaagtcctcagaatcagaatagccatccatcatgctctcaagtctcacaaagatc

SEQ ID NO: 107 - DNA, 535 bp, Hordeum vulgare
gacttcggcacgaggctccagcccggacgaccccgccgccgctccgtccgacctagggttctgcgccgccgcccggctcccgaggagatgcctcgttacgatgatcgttatggaaacgcacgcttgtatgttggtagattgtcctcccgtactcgttcgcgcgacctagaatatcttttcagcaaatatggaagaatacgggaagtggaattgaagcgcgactatgcattcattgaattcagtgattctcgtgatgctgatgaagcccggtacaatctagatggcagggatgttgatgggagccgcattattgttgagtttgctaaaggggttccacgtggttctggtggttcacgagagcgtgaatatgtggggagagggcctcctccaggaacaggccgttgtttcaactgtggtatagatggtcattgggccagggattgcaaggctggtgactggaagaacaaatgctaccgctgtggagaaagaggccatatagagagaaattgccagaatagcccgaggagtctcaggc

SEQ ID NO: 108 - DNA, 533 bp, Hordeum vulgare
atgctaaataatacagtactatcaatccaatccattacacacaacataacaagggagtagcaaatcccccccaaggcatcgagcaacaaaataccaggtttaggaaacagataggaaattcactgcaaaacatcttaaaactttaaatatgtcacagccacatgtagcgaccagaaactggaaaatggttccatgtttcagggagacgcgcttcttcctctgggtgagccagagccgcgaaggccatcaccgtcaccattgcctcttggacttgggctgccaccattaccattgcccttaggactagggctaccgttgttgcccctcgggcttggactgcccttgttgtccctggcaggactgggactgccattgttagcagggcttctagggctgcgcccattggccacagggctacggtagccatcagaagggctcctgcttgtcctcctgccccgagggctgtcaccattatcctttgctacaggggagatggatcgcctggggctccgactgcgatcaggtgtggggct

SEQ ID NO: 109 - DNA, 479 bp, Hordeum vulgare
caaatcggctcggcttctccttctccgacctcgcggaatcgctcgtcttcccgtcctccagttaggtccctcaagagcaatgggaggaggcaacgacggccatgggtacccgcccggtggccaggggggataccctccggcagggtacccgccgcagcagggaggttaccctccacagcaaggttacccgcctgcacctggagcttacccacctccacctggggcttaccctcccgcacctggggcgtaccctcctgctcctggagcaggtggcagtgatggggagaaggggctcctctccaacatcatgcacggcgttgccggtgctcatggtggtggtcatgggtacccatctggtggccacgggtaccccccgcagcagcatggataccctccgcaacaggggtaccctcctcagcatggataccctccccagcagcatggctaccctccacagcagcatggctacccccctgccg

SEQ ID NO: 110 - DNA, 556 bp, Hordeum vulgare
ggtgcacaatttatatatacgaggaaaggatgagagctcacgagaccgagcagcaaccacaccacaccctgctttagatacatctcaaaggctttccctgaccaaaccaagttctggaagcctacacgaagagtttaggttttttttgttgttgttgttgttgattcagctactagctagcgcattacttccacttcttgaacttgccgccgcccccgaacatgccgtgcttcccatgcttgccgtgcttgaacttgccatggccgtgcttcccgtgcttgaacttgccgccgtggtggccatacccaccgccgtagcctccatgtccgcccatcatgcctcccatcatgtgtccgcctccaccgtgcccgccgtgagagatcttgtgtgctccgtaagcggcggcagcagctgctgcgcctccagctagcatgccgcccatgccgatgcctcctccgtggctaccactgtgaccagatgagccagggtagccggcaggggggtagccatgctgctgtggagggtagccatgctgctggggagggtatccatgctg

SEQ ID NO: 111 - DNA, 396 bp, Hordeum vulgare
gagcgggacgcgacacgccgcggcacatgctgcaggcagacagagacagaggtccaccaaggtcgtcaatgtcggcagcagcagcagcagcggcaggcggcagcgcgccacgcccagcccttcccctcgctcaggcagtgtccctggcgctggcgctggcgctggcgctctcgccgtcaccggcgctggcggccgggttcagctgcggcccgggcgcccggcctgtggtgttcaacttcggcgactccaactccgacacgggcggcatggcgacggccaaggggtggcgcatcgcgccgccggagggccgcgccttcttccaccgccccaccggccgcttctgcgacggccgcctcatcatcgacttcctctgtgaaagcttaaacataagctatc

SEQ ID NO: 112 - DNA, 312 bp, Hordeum vulgare
tttttttttttttttttttttttacagatgtcacgtccacattaatctgctatcagccccaaaattaggagaaaaaacggatccttacagatttaagtaattcagtattttcaccaacatagtactgtatgaagcatgaagtttgatcaggtcttgcaaaactgatcaaacttgagctttggtctggaatatgaggagctcagtatcgccgcagccgcggcggcattggcggcctcggtgaggtgcacaccgtcccagctgacaaactttgagccatcagcgcagaccgtcgcattcggagactggcagctc

SEQ ID NO: 113 - DNA, 711 bp, Hordeum vulgare
  UNSURE (61),(102)..(104),(106)..(112),(115)..(119),(127),(130): n stands for any base
agtttttgtagtataagcgcgatttgggcccgaggaggggatgctatcggtcgttttggcncgcgggatcaaacaggtctaccacacatagttggttttttnnngnnnnnnntcnnnnntcgctccngcntctctttttcaccaccacacagccaagccttaatatttgcgtcgcccggttatccgttgtccggacctgtaacgggggtgattgaggcggtggggttgtggaggtggcgggaggcggtatttatgttcagcgatggggtggacccttgttctcgtgccggtggtgcgagagggcgcacgatcgggtggggggcgacggcattgatgtgggggctgggtaaagagggggattgggcccccagatgggggtaatgtgtggtgtagccacataagggctctgtgcgtgaggtcccgtgcgcgggtggctccttttttggccatagggtgcggtgtactctgtctgaagtttgtctttgggggagcctggggtgggtcgctggggtgcaactgagtatggtggcggcgtgaaaagacgggggagtctgcaccacggtgcgcgcggatgtgtgggggtggcctctaacgtgccgggcgctcagtagggggcggagcaaggaaatacgaagggtgcgtcggggcataggggggggcttcacttcaggtgagaggtggaatagtgccgtgtatgcgtattggctgctg

SEQ ID NO: 114 - DNA, 366 bp, Hordeum vulgare
cttcagtcagcgctgagaggaagaagaagaggaagatgagctccggttgggttggtagagcttccctcgttcttctactgctcatcgtcgtttcggtttgcgccgcaggaggcaccaggggtctggccgaagaaaagtttcagaaggagcatcacaacgctgcggccaaagaaggaacaacagctccaggcagccatccgaggaacctcatggtgaagacgaacgactacggccgctacgacccgactccagcgttctccaggcctcacttcaagcctataccccactgatctgctctgctcctgcacagtcacatatatatatggttaaactaattaaaaatatatatacgtatgtaactagatc

SEQ ID NO: 115 - DNA, 542 bp, Hordeum vulgare
  UNSURE (4): n stands for any base
gggnctgcagggaattcggcacgagggtccagcggcggcggcgataccctcctctcctctcctccgacgtccagcggccggtcaaggaagctgaattgaagttgctcgatggaggacctaccggaggctctgatgacagagattctcaagaggatcgccacgacaagtgatctgaactctctttccctcgtgtcgaagcagctctaccagatagaggggaatcaaaggggtgctatccgtgttggttccggcctttgcaccgctacaaaagcactgacatcattgtgcgcccggttcccaaatctgcggaaagtggaaatcgactactctggttggatacctggacatggaaagcagctggacaacaaaggactttctgtgctttcatctcactgttcctcgctgattgacctcaccttaagcttctgctcacgcatcgatgactctgggcttgcttgtttagcttattgcaagaaattggtgtctctcaggctgaactccacaccacaaataacttcaattggacttttctcggttgcagt

SEQ ID NO: 116 - DNA, 550 bp, Hordeum vulgare
ggtaaagcgcttaaatatcagatagaccaacggtctacagtgcctccatagcaaaaaacagggaatattggggccaactaatgccggtctcgaaacatctaccaggcttacagttgacagtaatccacaagtagtgcctactattaaagtttcattcactagaggccatccaaagatcatcattagagcatcataaaggaaagtcattgcagtaaagctagaaggcaacaaaaatttcagagaggtgaatctgggtcggatgatggcacagccttgttcaatgatgcacactgaacaacctaatggcttcagcagcaaattcatagtgaaaattttggtgaccacttcatcaatatacgccaagaccaattctcttcctaacggcatctaaatagttgctggagtagtgaactgacttggcaacaccctgcgcagcttgcatagagaccccaccacaatagtcaatgaccaaagagtctaacttatgtgcacgcctcagttcagccactccaacatcagtaatgtaatgacacaactgaagtgtgagatt

SEQ ID NO: 117 - DNA, 1792 bp, Hordeum vulgare
  UNSURE (12)..(14),(19),(30),(31),(55),(269),(372),(1035),(1158),(1160),(1216),(1235),(1240),(1242),(1245),(1250),(1310),(1393),(1418),(1462),(1530),(1532),(1596),(1627),(1635),(1701),(1716),(1784),(1788): n stands for any base
tatttatttttnnntattnttttttattannaaacattcattttatactcttccngcccaggcgtgtgttttgattatttctaaggacgtagggttcaagctctcgccacaggtattccaattatcatataccatcatccagacacactcgaccgccagttccgtagaagctgacagtcattctatcactcatactgtagtgtattgatatatattttgtatatggtcttatgattgttttggtgttttgagtggattgtacgtcttanaaggtgattgtctagagaataggttcaatgagttgttgtgctgcgcgtaaataaatggattgtaggattgagaaagttccgtagacttgttagtagatgattngagcagtaaccaattattttttattggatatacgaatatagtagccttaaatatcaattaattatattgatatagacctcatgctacatttaccacgcgccaacatcaaatcccttacgagtcccgcgatccgacgccgctcaaatactaactcttattgcaccctaagcatagtacgctaatctacgttattcacccaaatacgccatcaagttcgagaatcagagataatacgcacaaccatctccacgcctgtagtcatcaagacgacacgcctatcgtaacgactactcagccccacgcaagcgaggatagctcatcctctagctcactattacctattctcctcagtccaccaccgcaccagtatatctccacgtgcctatactcttattttaatccttctccgtatagaccacaccctccatagaccgtgtcttatcgacccacatcgcacaagaactcacatactagcgctttactacttcatcactccactagtccatcactcctagagagttccgcagagcttcacgaacgcaatatcacactcaacacgaacgcctacgctcagcctcaccgcagagccatcgcacatatctgtttcagctccaggttttacacacttcacgactcttacgttcaacgtcctaacccataagntaactccgagcacgctcatgcgctgccactccacacactactttcaatgatccgagtcatgctgttagccacctatttaccacacgctcgcagcagcactccaggtcacgtcaactccgcatncntcgcgcacactcctgtatacgacagcagccgtctcataacagcatatacaccaccntccgcgcgacgtccgacanctccngnccncgcanactcgcacacgtcgcctctctcaacacgcacgctgtcattagtgacgtccacaccctctntacataccactactacgctcactcaccattactctctctctagctcaatagactctgatgtccacgtcacgttacccatcatnactactagcagtacgcgttactgtntctgatgagcattctactgagtcatcatcattccgtacatagantagatgcccatacaccctctacacgctgtacgctgactgcaactacatcacacaccgcgcatcgcgcncntccagagtacgccttcagagcacaagataataccagtaacagagagtatagcacacattatatnctctgagctcaatccatgactaagtagtccncagtcccncctcattacatagagcgactcgatttatcccctagcaccatatcaccctcagcacttcacgagttntccaagacagccctnacatcgctcaatagtcactacactgagctagcatatatcacacgccgattgtagacacagagcaagantaantaat

SEQ ID NO: 118 - DNA, 532 bp, Hordeum vulgare
taaggacggcgccgccatccaatccagctactagatctaaggctttcgctcacagaatgaacaaagtaggcgtgaaaccaacgccacacacaacggcacctccagtgaggtatccgacgccaaataacgccgttgccgaccgaggtcaacacagggctttcacccataggcatcacacgcgcctccccgctgctgagccatgccgctgctgaggccggagctaccgccatcggccacccatctccaccaccgccacatcgaaccccgtcggcagcatccaccgccaacccttcagccgtggccacggaagaccgccgcccaagtaagctgctgcccctcgaagaccggatctagacgccaggatgcctcacagaccaagcacaatagcccacgttctccacctcgccgaccgtgccaccacgccgcaccgcatcttcaccccaccatcatcctccaaacgtgagcaccggggcaccggcgaagcgagttagccgctgggcatggagctcccctagatccaggcaaaggggag

SEQ ID NO: 119 - DNA, 1005 bp, Hordeum vulgare
  UNSURE (1),(34),(55),(78),(111),(124),(127),(129),(130),(141),(283),(286),(289),(326),(342)..(344),(346),(348),(349),(352)..(355),(358),(359),(361)..(382),(403)..(785),(787)..(915),(917)..(959),(961)..(983),(985)..(991),(994)..(996),(999),(1000): n stands for any base
ntttgcacttgaacctagttttcaaattgtgggngcaataatggcttgctaacanagtcgcaaaagcccaaattagtncctgcttcggttggagagataccccaagacctnatcatggaaccgnggnannagagaaggagnagattttatgtcagggggggtgccatccaaaaaaaaagctaagggagcatctctttatgttgcgtgacagtggtgccacacgccatttgttttttgtatccgctgttttcgactcttgggggctcgggtttttttttttttngcncangccaaacaaaccgacaaaaagggggaaaggagggganaccccccaaccaccannnanannaannnnaannannnnnnnnnnnnnnnnnnnnnnaaaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnncnnnnnnnnnnnnnnnnnnnnnnncnnnnnnncannnaannaaaaa

SEQ ID NO: 120 - DNA, 542 bp, Hordeum vulgare
cagtaagtggaggacaaaaaggaatactgggattagatagaatgtagcgacattctgcggggtggggtggtataagtagatatacagaacggaggaccgtctcctggtcctcagctttgggtcttctctaccttggccttgatcttctgctcgaggaccgccttctccgtgtcgaggttgaacatcctgttgagggcgtgcatgttgtcgagcgtctcgtccagggtgcggctgtcgctgccatcgcatctcaggtgctgcaacgggccgtggaggagcttgttcactatgcccgtgctcagctcttcgatagaccttctcgtcttcttgttgaggttgtcttccccgatcttctgcaggcacttgtcgagctcggatgccctgatcctgtcggcatacgacctcagctttttgatggtcgggaccgtctccagcgagtccctccacgcctcgaaccgcttcagttcttgggtgatgattgcttgggcctccattgctttcctgacacggtcttccttgttggcttccaccacctctttcaa

SEQ ID NO: 121 - DNA, 540 bp, Hordeum vulgare
  UNSURE (3): n stands for any base
ggnctgcaggaattcggctcgaggggtcgatgccccccctgagatggtcgcaatccctcatcggtaccccgttctgaccgagcatccaccaatctggcatggccaatcatatcccctcttcttaaataatgaggatgcagccagagatcatagcaggaggccagaggtggccacagggggtgttccaacctgggcatggagggtgagccaccctcctccaacacaacccatgccactcttctcgtcgtcatcgtccgctgcagcatcatcaggattctccaaaacagccgcggcagctgcccccgccgccccatcggcctcattccggttcgacccgatggctccatcatcgtcgtcaagcaaccaacaccaccaccaccacccccgctgaaaaagaagccatactgtaaatgttctgggaagccagtatcttttttgctcctccggcgtttcagcgttttcggtcttgcgccggggcggtttcatgtagtggattggattcatgactgtatttcccatgctgcccaagtgaaatgtccc

SEQ ID NO: 122 - DNA, 553 bp, Hordeum vulgare
gttcggtactgctgaatttacgtgacaagtttgtctacacaatggtatgaatccatctcagatggtgagatgagctgaggttagtatctgacagcgagaattatgggaccattgcgccgatgcagagagcgcaaaaaagaagggacatttcacttgggcagcatgggaaatacagtcatgaatccaatccactacatgaaaccgccccggcgcaagaccgaaaacgctgaaacgccggaggagcaaaaaagatactggcttcccagaacatttacagtatggcttctttttcagcgggggtggtggtggtggtgttggttgcttgacgacgatgatggagccatcgggtcgaaccggaatgaggccgatggggcggcgggggcagctgccgcggctgttttggagaatcctgatgatgctgcagcggacgatgacgacgagaagagtggcatgggttgtgttggaggagggtggctcaccctccatgcccaggttggaacaccccctgtggccacctctggcctcctgctatgatctctggctgcatcctcat

SEQ ID NO: 123 - DNA, 1336 bp, Hordeum vulgare
  UNSURE (7),(12),(20),(22),(31),(34),(36),(38),(53),(55),(59),(71),(83),(115),(215),(222),(229),(278),(284),(504),(518),(533),(541),(557),(569),(576),(589),(621),(652),(668),(683),(714),(754),(777),(811),(897),(942),(964),(1000),(1038),(1078),(1096),(1137),(1152),(1182),(1185),(1192),(1194),(1196),(1246),(1280),(1296),(1305),(1315),(1317): n stands for any base
cttagancatgncatccagngncagatagtntgngngnctctctgtacaggtncngcantaggcgttcacncgcgtctcgtcnctatgtgacgccgcaggagaaatatatagcgnacgatcggcttaatccaatctgtccaacaagctatcatctctgttctgtatctgtattctatattctcatatgttgtcgatgtaacagcagctgcctcgncgcattnctcattncttattttctactacaacacgcgatatcgccacaacattaatcactgtngtcgantgctatactcacctagcactacgaccgcacatgtgtgtattcatgtatgacaactgactacaatgagtgtcatgatactcacgttgtattcatagatacgtcaggtgtgcggtgtgtggacgctccatacatgcacacaaatcaaatcatatacctctatccacgttaactttagcctagaaccaataattctagaactcgctgcgagtgtgtccaatanataaccatacagcntcgcgatcatacgcntaggattncgcacacatactcccncatcgtatcatntgcacgntatgcgctgcgcnctcaccacatagcgctagactgagagtgcagnatactactggtccctatagatgctgcatttngcatcaccagctgcancacactagcgctccnctacagctactcatcttcctatctccgtctncgtatcttcgtgaaagcgtgtcgagtagtatcttacacgnggcatatctctacgacacgcgantctcactcgcagaacgactaattatgaccatgtnagccgctatggacctcatatacacagagatgattcgaatcacgctacagcacagacagctacctatatactcagtagtgtgtctcncagtatcagacgtaagtgcataacgctaacgtatatttactcatnagagtctgcacatctgctctcntatacactcgcgccctactctgctcggctcactcgncatgcgatctacgtccatgcgacattctcgtcactacntctgctcactcatgaacatccaatactacatatcgctagnagtcgtacatgtagttantaagcactaagagacgtatgaccgtaacgtaaggtctctanagcgtgatcgatatncagcatacatacttcacatactgtgtatantantctcgantntncgatcgaccatcgtcactactagcgtctatacatactcgcacgctgactnattctaatcacactcgtctctatgaatctacaantatatcagtacacacnactgtcacngattactccncnaactgactctcacagctcg

SEQ ID NO: 124 - DNA, 391 bp, Hordeum vulgare
gggacgcacggagcacggaggagatcgtcagttcgtcgtcgtccatccagatcggctcggcttctccttctccgacctcgcggagtcgctcgtcttcccgtcctccagttaggtccctcgagagcaatgggaggaggcaacgacggccatgggtacccgcccggtggccaggggggctaccctccggcagggtacccgccgcagcagggaggttaccctccacagcaaggttacccgcctgcacctggagcttacccacctccacctggggcttaccctcccgcacctggggcgtaccctcctgcacctggagcaggtggcagtgatggggagaaggggctcctctccacatcatgcacggcgttgccggtgctcatggtggtggtcatgg

SEQ ID NO: 125 - DNA, 373 bp, Hordeum vulgare
  UNSURE (16): n stands for any base
gtcccccggctgcagnaatcggcacgaggccgtctgaacccatcgaagagctgctgttcttagtacctgcacagaatggaatatatgtggtggctttatcatggaaccgtggtattagagaagtagtagactggatgtcaaagaaaagtggaatccctgcttccgagctaagggagcatctctttatgttgcgtgacagtggtgccacacgccatctgtttgaggtatccgctgggctcgactctttggttcttggggaaggacaaatccttgctcaggttaaacaagttgttagaaatgggcaaaatagtggaggcctgggaaagaacattgataggatgttcaaggatgcaatcacggctggaaagcgcgt

SEQ ID NO: 126 - DNA, 517 bp, Hordeum vulgare
gggcaaaaggaaactgggattagatagaatgtagcgacattctggggggtggggtggtataagtagatatacagaacggaggaccgtctcctggtcctcagctttgggtcttctcaaccttggccttgatcttctgctcgaggaccgccttctccgtgtcgaggttgaacatcctgttgagggcgtgcatgttgtcgagcgtctcgtccagggtgcggctgtcgctgccgtcgcatctcaggtgctgcaacgggccgtggaggagcttgttcactatgcccgtgctcagctcttcgatagaccttctcgtcttcttgttgaggttgtcttccccgatcttctgcaggcacttgtcgagctcggatgccctgatcctgtcggcgtacgacctcagctttttgatggtcgggaccgtctccagcgagtccctccacgcctcgaaccgcttcagttcttgggtgatgattgcttgggcctccattgctttcctgacacggtcttccttgttggcttccac

SEQ ID NO: 127 - DNA, 545 bp, Hordeum vulgare
  UNSURE (83): n stands for any base
gttccccggctgcaggaatcggcacggggttcctgcaacccgtcatcttcaacacgtacgaggccagggtggacccgctcaanaacgcgcacctctccgacatctgcatcagcacctccgccgcgcccacctacttccccgcgcactacttcaccacccacgaccccgccgggaacctctccgaccgcgagtaccacctcatcgacggcggcgtggccgccaacaaccccaccatggccgccatgtccatgatcaccaaggaggtgctgcgccgcaaccccgacttcacgcacggcaagcccgccgattacaacaactacctcatcatctccatcggcaccgggtccgccaagcaggccgagaagtacaccgcgcccgagtgcgccaagtggggcgtcctccgctggctctacgacggcggcttcaccccgctcatcgacgtcttctcccatgctagcgccgacatggtcgacatccacgccgccgtcctatttgaggccctccgcattgaggagaactacctgcgcattcaggacgactcgctc

SEQ ID NO: 128 - DNA, 533 bp, Hordeum vulgare
  UNSURE (10),(501): n stands for any base
tttaccatgnaaaaaaacatacatttttatttccgtttatccgcgaaagcataactaaaacaatcataaatcataattattaaagtaacgaatcctttacgcatctggttgcatccctaagcattgtaggtagtgcttcttcgtctctcttctcttctctacttggagttgaggttggtttggcgcagcttgcgctcctcggagagcctcttggcgaagcggacgagcgcctcttcattggtgccagcaccgtcgacggtctcatacatcccattgtcaatgtttacccgggatacggtcttggtgagcagattcttaccgatcccaataagcgcctccatgttctctttggtggcgatatccaccgaggacgtttgccccgtgagcgagtcgtcctggatgcgcaggtagttctcctcaatgcggagggcctcaaataggacggcggcgtggatgtcgaccatgtcggcgctagcatgggagaagacgtcgatgagcggngtgaagccgccgtcgtagagccagcggaggac

SEQ ID NO: 129 - DNA, 378 bp, Hordeum vulgare
gggtcatgtcctacaacgccatggtcgccgggtactgcgtcacggggcagctcgacaacgcccgccggctcgtggcggccatgcccatggagccggacacctacacctacaacaccctcatccgcggcctgtgcgggcgcggcaggaccgacaacgccctcgcggtgctcgacgatatgctccgccgagggtgcgtgcccgacgtggtcacctacaccatcctgctcgaggccacctgcaagaggagcgggtacaagcaggccgtgaagctgctcgacgagatgcgcgacaaggggtgcgccccggacatcgtcacctacaacgtcgtcgtcaacggcatttgccaggaagggcgggtcgacgacgccatggagttct

SEQ ID NO: 130 - DNA, 353 bp, Hordeum vulgare
ttcataagagcgccgcatcgaataagacatcattaagaacaatgaagtatctctacgtactgccgaagatgcacaggaacatatttctggatccacacactcctactggtctggttaaccttttgaagtatgcatagttccatcaagtaaccgaatggctcccttatttaccaaagtcttactcaccactcctctcgagcacaactcagccatcatttcccgcgcctccttgaccaggccttcataagccaagccttcgatcaatatagtgtaggtcgattcatttggcatgcagccattcgacaccatgtaagtaaagagatcgatagcactatgtgtctcgcgccttttgc

SEQ ID NO: 131 - DNA, 474 bp, Hordeum vulgare
gttacgaagcaaggccttctccaactccagcagcatgaaacgaaaagtgagcaaggcaaaaacgatgagtaaaagtgagcctgaactgaaaacttattctgcgaccgggagtaaaggaaacccacatgtgcagccagcggcatcttcttctgaagctaaagctaaagcatcaagtactgccgcactgccgacgcctgcaccaagcaggaaacatgcaaagccagccaacccaggcagcattgctacaaagccatgaattccggattcacatatacaatttaaacctcttgtgtgaattgatgaagaagaagaatgatctggacatcatttcgtgtgctttgtctatgatataatacatataccgaagaccctaatagtatgtaagaggttaataaagaggtggaaaagaaatatggatcgatatattgcatgtttgtagtttgtacgtccttgatgaatttcgtcgctgtccta

SEQ ID NO: 132 - DNA, 553 bp, Hordeum vulgare
taatgtcattcaaatttattaataccgttgtgaattaatacaataccaatacatgaacttaggacagcgacgaaattcatcaaggacgtacaaactacaaacatgcaatatatcgatccatatttcttttccacctctttattaacctcttacatactattagggtcttcggtatatgtattatatcatagacaaagcacacgaaatgatgtccagatcattcttcttcttcatcaattcacacaagaggtttaaattgtatatgtgaatccggaattcatggctttgtagcaatgctgcctgggttggctggctttgcatgtttcctgcttggtgcaggcgtcggcagtgcggcagtacttgatgctttagctttagcttcagaagaagatgccgctggctgcacatgtgggtttcctttactcccggtcgcagaataagttttcagttcaggctcacttttactcatcgtttttgccttgctcacttttcgctccatgctgtttggagttggagaggccttgcttcgtaactgggcgtcttcagcaagcct

SEQ ID NO: 133 - DNA, 517 bp, Hordeum vulgare
cgtcaccgccgacgacctccgccaggccgtctccaaggtgggcaatttctccgaggacaaccgatccgggatcaaccactcgttgcaccggatcagcgccatccggaaccgcaaggctcacataattggcctcacttgccgtgtcggacgggctatatcgggcagcgcggagatgatccgtgatctggtggtgggaggcggctccatattggtgattggaccccctggagtagggaagaccactctgatcagggaaatagctagaatcctggcagatgagggtaacaaacgtgtgatcatagtggacacatctaatgaaataggaggtgatggggatgtacctcactccggcattgggcgctctaggagaatgcaagttcctaaagttacgatgcagcataacgtgatgattgaggctgttgaaaatcacatgccggaagttattgtgatcgatgagattggtacagaacttgaagcaatggcagccagcaccattgctcaaagaggcgttcaactt

SEQ ID NO: 134 - DNA, 552 bp, Hordeum vulgare
ttcttggacattaaaacacttatttacactactggtgcacagcgctgtacaacaacaagaagatgaaggagaagaagagggagaagaatggtgttttacatttcggcaacggtgatcagagagtcaaactaaggtgtcacttcggcagaaatggcagacgggagaagctgaagcccccgccgttctcgccgacgatcaggtccgagccgttcttcttggtggacgtctgcccctgagcgccctggcctgaggtcttctttgctattttcactggaagaatctgcagccttgaattggggtcggttccgaaggtctcggcaaggagctggtagctctcaacgagctccagctgacgagcaacaatttctgaacaccttgggaggagttcgacgggctccccgcccgggattacaatgtattcaattgccagccgggcctcctccaatgcatcaatttcctccaatgatggcttccgtttcggagcatcatcttcaatctctatctctccttccaaaactttaggttgcttgcgtgatggtgcattaagcttat

SEQ ID NO: 135 - DNA, 516 bp, Hordeum vulgare
caggggcaagatcctcatatcgaccaaacctcccaaagagtaccttgaaaccaagaccagcaaggaggaggcccaaaatggtagcacagaggaggagagcgtgtggggggatgagatccccgacagcaaggctcaggtttcagagaaggacaccgagcagtatgtggaagaggatgaagagatggagatgcagggacaattgggggtcaatgaggagtataaaagtctcatctcaatccccctcacccgaagaaagcatgacatggatcaggatctcaaggttgatcccgagaaagtgtctcggatgagcttgggggaggcggcatacgagaaggccacaattacacatggatctgaaattataaagtttacacagaggaacttgctacggattttcccaaagacaacgcgcattacttcatccaattacaatccactgatgggatggacatatggagctcagatggttgcagcaaacatgcagggtcatggaaggaaactatggctgactcaagg

SEQ ID NO: 136 - DNA, 493 bp, Hordeum vulgare
caccctgtggcaaataatagtcgcagattgagttctaatcatatcatatacagcaagagtacgcacacaatgacagaggtaccaacgaacaaaaaatttcaatctttttacacacgccaccaacatcgccaggatcaacagggaaacgcccgcgagctccatcctttatgagaactcgaaccgcatgaggagcttgaccgagcgcagcacctcgccatcacgggcgtagagcctgacggatcgtatcccagaccggagctcccacaccggcaggcaggtctggccagcgaaatcgtccttctggtggttgtcagattcgtgcacctctacgcggagcagcgcgagctctggcacggccaaggggaactcgaactcttgatcccatgtcggtatccagttatccttgatcaccttggtctccttcatcgttgtgtctgcaacaactcctgctatacccacccttgcatagaagtctggtggcgagcacttatcg

SEQ ID NO: 137 - DNA, 520 bp, Hordeum vulgare
atttgttcttgctataaatgtttttatatagacaattattagggagtcttatttaaaatatcttccattttatgacatgtgtcatcataggtaagagtgccattatccaaagacactgattttgtgtgtttttatggtttttgacaagccatacttaatacatctccgcatttttattattacatgtcatcaataatgttaagattacatgtcattaataatgttatgtacctatgacaatttttgaggatgttaattggcaaatcagttttagatacaactaaaagcgaactataggaatttagaaaatcatggtaaaaataattaccaatatcgtgctagcttagaaaataaaagaaggcaaaaaaaggatttaaaaagaggaaaaggacgtaccaagagtatcatgaaagaagagatgaaaataagacatttgctagcaatttgatcctcttttatttaaatggaacagaaggcgagtactttgtgtatgtaccttttgtctattagaaattcaccg

SEQ ID NO: 138 - DNA, 551 bp, Hordeum vulgare
aaggtatcctgaaatactacgaagtaacagatgacaagctcaggccctgagcaaggggacacatgaatatttccacgctcactaccctatctatactatccagtatctacacatgaatatttccagagattttgctattatgatactgcgatcaagaactgtctgcaaaatcaagaaacactattttgattacgtccctatgatatactgctagttcctatatatctttcctgggttggtgaacttgagcttctgactgactgcttggtaggttcatctccgtgttcctctggacttgaaggtgtgaggaagggcatgcctccagagaagaaaagcgtgttgtgtgcctaccaaacttgcttcgttgacagcccaagggcaggtccccacgtgtcgtcgctttattttccttcttttcataaacaccttcaaacttttttcaaccacgcgctgcaactggaagtaatgattgtacaggctcttctttaattcaaatcacacgcaacgtcacaaatactaaccttgacatgcctggaactggcagtgtggct

SEQ ID NO: 139 - DNA, 294 bp, Hordeum vulgare
ataacaacaaactgaagagcaccatcgaccctttttcttccccagcggcggcggcggcggcggcggaggaggaggatcgaagatgatcatcccggttcgctgcttcacctgcggcaaggtgatcgggaacaagtgggaccactacctcgatcttctccaggctgattacaccgagggggatgctctggatgccttgggcttggttcgctactgctgccgccgtatgctcatgacccatgttgaccttatcgagaagttgctcaactacaacaccctggagaagacggagacaag

SEQ ID NO: 140 - DNA, 283 bp, Hordeum vulgare
ttttttttttttttttttttttttttttgtttttttttttttaacatgttcaacacttggagcgtaataagtttgaaactggacaatgcattaaatttgttggttaactaatagccctgaagattacatagtagaaacgcatggtcacactaatagtccttggagattcatggacaaaccaacttcatatcatatcaggactacctgacactttgcacctcctaagcactgacataagaaacagcataccatccatcttgaaaagtagtacaaaggaacaagg

SEQ ID NO: 141 - DNA, 552 bp, Hordeum vulgare
gtcccccggtgctgcaggcaattcttcacgaggcgcatgcctccgcgacggccacgcctgccgctccatgcgccgccccgtccgcgaccccaacaccggcatgctcgtcctcgagcccgccgtcgtcttctacggccgcgacctctccccgattcagtctggatgctgcaagccaccgacgtcatgtgcgttcacctacaacaacgagacgtactggagcgcgaaccccggcgttcccaccgtggtgaccgaccccgactgcctcaaatggagcaacgaccagcagacgttgtgcttccagtgcgactcgtgcaaggctggcgtcctggccggcatcaagaagagctggcgcaaggtggccatcatcaacatcgtcgtgctcatcatcctcgtcatcgtctacgtcgccggctgcgccgcgttccgcaacgccaagagggacgacaacgatgagtcgtacggcatggccaggatgaccaagtcccggccgagcaggttccagttctaggcttgcccgcagcgaaaagccgggaaaacctttgcctgtacaaa

SEQ ID NO: 142 - DNA, 546 bp, Hordeum vulgare
tgtgcagaatatacattcctaaaaatgagccagcccgtcctgttccttgcagacctcatcttgtaccaccaaatacagaatagacctaccctaaacaccacagaacccaaacaccacactaaacatttcgatccaagaacaccttccctttcacacaacccagctacagggtgatcaatcatcatcatcatcatcaacacagttcagcaagaaatatagttcaggccaaaagtcttaacaccaccacccacaacgagtggccttttgtacaggcaaaggttttcccggcttttcgctgcgggcaagcctagaactggaacctgctcggccgggacttggtcatcctggccatgccgtacgactcatcgttgtcgtccctcttggcgttgcggaacgcggcgcagccggcgacgtagacgatgacgaggatgatgagcacgacgatgttgatgatggccaccttgcgccagctcttcttgatgccggccaggacgccagccttgcacgagtcgcactggaagcacaacgtctgctggtcgttgctcc

SEQ ID NO: 143 - DNA, 518 bp, Hordeum vulgare
gtgacaccaatagttgtgaagaagaaacctgctacaccgaagaatgggctttcacaggtggacgacgacgcaaggagtgtgctcagtgtgcagtccgagcgacccaggcggcacagcatagccacctcgacggtgcgggatgatgagagcctcgccagctctccgtcagtcccaagctacatggccgccacaaaatccgccagggccaagtcccgccttcaggggtcgccactgatcgatagtgcagagacgacaccagagaaaggaggctctgttagtattgggtcagccaagaagaggctgtccttcccagcaggaggggcgcccccctcgccaatgaggcggcattctggccctccaaaggtggagagcatggtgaaggacatcgctgtgacaccgcagccagaggccctggcgatcaatggttgaaagctgaaacaaaggagcaactcataagagtgccgagacggggctatggatatacatatttcacacccaggaacaaaggttaaaaagtt

SEQ ID NO: 144 - DNA, 550 bp, Hordeum vulgare
  UNSURE (13): n stands for any base
ggtaaggcatggnaagaaatatattgctcgcataaatagaagacctgtgttgtgtacatacaaacaacaaaccccatatggttttacacaagcaacaaatgaaatggacatggaccgacagatgacaccgagagtcttctcctaataaagctgacaatgtagtcacaacaattaatttgatgaaagcaaaatgcaacaattcaataactttttaacctttgttcctgggtgtgaaatatgtatatccatagccccgtctcggcactcttatgagttgctcctttgtttcagctttcaaccattgatcgccagggcctctggctgcggtgtcacagcgatgtccttcaccatgctctccacctttggagggccagaatgccgcctcattggcgaggggggcgcccctcctgctgggaaggacagcctcttcttggctgacccaatactaacagagcctcctttctctggtgtcgtctctgcactatcgatcagtggcgacccctgaaggcgggacttggccctggcggattttgtggcggccatgtagctt

SEQ ID NO: 145 - DNA, 542 bp, Hordeum vulgare
gtccccgggctgagaattcgacgaggccctgatcgccatggaggagatagcagggcgtccgggtcggtcggcctttcctacggtgcgcactcaaatctgtgcatcaaccagctggtccgtcatggcagccctacccaaaaggaaaagtatttgccaaagctaatcagtggggaccatattggggcattggcaatgagtgaaccaaactctggctctgatgttgtcagtatgaagtgcaaagctgagaaagtagatggcggctatgtcattaatgggaataagatgtggtgcacaaatggtccatctgctcagacattggttgtttacgcgaaaacagatataactgctggatcgaaaggaataactgcattcataattgagaaggggatgccagggttcagtactgcacagaagttggacaaacttggcatgcgaggaagtgacacatgtgagcttgtctttgagaactgctttgtgcctcgagagaatgttcttggtgaagaaggaaaaggtgtttatgtcatgatgtctggtcttgatct

SEQ ID NO: 146 - DNA, 551 bp, Hordeum vulgare
gtacagattgaactttatttgcaagaatgttgggcatatacaaaggtatgagaaggattggatagaacatcatcaaacatttgaacacccgggaccgttcactaatggtctaaatcctgctcacctcctccagttagaatatgcactgataagatggcttccagaagaataatttcagtcctctttgaacagctcacggccaattatcattcttctgatctcactagtaccagccccaatctcgaacagttttgcatctctcagtagacgcccagttgggtactcatttatgtatccattgccaccaagacactggattgcctcaagtgcaacttgtgttgccctttcagcagcaaagaggattactcctgcacaatccttgcgatcaactttgccattatcacagtccctagcaactgagtatacaaatgatcttgatgattgcaaggaggtgtacatgtctgccattttcccctgtaagaactgaaattcaccaatcggacgcccgaattgctccctctgtcgaacataaggaagaacaacatcaaggc

SEQ ID NO: 147 - DNA, 491 bp, Hordeum vulgare
  UNSURE (7): n stands for any base
ggcacanaacatgagaagtttggttttgatgtcaaaacattgcgccctataacgtatgatcagatcagtgccatactcaatgggctgtctgagagatttgaatgggacaagataatggaagaaaaccatgttattggtctcaagcagggaaagcaaaacatttcactagaacctggtggccagtttgaacttagtggcgctccccttgaaacattacatcaaacttgtgcggaggtcaattcacatctttatcaggtcaaagcagttggagaggaattgggagtaggatttcttggaatgggttttcagccaaaatgggccctagctgatataccaataatgcccaagggaaggtatgaaattatgaggaattacatgcctaaagttggtactcttggccttgatatgatgttccgcacgtgcactgtacaggttaatctcgatttcagttctgagcaagatatgataagaaaattccgtgctagccttgc

SEQ ID NO: 148 - DNA, 553 bp, Hordeum vulgare
gccaaaacactctgaattatttttccggaaatgaggttccatcatcacacgacagagatggatttattccgaatacaagccgttcatcaggggaaggtgaaaaaggggtcggtacaaacaggggtttgttccggctccctggaaatgcgagaaaaatcgtaagttgtgaaagatcccccacaactggagaaagaaaaacagcaagccacaaacagagtgttccgagctcaaaattattcgcagccgcgagaccggaagtaggtttccctcgtcaggtggcttgtggaattgaggacgggatttttgtacagggatacagtctgaagaccctgtccaccttgtccagcgtccaccgaagttatatgtgattcagtgtatcaatataacaactcctcgaagacggggtccacgctgcgctgccacttcgtctcgtatagattcagaagcttctcagcaggtgtcactcctgttctaacaacttcatcgacctctctcaggaaaccaacctccttgtaccctcttctttctagtccattcttagctaactggagaa

SEQ ID NO: 149 - DNA, 519 bp, Hordeum vulgare
  UNSURE (12): n stands for any base
gattgatgttgntcttcatacaagacaagaaaataaaagaaatacctgtccccaaattgcacatctgcgacgaggctaaaagcattggtggcattcacctcggcaaataatgaacaaatcaaagatgccgagcagattgggatgaaagtgtactcctggaatgatttcttaaaaatgggaaaggataaaccagttcaacctcgtcctccgcaaccaaatgatacatgcaccatcatgtacacaagtggaacaagtgggcaacccaaaggtgttatgctgagccatgagagccatgggatgtatgtcaaaggggtggacctcttcatggaccagtttgaagataagatgtcgacggaggatgtatttctttcttttctcccacttgctcacattctcgaccgcatgatcgaagagtatttcttccacaaaggagcctcagttggctattaccatggagatttgaatgccttgagagatgatctaatggagttaaagccaactctactagttggagtgccc

SEQ ID NO: 150 - DNA, 555 bp, Hordeum vulgare
  UNSURE (11): n stands for any base
cacacaatagntgcattttattggctttttatgtagtctcgattaccagcgttcaatagtagatttacaatagtactccggcatgtgacctaacaaaacacatagctttactttgctttgctcgcagccctctgaccctccaatgttttgtatactttatcaatctcaggctgataatactttagcatgtagtttcttctcttcttcattgttgcagtgaccaaatccctttcaatgtcaaaaggtaccgggtccaacattacacctttgatgtactcgaaacctcgtagcttgttcttctgtgcagccgctgcgagctctttaaggatatgctctttaaggccttcagatttgcatatttcactgaaagagcctttgtagccatttgaccctgcccacttcatggtgttttcttcatgtgggttaactactgccactaacattgatttgtagctgtccccgtacacccagatatcttcaataattggagggaagacatatactttctccagatactcaactgcgacatactccccttgcgatagcttaaatatg

SEQ ID NO: 151 - DNA, 519 bp, Hordeum vulgare
catcgctccatgccagaggcaaccccgtctcggacggcgctcacctggtctgcggtgggaagctccgaccggcgttgttccccgcttcctccttcggtaccgtatccctgccttctccggggagtaggaggctcccccggacgtcggcttccggtccctcatctgactcccaggggcaagcaaagcccatcggttttttggagaggtacccggctcttgtcactggtttcttcttcttcatgtggtattttttgaatgtgatatttaacatcctcaacaagaagatctttgattacttcccctatccatactttgtgtcggtgacccatctttcggttggagtcttgtactgcgttatcagctggggcaccggtctcctgaagcgtgcgccgatgaattcgacgcttttgaagctgctgctgccagttgcaatttgtcatgccatcggtcatgtaacgagcactgtgtcttttgctgccgtatcggtctcatttgcccacaccattaaagctctcgagc

SEQ ID NO: 152 - DNA, 521 bp, Hordeum vulgare
taaagaaaacttctggtctatgcattatctgtcatgacagtgcaaagaacactagaaaaaaatacacttaggttcgtagatcacctagcgatgactaaagcacttgagcgagccgaaggtgcactgccggcatcgtccctccctcaccggctcaccgtgccgagcaaaactaaacagtcggaagtcatcatactaataccccacacgaccagtgcaccagaacaacaactgtcgacgatgaagagaatcatagatctaaaggattcaacctgttgtaaacacacgaacgaaaattggagatccagcaaagaccaataccgaaccgagtgaatcccacgagatccgccggagacacacctcgacacgcccttcgacgatgatagatgctacatgcaccgacagacaggggctaggcagggaggaccttattccatcttcaaggagctaccgccggcacgccttcctttttctcctcctcaatcttagccttgataactgagtatagagcaacaccagaaata

SEQ ID NO: 153 - DNA, 518 bp, Hordeum vulgare
cttccttcctccctccccctccttgcctgcttccgtcgctacctgctcccgctccgtcctcctcccctccgccgtcgccgtcgccgggacacgcccaagccaggacttgttttctgaagaatatgtcttgctttggatgctgtggtgatgaagatactcaaagagcaccagacaacaggaatcaatacccaggaagccatccagcaaggaatgatgcatatcgcactgccgatccaactcctaaaggtcctcaacctgtgaaagtgcaacccattgcagttcccgccattcctatggatgaaattagggaggctactcagggttttggtgatgaagctttgattggtgagggttcctttggtagagtatattttggtactctaagaaatggcagaggtgcagcaatcaaaaagctggattccagtaagcagccagaccaagaattgctggcacaggtatctatggtgtcaaggcttaagcatgaaaatgttgttgagttacttggttactgtcttgat

SEQ ID NO: 154 - DNA, 551 bp, Hordeum vulgare
tcgtgaacggtgttctaggtactagatacttgctgatcttgcaaccgatacaaagaatcgaatatttctggtactagaatctcagagggttacaacttgggaagaataatcacaaatgtacaaaaaccgcctgtcacgcaccccgcgagaacaacaattgatggctcatttttccttatctattatatcatacaaaaggtccaactggaacttagcgcccagcatgttcagccccgggatgggctgctcgcgcgttcagcaagggctggagcgccttgacgacgatgctcatgtttggccggaagtcagcttcgtattggacgcacaatgccgcaacagctgcaaactttgcaacagccttaggaggatagtcccctccaagtcttgagtcaacacattgcctaaccttatcttcactcagtcttggggtggcccatgtgacaaggctctgctgccccctcggtaatgtatggtcgacaggtttcctcccagtcaatagctccagaagaacaactccaaaactgtacacatcgctcttagagctaagttga

SEQ ID NO: 155 - DNA, 1829 bp, Hordeum vulgare
  UNSURE (8),(21)..(23),(581),(838),(883),(982),(1198),(1326),(1403),(1426),(1433),(1493),(1512),(1571),(1725),(1788),(1827): n stands for any base
gggggggnggggggggggggnnnaaagggggcatagaagtggatatagggggagccctagaaagtgggagagccccgtacaaagaacggagggggatgagttactgactccctcaagagtctccactgaggcactgagcctcttagtgagtgtcgatcagtctatatacagaataagtatgacgatgagcagccatgccagactgtacagcatactcaggacgttagctgtggtcttggcggctttatgcattatggtatattgagtctcacttgcattaccaagagagcaaagcacgacgccgaatccgagcacagctccgcttagaggaagtcgtcgggagtggtacaagacaccaatcacatgagcggaataatctctcgctccgtgagagcgtttgttcgtgccggtggctacggacgcccactggcgcgtcagtggtcttccacacccgcattattctgatggtgcgtgaaaccacgcgcccccacgaaatgccatatcacaacggtgcgcccaacagcgtcggcgtccgccgagcactcagatatctgaccccatctcgcattgtgttgtcgcgncgcgtagcgtagtcacacggagtggatcgatgatcttagttcccgagtcgctacattggctttttggatctatcccacttccagtcgtcccgccgcagacgccgtatattatttttctaagatcgtcgcctactatcatcgccctatcttcccattttcgcacttctccccctctgtatcgatctctgtcgactctcgcctcccgccaaataatgcgacatccaacgcgtatcaggtcgtgcacacccgatcttganctatcttatcacgggctatcatgcccactcgacccttgagtccgnatcacaccaccgcctccctgacgctacagaggtgtcgtaccaagtcaccgccagtgtccaccacactaacaccgccgctgtatcaagaactatatctantcctttgcgacgtcacgcacccattcagaccacgccataagagtttctcctccaccagcacacacagaatagacgacgggcattcagtcgatcaagatgcactacgcgatcacgcaagctgcacgtgtcgctcgtgagctagcgcgagactgacacggtcagccccgttaatgatgttttctgtgagtcgcgtgaatctctactgccacactgtgnggtgtcgcacgcccgaatcgcaccaccatactcctgtacacacagcacagtctccagccttccagatagtacgcagcgaattataccagtgacgttgtccgcgcgcgccgagctcgcacacgacgcgnctggacatcagagtctgagagtacgcgctagtctactcgcgccctccgccgacagataccgactcgtctagatgacntccaggtcgctgcatctcgtacngacccanacagcgaatcttattgtagacaaacatcgcactctgctctcgccgtccgcacaccctcancaacgatcacatacctcantcgataatcacagcgaacactagcacactcatttatgttttagacaccaaatctccccnccattgctgttcgtcacgccatctgtactttacaagctgacgcatgcagcatgtgtaagtctatcaacgtactcaagaacatagatacagaggcaccaattgcccatcctatactgctcgtcgcaccacaccacgacactcatagatacagtantgctccagatacgttacacgagatacactcatgtcacccacaccccttcaacttccacacgcnaccacacgttattacccagacgtacattagtatgtactnag

SEQ ID NO: 156 - DNA, 511 bp, Hordeum vulgare
  UNSURE (41): n stands for any base
atcttctaggtactagtaatctcagagggttacaacttggngaagaataatcacaaatgtacaaaaaccgcctgccacgcgccccgccccgcgagaacaacaattgatggctcatttttccttaactattatatcatacaaaaggtccgactggagcttagcgcccagcatgttcagccccgggatgggctgctcgcgcgttcagcaagggctggagcgccttgacgacgatgctcatgtttggccggaagtcagcttcgtattggacgcacaatgccgcaacagctgcaaactttgcaacagccttaggaggatagtcccctccaagtcttgagtcaacacattgcctaaccttatcttcactcagtcttggggtggcccatgtgacaaggctctgctgccccctcggtaatgtatggtcgacaggtttcctcccagtcaatagctccagaagaacaactccaaaactgtacacatcactcttagagctaagttgaccagtcattgcata

SEQ ID NO: 157 - DNA, 541 bp, Hordeum vulgare
  UNSURE (11): n stands for any base
ggtctgcaggnaattcggcacgagggcgcaggcgaggacgctgaggttttttgagtttcgggcaccatggggcagaggctcctcttattggtgaccacttgtctgtgggccatttcatgcgccgtgccgcaccatgcttcctcgcgtgacggactgctaaggatcaacctcaacaagaggagcttgacccatgagtctctggccgcggcaaaggccgcgaggcagtacggcgccctccgactgaagagcggcaattcagacagcgacatcgtgcctcttgtcgactacctcaacacccagtactatggggtgatcggcctcggcacgccgccgcagaatttcacggtgatattcgacaccgggagctccaacctgtgggttccctcgtcgaaatgctatttctcgatagcatgctacctccaccccaaatacaggtcgagcaggtcaaccacttacaaagcagatggtgagaattgcaaaatcacatatggttctggagcaatctctggatttttcagcaatgataatgtgttggttgggg

SEQ ID NO: 158 - DNA, 542 bp, Hordeum vulgare
aagctattattgaattgattgctacacgttcgtccgtttacaaatacaacaaacctttttacaaaccatgtgttgcctatttgctctcacttctcatcgtgcaagcactccattcttcattacacagcaacagccataatggatacaaacgtacttcttttcttcagagtttaggcgtccatttattcttggtttaagaaagaaataaaaggttctctcttttgtttcagcttttttacttatcaacggtttacagcagggctcccatgtctgaagatgcacaaactattctaggatacgtggaacgtcacagtgctctcgactcctcaagccgattctgcgaacccgattctgtccttgccgaagtcgaacacggtgtggtaaccgcccatgaagacatccccgagaatccagagaggaccgcgtgggggcggtatgtcgaatgccatgaacccactgatgcagacggtctgccctgattgctccagtttcacaatgtactgctctggtgttagcacgaaagtcttgtttgctatggcgaa

SEQ ID NO: 159 - DNA, 1072 bp, Hordeum vulgare
  UNSURE (1),(14),(19): n stands for any base
nttttttttttttnttttnattcttttcctcctattgtcatgtttttccggtctgtaaccaatagttccgtgggtaagcgatcaattataacatgtcttcgttctattatgttgaactggtttattagggatggttatggccgactaattgtcacaccacacctttaagggtcccttcctcagaagcttcaacttgcttcgtaggtacttcacccagagcatctcattcatcccttgttataatgctctatactccacttctgttgttgatctacacacatccgactggggggtggggtattttactcaaatcatctcacactacccttgagataatgctctatactcagcttttgctgctgatctagatacaaccggttgtctcttgctttttcatgacaccaaagttcctcccacaaacccgctagtgtgcactagttgttcttctattaccattgacgcctggtccaatctgagtcactatagacattcatttgttgttggcctactcatcccaaatctcattccctttcccaaggatagattttatacacctatttccggccgtttattttgttgtttcatccgatggtcaccactttgtttaatggcattttgcctttgtcgtccctcttccccgtctttctcgttcctttcattgccgtggcctcgatcttagtgtcatcaagacgatgttaacctttcaccgatactccctacataatacgacgactgttacctgcggaggatacgggtattattcatcgggcgttaggcgggtggtagcacggaattgtttatggcggccccgcgacaaagtgcattatcacttcgcgtgcacgttttgggccgattactcctgtcactctttttttcgtttttttgcgcacaccacatctgaatccacaaccgcggatctttttctcttccacacctatttcctacgcctgttttaaaagcgtcggtagaaatgctttcccacaacgatcgcgtcggttctgcgcatttttacagtgtcacacggaatagcgtcatgtctcgtgttcctttatctcttctgcgcccctattat

SEQ ID NO: 160 - DNA, 461 bp, Hordeum vulgare
cttgaacatgtaggaaacattctgagttctgatggacatacagtttaataccaaccaattcataaaatactgcactagtcctaaagttgatgagcttagatgcacttctgaatagaaactgtattagtttctctctcggagcactttttcctcgcaaggaacgcagacaagcatctaaacggcactcctgtcagatgggcattaaaatgccgagcgccctctagggtccgacgatggattagtggagtggcttgaccttttcctcctgagggtattccaggtgaagctacccccgtgctgcaaaccaccagcagtgacttcatcttcgtcgttgtcgtcttcgttgtcgtccttgctgtaggaagaaactccaggtcttcctttctctggtgtccaggttgagttgcctgcaccattggcgctgtcagaatatttgagcctttttgccctatcatgtaaat

SEQ ID NO: 161 - DNA, 537 bp, Hordeum vulgare
ggggctgcaggaattcgtacgaggcctcgtgccgggcaggaatacttacttcgtctaaaatccagggaacaggatctaacagaatggggtatgtctcaagcatcgcttctccaagcaaagacacagttgaagttggaccagggtctctaaagatgacattctcctcagcatctggacaacttacgcggatgtccaattctatcacaggagtggatttaccaattcaacagagctttctttggtatggttcaagaaccggtgatggggattcacaggcatctggagcttatatttttagaccagatgggtctacaccaactgctgtttcgagatcgataccgttaaaagtcatccgtggacctctggttgatgaagtccaccagcaattcagcccatggatttatcaggttacaagactctataaggataaggatcatgctgaagtagaatacacgattggaccaatcccggttgatgatggcataggaaaagaggtcatcacaagactgacagcaaatatggtcacaaaccacactt

SEQ ID NO: 162 - DNA, 527 bp, Hordeum vulgare
tttattgtagtacaaggcacactaactataagaaggcatttgctcacagaaatgaaaggcacaataatactcctagaacatgcatggaattacataacgatatctctgctattgcagctcacagtttcaccaagaatgttcttatctccatgggtcccagctcgacaacaaggactttatcattaaccgggctaccggtaactggggcgtgactactttcagtgtctccaacaaccctccacttgagcttcctcatcgctgacttcttttggttggcggacaggttagtttcagtcaattccttgatagttctctttccaaacaattttttcagttcaacttttgccatcactgaatattgtgggtcttctgcagcctgaaacaaatgtcccaagcggagaagtgtggtcccatcatcgagattctgcaaggtgatgatcgcgacattatcaggaagactgtaatttgcatccatcatgctctctttcacaacactgtacgatttccagctgctctcatcctcatga

SEQ ID NO: 163 - DNA, 944 bp, Hordeum vulgare
  UNSURE (12),(935): n stands for any base
agtcccccgggnctgcaggaattcggcacgaggttttttttttttttttttttttttaaaaaaaaaatggcggggttttttttaaaaaaagaggtttttttttcccttacaaaaaaaattggtttcccaaattttgggggggtggaaaaatttggggttaaaaaaacccaaccctaaaggtttggaatttttttggggcccctttaaaaagtttttatttgctttgggggtgaaaaagtggttaaaaggggaacccttggtggagaaaccaaaattttggccccccgggggggaggggccaaaaaccaattttgggccctccaaaactggaacttgggggccaccctaaagggggtccccttggccctaaagggggcccccgggggggcgggttttgggggggttaaggaaaagtttacccccgccaatttttgggtccccggaccctttttcccccccgttgttgggggacaattccggaaaaaggcccaacccccgcccgtgggcctttttaaagggggggcaaaggttttttggaacggaaggggggccaggaccctttttcccgggaaggggggggatctaaaaccccagggcgtgaaaaggtttccccggggggggggcccggaccccaaattgcccttaaggggggccaataaaaaacacgggggggaaacccctcctcgcgggggcggcgggtaaaaaccggcgccgttcctcccgccctaccggcgtcccaatcttcttttcgcgcggcttacccgccattccacatgtgtcgggtgcgatacgagcgaggagatcgactctctcctttagtggaccccattcctatggatttttgccattccttcacattgattgatggccacgccaccagcgtttccggtgtggtttcacggttttcggcccggcacaacgggaatctaccgttnggtattgtt

SEQ ID NO: 164 - DNA, 367 bp, Hordeum vulgare
  UNSURE (36),(288): n stands for any base
gcaaattgactggttattattatcaaaagatgtttntcttctacacttacaaatcaatctgtatactcaattcttgctgggctgcaatatattgtgcttaacatatccagaccctaaagttttgcatatttcttgatgccctcttcatagctcttcatttgctctggtgttgacaagttggttaacagggtaacccttgctgatgataccaaatctttgcgctccgatgtggaagggtccaacagccatatctggacctcccaaacctggacgttgcggccgacctgnaatggggttcgccttggcctcgatgcggtcgccgaggcgggcgggcttgaggtggttgatggagagctgcacgcctggc

SEQ ID NO: 165 - DNA, 392 bp, Hordeum vulgare
aagatgaagacattggaaggcaaggctgacatattagataagtcacttactgaactgagagacatgggttttgtctctaagaaagaattcgatgagattctgactcagttgaagagaaagaagggtttggatggcactgggagtgatataaccttggacgatgtaagaatatttgccaaagagattgtggagatggagatagctaggcatgcagcagatggccttggaatggtggattatgcattagggtctggtggtggcaaagtggttaagcattcgggagctttcaagaaagctaagagcattcttcctcgtcgtagtgaaagtcacaaaatgctggagccaagttttgggcagccaggagaatgttttgcactggaaggaagtgttgg

SEQ ID NO: 166 - DNA, 550 bp, Hordeum vulgare
attacaaatactgccacagtacagtacagcaatcacagttgctagatactacaaacaattagcacctctagctaggaatacgaacagcaagtcaggtgtgtccatagtggcaccattatgctacagattagaatcaacttgaacctaccgtttgacaggggcttcaagtcttcaaagccaaagaggaaagaccgtcacacaactacagaactactagaacaggcaggcctcacgaggctgcggtgccgagagagccaggctcgctgccgtgcaccctgaagcggtagatgcacgtcagctcaggctgcccgtggttcgaggagaagtcgagccggaccatgttgaccaccgacgcgtcggcggtggtcctgtctagctggaaggtctgggcgttgctcttctcaaggtcgtaagtgaactctcctaggcttgtcggcatgcgtggttgcttgtctgaatcgtcgtctgctccttggtaccacccgctgacctggaaatccttgggagcgctggagcggtcgaaggccacactcttgtcgacatgctctag

SEQ ID NO: 167 - DNA, 10 bp, Hordeum vulgare
  UNSURE (1)..(10): n stands for any base
nnnnnnnnnn

SEQ ID NO: 168 - DNA, 905 bp, Hordeum vulgare
  UNSURE (720),(723),(726),(729),(774),(824),(849),(860)..(866),(868)..(905): n stands for any base
tgcaatgtgcagctccctttgatatagaaaagcagcacagtgacaaaatagaaagaacttgtacagcacaacaaaagccgtctttggtacacttgtaaatcaagatgcaaaggcaaggacaactaaacacaatttttgtatgaacgaaattggaaacaaggcgggaaagtccaagtaaggatttgcttaaatcctcaaagcgtcaaaaaaataaaaatacagacgccacacagcaatgtttccttcaacataatcatttattatttgtctatcagcaacttcagaggtaagagaagagctgcagcagttcaagttactccttttagttccgatggagagaagacctgtccattccaggaacagcaggagaagcagccgagctactcctcgacctcgaccaccttcttgggctcgtggaggtccgccgggcggtggtccttgccccatccgacgccgcgggtggactcgaggtactggtcgacgaggtggcggcacttctggtggtggttgacgccctcgatccggtagcaccagcggaggcggtcacggatgatcttggcggtctcgatctggatccacttctcccgcaccaggtgctccctgtactccagcatcgccaccgggtccccgtacgggttcttcgggtcgaagtcatccggcggcctctcgtcgaactcgaccttcgccttccgcaccatcttccgtcgtctcctgctccgncgncgncgncggcctctctccttccttctctccttgcctagggtggatctcgtnctcgtgccgaattcctgcagcccgggggatccactagttctagacggccngcaccgcggtggagctcagctttgntccttaagggnnnnnnntnnnnnnnnnnnnnnnnnnnnnnnnnnnnnnnnnnnnnn

SEQ ID NO: 169 - DNA, 518 bp, Hordeum vulgare
ctggtaatcgagctagagacgcgcttgttgcacaggggctgaaggttggtcttgttgatgtgctccttggcattctcgactggcgagctggtggaaggcagggactctgtaaccaaatgaagtggaatgaatcagaggcttcaattgggcgtgtattagcagtggaggtacttcatgcttttgcaacggaaggcgctcactgtgctaaagttcgagaaattcttaattcttctgatgtatggagcgcctacaaagaccagaaacatgacctgttccttccatccaatgcacaaacttccgctgccggagttgcagggcttatcgagagctcgtcttcaaggctcacctatgccctcacggcggcgccctcgcctcaacccgccctggtccgtctaccatcatcatctcctcctccaccgactggtcctgtaaatcctgccagcgggcggcggcattcgtagcgcacaagttgaaaaacacgccgatctcagcttcttgaggatgtcgtgaacattttg

SEQ ID NO: 170 - DNA, 542 bp, Hordeum vulgare
ggcaatgtattggcatggcatgaagccgaaacgaatcgatgcaatcatttccatcccggatattctctatggacaggtgaaactaacaaaaaggagtgcttttacatgtacaagaaacgcacacgacacccgacctctgtgtaacggaaaaaaactgtacatgctatgtacttgcaagccacctgcagtcactctgaagagcaccaccaactccaaaatgttcacgacatcctcaagaagctgagatcggcgtgtttttcaacttgtgcgctacgaatgccgccgcccgctggcaggatttacaggaccagtcggtggaggaggagatgatgatggtagacggaccagggcgggttgaggcgagggcgccgccgtgagggcataggtgagccttgaagacgagctctcgataagccctgcaactccggcagcggaagtttgtgcattggatggaaggaacaggtcatgtttctggtctttgtaggcgctccatacatcagaagaattaagaatttctcgaactttagcacagtgagcgcctt

SEQ ID NO: 171 - DNA, 547 bp, Hordeum vulgare
  UNSURE (47),(49),(63): n stands for any base
gtcccccggctgcagcaattcgcacgaggtcggctaacaaaatcaananaccaatattacttnattcatggggagcaagacaacaattctggaacactgacaatgcagtcggaccgattcttcaatgctttgaagggtcacggtgtgcagtctcgtttggtaatacttccttttgaaagccatgggtactctgccagggagagcattatgcacgtgctttgggagtctgacaggtggctgcagaagtactgtgtaaacggcactagcaaggctgattcagaggcagcagctgatggaggtaaaacattgtcagctagtggtggtgtagccgcatccgaaggtctaagctctgacggtttctcatcaatcccacggtcgcttctgtgatcaactactgtgaagatgtacgggaaataaaatcatcattggacagcatgcaaaggccaaaaggaaaataaaatgtgctgccaaacttgtacgaaccagtgcttcttccaggcaagtctggatggccattgtattttgactgcatttccgcagaaggcga

SEQ ID NO: 172 - DNA, 548 bp, Hordeum vulgare
gctgtcaaacaatggataccgcactcagcatctgatttggtaatgatacgcactagtctacacctgtacatggtcgctcgctgggtgtgggtacaaaattacagtatcttgggcgtccccaccaacagaattacagtcgagagaattcagccagggcgcaatatccagcaaggtgaagctttccttagcccacacgaatctatgaaataatcgccttctgcggaaatgcagtcaaaatacaatggccatccagacttgcctggaagaagcactggttcgtacaagtttggcagcacattttattttccttttggcctttgcatgctgtccaatgatgattttatttcccgtacatcttcacagtagttgatcacagaagcgaccgtgggattgatgagaaaccgtcagagcttagaccttcggatgcggctacaccaccactagctgacaatgttttacctccatcagctgctgcctctgaatcagccttgctagtgccgtttacacagtacttctgcagccacctgtcagactcccaaagcacgtgc

SEQ ID NO: 173 - DNA, 524 bp, Hordeum vulgare
  UNSURE (10): n stands for any base
catttgcctntctaatgttcaagcagagaaagcttgtgaagaggcacgcggcagagatattcacgtcgatcgccattgcgtcgacattctccctgtactcgacggccatcctaggacgcctggttgggctggagccaacgttgaccatctcgatcttgccaaggtgcataaccgtggcgttggctctgagcatagtgtctttcttcgaaggcgcaaacacttcggtgacggctgccgtggttgttctgacgggcctgatcggcgccaacttcgtgcaggcggccatggacaagcttggcctcaacgaccccatcgccagagggatcggaacagcttccagtgctcatgggttgggaaccgcggcgctgtcggccaaggagcctgaggcgctccccttctgcgccatcgcctacgcgctcaccggcattttcggctccctgatctgctcctctccggccgtcaggcaaagcctcgtgttcatagccggctgacacacatatacactagtacacaggcatacagca

SEQ ID NO: 174 - DNA, 512 bp, Hordeum vulgare
  UNSURE (4),(6): n stands for any base
atgnanccatagttatgcacatatttttgttgggaaattttgcattttttttctccaaagcacttaccattcttttataaaaaggaaaataaaaactcatcacaagctgctgctgttgctgtatgcctgtgtactagtgtatatgtgtgtcagccggctatgaacacgaggctttgcctgacggccggagaggagcagatcagggagccgaaaatgccggtgagcgcgtaggcgatggcgcagaaggggagcgcctcaggctccttggccgacagcgccgcggttcccaacccatgagcactggaagctgttccgatccctctggcgatggggtcgttgaggccaagcttgtccatggccgcctgcacgaagttggcgccgatcaggcccgtcagaacaaccacggcagccgtcaccgaagtgtttgcgccttcgaagaaagacactatgctcagagccaacgccacggttatgcaccttggcaagatcgagatggtcaacgttggctccag

SEQ ID NO: 175 - DNA, 503 bp, Hordeum vulgare
  UNSURE (27): n stands for any base
gtcccccggctgcagcaattcgcacgngggcaagaaaaaatgttcgcaccattgagaaaagaaatcagatttcaccttcatacctgtagaaaacggagagggccttcaggttctccactatgaagttggacagaaatatgaacctcactttgattacttccatgatgatttcaacaccaaaaatgggggccagcgcatagccactgttcttatgtacctttcggatgttgaagagggcggtgagaccgtgtttccttctgctaaagttaatagcagctcaataccattttataatgagctgtctgaatgtgcaaaacggggtatatctgtcaaaccgaagatgggagatgcattacttttctggagcatgaggcctgatggaaccctggatcccacaagcctccatggtggatgtccagtgataaaaggtgacaaatggtcatctacaaagtggattcgtgttcatgagtacaaagtttaggcataacaaaaaccaggcactt

SEQ ID NO: 176 - DNA, 551 bp, Hordeum vulgare
gtaggagggcatggttttatacctaaaaatcatcttctcttgagtgatcatggttcattaagcctaattaacaagttaatgtacaacaaggtgaccaagacaaagccttggttaaggtagagaaaaaaaatgtaggcgatcctctatggaaaactggagacctcatcatgtgctgtaacgtccacatatttagtaactggtgcatgaccttaagtgcctggtttttgttatgcctaaactttgtactcatgaacacgaatccactttgtagatgaccatttgtcaccttttatcactggacatccaccatggaggcttgtgggatccagggttccatcaggcctcatgctccagaaaagtaatgcatctcccatcttcggtttgacagatataccccgttttgcacattcagacagctcattataaaatggtattgagctgctattaactttagcagaaggaaacacggtctcaccgccctcttcaacatccgaaaggtacataagaacagtggctatgcgctggcccccatttttggtgttgaaatcatc

SEQ ID NO: 177 - DNA, 472 bp, Hordeum vulgare
cctcgtgccgaatcggcacgagggcttaagcttctcgccatcagctggagagacatctcgagcagagcaacaggaggagccacagcttcagccttgtggtcgcacatatacagtaggcggcgcgcggcaagatgcagatggtactggtgatctcgctgcccctggtggcgctggtggtgatcatcgccatcatcctctgcatcgtctgccgttgaccagccaggcagctagctcgtgcgcggcttgccggatgtagcaccatgtagcctcctagtcggtgttgttgccgcgcccgtctcatgctgtcgtggtgtgttttgtctgcagccctgctcggtgtgtgtgatcttttctcctgctagcttctcgatgtgaaatgtactattgattgatccatgtgtctggtcgtgtgtgtgagtgtgttagtacagtacatactactaccagtctaccatgtaatgtaagctcttga

SEQ ID NO: 178 - DNA, 432 bp, Hordeum vulgare
tactgtactaacacactcacacacacgaccagacacatggatcaatcaatagtacatttcacatcgagaagctagcaggagaaaagatacacacaccgagcagggctgcagacaaaacacaccacgacagcatgagacgggcgcggcaacaacaccgactaggaggctacatggtgctacatccggcaagccgcgcacgagctagctgcctggctggtcaacggcagacgatgcagaggatgatggcgatgatcaccaccagcgccaccaggggcagcgagatcaccagtaccatctgcatcttgccgcgcgccgcctactgtatatgtgcgaccacaaggctgaagctgtggctcctcctgttgctctgctcgagatgtctctccagctgatggcgagaagcttaagccctcgtgccgattcggcacgagg

SEQ ID NO: 179 - DNA, 545 bp, Hordeum vulgare
  UNSURE (27): n stands for any base
gtcccccgggctgcgggattcggcacnaggctctcagccgcctcctgctctgcacaccgcgcacagaaaaagacggcggcggtgcggtgtgccgaggagctagtggagagggagatgagcgggcgcgacgcctcccacgacgccgctcacgcactccgcgtccgggacctcgcgctctccctcgccgccgagcagggcgtctcctccccggaccgcctcctcatcgtggaactggctgcactcctgcacgacatcggtaagtcgcagttgccctgctgcttcgttattgattttgtgtacggatttgcttgagccgattagctctcatttgaacaaaaaactgatggggaactcccgtttatcgctatctctgttcgtgcaggtgattacaagtataccaagtgagtaaacttctcgttgctttgctaaatagtatcttctttcgatcttggagagtgagagcgaagttgagtcagagttagctaaaccgcttatctcatactagaagtctcgtagttgtcttgtaatgttctttttacggtgac

SEQ ID NO: 180 - DNA, 546 bp, Hordeum vulgare
  UNSURE (20),(28),(40): n stands for any base
ttctggttagagatcttgtncatttttnattatattcggngctctagcgttttgcggaagtttcatgggaaccctgacaatgatgtaaaaccagatggtaatccatgggcttttatagatgcgagttggtgaaagttggttggccaacttcaagccttgcccctcaagcccacggtctggttggtcaacttcaagccctgccactccactcttcatagaattcagccacaaaagtctccatgaacttgtgccttttctctgctctctttttcccagcctctgtcttcatcatgtccttcaacttaaaaagcttctcatggaaatgattaattgatgtttgtttctcctccttggacatgtacttctcctttgacaaattatcccgcggaagtacgttaggatcatgcaatgcactgttcttgctccctccatatgtaaaacatcttgcaacgccaatcgcaccaattgcatccagacgatctgcatcttgcacgattgcaaactcaagagtggtctctgcattaagcttctttgaaacctcatttt

SEQ ID NO: 181 - DNA, 542 bp, Hordeum vulgare
ggggctgcaggcaattcggcacgaggggcgccatatgcggccgccgcaccccgcccccaacagcggccgccgcatcttcacggaacccagccgcagcgcctcctctcccctctgcgacgccactctgaaggtcgcctcctctcctccatggccccaatggccacatcctcctcccccaccgcgaacccccagcctttcaagttgatcctggggtctatgtcagtggccaggaagaacatcctcaacgagatggggttcgagttccaagtcatgaccgcggacatcgacgagaggagcataagaagggaggatccggatgagctagtcatgcttcttgcggaggccaaggctgatgctatcatgtctagaatgaacatttctgattaccagaaggaaggcgatcaaccaacactcctgatcacctctgacatagtggttgtccatgaagggattattagagaaaagccaagcagcaaggaagaagcacgccaattcctgaaaggttattctggtgggcatgtgtcaactgtgggtggtgtggt

SEQ ID NO: 182 - DNA, 549 bp, Hordeum vulgare
tctctatcaatgtactccagaagagaaaatacaatttcacttatcatacaaattcaccttatgtgagaaccaagattcaggacgtttcgacaggaggactgtaggtgacatctcatcagtgatcacaatagcaggtatcagttctgaagtgttcttgcacactcaatgaatcttcgtgccatggtgcctgaaattcttcatataatttaaaccataacaatcaccatgttttgacaggttgccgacatcgcattaccttcatgcagtgcagtaaggattcaatcgatggtgatcacacccaaactgctaggctatgccaacaatgcctcgtgaatgagtttgtttgccagatcctttgacagccccattacactgtcactagaaccaaccactgcttcgacaaacggcaacgtcaatggatgttctagcagcaagccgcccgcaaccctaaataccaccccctcgtcgatcaggttctcaattatctcatctggtatgtcatggaagtacacctcagctttgtctaaactgccaagcttcttgccagtt

SEQ ID NO: 183 - DNA, 463 bp, Hordeum vulgare
  UNSURE (436),(441): n stands for any base
tgattgtgaaagggtccttcggccagctcctgccgcgtcatcagaaactggaggcgttaacttcaaacgattcaaaaagaggcaaaccgtgtctggaaacagcttcaaggcccttattccatgtgcacgagaaccatacagagaatctgattacgagaagggcaccttgaacgatttcatgagagaggagaagcggcgaaagcaaatggaatccatcgcggaggacctcttcaacaaccagaagccgcagaagaagaaggcggtcgcgggcagtttgatccagaccctgctcactggttgccgatgaagtccaggatgaaaacggctcttcgtcaaaagcaggaacctgatggcggctctctttgtttcccgagttgtacccatggtttcctcggcgcgacgagagtgtgatggcaagtactatagtactacgtangaggngtgtgtgtggatatgggttgtg

SEQ ID NO: 184 - DNA, 397 bp, Hordeum vulgare
ggatgctccattctggacgagtatgcgatgatacaaacgtcttccccaaatctgagcatggtaggagtaattacaacccatatcccacacacacccctcctacgtagtactatagtacttgccatcacactctcgtcgcgccgaggaaaccatgggtacaactcgggaaacaaagagagccgccatcaggttcctgcttttgacgaagagccgttttcatcctggacttcatcggcaaccagtgagcagggtctggatcaaactgcccgcgaccgccttcttcttctgcggcttctggttgttgaagaggtcctccgcgatggattccatttgctttcgccgcttctcctctctcatgaaatcgttcaaggtgcccttctcgtaatcagattctctg

SEQ ID NO: 185 - DNA, 408 bp, Hordeum vulgare
attggacattgttaagggctcccgattgatgagttctcgaggaagaagatggatgcgaccgcccaggagctgtcggaggagaaggcgctggcttactcatgccttgagtaaatcaacattcgaagagcagttgatgctctgatgttttgaataaaagaaaccttccgctttcaactcccgtgtccacccagaacagctgcacagcacggtgcatgctccttttcgctggttttcagtgtgtatgaggcttgtagctccccttttacctgaacatttgctggaagattgaaacagtttgatacctgattagaatcaacttctttttctcttagagcattcaacaagtcctataaaaattcccctaaaactggttatactgggtaaaaaaaaaaaaaaaaaaaaaaaaaa

SEQ ID NO: 186 - DNA, 381 bp, Hordeum vulgare
ccagttaaccgttttaggggaatttttataggacttgttgaatgctctaagagaaaaagaagttgattctaatcaggtatcaaactgtttcaatcttccagcaaatgttcaggtaaaaggggagctacaagctctcatacacactgaaaaccagcgaaaaggagcatgcaccgtgctgtgcagctgttctgggtggacacgggagttgaaagcggaaggtttcttttattcaaaacatcagagcatcaactgctcttcgaatgttgatttactcaaggcatgagtaagccagcgccttctcctccgacagctcctgggcggtcgcatccatcttcttcctcgagaactcatcaatcgggagcccttgaacaattgtccaat

SEQ ID NO: 187 - DNA, 1010 bp, Hordeum vulgare
  UNSURE (1),(34),(55),(65),(883): n stands for any base
ntgtcagccagacaccatgcccccgatgtgcggnacaaaagaacgatgctcagtncttacgaacncaagctggttgtagtattcctggttcttcaggggagacactatgtgcggctgtctcagcatctacttgggtggagccgctttttaggtgggggggggcatttgctctggcttggtcctcacctaaagggaagtttcagaaggggtgcacatataacaggaggtacaccgaattttatcgaacttctgaaagatcagaggggattaattcgcttctttttttcctaaacaaaatatagactccgcgaagaagagaccgagaagtgcccacaccccatactcaaggatgaaaaacccccagaatggaccaagctcacccttcctaacgagctctatttctccgcgcccagacgacactgtactgcccatatggccaaccctccacacatctactgcaacaagtcctcgctaccaacataagaacccaacagaaggccgcccccctccccacccatatattgctctccctctccaaaccccctcatcttacctcgcccccttattgggacacctacctccctcaaagaacctgataacgcatgacccactaaccccactgccccccctccccctggttacactatcaaagccgcagacccaccacgtcccataccccgagacggcaaacaacaccacacgctataaaccattgttcacaccgccacccccccttcgtaaacacataatcatccctacaaaccagcgacatacaatcccaacatagatacccacacctcatgggctagctgaaaacacgatgcaacctatcaaaaaactgagccctcctacaacagacaccacatttaccaacaacattcangcacaacaaccacgaatacaagtctcactgagggacgtcttcgataaaggtactgatatacgtcgataaagattataggagactgagcctcaaatgtgtgtatagatttctacggcacatagccggg

SEQ ID NO: 188 - DNA, 542 bp, Hordeum vulgare
ataaattttacaaacttctcgaatctgttatttaatagttcactgtacaaattatacaacaaaagctctttggagcagtgagttcaactgtcccataggtgttccctctgattgtaaaggagaaaaaacctgaaccccactggatcttggaagggggcaaggagaagccggaagaaaaataacatgacctgctcatcagtcgttacacgttaccttctttccgtggttagcattcacactggaacgtggagctgggaatacatctgttatcaggggcgatctttcgaatacctatctcactgactgctcggactgcttgaggggatacatgtattctgtccatcaggtttaccttcggtgcctcaagaatcgtctttgggggtgacaatgcccactgcattgcccaaatagcaagaggccgcatgtataccagcgacctgtaatgcccatctgtggtccatccttccggtgtttggaaccaatacccgtatccatcttctgaccagccagcaagaaatattccttctgcagtgataaaacct

SEQ ID NO: 189 - DNA, 493 bp, Hordeum vulgare
agggacagacctctccttccttccccgcgagcaccgtcgccgtcgtcgtccatcccgatgcagcagcggcgcggccggccgtccggcacggatggctccgacttctcctaccgcatggtcgtcgactcccggtaccagagggtcgccgacgggagatcccgcctcgcccggctcatcctcgtgcagatgctgcaccaagtcgctgggggcgcgtcgctgctgctgtcgctgtcgaagggggcggagataaacaagttcgccgtgctgtccgtggccgccgggctgctggccattctgttgggggaatttgggcggaggcggactgtggcagtgtttcttcggttgtacacaagcttgtcatcaattgctattgcattctctgtgacgtgcattattcgttcagacttgttcgtgaagatcatgaagcaaaacacagcagacatcacaagctatgagatgttcgatgtggtccgtgttgcgcttggtgtcctgc

SEQ ID NO: 190 - DNA, 554 bp, Hordeum vulgare
  UNSURE (17),(24): n stands for any base
gctcccacaaaaaaaanttccggncaaggtcggagaacagaagaggggctaaaaataagcaactcatgatcaacatggactcatggagatttgccgtttctttagaggtctatagcatttctatttcatgagtataagacccaagacggtgttcctttgtactggtagagcgcagctacagtgtcacgcacggccttcatgaggttctcttgggaggagacatgttttgcaggagtctggttgttgttgcgatgaccaccaattggagcaggacaccaagcgcaacacggaccacatcgaacatctcatagcttgtgatgtctgctgtgttttgcttcatgatcttcacgaacaagtctgaacgaataatgcacgtcacagagaatgcaatagcaattgatgacaagcttgtgtacaaccgaagaaacactgccacagtccgcctccgcccaaattcccccaacagaatggccagcagcccggcggccacggacagcacggcgaacttgtttatctccgcccccttcgacagcgacagcagcagcgacgcgccc

SEQ ID NO: 191 - DNA, 519 bp, Hordeum vulgare
ccaacgtcgaggatctgttgtttctccatcgtacttcagtaatggatctggctctagatctagagctcctaatgttcctcctctggtacctcagttcatgagggcacatggtagcatcaacgaacagtacccgcagagttcatcatccagccttttcgctggagctcatagatcaggaggcatgcgacctgcccctccgccacctcaaccggaaaacccaacattttgcctgttcccaccgggctcatccggtcatagttcaatggatactgatgaggctggaggaagccgattctatgcctgggagcgcgatcgcttcgcgccgtacccattgatgccagtcgactgtgagacaagctggtggagctcacagcagtctcatggcgcatcagaatccacacccgcacctgcgccgaggagactctttggccagtggatcggcctcggcaggtcgtcgcccgagaatagatcacccgagggctcatcgtatcgacaaatgcactctcctcggatgtagcc

SEQ ID NO: 192 - DNA, 551 bp, Hordeum vulgare
ttccaaattgattttaaatatgtacgagacggaattacataaaccaaaccaaaacgttttccctccaggttatttcatgtttctcccttgcagaattctccggaagttcagcgcacaacccggtttaaattccatacagatggttttttccccatcttttcttacaagcaactcaggttccaaatgtcaagttttaacttaggttgcctctgcagagggggctacatccgaggagagtgcatttgtcgatacgatgagccctcgggtgatctattctcgggcgacgacctgccgaggccgatccactggccaaagagtctcctcggcgcaggtgcgggtgtggattctgatgcgccatgagactgctgtgagctccaccagcttgtctcacagtcgactggcatcaatgggtacggcgcgaagcgatcgcgctcccaggcatagaatcggcttcctccagcctcatcagtatccattgaactatgaccggatgagcccggtgggaacaggcaaaatgttgggttttccggttgaggtggcggaggggcagg

SEQ ID NO: 193 - DNA, 526 bp, Hordeum vulgare
ggttcgaggggctcaagctcatgttgagaagcatttctgaagatcaaacacttactcttggttgattcgctgaatttaggtggatgggtttcattgtcagaaatgaacaaggtggagctggagctggatccatcatttttctttctttcgagaatgacgatccatcaaatttcaaacctgaagctgccagacagagttggctccaggagatgtcgagtcggtctgtcggtggcctacgttggagttaaatgtatataaccccctgaactcccagatttggagtacatcaccccctggactcaattttggctcacttaatcccctaaatctgcacaaaccgggcaaagcaccccctgacgactctcctggtggtttgggacggctgttttgcggacgtggaaaggggccggtgccatgtaggcttggacctggtggactcggtgtagttgcgaccagaccatctcgattccatcgagtgcccccttttttccttcctctctccctctccctctctacaggcgacgcc

SEQ ID NO: 194 - DNA, 555 bp, Hordeum vulgare
gttaaatgcacttgcctctagtgccatgtggaacattagtacaaatcatgtagtaaattgtgcttctggaacagttacacaagtgtaaattgcgtctctctttcattccattacaaattttaaaaacagagaaatgcatccattgcaagctcccatcgctgaagtgatttgcacagcttcaagtagtgccagggcttcacaacgtagaggctccggacaacactgacttctccatcactaccctcgtcataggacatatcatcatcactctcaaaatatggtgtttcatctccatcactttcatctacttcctccgttccttacatgtttctgggacaataaaactgtttagcacattgcaagtctttccattttcttccccaagcatcttctttcttttgttctccttgaattcttgagcatattttctgtactcaatcacctcatcatcatctgcggaactgttgctctctgttggaggaacatcataatcactgtcactatcactatctgcagtagccacaaatgatttttaaggcctgaaaactggtagtt

SEQ ID NO: 195 - DNA, 516 bp, Hordeum vulgare
  UNSURE (8),(23),(32): n stands for any base
gtccaacnactattccaccgagnagctccagnatctactcgctgcggctgatctatatgcacttgataggctcaaggttatttgtgcccaaaagttatggaacgcagtttcagtagacacagttgcaaccatgttagcttgtgccgaaacctataactgccaggagttgaagaatagctgcattgacttcttcacagtggaaggaaattttaaggaggccatgttcactgatggttatgcattgttggttctaaaattcccgttgattactgctgaactcaaaaagagggttagagcataaacatgtttatgcttcaggcgttcaagaatagtcttatttggtgttttggatttggtgagtggtatctgacaccttgtgaagcatataatctatatttgctgaggagggagcctggaagctagaaattgtagaatcttattcctgaagttttggtcttagttgctatcgagtattaataccgataaatcatatgattgccaaattaccaactcatt

SEQ ID NO: 196 - DNA, 422 bp, Hordeum vulgare
gttggtaatttggcaatcatatgatttatcggtattaatactcgatagcaactaagaccaaaacttcaggaataagattctacaatttctagcttccaggctccctcctcagcaaatatagattatatgcttcacaaggtgtcagataccactcaccaaatccaaaacaccaaatgggactattcttgaacgcctgaagcataaacatgtttatgctctaaccctctttttgagttcagcagtaatcaacgggaattttagaaccaacaatgcataaccatcagtgaacatggcctccttaaaatttccttccactgtgaagaagtcaatgcagctattcttcaactcctggcagttataggtttcggcacaagctaacatggttgcaactgtgtctactgaaactgcgttccataactttt

SEQ ID NO: 197 - DNA, 545 bp, Hordeum vulgare
gggctgcaggcaattcggcacgagggcgaaaagaagccacgacagcaaggggggaggagcggcagccgtcgccgacactgatcccacgagcagattagagagctcgcctccgtcgaagatctgaactccctcctcccgctttcggaactcggatcattccttccttcattccggatccgcggatctacccttctgtgctgctgcagcagctgtcgctgctcggttgatttggtgggtggagatgaggttctggagggacggcggcgcgagcgcgagcgggcgggacctcaacggcgggatgccctacggccaggtgcgcgtcctcatcgtcggcgattcaggtgtggggaaatcttcattggcacatctcattcttcaaggttctgcgattgctcgaccgacccaaacaattgggtgtacagtcgatgtaaaacatattacttacggaggcctagggagttcatctaatagcatcatcggggatgctgaaaggaacttctttgttgagctttgggatgtttcagggcacgatcgctacagagatt

SEQ ID NO: 198 - DNA, 559 bp, Hordeum vulgare
  UNSURE (35),(36): n stands for any base
tttaaagatgtttctactcgattttattacatgtnntcattgtctccaattccaatacatcacagttcaataaatattggacaagatatgaaagaaatgctaactactgatcgcacaatgaaagacaaaataaacaaaaagaggcatatccgacgacatgcacatgttgccagtaagacagtagttgaacttctcaagaatacagaaagtcggattcaaatagttccccgggagtatgtgcttttcccacgtcgcaagctgtatatcatggtgattattcgtggtgattatgagcccgtgtatcataaattgatgtctaatcggcttgtcctgctgctgtttttgtcaggaattgctgatgacgagaatctgtggtatctgtagttctccgcggaagaggacatcggctgttgaggagagggactgagcggtagagttacgttctgctgagcagatagtggggcgacaccgttatatttgtacctctgcccgccatagcttttccttttgaacaactcttcgtcattcgtggtttctacaggaagaatggtatcccctc

SEQ ID NO: 199 - DNA, 516 bp, Hordeum vulgare
gccgccacacctcgacctcaggcgaagaaagggcgaaagcaccatgtacacggcgaggaagaagatccagaaggacaagggcctcgagccctccgagttcgaggactccgtcgcgcaggctttcttcgacctggagaatggcaaccaggagctcaagagcgacgtcaaagacctctacatcaacgccgccttccagatggatgttgcagggaacaggaaggccgtggtcatccacgtcccgtacaggctccgcaagtccttcaggaagatccacgtcaggctcgtcagggagctcgagaagaagttcagcggcaaggacgttgttattgttgcaacaaggcggattgtgaggccacccaaaaaaggttctgctgttgttcgccctcgtacaagaactttgactgctgttcatgatggtcttttggaggatgttgtttacccagctgagattgtggggaaacgtgtcagatatcgtcttgatggctcgaaaatcatcaagatcttcttggacccaaa

SEQ ID NO: 200 - DNA, 556 bp, Hordeum vulgare
ttcaacaatttttccttagcaatatttagggttagcatcacagctataattttgattttttgagtacatgatccaaataacaaagagctcaagcaagcggttgcatattcaatacatgaacaagagagccagccaatatgcaaatcaagaaggatcttcaagcagtttcagcaacggggtactcgtataccacatccttgccacaaagcctgcggtacactgaagtgaaggtatccaacttgtactctgtgttgttgcgttcctttgggtccaagaagatcttgatgattttcgagccatcaagacgatatctgacacgtttccccacaatctcagctgggtaaacaacatcctccaaaagaccatcatgaacagcagtcaaagttcttgtacgagggcgaacaacagcagaaccttttttgggtggcctcacaatccgccttgttgcaacaataacaacgtccttgccgctgaacttcttctcgagctccctgacgagcctgacgtggatcttcctgaaggacttgcggagcctgtacgggacgtggatgaccac

SEQ ID NO: 201 - DNA, 503 bp, Hordeum vulgare
  UNSURE (3),(11): n stands for any base
ggnctgcaggnaattcggcacgaggttgaaattgctctcaaaattgcaaacaagattaaggcaaaagagaggttttccgcatacatagtagttcctatgtggcctgagggtaatccaactggtgctcctacacaaagaattctttactggcaggttcgattaagcaccctgtttcttcctaatttgttttggtggagcatacccagtctgtttatattctgtgatcacatgttttgtctttctcttatattgtagaacaaaacaatgcaaatgatgtatgagacaatatatagggccttgaaagaagtaggtctggatgatatatacgagcctcaggattatttgaacttcttttgtcttggcaatcgtgaaattgaggacagccccagtactccaagtactgcaaataatcctcaggatcaagctaggaaaaataggagattcatggtttatgtacattcaaaaggtatgattgtagatgatgaatatgtgatcattggatc

SEQ ID NO: 202 - DNA, 481 bp, Hordeum vulgare
tgtgcagaatgcatttacagttttgtactagaaacttagtttcataaacttacatataacatactccaggttacatgctacaaacgccaggttcccttcaaaagggatccaacatgccatcatcttatctacagggacttgaacttttttttctagtttccaaacatgatgagttaagatggtaacaacaaaaggcaggaatgacttgaactttttttttctagtttccaacttgccctacttgcctgctacctatatattggcttgcggaattctctccctacctatgttatcaggaataagacagtgctacttcggcatcttcgttgtccaggatatccaagaagtcaccaacaattgcatgcttgcattagcagaattcatatcgtgaggttttcttggatggccgtgaaggagccacagatgttcccgcccatgtctgggaatgtcgcacatcctggcaagggtttcaccttgccct

SEQ ID NO: 203 - DNA, 517 bp, Hordeum vulgare
aattggcgacctggtttagctgtcgtggcatgctcttgcagtaaactgcaagagctgcgggtcttcccgtctgaaccttttggtgccgggcaagttttattgactgaaagaggccttgttgatgtttctgccagttgccccatgttggagtcagttctctacttctgcggccagatgactaatgaggccctcattacaattgcgaagaatcgacccaacttcacttgtttccggttatgcatccttgagccccgtactccagattacgtcacacggcagtctcttgatgctggcttcagtgccattgtggaatcatgcaagggccttaggcgcctctctgtgtctggccttctgacagatctcgtgttcaaatcaatcggtgcaaacggtaaccgtctagagatgctgtcaatcgcctttgctgggaacagtgatcttggccttcattatatcctctctggctgcaagagcttgaagaagctggagataagggactgcccatttggaaataagccgt

SEQ ID NO: 204 - DNA, 549 bp, Hordeum vulgare
  UNSURE (65): n stands for any base
gggtgcaaactagctaggtagaggtttatcagcagtagtacagtacaatacaagattaaaatggngtgccatatctttatacataaaagaactaaacacgctaaagaaaacaaaccgacgttttctcatgacgctatctagcagtttctgtaatccacccagcctcctacagttattaacacctgaaaaggcctcgagtctcatcctacacttgcccagtcgagattttatgacagctttatccaaccaccagcctttctacttgacaggaaaattctatgttatgctaggaaggtgttgaaggtaccaatccaatccaggttgaaaatgaatacaccgctgtacctttaaacaatctggacgtaatctggtgtgtcggaccttggaccggcaattgtccggtacacatacaatgtctcgaccgggctatcatccggaagtgactccacagggcatgttcgtccaggatcgttcattatctccacggtaaggcgaggcatcttctctgcaagctgtcggcatgcgcccagggtcaatgagcacgacgac

SEQ ID NO: 205 - DNA, 559 bp, Hordeum vulgare
  UNSURE (39)..(41),(84): n stands for any base
gtacccccgggcctgcagggaattcggcacgagggatcnnngttggttgaaattattaaagaattttgggtacccccaacaagnggaagaaatcaggtgcatgaacccaaactactctgaatttaagttccctcagataaaagctcatccctggcacaaggttagtaacctctctatttgtattcagttagcctagaccgctgcaacctgcttgcctaattttcttctgcacacagctttttggcaagcgcatgccacctgaagcagttgatcttgtgtcaaggctacttcagtactcaccaaatctgcgctgcacagctgttgacgcatgtgcccatccattctttgatgaactgcgggatcccaagacctgcttgccaaatggacggccattaccaccattgttcaacttcacgggagctgagctggaaggcctccctgttgagctgctccaccggatcattcctgagcatatgaggaagtgaagaggtggcggctggagaagcggtgactttttcacggcgcctctgtgcgtatggagacgacgagaatggacaac

SEQ ID NO: 206 - DNA, 553 bp, Hordeum vulgare
tagcatgacgtcatcattggtctgcatcactgggaaaattctgaatgctggaaacgagcaacatgctattctttcatcaaacggcataaacacatacacttaaaacaggggcccacatcgatgcgggcctgggcgctgctgggcacatgccacgcttgctgcccttttctagctccaggccgaagagtctactctggatgaatccaccacgagacatggatatgctcccgttgtccattctcgtcgtctccatacgcacagaggcgccgtgaaaaagtcaccgcttctccagccgccacctcttcacttcctcatatgctcaggaatgatccggtggagcagctcaacagggaggccttccagctcagctcccgtgaagttgaacaatggtggtaatggccgtccatttggcaagcaggtcttgggatcccgcagttcatcaaagaatggatgggcacatgcgtcaacagctgtgcagcgcagatttggtgagtactgaagtagccttgacacaagatcaactgcttcaggtggcatgcgcttgccaaaaagc

SEQ ID NO: 207 - DNA, 423 bp, Hordeum vulgare
gccagccgtcgcgcggcgccccacctctcctctcgcccggtcaaagccagagagcaccagcctcaacctggctggcggctgccgccttcccctccgcttctaatcctccgcccctccccgcctgtgaccatcggctcgaccggcgccgaatctgggacggcgcggggggatgggggtgtcgccggtgtcgccgggggccagcgccggctacgagtgctccttcaagatcctcctcatcggggactcgggcgtcggcaagagcagcctcctcctcagcttcgtcgccgccgccaacctcgacgacgacatcgcgcccaccatcggagttgatttcaaaatcaagtttcttactgttggtggaaagaaactgaagctgactatatgggatactgctggccaggagaggtttaggacaatcactag

SEQ ID NO: 208 - DNA, 471 bp, Hordeum vulgare
cctttgtacaaaccaattttaaccactctccaaaaccttacaaactactgtacttactttcccaatctccccaccttttctactcacagattgtttagacacagctcatgtacaacgagaacgcgacaacagctacagtttgggtatctagaacttgcctgcgatacggtgaccacagatagcgagctcaatcatacgcaacggatctattgacagcatctaccaccatactttgcatgactttcctgctgctgtttcagaatgttcctcttgacaacggatgacgagccttcctccaggagacttggaacttcaaggatctttagcacaagttcttcaaaacaattctcgacgttttctcgtgtttttgcactgctctcaagaaacagacatccggattcttgtgcgaaagcaagaccttcttctcttgtgactgttctctcatcatccttatcaactttgtttccaaca

SEQ ID NO: 209 - DNA, 524 bp, Hordeum vulgare
  UNSURE (83): n stands for any base
cgcggctggaccggctggctgccgccagcgccggtgacgacgccgagtgggaggacatacggctgaagcgcatcctagttganacatgctccggatgtcctactacgacaccgccaccaagctcgcggaaacctctggcattcaggaccttgttgatattgatgtctttctagatgcaaaaagagtgattgattctcttcggaataaggaaatagctcctgctttagcttggtgtgcagaaaataaatcccggttaaagaaatcaaagagtaagcttgagtttttactgaggcttcaggagtttgtggaactagtcaaggctaagaacttcctgcaggctatatcatatgctcggaaataccttgctccctgggggtctacccacatgaaagaattgcagcgtgttacagcaacactggtttttagaagcaccacaaactgtgtttcttacaaggtcttatttgagcaaaatcagtgggattttcttgtggatcagtttaagcaagaattctacaaactatatg

SEQ ID NO: 210 - DNA, 544 bp, Hordeum vulgare
agttaaattcggcgaattattcttcgatcggaaaataactgatggaaaagcgcaatctgcagtttcaatttcggttggttcttttgctttgcactacaacttaaattaaccgcacaacaatgttcggatcatccattcattctatgtacattcagactggcaattctcatcaatcatccatcacccaagacgagctacgacggcatcgccaagatcatgagatgtaagccttgacgagctcggtgtagttgcagacttctcctgtccttgggcatgtgatcttgcccccgttcttcttggccatctcatcaagggccttggtgctataaacgtagccgttgggcaggacgagcggtggattctcggtgtccatgagctccttggttatgtggcagacaagcttcgagtggtgctgctttgagaagggcagcggctctgcgagtttccggaagccgtccagcgacaaggggtcttctttggggcagttcccctcgaagcagaatggagtcttgagagctgtcaggcctgcttgcaggtaaatgtt

SEQ ID NO: 211 - DNA, 520 bp, Hordeum vulgare
gcctccaaattcgccggctgccggtgtcccggctcggccacagcccgcagtaggaccatggtgctagaacagaaaggagaaacgtccagtggcatgtatacttacaagcatcgtggtgacaagggagttgatatccatgagattttcgttaagaagagcagaacccgtgttctgctgtcgtatactggactcattctacttcttgcaattgtctgccgatcattgctgggaaaggagaagttgtatcttgagtcagtgtggagtattacctttggagttctggttgccaaatttttgcaatacaaaccagtgaagaaagagtcggtagtgataatgccattttttggggttcagctagaaatacatttttggagcggaagagttgatcgtcattttgtgccaattggcaagattctaaagccactgttgaacgagtgtgtgacaccagtaacctgttactggagcttggcgttgcttctgcgcgatgaagaggagctcaagctagttttccagaaattcc

SEQ ID NO: 212 - DNA, 552 bp, Hordeum vulgare
tatcgggcaatcgttttatatattagacaaccaagtacttataagtatactggtcaagatttcaagaccaaaaggttgatggcgtagatccatggtggcctgcattgttgaccaaggaacaattcagggcatggacgatatttcatatttgagaaccatcgcggtagttgttaagtgcattacactgtacacccacgtctgaaaatctgcaggcgttcatcccaacaattagtggccctcgcattagtgagacctacctccagctcagtttggtatctaagctcaactgcggccgctttgccatacgttgcaatcacaccagatcgccaacagagagtcacgcttctgaacggttcggtttagaaactgcagaatgctggcttgtgcattcggagtctgtgaatgcgcagagagctctccagatagggaccagcattttgacaggtgggcggaatttctggaaaactagcttgagctcctcttcatcgcgcagaagcaacgccaagctccagtaacaggttactggtgtcacacactcgttcaacagtggct

SEQ ID NO: 213 - DNA, 396 bp, Hordeum vulgare
acacactcgcagtagctagcatagctaggtgcttgacctagctacaacctcccgtggccaatatggcgtccaaggtgtcggcttcatgtggcctcttccttgcccttaacctcctcttgtttgcagtgaccagtgcctgcccaagctgcggcgactcgggcaacaatggtggccacgggagcagaggcggtgggagaggtggtggcggtggaagtggcagcggcggcggagggcatggaggcgggggcggcggaggccaaggcggcggcagcggaggatatggaggcggaagcggagggggtggcggaagtagcggtggcgggatcattggcggcggtcctggcggtgggatcatcggcggcggtccaggcggtggcatcatcggcggaggccctg

SEQ ID NO: 214 - DNA, 331 bp, Hordeum vulgare
gcacatgtggccttttttttttttttttggggaaaattcaataattaggaaaagataatttgtcacgataacaacaccaacaacaagcggacacattccctcgcaaagtaaaatgcaatggccactagcacaagctacgactcaaacgtttgcgaaacaatacaaaacaactaaagcaaagcaaataattgaacgtatgcatgcacttcgtcgaaatcatgcatgcatgcatggacgtgacctctcgcatccccttttctttgtgggagatcatacgacgaactcaatgctatcactgggattaggtcgggcacatgaagccggtcgggac

SEQ ID NO: 215 - DNA, 458 bp, Hordeum vulgare
  UNSURE (421): n stands for any base
atcccatttctccaacccaatcactcctcccccctcccactcctcacccacggcgaggagacggacaggcccgccgctgctgcaccgtccggcaggggttgccttgatcccttcctccactatcgatgggggacattgccaaggacttgacagccggaaccgtcggagggatcgctaatctggttgttggccacccatttgacaccatcaaggtcaagctccagagccagcccagccctgctccaggccagctacctaagtatgcgggcgcctttgatgctgtcaagcaaacagttgcggctgaagggccgaggggattgtataagggaatgggggctcctctcgctaccgtcgcagccttcaacgctctcctgttcactgtgaggggccaaatggaggctctcttgagatcggagcctgnggtgccattgacagttaagcagcaggttgtcgctggt

SEQ ID NO: 216 - DNA, 344 bp, Hordeum vulgare
ttttttttttttttttttttttttttttggtaagctcaacctttattatcaccaacgatcctgccattgctgccagtctatgcgaggttctgagaaacaatgtcgcagcaaagaagaatggttaatttttcctttcttttgtctgccatggatcccaattctgtctcagttgctacgcttaatgccgcttcagccgcgtcggaaaagagacggagggcggcgccaggaccttgggtcagtcagcccatggccgaccgcgtgatctcgtaggccacgaaggtggcggcatttgccgggacgctgcgggccatggcggggccgaaccccttgtacaggcccttgac

SEQ ID NO: 217 - DNA, 427 bp, Hordeum vulgare
atacataacacacatagaggatagagcagcggctgcctcccgcgagcaggatcgagctccgtcgatcgagctgccatggcagcagccagcgctcttctcatggctgctctcgcggtcttcgccgcggccgccgccgcggcgctggacacgtcgccggtgccgttcgacgccgggtacgcgcctctcttcggcggcgacaacctcgtccggtcggcggacggccggagtgtcacgctcaagctggaccgatacaccgggtctgggttcgtgtcaaagtcggcctaccgccatggcttcttcggcgcttccattaagctgcccggcgactataccgccggcgtcgtcgtcgccttctacctatcgaactgggacgagtaccccaagaaccacgacgagctggacttcgagctgctgggcaaccggcgcg

SEQ ID NO: 218 - DNA, 326 bp, Hordeum vulgare
tttttttttttttttttttttgcatgacttttgtaatgattaacaaaaatactgtagcacgatagcgacacatagagaagtataacaggcggcgcgagaccgggtgcctatccattgcacccgccgcatgaaaagtccgctgagcggcgcttctagctagatttccccaacaaaaaaaatcttaatcctcctgtgtactgtactgtgtacatttccgatagatgaacgaacctcggtcgacaaaactacttgaccatgccatgcatcgatcgactcgactcattcgatcggaaaccataacctactgcatgctggaagagtactgc

SEQ ID NO: 219 - DNA, 544 bp, Hordeum vulgare
  UNSURE (16): n stands for any base
gtcccccggctgcagnaatcggcacgagcactttccgtggcgtcaccggcctcctttacatctcattcccaccatcaccggccaccaccctcgccgctcccacgccctcgcaccgcacctatatctcgcccctcctcctcccccctctccccacccaccattcgcctgcgcccttcgcttcctcccgccgccgccgacttccccaggtcttctcgctccagatcagttaacataaatggctgacgctgaggacattcagccccttgtctgtgacaatggaactggaatggtcaaggctggcttcgccggagatgatgctccacgtgcagttttccctagtattgttggccgtccacgccacactggtgtcatggtagggatggggcaaaaggatgcttatgttggtgatgaggcccagtccaagaggggtatcctgactttgaaataccccatcgagcacggaatcgtaagcaactgggatgacatggagaagatttggcatcacaccttctacaatgagctccgtgtagcacctgaagagcac

SEQ ID NO: 220 - DNA, 552 bp, Hordeum vulgare
  UNSURE (20): n stands for any base
gaacagcgatgaacttgtangaatcaataattaaatcattaaatcagactacacacataatagagtagatacacccatagacaggccatcggcccaacattgtgtccaacaaaaccaccacctaataatgctactagacaagggtatgcatggaaaataggtctggcaacaactgtctagaagcacttcctgtggacgatagctggaccagactcttcgtactctgccctggagatccacatctgctggaatgtgctcagagatgcaaggatagaccctccgatccagacactgtacttcctctccggtggagcaacgaccttgatcttcatgctgcttggggcaagcgctgtgatctccttgctcatacggtcggcgatgccagggaacatggtagacccaccactgaggacaatgttaccgtacaggtccttcctgatgtccacgtcgcacttcatgatggaattgtaggtcgtctcgtggatgccaggagcttccataccgatgatggaaggctggaagaggacctctgggcatctgaagcgctctgcg

SEQ ID NO: 221 - DNA, 517 bp, Hordeum vulgare
ccgggaggagtggccagcggtgacgtcatgggccttcttctccgggagcgcatcatcttcctcggcaacgagatcgaggacttcctcgccgacgccgtcgtcagccagctcctcctcctcgacgccatggactccgaatctgacatccggctcttcgtcaactcccccggtggatcactcagtgcgacaatggctatctacgatgtaatgcagctggtgagggcagatgtatccactattggaatgggcatagctggatccacagcttctatactccttggtggtggcgcaaagggcaaacggttcgccatgcccaacaccaggattatgatgcatcagcccgtgggaggcgcgagtggccaggccttggatgtagaggtccaagccaaggaaattctggctagcaagaggaatgtcatccggctgatatcaggctttacgggacgcacactggagcaggtagagaaagacatcgatagggaccgatacatgggtcctcttgaggccgtggattacg

SEQ ID NO: 222 - DNA, 549 bp, Hordeum vulgare
ttaaaaagtgttacatctttgttttgacaaagctcagcagttgcttgctgtgcaaaatacatgcgaggctagctggttagaccagttgtatgttccatgcgctttcatttgcttggtcaaatgccagaacacaacagctacaccatcacaccaaatgcaacggcagataaagtctactgctaaggattacatcatctttgttcgatgaaagctccagcgactgcctggttcgaaatacagatgactgacaggctagcttagtatatgactgacaggctagcttagtatatctcatcatctgggacatccggcgtaagaaacttctgagggtccttgtacatttcctcatagttgtatttaggtttcaccctctctggaaccggctcaagtgggatgatgctgtcttcgtcaatcacaccatcaatgatcccgtaatccacggcctcaagaggacccatgtatcggtccctatcgatgtctttctctacctgctccagtgtgcgtcccgtaaagcctgatatcagccggatgacattcctcttgctagcc

SEQ ID NO: 223 - DNA, 520 bp, Hordeum vulgare
accgacagcagcctctgccagttcagatttgtatggtgctgcagttttggatgcttgtcagcaaataaaggctcggatggaacccattgctagtagggggaatcatatgtccttcgcagagttagctcaagcatgctacatggaacgagtagatctttctgctcatgggttttatatcacccccgatatcgggtttgactggattgctggcaaggggagtccatttaattatttcacgtatggagccgcatttgcagaagttgagattgacaccctaactggggatttccacacaaggacagctgatattgtcatggatctcggctattcgattaatccagcaattgatattggccagattgaaggagctttcattcaaggtctgggttgggctgccatggaagagctaaaatggggggatgacaaccacaagtggattcgacctggacaccttttcacttgtggtcctggctcttacaaaataccctctataaatgatatacctctcaatttcaaggtt

SEQ ID NO: 224 - DNA, 549 bp, Hordeum vulgare
tattgtttttgctcgattcaggttatttgaagtcagtggtattcgtaatcctatatcaacacttcatctgtacttttatcatgcacacagcgtgtccggactgtacagtatagtgcaccacataacaggtatacacatttacgttgcatgtatcggctactctggcagcaaccactatacgctaagcttgggacggtaatacacactcgcaaatttcttcgtaatggagtcaacacacgccatccttatcctttcaggcgttgccgggttgtcgagggggaaccagtcgagatggccctcctccgccctagccgccgcgatcgcgtcttttatcgcaaacaagacggcggaagcgaggaagaacggtggctctccgacagccttggatgagtgtatggcccttggatttggaacacccttcaatagtgaaaccttgaaattgagaggtatatcatttatagagggtattttgtaagagccaggaccacaagtgaaaaggtgtccaggtcgaatccacttgtggttgtcatccccccattttagctcttc

SEQ ID NO: 225 - DNA, 544 bp, Hordeum vulgare
  UNSURE (16),(27): n stands for any base
gtcccccggctgcagnattcggcacgngggccttcacggcccacaagctgtctcctacctccacacccaatgccaacgaaccggacgacaaggccaggcggaatgctgccaactttgagtgcaatgtctgctttgacatggctgacgaccccgtcgtcaccaagtgcggccatctcttctgctgggagtgcctctatcagtggctccatgtccactccaaccatcgtgagtgccctgtctgcaagggccaggttgctgacgatgccattatacccatctatggacgtggcggctctgcagcgtctgttcaagccgcaccgccaaggcccactggggccagagttgaaagctccagacagcagcagctgcagcaggcttctgctgcaaactggactatgctgggcgaccatgaagacgacgacccctttgatctccaggagattcgtcttggctttggaattcacaggctgagagatgctgtgttgagtttcatacccgatgaccatgtcgacatcgagcaagattatgatgactacactgatcc

SEQ ID NO: 226 - DNA, 475 bp, Hordeum vulgare
  UNSURE (22): n stands for any base
tctatatgcttataaggtgccncagatggggcggctacaaaagtaacggaacagagaatcataagaaagaataattcaaggctggatttatttgattgccactttcaggccatgatcaattgtaatttgctccttgcctcctgctattctgcgttcctcttccaccaccggagtttgaattacggttgcttcttcctcttctctcggtccatccaccattaggccgagaggaaccacctgtattattactatgatgatgaggaccagcactggtgtcacggtaagatgcaccgctgctgtcctcgatccgcaagctactctccaacaccatgtcaaccatgtgatcgttgaaatgatctgcggatgtcattcctcttgctctcccgcgctgacgccgaccaccgcggtaaccaaaatctggctcctgatgggttgtgttgtcaaagaatgtatccataatgtcatcagaaaaaac

SEQ ID NO: 227 - DNA, 525 bp, Hordeum vulgare
  UNSURE (8),(14),(15): n stands for any base
gattacanttgtanntgggatatgaatctgaatagtcacatctattctgaatttgtagtcaccatcaaattgccatctaaagccaaagattccatcttcacccaagaagattgtcatgattcatctgatgcttcactggtcttgagtccaagttcagccgacagtgtatcacaggacatgaatcttgaggcatctccagcattgggtggtcagtatgaagcccccatgttaggagattcaatggcaaaagctccaagtacaccttggatgcctttttccatgctatttgcagctatttcgaccaaacttcctcgcgagaaaatggacatgatcaataactgttacgaagaattcaaggcgaagaaaataagcagaatcgacctagtgaagaggttgcggctcatagtcggtgacagaatgctggtatccacaataattcggctccaagataagaataagcttgtgtttctcttttaacagttgcctccgatggcgaagcgggaagcagcaaatgtgccagcagcc

SEQ ID NO: 228 - DNA, 550 bp, Hordeum vulgare
agaattaagaaaaataacataaaatgagaattatttaactaaactcaatgttgattggacaaaaaccaaactaggagggtaaacaaggagcttctcccttgtaaccatcttgggttcacaagtatactcggacagttccctctttgcaactactaaaacagacagacagagcggcagattcatagacacacgcaaataaactcaggagactacattccttccaactcatgataacaagtcgaccagttccttcctccaatccaccatggtcactgacctcgtgccttggctgctggcacatttgctgcttcccgcttcgccatcggaggcaactgttaaaagagaaacacaagcttattcttatcttggagccgaattattgtggataccagcattctgtcaccgactatgagccgcaacctcttcactaggtcgattctgcttattttcttcgccttgaattcttcgtaacagttattgatcatgtccattttctcgcgaggaagtttggtcgaaatagctgcaaatagcatggaaaaaggcatccaag

SEQ ID NO: 229 - DNA, 422 bp, Hordeum vulgare
cagcaggtcctccagcagctcagcgccatccgcgccaccgtctcccacctccgctccgccacccctcccccgccccccgagctcgtcctctactcgcgcctcgcccccgtcgcctccgcatgctccgcgcaccccgacctcctccaccgcttcatgacctacgtccccttcgcttcctgccccgacgacgtccacaccctcgccgagcctctcatcctccgcggctgccacccgctccccaggcgccgctgcttctccccgacgcccgacgccggatccgtccagctccccaccgaccccttcgcgccgctccccgactccgccgtgcgctggccgacggacgcgaagaaatgcaggtccttctcttgcctgccggcgtcgctcgggttcgacgtggcgcggacggaggctggcaagttcct

SEQ ID NO: 230 - DNA, 393 bp, Hordeum vulgare
ttttttttttttttttcgatgaaagatctcttaaaaatgaatggtaacggtttccaaccttgctacacatcactgcattttgcagatcgttgattgcacatcaaacagcatatggcactagtgggaaggaacgtgaacgtgccgatcatggatgaaccacaaaagctcccaacacttgcagagatcagataagcatgtgtccacatctgcagcctggctagaatggcttctgcagcagtgcggtgaggtagacgagctcgtccttggcgccgttgccggtcttgtcggcgacggcccacttgatggtcttgtagcccagcctccgcagcatggctgcgtacacgccgtcgaggtcgcccttccggcaccagaggtgatccacccagagcagcc

SEQ ID NO: 231 - DNA, 876 bp, Hordeum vulgare
  UNSURE (1),(14),(27)..(29),(33),(38),(39),(47),(49),(50),(70)..(78),(83),(88),(89),(109)..(135),(143),(150),(151),(168),(180)..(257),(268),(269),(271)..(274),(288)..(290),(292)..(311),(326)..(340),(342)..(370),(372),(373),(375)..(380),(382),(384),(455),(487),(491),(627),(628),(716),(835): n stands for any base
ntttgtccactggncccccaatggggnnncctncatgnnccgtaaangnnttttgcggatgcccaaaaannnnnnnnnttttnggttnnggggggccccccaaaaaccnnnnnnnnnnnnnnnnnnnnnnnnnnngggggggnttttttnngggggggggggcccccncccaaaaaaaannnnnnnnnnnnnnnnnnnnnnnnnnnnnnnnnnnnnnnnnnnnnnnnnnnnnnnnnnnnnnnnnnnnnnnnnnnnnnggggggggggnngnnnntttttttttttggnnngnnnnnnnnnnnnnnnnnnnnggggggggggggggnnnnnnnnnnnnnnntnnnnnnnnnnnnnnnnnnnnnnnnnnnnntnntnnnnnntntntaaaaaaaaaaaaaaatttttttttttttttttttttttattttttttttttattttttattatttttttntttaaattttttatttttttattttttttttntatntttttttttattatttttatttattattatattatatattttaatatatttttttttaattttttttttttttttttttattttatttattattttatttaattatattttttttttttttttatttttttttttnntatattttttttttttttttttttttttttttttttttttttgtattgtaatttttattttgtgttttttttatatgttttttttgtnggtgttttgttggttttgtttgttggggttttttttgtttgtttttatttatgtgagttatttgtttttttatttttaagttgtttttataaattttttatattatttatatggttttnattggttttttttatttttgttaattaggtgggggatattt

SEQ ID NO: 232 - DNA, 550 bp, Hordeum vulgare
tattatatttcgcgtgctcaaaactacttaaacctagtatcttggcttaatatggaaagtcgtcatgtgaaatactcgaccatggcacgaatcatcactaaaatctctcaatgcacctcaggtccaaatcaagaactgtttttacatgtatctgcggtaacattagcactctgcagaactttttctcacagcttcttttctgctgccttctgactgtactcgtgcttgagaaggttcgccctcagaagcatggacttgacatctctctcaaactcgttgcccgtctgcagtgcccgctggaaggttgcgtttctttgatcggcgtgacttgcgtacaaaatcttgttgtgcgagtctatgcgagcctgtatcttgttatcggtgataagcgctgccaactctttctctaacagggacacagaggtctggaaggcaacagccatcaagttgagatcaacagatatgaatgggaatgtgtactgaatgatggctttgtggcgaatgtccttgtacagagtttcgatatgctcgtgcaaatgcatatccagca

SEQ ID NO: 233 - DNA, 541 bp, Hordeum vulgare
  UNSURE (4): n stands for any base
gggnctgcaggcaattcgttacgaggcaataatccgtagttccgatccgcaaggcctgcgacgatggcggcttccgtccgcgaggcgtcgatgaggatcctgcgtccggcgggtgaggggcttcgccggctcatccacgccccgcagcattccggatccatcagtgtctttggggaaggctaccgcgcaacgcaaatccagcagtcaaaagaggacctgtataatctcatcgctgacgcccaggccaattctgcggcttctcaggaagacaaaatggtgctcaagactctctgcacacatgtcaagcccagaccacatgaccctcaatggcgccggataactactgccaagaaggtgaccaagtggactgcaacatcaattgtgcttgctacttgtgcgatcgctttccctgccttagccaaccgccctgactatcgtgttactactgcatgtgagcagaagacagtggagcaatgcaggctgcctgagagtgtggcccagcaaggggtgcagaagccttagaagcaagtgaagggaagac

SEQ ID NO: 234 - DNA, 552 bp, Hordeum vulgare
gcctagaagaatgcatgacatactagtgcagaaaggataacataccatgtcagcaacatcacaaattatcttacaatgcgaccagacatatttcaagagacctaactaacatagtgctggaatagaactgatatccgtcttgcttctccatcaaacaagatgtattttgtcttcccttcacttgcttctaaggcttctgcaccccttgctgggccacactctcaggcagcctgcattgctccactgtcttctgctcacatgcagtagtaacacgatagtcagggcggttggctaaggcagggaaagcgatcgcacaagtagcaagcacaattgatgttgcagtccacttggtcaccttcttggcagtagttatccggcgccattgagggtcatgtggtctgggcttgacatgtgtgcagagagtcttgagcaccattttgtcttcctgagaagccgcagaattggcctgggcgtcagcgatgagattatacaggtcctcttttgactgctggatttgcgttgcgcggtagccttccccaaagacactgatgg

SEQ ID NO: 235 - DNA, 526 bp, Hordeum vulgare
cagagaatccgcagtagctcaaagagtgctagaagaagagaaggctgcggagaaagccaaatctgagggggcgaaaggccctgagccatctagtacttctgcccttaaaaagacgcagaatacaaatagcagcatggtaacaaaagctaacggcaagataatagatgaagatggtgggattccagaagttggggatttagtttacgttcctaaactcaagaaccaagctaccatagtcaaaatagatccgtccaaaaatgaagtgcaagtccaagctggcatgatgaagctcaagctaaagttgaaagatgtcaaggtccagaagcagaggacatccagataaaacggttgctctgccctgcaacagtatatggagataagtatgtagatgttctattcaacatatagaatttcccattttgactgtactatagccatgcgattttagacccctagtttgcatgttcaatttgctgctttctctttgccatggtgtaaatgtaattgtttatgagatacttggtca

SEQ ID NO: 236 - DNA, 463 bp, Hordeum vulgare
tgaccgaccggagccattttatagtgatacatttgattgaccaagtatctcataaacaattacatttacaccatggcaaagagaaagcagcaaattgaacatgcaaactaggggtctaaaatcgcatggctatagtacagtcaaaatgggaaattctatatgttgaatagaacatctacatacttatctccatatactgttgcagggcagagcaaccgttttatctggatgtcctctgcttctggaccttgacatctttcaactttagcttgagcttcatcatgccagcttggacttgcacttcatttttggacggatctattttgactatggtagcttggttcttgagtttaggaacgtaaactaaatccccaacttctggaatcccaccatcttcatctattatcttgccgttagcttttgttaccatgctgctatttgtattctgcgtctttttaagggc

SEQ ID NO: 237 - DNA, 517 bp, Hordeum vulgare
tattggtgaccttcagcttttctataaagcatccaaacaaagatttgatgatgatgcagaatttaaagacagggctcaacaagccgttgttcggttacagggaggggaggaaaagtatcgtgctgcttggaaaaagatatgtgaaatcagcaggaatgaatttgaccaggtttacaagctcttagatgtacaacttgaagaaaagggggagagcttttataatccttatattccgcaagttttggagaaattgagtagccaaggtttgatcgaggaaagtgagggtgctcgtgtaatattcattcaaggtcatcaaattcctttgatagtggttaaaagagatggtggcttcaactatgcctcgacagacttggctgctctttggtatcggcttaatgttgagaaggcggaatggataatatatgtaacagatgttggtcagcagcagcactttgatatgtttttcaaggctgccaggatggctggttggcttccagatccaaaggaaaagaagttc

SEQ ID NO: 238 - DNA, 495 bp, Hordeum vulgare
tgcttcagttttcaaatgggggcaaccgactacaagagtatgttagtggtgccaactaggttacaaggacgaaaactgtaaccatggaaacatgcttgcgtggaaacaaatgtatgatgtaaaaggtcagacactggccaatcacagcttgtaaactggtgtgatcccaagcagctggaagcattgtcgcatgacgaccgccgtttttttttaaagcagtagccggcttggctcctccggtgacccaacaacctggcagtttgtgtagaacctcgtgaacatttcagataagttgtataggtattcacacagaacactgggaaggagattggtgcatgcctcttcaacaatctctgcataacggataagatacagtcccaagacacgctcatctggatgagcaagagaaatgttcccactcacttttagctcttctacatccatgttggattttcgaataatggagcagatacgagcatgagcatactgaagata

SEQ ID NO: 239 - DNA, 522 bp, Hordeum vulgare
  UNSURE (35): n stands for any base
tggtctctgcacatccaccagctctggcatctgcntagcaaaaaagtaagcttcaccatttcctcgcaagcaacatagagaaagaagaaaagaagaccactctgcactcctccatcgaagctcgtcgccttggtggcaagagtttcgtatcagtaattcagcatgcacatctttcctcaagtttatgcttcttcaggctagtcctcctcttgcaacaaacaattgacatcacctctacttactgcaggtgacttattaactgcatctgcaccaccatggacttcgccgtggacgcggcgctgtgggtggtgggcaaggcgctggcccccgtcacgggcggcctgctggagtcatgggcagccagcaccgagcttggccgcaacatcgacgccctcaagatgcaactgctgtacgcacaagggatgttggacaacgcgcagggtagggacatccgcagccctgctctcaaggagcttctgcacaagctgcgggagctggcgtacggtgccgacgacgcgctcg

SEQ ID NO: 240 - DNA, 552 bp, Hordeum vulgare
gacgggaagtgtttacccattgtttttgcagcgctgcgagcacaagagacgacattaggcatgcatccgccatcagcctcttggactccctgggtggtgcgtagcggtggtgatgagctgatatcatgcccaccacacgagccaacgacagagaggcatactcgtgtgccaccatctttctgatcgtcgggatcagcacgggtagaggatgacgagcacttaagtttaatgcctgcagccttggcagtgtgccgagcgttgatggctagcctgtcaacgcagttctgggcatccaaatcggcggcatggtatgtgccatcgagctcgtcctggatgcggaagtagtcgagctcgtcgagcgcgtcgtcggcaccgtacgccagctcccgcagcttgtgcagaagctccttgagagcagggctgcggatgtccctaccctgcgcgttgtccaacatcccttgtgcgtacagcagttgcatcttgagggcgtcgatgttgcggccaagctcggtgctggctgcccatgactccagcaggccgcccgtgacgggg

SEQ ID NO: 241 - DNA, 518 bp, Hordeum vulgare
  UNSURE (10): n stands for any base
cttacctggntatactccttgggaacctgcaatatcagtgcaaaatttgatgctaaaactatagagctcattgttacaacgtatcaggctgcgttgctgttgttgttcaatggatctactaagcttagttactctgagattgtaacacagctgaacctttcagatgatgatgttgtccgtttgctccattctctctcttgtgcgaaatacaagattcttagcaaagaaccagctggtagaactatttcgcccaatgattcttttgagttcaattcaaaatttactgacaggatgagaaggatcaagatacccctacctcctgtcgatgagaagaaaaaggtggttgaggatgttgacaaggaccggaggtatgcaattgatgcatcaattgtgcgtatcatgaaaagtcgcaaagttatggcccatacacagctagttgcggaatgtgtggagcagctcagccgcatgttcaagcctgacttcaaagcaatcaagaagaggattgaagatctcatcac

SEQ ID NO: 242 - DNA, 526 bp, Hordeum vulgare
agtaattcagtggggtaccgaggtgactcctctaatccagagttgcctactgtttctgacgatgcatgtacaaaatgagaccagcccgggaagatagcaaaccgaaatcccaaaaataagctgcaagcatcgcagcaagtccttggagcccgacacggcagctgccaccatcagcaagcttgtaacctacccaccaatactaattaagccagatatctgtatgtgttggcgttgtccttgtcccgctcgaggtaatccctcgtgatgagatcttcaatcctcttcttgattgctttgaagtcaggcttgaacatgcggctgagctgctccacacattccgcaactagctgtgtatgggccataactttgcgacttttcatgatacgcacaattgatgcatcaattgcatacctccggtccttgtcaacatcctcaaccacctttttcttctcatcgacaggaggtaggggtatcttgatccttctcatcctgtcagtaaattttgaattgaactcaaaagaatcat

SEQ ID NO: 243 - DNA, 517 bp, Hordeum vulgare
atttcctccgtcctcgctcggtgcgcgcgacactccgccggcccgtccccctcgccggcgacttctcgccctcctcgcggccgcccccaggcaggcagagcgtgttgcgacttgcgagccatggccggcgacaagaaggtgttcggcttcgaggaggtcgccaggcacaacgtcaccaaggactgctggctcgtcatcgccggcaaggtgtatgatgtcacctctttcatggatgagcatcctggtggagatgaggtgctgctggcagtaaccgggaaagatgcaaccagcgactttgaagatatcggacacagtgattccgcaagggagatgatggagaagtaccacatcggagagattgatgcttcaaccatcccagcaaagcgtacatttgtacctcctcaacaagggtcccatgtccaggccaaggataatgacatcctcatcaagatcctgcagttccttgttcccatttttatattgggtcttgcatttggtatccggcactacagcaaat

SEQ ID NO: 244 - DNA, 549 bp, Hordeum vulgare
ctcatatgttgagaatgtaactaattggagtacatctgggcatacatatggacgtttggaattcagagtgccttgtatgatcaataagacaacacactgccaccaaatgaaaccagccaaccaataccattattatgttgttctaattcaaaccatgttacttgaaagctatttctcagaagcaactcgccaccaacagcctactcagatttgctgtagtgccggataccaaatgcaagacccaatataaaaatgggaacaaggaactgcaggatcttgatgaggatgtcattatccttggcctggacatgggacccttgttgaggaggtacaaatgtacgctttgctgggatggttgaagcatcaatctctccgatgtggtacttctccatcatctcccttgcggaatcactgtgtccgatatcttcaaagtcgctggttgcatctttcccggttactgccagcagcacctcatctccaccaggatgctcatccatgaaagaggtgacatcatacaccttgccggcgatgacgagccagcagtccttg

SEQ ID NO: 245 - DNA, 1317 bp, Hordeum vulgare
  UNSURE (32),(625),(657)..(660),(663)..(673),(687),(698),(702),(755),(756),(796)..(798),(806),(812),(813),(817)..(819),(822),(829),(831),(833),(847),(848),(860),(876),(889),(896)..(898),(903),(906)..(909),(927),(929)..(931),(950),(951),(959),(962),(976),(979),(982)..(984),(989)..(991),(995),(997),(999),(1013),(1017),(1018),(1021)..(1023),(1026),(1028),(1034),(1038),(1039),(1043),(1045),(1048),(1054)..(1056),(1060)..(1064),(1067)..(1069),(1074),(1075),(1083),(1094),(1095),(1102)..(1105),(1108),(1110)..(1112),(1114)..(1116),(1118),(1119),(1124)..(1126),(1128)..(1130),(1133),(1138),(1139),(1141)..(1145),(1147),(1152)..(1154),(1156),(1158),(1159),(1161)..(1166),(1170),(1174)..(1184),(1188)..(1192),(1194)..(1197),(1200)..(1202),(1205)..(1208),(1210)..(1213),(1215),(1216),(1218)..(1223),(1227),(1231)..(1245),(1247)..(1249),(1251)..(1253),(1255)..(1262),(1264)..(1267),(1269)..(1271),(1273),(1276),(1278)..(1288),(1290),(1291),(1294)..(1299),(1302)..(1306),(1308),(1309): n stands for any base
tcgttttcttgtttttgttgattttattttgnctcatgacacattccgcgacgttttgggaggatttgttaggaatatctggcaaaaagggtgttatgtgataactgtcgccgctgcctgcgaggcaccagaccccgggggcgccagacaaacataacgacatcccacccccgccggtaatgtccctttatattataccctacccccacttcggtctttcccccacccacgacgtttgtgtgttttttgtgctgtttttcagtacacatttcgtgagcttttttttttatttgtccgtgctgtttgtgtggctaggatggagagttgcgttgacgagaacaccgatgggttcgccgccggctgaggtgccgcactatggcgtgcattgtcgaggagagaatgtgtcatcttgctctcacttagctggtgcgagttttgatagccattttagcaagtctctcacacatcgacccgacatcttgtgaggtagtgtcccttcacagtagagtgtcgaccttcggttatgattctaccaagcgtgccgtgatcaggatttcatatgggcctggagggattgacagattgggctggttccgcaactacagttcattcactcaaaacatcnttctattgtactcctgcgatctgcgcctttcnnnnttnnnnnnnnnnnccagatgaagattnccctggactcngcgncaaagtaccccaaagcggtgggagccatgcagaggcggcagttagggatttcnntcaatgggcataaaaggatggtgtgggtaactttttaggnnngggaaaangagtgnnttannntcncagcaangncntgctggcgagatgnnatctcaagtcgntgccagtgcgattagnagagtgatcaaangtaggannnggctntcnnnntccgagcttagccgactncnnntccatgatgaggagatcanngttgccanagnatgccgtagccaangangtnnnacccnnngtgnangnggatgagttccccngtgnngannnggnangatagngacnnaccnanttncacttnnncctnnnnnatnnnagttnngagccganatagccgaaanngctccannnngangnnnannngnnttccnnnannnccngattnngnnnnngnaaccnnntncnncnnnnnngaangttnnnnnnnnnnntgannnnngnnnnccnnngtnnnntnnnngnnannnnnnttcncagnnnnnnnnnnnnnnngnnncnnntnnnnnnnnannnncnnngnttngnnnnnnnnnnngnnccnnnnnngcnnnnntnnactgcttt

SEQ ID NO: 246 - DNA, 539 bp, Hordeum vulgare
tgagaatttaaagaattgtttggtacctagttgtacaaagggcggccaaggatgcgccacaacgcagtccacaatccctcgaaaaatgttgatgaatgaaacattttgtgattttaacatacaacatactctaaaaattacacctaaactaaccttccagcattaagatacaacaaaatacaacatggttcggcttttgccgctatcaactgtatttgccatcgggtagaccaaaaaacccgcaggtgtaattaccatttcgactggtgttcttggtttctagaatggagcaatagcagcttctcacgcccacagcagacaatcaacgcccagttcaaagtttgtcacgggactgtctccgaaatcctcgccttggttttggacctcatggtttgtgtcaacgtagggctccgataaatccattgaccttacagaggggatggcatgctctttttggatatctgacgatgcagctactgcttcttcccggtccaacacaacgaggaagtcgtcttcgaattcgaatgtcaagaacttgt

SEQ ID NO: 247 - DNA, 360 bp, Hordeum vulgare
  UNSURE (293),(299),(300),(305),(307): n stands for any base
gtacccccgggtctgcaggcaattcggcacgagggacatggttgagagcgtagatgacgagaagattgcaaatcgtcttgatcgggtggtagctgatttggggagaaaacctcttaaggtcttggtccaagtcaacacaagtggagaagaatcaaaatttggagttgatccctcaggatgtgtgggattagcaaaacatgtcaagttgagctgcccaaatcttgtattttctggtttgatgacaattggaatgcttgattactcctcaactccagagaatttcaaggcattgnacctanngttgncncggaaggaggtatgtgatgaacttggaataccggaagagcagtgcgagctgtc

SEQ ID NO: 248 - DNA, 556 bp, Hordeum vulgare
  UNSURE (48): n stands for any base
gttgcaaaaaaatgttaatattaatggatggaaatcaaaggatatgtntcgttacttttttaggctcccaagaaacattacaaggatgctactgatgaatcaggtagaaacaataatacaagttggaactccagtgctctctgaatgttctataacagcgggagacaccatgacaaaacaatatccttatttatttatggcacatgtgtagaacatcaaagggtaaatatcggtggaaatagatacatatttaccaccaatactgcagctgttagatgcacggtctcacagaaaaaccctgtaattatcctagttcttttttgggtattctcttgcaccaaatatggttgatccaaccctgacatttgtgctgcccatttcaatcgcctgctcaaaatcggcagacatgcccattgacagctcgcactgctcttccggtattccaagttcatcacatacctccttccggcaactagtcaatgccttgaaattctctggagttgaggagtaatcaagcattccaattgtcatcaaaccagaaaatacaagatttggg

SEQ ID NO: 249 - DNA, 1072 bp, Hordeum vulgare
  UNSURE (1)..(6),(16),(17),(20),(22),(23),(25),(26),(34),(37),(47),(51),(56),(70),(72),(79),(100),(819): n stands for any base
nnnnnnggggcaaaanntgngnncnnaaatgggnggncacaggcacnaggntaganactagcttaggttntnttttttntttctttaggggggaaccccncccattaaagataacctggttccaaccgaaaaaaagttttgtggccactaaaaggtgcttttccttctcaaacccattcggactacttttattagtcttatggcttcgcctattttttccgcttcgtatgcgcagggaggtctggtggattcgggcacctctatcggggggggggatttttccccgtttattatgtttccttccgacttttaaatatagctcactattacccccacttttctttctctgtttcatttaattttttgattgttaagtttttttcttcctccctcgcttttccgttttggttctttcctccccctcctgaccatttgaccctccggtcttcagaggccttccactttgcccctcgggttcgcgcaccacacccccacgtactattccttcatcctccttgagttgccgctccctgtatactcgatttccctcgcatatatctgctacgtttcgctcctcccactcctttttcccttcctcccagatttacccgacgtcatccctgacttcccatatttttatcccaccgttcctaatcgtccctcttcctttctcttgtccctcatcccctgtctttccttcactctccttcgatttttcccgtccccccttccccacccccccactataacacgccgtcctgtttaccccatcttcctattacccgagctaacacgcggtttctcgcactatatagttgnttatcattttatcttccccgttctctttctcttcaacttttctccttcgcccgatcctccgcgctattctaactttatcttacggcgtgtcgtatcgtcccaccctttgttacattctctttgttatcccataccgacctaatacattagtcatatcaccagcggcgccgcggctttgcaatcctataccttatagtgatctctgtgtctcaaagtccattttatttctgcccgccgccggttcccttattgt

SEQ ID NO: 250 - DNA, 559 bp, Hordeum vulgare
ggtattgaatttccagcccgagtctagattaacattgttaccaaccgcaaaaaaactttatcaattcagataaggcggcataacacgcgtctaacatttgtcaaacatgaaaaaatcacgacccggacagctttgacaggtttagacgaggaggcatgacgcgaatcaacgtttgacaaacatactaaaacatagtctaccaacacaagagttcagcccaagagataatgcaacaagattcaagttgcagatagtgctcggcattcaccgtcactcccacgcgctggggctccttccgttagtggcagggcggctatcacgagctggactcaggctgttgcctctcacaccgttatgtaaaccattgacttcagcttgctcccttggtgggtggctcttgccatttggtgctgggctgcggttcaaaccggaaggtgaagcactcctcctaggactgtaactagagcttcttggtcgcctttcctcatggccaacggcacaatcatccctccttgtataaggcgatcggctgtaactcctgcttcggctcattccacga

SEQ ID NO: 251 - DNA, 165 bp, Hordeum vulgare
agaaagcaggacggtactcagaaatttgtgaaagctgagatacgtggttatgaggagggttcaagattcttggttgcattccgtttggagcccacagatgggccgatcaggatcgagaaccggacaagtagtgcaactattggtactcgccagtctggtttaggc

SEQ ID NO: 252 - DNA, 271 bp, Hordeum vulgare
ctccctactagttaacactctaaccggtattgacaagcatcaagcagaaatacaaatcccagcaacagccaaaaaacaattgcaagctagcacattatctctccctgctgaaatgccatgctcaataacataatgccggccaaaactgtacaaaaacatttcatatccgagacaaactatcttgcaagaaattgctgggtctactcttttgtctagcaaagtttctcatttccctatattatattatacataccgctcctgatgtctccga

SEQ ID NO: 253 - DNA, 551 bp, Hordeum vulgare
  UNSURE (20): n stands for any base
gtacccccgggcctgcaggnaattcggcacgaggccgacctgcaggctccttcgtcggcgtctatgatggccatggtggaccggagacggcacgctacatcaatgaccacatgttcaaccatctgaagggatatgcatctgagcaaaagtgcatgtcagtggatgtgattcggaaggctttccgagcgactgaggagggatttctctctctagtcagtaatcaatggtcgatgaggcctcaattagcggcggtaggctcttgctgtctagttggtgtcatttgtgctggaactctctatgttgcaaatgttggggactcccgtgccattctggggagacttgtcaagggaactggagaggttgtggcaatgcagctctcagcagaacataatgcatccttcgaggaggttaggcgagagatgcaggcaatgcatcctgatgatccccacattgtggtcctaaagcacaatgtttggcgtgtgaagggtattattcagataacaaggtccattggagatgtgtatctgaagagaccagaattcaacagagaa

SEQ ID NO: 254 - DNA, 544 bp, Hordeum vulgare
cgttgtagatcgtgttgatgagagctcagcagattaagcatcaagaaagcaacctgccacatgtccaacattagccagccttgagatggcagcactttgtgaggggctaaacaaaatgaaatggtgatgagatgaactattatcacaagacgatccggagaatgtacactaagaataatctaatcttataccttgccgctatcagtacactagtaaccaggttgaatctaaaagttttttcttcttgcgaggacgcacaggaaacaagctacacttgaccttggctgctgctcttcttcttttccatttcttttctggtcttcgtgtcttcttgactccagtgaaagggctaggaacctgagaatggagcaagggaatttgcagggagcgcaacgccgccacctcgcagagaaactgtgggacggctccaggcgtccatggctatggcattcgaatcaaaaaataccaccacgaccgttatatcatcatgaaagtggcgcctcactccacggtcgattttcttgagatctgaataacgcatctc

SEQ ID NO: 255 - DNA, 518 bp, Hordeum vulgare
gcgctctgcgatttgcttgatgcggacgggaaggagagcctggagctcgccgtgtgcaaggaggctgccggcaagtcgccgcgcgcattttgggccttccggagactcggctacttgcaggttcatcaaaataagtggtcagatgctatacagagccttcaacactcaatacgaggttatccaacatgtgccgatttatgggaggcacttggtctggcttaccaccgtttgggcatgtttactgcagcagtaaagtcatatgggcgagctattgaacttgatacttccagggtctttgctttgattgaaagtggaaacattcagctaatgcttggttatttcagaaagggagtcgaacagtttcgttctgccgtggagatggctcctcataatcattctgcatactttggacttgcttcggcattgcttgcgtggtcaaagcattgtgtaactactggggcctttacctgggcagctaatctgttgaaggaagcatcagaaactgctaaagtttgcac

SEQ ID NO: 256 - DNA, 554 bp, Hordeum vulgare
ggttccgctaaatcggcttgcatgggcagtctcaactcccagctcctaccactagagggaaatgttagaaagaaactatgtttacaacaacaaatacacttcgccagagcacctcatgggctcatagcaaagaggtctacacgacacaaattacgctacaactgcgttaaactgattctgctacgtccgtctcagctacaagaccgaggctacacgtacacaagctgcagcaaggccttccagtacctggagcacgacgggttctggtgtatcgccctcagaagccacgccccgggactctgcatcgtctccaccagctgctgctgcttcttccgctgggggcctgccagcaccgcagtcgactggctcgccagcaggtgcatttggaagtagagctcggcaggccgcagttctgggggccaagagaaccactcgaggcgaaggttcttctcccacttggctttggagccgaggctgccttctgcttgggccagtaggagtgacacgatgggtacggcagcttgagacttctgctgcgcctttctgaggctcga

SEQ ID NO: 257 - DNA, 523 bp, Hordeum vulgare
  UNSURE (140): n stands for any base
cttccgaggaaactgtcacatggcatgtatatatatatatgcataataacaagcactggtttgctcatgcatccatcacacataatctaggccaataaaaccaccattacaagttcattaacatatatatgtatatatanactcctcaaacaaaacagaaacaccgctcacatcgacgccatcctttttattccagaaacattcagtacttgcttattattaagaccgcgcgctgtttgaaccaacaaacttcagcatatgcatcgttcaccaggcaacgatcttccagcgctggttgtcgccctcagtccactcccacagaatgagggtggttccatcgcgcacaccgccatggtccttgtcgccatggagcgcatcaaagttcaagtagatgttgttcaccatcctgatgcagcggtagcctgccccaacatccctgctctcggtccaaaggaccgactcgtccagggtatctggattgtacctggtcagaagaacagggtgggactggccgagggagtgc

SEQ ID NO: 258 - DNA, 536 bp, Hordeum vulgare
aatggtcacccttcagaacagcattatatatcagctgacatgcatactaccgctagatacaaatattaccctgtaaacctgaagtgctcgacatgacaagagcgagttcacaaaaatttacagcaaaactgcacaaaaacagcctgtcccaaagaatcctaacactcataatacaaacagctcacagtatgcataaaacattctctaatggccaccatcagcaagaactccctcttccgctgctttacctccacaagaccttgcaacagactcaaacagcctctcaatctccggcgcacagcgtgtaaaggatcgagcccaaaagctatagcgtggattctttatgagctcaatgaaagtaataagtaatccccagggatgaggacgattaactattaggcgctctaaaagaactcttgttatctgctcctgtacaatatcctgtgttgcctcagcaaacaagtacaaaatgatgaaggagaagtagtgggtatgattgtttggatagcgtagctggttagcaatcgcgttcagga

SEQ ID NO: 259 - DNA, 420 bp, Hordeum vulgare
ctggactcccacacaggaaccatcactccgcactgcccactcgtcagatccacacacacaccacagcgcgcggcatgggctccctcccctccctcgccgtgctcgcggcgcttctctgcttcctggccgtcaccggcgccgtggacctcaacgccaccgacgcctcccccttcgacgtcgacctcaacgtcaccgacgccaccaagtactggggaccctggaccccggccagggcgacctggtacggccagcccaatggcgccggccccgacgacaacggtggtgcctgcggcttcaagcacaccaaccagtacccgttcgcgtccatgacctcctgcggcaaccagccattgttcaaggacggcaagggatgcggctcatgctacaagatcagatgcaggaaggaccaatcctgctccg

SEQ ID NO: 260 - DNA, 365 bp, Hordeum vulgare
ttttttttttttttttttttttttttagtagtagtagtaacaatatactttcgattaatatcaccgccttgaatgatactatataaattataaaaggcgagagtgggcgggagagcgtatcttgtacgcctgcctcctccattttcccacacagcccttttcccatttgccaatacacgactcatctctcacttccctacagaccgagacccaactccacggacgcacccgcacccgcacccaaccaaacctttttctcacctagaaagacgcaccgacaccacacacccacccaaccagatacagtttacaacgactcagcgcgacgcaaggacggaccgtacactcccaatgacttgaccgta

SEQ ID NO: 261 - DNA, 517 bp, Hordeum vulgare
gacattatgatgagtccggcccacatgcagaaggtggaggagatgaagcagctgttcgagaagagcagcagggatctgagcaaggtgctggacatctacgaccagcggcttgaggaggccgagtacctcgccggcgacaagttcaccctcgccgacctctcccacatgcccaacgccgaccgcctcgcctccgacgagcgcactgcccgcctcatccagtcccgcaggaacgtcagccgctggtggactgccgtctcgagccgcgggtcctgggtgtacgtcaagagcctgcagcgcccgtcgtccgccgaggcgccattctgatctccatgcgcgatcgccgtcgagaaggtgctgcccacagctccatcaacaccatatccgtggcatttccgttcctgcgcttcacagtttcgattgatatctttgccctttccgttgttctgaataatctcgtatacgttgcgttcttcttcatcggcatgggtgtttcgcccctgccttcctgctgttgccg

SEQ ID NO: 262 - DNA, 554 bp, Hordeum vulgare
agcaaggggaaaagccattttattacgcttattattacacgattcaaatgatctttcgacggcaacagcaggaaggcaggggcgaaacacccatgccgatgaagaagaacgcaacgtatacgagattattcagaacaacggaaagggcaaagatatcaatcgaaactgtgaagcgcaggaacggaaatgccacggatatggtgttgatggagctgtgggcagcaccttctcgacggcgatcgcgcatggagatcagaatggcgcctcggcggacgacgggcgctgcaggctcttgacgtacacccaggacccgcggctcgagacggcagtccaccagcggctgacgttcctgcgggactggatgaggcgggcagtgcgctcgtcggaggcgaggcggtcggcgttgggcatgtgggagaggtcggcgagggtgaacttgtcgccggcgaggtactcggcctcctcaagccgctggtcgtagatgtccagcaccttgctcagatccctgctgctcttctcgaacagctgcttcatctcctccaccttctgcatgt

SEQ ID NO: 263 - DNA, 942 bp, Hordeum vulgare
  UNSURE (42): n stands for any base
gtacccccgggtcttgcagcaattcggcacgtgggtacacanacacacacacacagagacagagagagagagagagagagagagagagagagagagagagagagagagagagagagagcactcccgtgtatattgtgtgccccctctgtgtgtgtgtctctgcgtgtgtgtgagagagtgtccaccctcccccccgcgggggcgccccccccctctgcgaaaacacccccccccgctctctgcctctctctctctctccctatactctctatacacacacacacgtgtgtgctccacactctctccgtgtaacacactctctctctctccatatagagttttatttccggtgtatatctctgtgtgctcctctctgcgcacacatatagcgctcttttttttttttttttttccccccgcgcgcacacattgtgtcacacccctctattctcactctttctctcgcccccctttttgaccctcgtgtgcgcgccttatatgtctctctcactcactttttctatcgccgctctttatcctctcgcgcccccggttgtgtgtgcgagacattttttctttgtatatacgggctatctctctcttcttgttattgtgatctcactttatggtgcccgccccctcactcaccgtctttctttttttatatttttactcccccgcggccctcccccattgttgtttttttgtttccccatatttcttttggctttttatttttgctgtttctctttcccaaagcccagcgagttcagtttctcctctctttctttttttttaccacttcctgtgtttgtcttcttctcccctctccccaaccataatctctccctcccttttttttgcgtcgtcttttgtcagtttgtctctctcgattcgcctggcgctgctcctcccttaataatgcttccttctccccctccc

SEQ ID NO: 264 - DNA, 484 bp, Hordeum vulgare
gagaggtatcatgacgtcttatattagtttacagaaggagtattacaataaagcacatggtatttttacaaagaagtcaaagcagtagcgtcgatcagtattttactgggactgcatatccacctagtccctttattctcgaatccatatatttgaagtctttgatcataagatgctccttagtttatgtggtctgcaaggagagcctcaatagctgaattcttggcatgtacatcctcataccggattcggtagccatgcccaggtaaaaaccactcaaaatcgatgaccagtaacttcctgatgctgtccagctgcacacccactgattgcttactgtacatcagaaagaggtttagatcatctgactcttctgtttttgcgacatggtcaccagtaaatagtgccttcaaaggtttgtacaacaaacatactgagcctttggtatgccctggtgtatgaataagttcaaaatcagttccaa

SEQ ID NO: 265 - DNA, 300 bp, Hordeum vulgare
  UNSURE (44),(224): n stands for any base
acgccgccgcttcacccccgctgacctcgatcggagctcttttnatggagggggccttcgccaaaaaaattccctgccggagatccgtaccctaggaaggaaggaaggaagggaggaaggaagcagggtgagttgtggtgattttgtggtttggaggggtggtgatacagtttttttggagcttggagtcaggagatttagaaggaaggggggggggggagcanccccacccccccgccaagggaccgcaggatgcgtactgaacgcacctcgtatcgtgacgaaaaaaaaaaaaaagac

SEQ ID NO: 266 - DNA, 555 bp, Hordeum vulgare
  UNSURE (25),(26): n stands for any base
taagcatacacacttatttatatanngatccattctcgacagaatgaaccagttaagaatagctgaaatcacaatttacagataagcacttggtattcactaatccatgaaaatagttattattcaaaacacagggagatcgcaagggagtctgatctgaaaaggccctagaagccattcagtaaccacgagagtaacaagttgcagaaagctagaaacaactggaatacttaatcccttgacattcaaaaacatgaagaatgtcaaaatgatgattcataacacgatcgatcaaaaggaccagtcatctggaagaactcttggtagtcgttcagtaacggcgtggagggaaccggtccaggagcctcccagatggacactcgtaagccatgtgaccacgaccaccacagttgttgcagatcatgaaggcgccacccatgcagtcacggctcatatggccaacctggttgcaggcccggcagaccatgtcactgtagccaccacggaagagagcaccgccgccaccacggaagggagcatcgccaccacggaaca

SEQ ID NO: 267 - DNA, 541 bp, Hordeum vulgare
  UNSURE (3): n stands for any base
ggnctgcaggacttcggcacgaggcgggagtctaaaacttcggatttaaaggtgtttcaggtgctgtaactgaaagaatccagcgagctcatcaacaaaaagattctccgatgatgttgctctttcctgagggcacaactacaaacggggattatcttcttccattcaagacaggagcctttctcgcaagagcaccagtacaaccagtcattttaagatacccttacaagagattcagtccagcatgggactccatggatggggcacgccatgtatttctgctcctttgtcaatttgtgaatcatctagaggttgtgcatttgcctgtgtactatccttctgagcaagaaaaagatgatcccaagctctacgcagacaatgtacggaaattaatggcagtggaggggagtttgattctctcagatcttgggttagcggagaagagagtgtaccatgcagccctgaatggtaatagcctgccccgtgccttacaccagaaaggtgattgaaatgtatcgccgatgcgattcgtgtactgaca

SEQ ID NO: 268 - DNA, 547 bp, Hordeum vulgare
gagtgtgtgaaaccccggagtcgtgtaaatttgttgctgatgttactgaatacaacagttagttgattgttttctacagtgaaatagcagggtatattacaatgctcccgaggattccatgtaacacacccaccttctatttattgttacaagcaagtcactcaactgtcagtacacgaatcgcatcggcgatacatttcaatcacctttctggtgtaaggcacggggcaggctattaccattcagggctgcatggtacactctcttctccgctaacccaagatctgagagaatcaaactcccctccactgccattaatttccgtacattgtctgcgtagagcttgggatcatctttttcttgctcagaaggatagtacacaggcaaatgcacaacctctagatgattcacaaattgacaaaggagcagaaatacatggcgtgccccatccatggagtcccatgctggactgaatctcttgtaagggtatcttaaaatgactggttgtactggtgctcttgcgagaaaggctcctgtcttgaatgga

SEQ ID NO: 269 - DNA, 519 bp, Hordeum vulgare
gcaaccctgagttcttcgccgccccctcccctcggaagaagcttcgccgggagagagatccccgccgagatggggttcatcggcgaccaggtggagtcgatccggtcgatgcaggtccgccaggtcctcacgcagatcatcagcctcggtatgattgttacctcggcattgatcatatggaagggattgatggttgcgacagggagcgagtcgccggttgtggtggttctttctggtagcatggagcctggatttaaaaggggtgatattctgtttttgcacatgagccaagatcctatccgcactggagaaatagttgtttttaatattgatggccgtgaaattccaattgttcaccgtgtgattaaggttcatgaacgccaagaaagtggagaagttgatatcctcacgaaaggtgataataattttggggatgaccgacttttgtatgcacaagggcagctttggcttcagaagcatcacattatgggacgggctgtaggctatctaccatatgtt

SEQ ID NO: 270 - DNA, 542 bp, Hordeum vulgare
aagagactgttgcataagagctgggtttaggcttttgggcagagacaactgtaggaacagataaaaatacatcgtccagttggtacacggcgcaacaaaacttgttctgccctcgattacatttgcactacaagatcaaaccatgcacaaaggttgacagcttcactctttcgatgttatgaccagcaggcccagcgcgccaatcagaaggtacttaataatcggcttctcagtcatcacaatagtaacccacccaacatatggtagatagcctacagcccgtcccataatgtgatgcttctgaagccaaagctgcccttgtgcatacaaaagtcggtcatccccaaaattattatcacctttcgtgaggatatcaacttctccactttcttggcgttcatgaaccttaatcacacggtgaacaattggaatttcacggccatcaatattaaaaacaactatttctccagtgcggataggatcttggctcatgtgcaaaaacagaatatcaccccttttaaatccaggctccatgctaccag

SEQ ID NO: 271 - DNA, 549 bp, Hordeum vulgare
gtacccccgggcctgcaggcaattcggcacgagggggcagaccgtgaaaattgcgttctcacccaagtgagaagatagatgaagcgagggctgcaggagctgatattgttggctcagatgacttgattgaacaaataaaaggaggattcatggagtttgacaaattgattgcatcacctgatatgatgcctaaggttgctagcttgggtaagattctaggaccaagaggattgatgcccaaccccaaagctggcactgtttctccaaacatcactcaggctatcgatgagttcaagaaaggtaaagttgaattcagagttgataagacagggattgctcacattccttttggcaaggttaacttccctgaagaagaccttattgcaaacttcatggctgttgttcgctctattgagaggaacaagccatctggtgcaaaagggatatactggaaaacggcatatgtatgctcatcaatgggaccttcaatcaagctaaacataaaagaaatgctcgactatggcgcagattcgtctaactagatgtcac

SEQ ID NO: 272 - DNA, 550 bp, Hordeum vulgare
  UNSURE (69): n stands for any base
tgagctcaggatgacatttgactaatgatgaacattacaacaaatatcaggcaaaaggacatctataangtgcatgcataatccgctcataaatacaaacgtctcgcctgtttgtcgatcagggcattgtttaagtgctgatgttggatgcccgtgaaactaaaaaaaactgtacctaagcactcccagtcttcccccacagtcgtgtttctcagtgtatttatcacaagggatggatggtcaagcctgtgaaattggtaagcaaatgcccagtgacttaattggtgctcgtggtgacatctagttagacgaatctgcgccatagtcgagcatttcttttatgtttagcttgattgaaggtcccattgatgagcatacatatgccgttttccagtatatcccttttgcaccagatggcttgttcctctcaatagagcgaacaacagccatgaagtttgcaataaggtcttcttcagggaagttaaccttgccaaaaggaatgtgagcaatccctgtcttatcaactctgaattcaactttacctttcttg

SEQ ID NO: 273 - DNA, 552 bp, Hordeum vulgare
gtacccccgggcctgcagggaattcggcacgaggcctcgtgccgaattcggcacgagggggaaagtgcctcctccgcctaccctcttctccctctcctggtctcccgtcggacggtggcggcggtggcggtggcggcgcgggtttcctcgccctcgccgtgtcggtttttctctctctttccgggcatcactttagcgccctacctataaatctagcgggaaacgattgacttaaagtcatggatgggaacaaagatgaggccttgaggtctgtcaagcttgcacagactgcgcttgcatctggagatagacagcgggcagacaaatttattcgaattgcccaaagattggatcccagccttccaattgttgatttgttgaccacaaccaagaagtttgatcccctgaatctgaatggtactgcttgccaagacaagaccacaggaggccatgaaaacctaaaaacgccaaaagaatgtgctggtccttctaatgttgataaaggttacaccgaggagaatgttagagttatccgtgatatcaggaagaaca

SEQ ID NO: 274 - DNA, 555 bp, Hordeum vulgare
ttttttatttaaaaggttacagtcacgttttctaatcttcatttcaaggggtttacagttgttcagaaggaacagcagctacaaccaacccagagaatttcaactcaacagtggtttcaggcagtacaatgacgatctcatgatcgctagccatcattcagagtcgtatatgtacacaattttgcacagcaaatataggtgggcatagcatgataatctgcacaaaatcttgcactcagcaactacaggcgggcgtagaacgataatctgcacaaaattttgcactcgcaggtgtagaatggtaattgctccagaagaatgacagcctgattgaactccaccatgtacacgctagccagccatcaaagcttcttcatgtagcagtcaatttactggttcataatatgtcatcgatagggcaccagacaaactagaaatatattgctcatccttttccataaaatcttgccatgttacaccttcaagagagtgaacttctgcaagaccgcaaatgagacaacaaactaatcaccatgtgggcactattatgccaca

SEQ ID NO: 275 - DNA, 518 bp, Hordeum vulgare
tcctcctccgccgccgccgccgcagccgcgaggcgcctgcagtcccgctacgatctgtacatggggtttgacgacgcggacgccggcggggacgaggtggaggcgcgcggggcggaggcctacaactgccccttttgcggcgaggatttcgatttcgtaggcctctgctgccacatcgacgacgagcacgccgtcgaggccaagagcggggtatgccccatctgtgctacgagggttggggtggacttgataggccacttgacaatgcagcatggaagttacttcaagatgcaacgcaggcgcagagtccgaaaagtatctcctgggtcccattctttgctgtctttgttgagaaaggatttaagagacggcagtttgcagtcctttcttggtggatcatcctatgtatctaatcctcccgccgcagcccctgatccatttttgtcatctttaatttgtagtttgcctgtggctgagccatcgaaagattttcgttccgactcatctgacaaaacatt

SEQ ID NO: 276 - DNA, 550 bp, Hordeum vulgare
  UNSURE (17): n stands for any base
tcaaatgtaccacaatncgaatatatacataaaacatcaaagcaatctcacatactaaggatgagatgagtatacaacacacttattacattgatgaaacacaacagaatctgatacatgacgagcccctcttttgtatatgcacaatgccactacaaggatagtatcctcatttattccatgttggaaagctgcaacacaaagccttcctccactattctcatgttgcgctctcggcaaggcatacataaatacatatacattcataactggatggacctccggtcgatcgttaaggcatgtgagcggcagtggcagcatgaacaaggttgcagcactctagataaattctcttgtgtagagtgccctcgactatgtcatgcaaccactatcaaagtcgatctcccttacatggtatcatcatcaaatattgtggaaagcacaagcccacgggcaaatgcactcctttgagcacgctccttctgatccttctcggacagagatgtttcagctctctctacgatcttttcatctgggaatttatttagca

SEQ ID NO: 277 - DNA, 521 bp, Hordeum vulgare
  UNSURE (1): n stands for any base
ngggccgagccccaacgccccaaacccctcgccctcccaaaccctaaccctaaaacctcggccctcccgccgccgccgcccgattcccctccccagtctccgcatcccctgttcggattgaagcgatgtcgtccgacgaggaggtcagggaggagaaggagctcgacctctcctccaacgaggtcgtcaccaagtacaagaccgccgccgagatcatcaacaaggctctgaagttggtattgtcggagtgcaagccgaaagccaagattgttgacatttgtgagaagggtgacaatttcataacagagcaaactgggaatgtctacaagaacgtgaagaggaagattgaaaggggcattgctttcccgacatgcgtatccgtgaacaacacggtctgtcatttctccccactggcaactgatgattctgtactcgaagaaaatgacatggtgaagattgatatggcttgccatattgatggatttattgctgtggtagctcatacacatgtcatcaaagct

SEQ ID NO: 278 - DNA, 544 bp, Hordeum vulgare
gatactttcattagacactttaaaaaaggtactcaaatccccacagctgaatgtaatataacacaatcagatgcagcaaaggagcaggtacaaacgtaacggaagcaattcaaaaaaatacgaattattcctggcttggtgcgtccttagaaacctccatgggctctgcggcttctgctgcatctcctttcttgcctttctttttcttgccaccacccttcttctttgactttgtgcccaaagcaagccaagccttgatctccgcatcatcctcaatggattttgagggctccaactgctgtagtggatgtgacgtgatcttgtcagacccatttggcatcaacaacacggtgaatttgatgtgggcaacaaggtcgccttgcttttcatggagaacagggtatggctgcaacagctcatgattcatgcattctaccaaacctaagcgtgcacgcttctcctccaacgccctagcagtgaatggcatgattgggaacttctggctaatctcactgaagatgaaccttgatgccttcatcttcaa

SEQ ID NO: 279 - DNA, 1190 bp, Hordeum vulgare
  UNSURE (1)..(27),(125),(501),(547),(548),(557),(583),(592),(611),(614),(621),(633),(662): n stands for any base
nnnnnnnnnnnnnnnnnnnnnnnnnnnaacggggcgaagacgtgacacctatgttactcccccgaatacgtggcgagccacttcggacaacgcgagtgctccgctaagggagtcagttgaccttncgcacctcgggccaacccgcccttccgcctaccacgttaccatgtaagcgcgcttagacgctgtcctatacggagtacgtaaccccgaacggccgagacgaggcagttaccctgtcactcccatagtactagacgttctaacttcgtgagtaaggctcaatcgcacaggcagtcatagagcggtgtggatcattatctttccttaggccattcgtcatacgaacggcaagtgcccatacgtatctaacttttcactcggtatatgatctcctttgtgaatttttttttcttcactaaagactgaagaattatgtattattgccttatggcgtacgttgctaacccatttttttgtcattaatatttttgtaacacnccccctttgggtttttttttctcccggggagtttcttgggccgagnncccatatcncgtgtttctacggttgtggcttttgngaacccgtnccctatcgacaacacttcnaancgggccnaccacaagtttnttttttacacgccgttttgggggtttttnctggacttgttaggccattcccaaatggggattcttgcctaattggccaggaaattgccaccaagggttccttcaaaagaagaaccatggcccaaattcaattcttttgggctttggggaaaacaaagggaaccaattttcttttattgggccaactttaaaaaagaggggaactctgggaaaaggagaaagcccttttccccctttaaaaaggtgcgggggggggtttttctaaagcgccccctttttaagaaaaacaaaagcttgtttttaaaaaaccttaaaaaaaagacagggccccattttggggcacaaaagggggaaaaaaagtttttcaaaaaaatgttggggggcgggaatctctcagggttttatttgggcccccccggggggggggtaaacaccccctttttttaatatgttaactcccccccaaatttgggggggtttttttttttctcccccaagggggggaaacaacaatctgggggggacccccctttttcttttttataatgggggccacgg

SEQ ID NO: 280 - DNA, 436 bp, Hordeum vulgare
tctgtcgatgctcattatttttctcggcgtacaaatgagcgcatagcccgtcctttgagaaactaacatgatgaactcagaccaaaccgaagtacacgatggtgtccttcgccatgaccagcaaaagcagcttgaagtatatcaaagcccacttcctggtaatatcgtggtgcacatagtccagaaggatctctttgtggaacatgtaaatctgatggtatactgccgcgaccataagagatgtactcatgctgttccttgaggaaagaagcagaattgggatcatgtaaaaggttacacctgttgctatctctgatcgcctaactttagaactttcacttgtcaatggactgcttctaggtttagcagctgcttctactgggctgaatgccgcgactttagggaaggctccttcagtcacttttagtgcattaga

SEQ ID NO: 281 - DNA, 524 bp, Hordeum vulgare
gcacgtagtcaaactgtattttattcccttcttcgtgctctttgcagaagtaaaacatagaagatgctgaggagttgcttcttgcaagaaggaaatttttcccactcacagcagaaggtttcaatataatacttgatggttggtgtaatatattcaccgatgtggccgaagtaaagagaatttggagagaaatgtcaaattgctgcattactcctgatggtacatcttatgctctcatggtctgttgtttctctaaggtagggaacctttttgatactctgagggtttatgatgagatgaagaagaggggttggagtcctggtattgatgtctataaccaacttatttatgttctgacaagagagaattgcgtgaaggatgcaaaaaatgttctcagtaaaatggtagatgaaggtttccaaccggatgttgaaacatacaacagtattatagttccactttgtgaaagttgcaagcttgacgaagcgcggaagataatggaagatatgaaaatgaagggcatt

SEQ ID NO: 282 - DNA, 554 bp, Hordeum vulgare
tggatccagtcctattttacttagttagttggtcactggtattaatcacgggccttcttctaagaggatttcttacatagaaagaaaatcccagttcctctgcctactgtcttttttctgttgttgttgaagaaatcacgagggagaggattaaaaagtagccagagggctaagagttacagaggcactgcaagccataaggggaggtagtcgcgccaagataaggcggctgaattactaaccagatctttaaacctaaaaggccacaattcaaagtcagaacaaatgttcccaatagtagtagcagaggagtggtcttcgtttctgaaggcagttacattcctctgatttccatattttcttccaaaggatggaaagcaccacttctggccacgcacagttattgaggtgagctgggatgggagtacagtacaccatagatcctggaagcagtcagaaggagtgatcccgaggtgatgccaaatccgagtggccttgtggcaactgatgaggagttgttcagcatcttcagaggtgtgaaaacatcttgggca

SEQ ID NO: 283 - DNA, 553 bp, Hordeum vulgare
gtacccccgggtctgcaggcaattcggcacgagggcctcctccgcagtcttcttcctttgtctgggaggcgggcaggcgagcgagcgagcgcggaagcatccccccggcagattcgttcttctgggcaggtgcaacagtcatggatatcactcagattctgctagctgctcagtctccagatggtaaccttcgctcagcagcagaagccaacatcaagcagttccaggagcagaatcttcccaacttcctcctatccttgtcggtggagttatcgaatgatgaaaggccaccagagtctagaagacttgctggtattatccttaagaattcactggacgcaaaagattctgcaaggaaggagctgctgattcagcaatgggtcagcttggatcactcgatcaaatcgcagattaaggagtcattgctgataacactaggatcttcggtgggtgatgcccggcagacgtcatcacaagtcattgcaaagattgcatccattgagataccccgtcgggaatggcaagacctcattgccaaattgctgagcaacat

SEQ ID NO: 284 - DNA, 550 bp, Hordeum vulgare
gatcaataataatgagtttagcttgttaagacgtaaaccccactgccgtcgaatgtgacgcacaacgacttgacagactgaaaataataaaaccacccaagacatctacgacaaggttcctactgactgactgacgctacatatactttggtacccttctgttcatatgagccaaacccaaattccgtttggtgcatcaataaaaccaaacatccaccataacaagacaaggtaagatagtttctcgtctaagaaactatcgcttggtttatcatcccctgggtccatgacgccgtctccctcacttcatcatccagatcgaggcactccctcaggaactcaacatggaagaggtggctcttgaacagatccttagagattggcccaagtgtgtccgcaagatcccccaggacagcaacggcggcttttgtcacgctctcatccctgctcccatctttgtagacagcttcagtgaattgcaatagatggcctgcataaggtatcatcagctgagcttttgcgccctttagaccctgtagtatgccagagt

SEQ ID NO: 285 - DNA, 236 bp, Hordeum vulgare
gaagtcaccatggtcaacaagatggggttcttcgcagaggctggtcccgtgcagatctttgtgtcaaaccatttgattcctgatgatatggagttccagtctggtgatgtgccaaactacacaacttccgatggatcggtgaaaattcaaaaagaaagtgaggttcgtctgaagattataggcactcgtgttgacgcaacagagattttttgcatcggcacaataaaagacgactt

SEQ ID NO: 286 - DNA, 557 bp, Hordeum vulgare
gttcaaacatactgctttgaattccaacaaatcaaccactagagttaaaagagatcctagttatgatattacaggtcccagttactttttttgaacagtagtatgacccagaactccattagataagcatgacagcacattttacatcaggacacagtaggaaaaccaaattacaaccttccttggggacttctggaattcaacgttacaagcttatcatgatgtagaagttggagagcatgatgagggcgcagtatttacagcgctccaccaggatcactgataacacccagaaagtcgtcttttattgtgccgatgcaaaaaatttctgttgcgtcaacacgagtgcctataatcttcagacgaacctcactttctttttgaattttcaccgatccatcggaagttgtgtagtttggcacatcaccagactggaactccatatcatcaggaatcaaatggtttgacacaaagatctgcacgggaccagcctctgcgaagaaccccatcttgttgaccatggtgacgacggcctcgaggatccctcgtgccgaatt

SEQ ID NO: 287 - DNA, 507 bp, Hordeum vulgare
gcacgtggggcggttctatgtcgagttgaaaacaagcagagagctggagtatcatacggtggaaaaatttgagaaagagaagttacttaggttttggattcaatcattccttgccggcgtatcatatgttgtcgtgggattcaggaatgatgctggtgtacttgtacgaactgagagactaagaactaaagatatcacacaaaaagtgaaagcaaagaactactggcagggtggtgtctgcttggcgtttgcggacgaggttttatgctggctgtatggcactgtcaaagaaaatgaagactacgttctgcaatttgcacacccgttccatcgattggaactattaaaagcccagtctccttgccccgagccaataactctgcatgtggaacagctcaccggtgcaacaagctagatccgttcctaagcaaagctccggagctgctgttttgagaaacggacagttttgatggaccttatgtagcagcgtcgcgacttagaatggtt

SEQ ID NO: 288 - DNA, 541 bp, Hordeum vulgare
tgctgccttggctgacacgtctgtcttaaaattactatattggtaatagttacacatcgttggtgccttgcgtgatgaaccgttacaatggcagcgtaactctgcacttccctaatttataacttagtagagcattacagaagaaatgcagcttttcatggcttcaaaatctctttgaacactcaaagagcaaaccgtaaccctaaatgcccccagtttccgaccgactatatagagtgacatcgtcagtctcttatgcatccgcgtcagccccacgaacccagtatagctcaaaccattctaagtcgcgacgctgctacataaggtccatcaaaactgtccgtttctcaaaacagcagctccggagctttgcttaggaacggatctagcttgttgcaccggtgagctgttccacatgcagagttattggctcggggcaaggagactgggcttttaatagttccaatcgatggaacgggtgtgcaaattgcagaacgtagtcttcattttctttgacagtgccatacagccagcataaaac

SEQ ID NO: 289 - DNA, 523 bp, Hordeum vulgare
gcatcctctgcgcgcagctgctcctcaccaccgtcgtctccgccgtaaccgtcttccaccccaccctcaacgccacgctctccaactcgcccgtcctggcgctcgtgctcgctgtcctccccttcatcctgatgatcccattgtacatctatcagcacaggcacccgcacaatcttgctatcttgggtttgttcactctgtgcttgagcttcagcattggtgtggcttgtgcaaacactgaaggaaccattgtgcttcaggctttggtactgacctcagctgtggttgtctctctgactgcgtacacattctgggcttcaaagaagggcaaggaatttagttaccttggaccatttctgttttctgctctcactatcctggtcgtaataagctttacccagatcttcttcccatttggacctgcatcgaatgctgtgatcggcgggtttggagctctggtgttctcaggcttcatcgtctacgacactgagaacttgataaagcgccacacttatgacgagta

SEQ ID NO: 290 - DNA, 550 bp, Hordeum vulgare
tggtgaaccgcgttggagttgccctgagaaggggacaaacaacacgacaattattggcacaaaacgttcatacgatcactgattgtttgcagtttaacaacacttaggcgcagaactcacgctagaacacctatacatattggttgtactttggcctcatctctggatgatggcaaaaactcactaccatgtcttccgagttatgtagatagcaattcaaaagactagataaaggttggacatatgaccgggttggcacaaggtcctggtgaatcagatgggactcatcagttgtcgttctgcctgagcatctgtaggatggtgaggaacaggttgaggatgtcgaggtaaagttcaacagaagcccagatgtactcgtcataagtgtggcgctttatcaagttctcagtgtcgtagacgatgaagcctgagaacaccagagctccaaacccgccgatcacagcattcgatgcaggtccaaatgggaagaagatctgggtaaagcttattacgaccaggatagtgagagcagaaaacagaaatggtccaa

SEQ ID NO: 291 - DNA, 518 bp, Hordeum vulgare
aagcaatggaaccattaagcatatcccaaatgggggtcactcaagcgtcaattctggccagaatgaaacgcctggttctgagaactctggagagtttacccagtatttccaagagggctattgtaaaatatcagaactcgatgactgccgtgagttaactgaagctgttactgatgctgacagcagcagcagccactgcgagagagagaagcccgaggaagatggggacaacgacgacatgcttggaggggttttcgccttcagtgaagaaggttgaacttacaataccgctttacttgggatagataatggagaacagttgccacaatattcagtgtgcaatattatgtagaaaatggtggaattctagtaggtttccgtggaataaagtcatgccgcgttgataatctaatgtttggtacatatttgaaaggtgaagcatgcttatttgccggaagagttcactctgaagcttgagacgaagatccctccaggcaatttactaatccacggaagga

SEQ ID NO: 292 - DNA, 549 bp, Hordeum vulgare
cgccctctaaacagaaatcttttactgaatgtttatacagttatgtcacattaatcgttgctagcattcctttctcttaataaaacagaaagtatgtacaaataaacatggaacattcacaggccctggcaggaagcagtcaacaaatatggctcgccgggctttcagaccatccaatgtcccagaagtgtatctcacgaaacaaatgggtcttacagtatgtacaaagcaaacagaaaaaaggcaaagtgtcgtggcaggcagtggcggcttctcgacaaacaccaaactcccttccttccgtggattagtaaattgcctggagggatcttcgtctcaagcttcagagtgaactcttccggcaaataagcatgcttcacctttcaaatatgtaccaaacattagattatcaacgcggcatgactttattccacggaaacctactagaattccaccattttctacataatattgcacactgaatattgtggcaactgttctccattatctatcccaagtaaagcggtattgtaagttcaaccttcttca

SEQ ID NO: 293 - DNA, 505 bp, Hordeum vulgare
  UNSURE (498): n stands for any base
ccgttcgtgttctggttcgggccccggccacggctggtggtgtccagcccggaggtcgcgaaggccgtgctgaccgactcgtccgggacgttcggaaagggctccgggagcagcgtcaacccactctctcggcagctcctcggcgaggggctggtggggctcaccgggaagaagtgggcgcaccaccgccgtgttatctcgccggcgttcaacatggagagaatcaagggttggatcccagaaataacagctatcacctcatccatgctggattcatgggaagttcaaggagatacccgcattgagtttgagattgatgtaaataaagaattccacactttgagtgcggatgtcatttcttgtatggcctttggaagtagctacgaggaaggaaagcggatttttaaattgcaagaagaacaggtacaacttgtcctccttgcaatgagaaccttctactttcctggattcaggtttgtgccgacaaagaagaaccgnagaaggc

SEQ ID NO: 294 - DNA, 514 bp, Hordeum vulgare
  UNSURE (5),(20),(25),(28): n stands for any base
tatgnactggatttactgtncgcgnagncatactagtttctatacacactggccttcgagatgttacaatttctatacacattttcatgacaaacttcagacaagttagcaacctcttattacaagtcgctcaaaatccacacggatgcaggagacacggagacatcgcgttcacatatactctctccgtcctaaaataagtgtcttaattttttatcagctttaatacaaagttatattatggttgagacacttattttgagaccgaggagtaccttgctgtcacgcctcctaattccatataagtcaggcaccacacaagcctcagatcttgtggacaagaagttgagcaccatactggggatggagggtcatcgccatcatgggcgcatgaacataggacggcgagacatcaaacgcaaaccgctggaggaccattgcaagcgccaccttcgcctcaacaatcgcgagattctgcccaacacagatggcagggccaatcccaaaggggaag

SEQ ID NO: 295 - DNA, 478 bp, Hordeum vulgare
ggacggcggatcctgatgggaggcgagttgagatacatgtgctgcttgtggaggacatctggggcatgtgttcaaaggggaggggttcaacacgccgactgatgagcggcactgcgtcaacagtatctcactcaagttcgttccggcctctgaagaagaggctagttgagtgagagcaaccatcatcatgactactggatgtcagaactcagtacttttgtcaataatgcaagccccaagtaccgattttgctgctaatttcggcagtaaactgttacatgtgtaattctaggttttgttttcctagtggaaattaacagtgaggagcctgtagatttggaaataaagccacctgaagagtgcagctcaagttgtttcccttcgtgcccacataatattgtaccaattgcctcccaatcaagttcttgtgcagcaataatacattgattcacgtcaaaaaaaaaaaaaaaaaaaaaaa

SEQ ID NO: 296 - DNA, 449 bp, Hordeum vulgare
gtgaataatgtattattgctgacaagaacttgattgggaggcattggtaaatattatgtgggcacgaagggaaacaacttgagctgcactcttcaggtggctttatttccaaatctacaggctcctcactgttaatttccactaggaaaacaaaacctagaattacacatgtaacagtttactgccgaaattagcagcaaaatcggtacttggggcttgcattattgacaaaagtactgagttctgacatccagtagtcatgatgatggttgctctcactcaactagcctcttcttcagaggccggaacgaacttgagtgagatactgttgacgcagtgccgctcatcagtcggcgtgttgaacccctcccctttgaacacatgccccagatgtcctccacaagcagcacatgtgatctcaactcgcctcccatcaggatccgccgtcc

SEQ ID NO: 297 - DNA, 536 bp, Hordeum vulgare
ccccgggtctgcaggcaattcggcacgagggtccccctccctccaaatctcgccaaaactcccggggacgagcgcgctcccggcattttctccagcgccctcgtcgccgacgaaggcagtagatccggcgggcggcggcccggcgcatctcctcgcctgcggagcaggtgcataatttgctggcttgtgttagttcgggggatcagcaaagctattgaaaatggtggttcttgctgcttccatcatctcgaaatctggaaaagcacttgtttcaagacaatatgttgacatgtcccggattaggattgaagggttacttgcagcattcccgaaacttgttggaactgggaagcagcacacttatcttgagactgaaagcgttcgttatgtttatcaacctattgaaggcctatatctgctgcttatcacaaacaagcagagtaatattcttgaagatctggacacactgaggctactatccaagcttgtgcctgaatactcgtctctggatgaggatagtatctgtaaaacagcat

SEQ ID NO: 298 - DNA, 549 bp, Hordeum vulgare
tcaaaagggtacaggagaatcatgcttttatttgtaatggtgcgacacactacatatggaacaggacaaatcacacatttttaaacaagtttcatgcaaaattatactcattgtgccactaacaagaaacggcagtaacaatttcagtatggctttagactatttgatagttcgcagcaaccaaacggaccctctgtgaatactttggagggttgccttccttcagaggatgaattccagtgaccttcagatcactgaaagtattggaagcaccaaatccaatagagatggggaaaaatgttgacggatcagccgggggaacaataaattccatcgatccactgcggtttgactgatcaataaggataatggaccattccaatacagagtttctagagtcatacttccactctccatcaatctgtttaacggttggagcctcccgaagtgcaggcagaggaattgatatgacaacattgttcaggtcaaacatctctgaggcctcgtattcaatgttgacataggtttcatttccagataccgatggcc

SEQ ID NO: 299 - DNA, 502 bp, Hordeum vulgare
aggccagaacggcggcgtcatcacccgtttccctgaggtgctgggcatgcgggtgggggaagatcattaaacctttcgtcgaacaccttcaggcattggcctgcagaggctggccgttgcaagaatgatcgagaagaagccgtatgtccttggctttgggttggaggaaagggtcaagcctaacattgaggcgcttctagagtttggggtcaggaaggaggcgctgccatccattgtgattcagtaccctgatgttcttggagttgagctgcgagacaagcttgttgagcagcagagcttgtttgagtccagcattatggtcagcggcgatgatttcggaagagtggtcgagaggatgccacaggccattagccttgggcgcgctgcggttctaaagcacgtcaacttcctcacaggctgtggcttcttgctgtctcaggtgagcaagatggttgtggggtgcccccaattgctcgcactgaacatggatataatgaagatg

SEQ ID NO: 300 - DNA, 525 bp, Hordeum vulgare
acatccttcaaaatgacaatctaatgactactgcatcatatacaacaaagcatcaaggctgaagacataaatgcaagtttgtcagctaacagttgatactagattctacgaactgggaagggaatcattcgatgatctcatcaatcggtgtcatcgtaatcgctatcctcttccatatcatcatcgtcctcatcttgtacttgctcctcgaacctatctctgtcaaaggaattatcatcctccatttcttcaactccaatcgtgtcatacttcatacgctcatcaaatttcgcatcggagcagttgagcagccacgcgagagagcatgtgaaccccttcttagccacaatctcatgccggtatcttatagtggattcgaggccatatgtaaagaatgcagggaactcaaccagctcctccaaatccctctccatttcattcttgaagtactcgaagttcatcttcattatatccatgttcagtgcgagcaattgggggcaccccacaaccatcttgctcacctga

SEQ ID NO: 301 - DNA, 542 bp, Hordeum vulgare
  UNSURE (3): n stands for any base
ggnctgcagggaattcggcacgaggcctcgtgccgaattcggcacgagggttccgctgtcctcgggtcgctgcgctgccgtcgcctggtcctcctcctcctcctcagctcagtcggctggtctcgtatccctcccagccccagtccccaggaaccagcggcctcggcactcggcaggatggctaccccgcagtgctgcgcggacccgccgacgctcaaccccgccggcggcgagggcaaggtcgtggacagcttcggcgggatcacggcgtacgtctccggcgcccgagagtccaaggccgccgtcgtcctcatctccgacgtcttcgggtttgaagcgccgaatctgaggaagatagccgataaagtcgcttcgtctggatatttagttgtggtgccagatttcttacatggggatccatatgtacctgaaaacgccgacagaccaatacaagtgtggttaaaggagcatgccccgggaaaagcatttgaagaggcaaaacctgttattgctgctctcaaagaacaaggagtatctactgt

SEQ ID NO: 302 - DNA, 553 bp, Hordeum vulgare
  UNSURE (31): n stands for any base
ttttagtgcaatagtattatcgtaatgtgtntagcacaagcagagaccgatatgagtaatcacacaatgcatgctagcacaggacagatctgtacaaccaaagatgcaggccctataacataaaccctggatgattacatgatgactggtgaagagtgacactggcgtattaaggacaaaggaccgctaattcagattcactgtaggttcttgctaaaccagtcgatcatatgtgacagggcttcctcagcactcttcacagcacctgcgtcttcacttttgtatctcacagtccatccatgagaaaccccagggaatatcttgacaaagtgagcaatccctgagttagaggacagaacctgctcgaactgcttgaccaattctggtggggatgttttgtcaatttcagctccaagtacagctatggggcatttcacctctttgatatcttcaacagtaacaaaagaagggtgtgacataacagctgcatggatctcattagctttcgctagctcagcaaccacctttgcaccccagcaataacctgcagccc

SEQ ID NO: 303 - DNA, 518 bp, Hordeum vulgare
ttacgaagtttgagactgaggaggcaatgtatgaatctcagaggataagagctgttgacagcaaacgtatagccacggcagctgtcaaagctagcaggacatgtcgagatctgaatacacaaactgttaaatatctggtattatttcaaatcctcaaattgtgtttttatagcctctcctggcttttgagtaatcatattacatgtctcgtttcttttttgcaggatactttgcatgaacatttggggataatgctgtctgtccatactgcattttctgatcgggctagtgcattattgactgttcaaacgcttatgtcagaccttgcatcattacaatcaaggattgagaaactcgaagctgcatcatcgaaagtatttggtggtgatagaactaggctaaggaaagttcatgagctgagagaaacaataagagctactgaagatgctaagtgctgcgcgttaagggaatatgagagaatcaaggaaaataacaaaattgaactcagcagattagat

SEQ ID NO: 304 - DNA, 544 bp, Hordeum vulgare
  UNSURE (7): n stands for any base
ccagggnaaatagatgggtaccattccagacaatggcaaagcgatgcgacagataaccgaaaaacaaattgaatttaggttcatcttctatttggaacgcatcctaaattacattgtacatacatgtaccccaacaaaacacaggctaatatgtcacgtcatccgatgatcttcgagcatatccgctagtctcctcggcgaccgtctcccaaccatcgacgatcttctctgcatatgaagcctggcttgtaacatatcctttcagcatctccaggaaatcttctctcctttctctatctaatctgctgagttcaattttgttattttccttgattctctcatattcccttaacgcgcagcacttagcatcttcagtagctcttattgtttctctcagctcatgaactttccttagcctagttctatcaccaccaaatactttcgatgatgcagcttcgagtttctcaatccttgattgtaatgatgcaaggtctgacataagcgtttgaacagtcaataatgcactagcccgatcagaaaatgc

SEQ ID NO: 305 - DNA, 365 bp, Hordeum vulgare
gtccagtgctcatcattccaattaaagccttcaatcttcggcaacacagcagaaccaaggatgtcttgcagctgtggatcaagctgcggctgcggctcaaactgcaactgcggcaagatgtaccctgacttggaggagaagagcggcgccatcgtacaggccaccgccgtcgtccttggcgtcgggcctgcgaaagtgcagttcgaggaggccgccgagtccgatgaggctggccacggctgcagctgtggcgccagttgcaagtgcaacccttgcaactgctaagctgcaagcagtcgatgcgcttgtggtgattgtgccgtgtgtgatcgagtgtgaataatgaaaccggcgccggacgtctg

SEQ ID NO: 306 - DNA, 195 bp, Hordeum vulgare
tttttttttttttttttttttttttttttttttttttttttttttgcgaaaacctgttttgtatattaacttcagtttaaatagaccattacaaagacccacccatttaggttcgcgcacacaaacacaaagcagtagggacagtttcacacgtcacaaggaccccaagaacaaaccacaccacaacaccaacca

SEQ ID NO: 307 - DNA, 343 bp, Hordeum vulgare
gcaccaccaagggcttgttggacgatgggagtatggcacagtggtttatagatgggcaagctggatttgaagcaattgcttcctcgattgagcatgctaaatctgagatatttattgctggctggtggctctgcccagaattgtatctccgacgtcccttcgaacatcatgggtcatctaggcttgatgctctactggaagcaagagcgaagcagggtgtgcagatttacattctaatgtataaggaggttgctcttgccttgaaaattaatagcttgtacagtaaaaacaggctgcttaatattcatgaaaatgtcaaagttctgcgctaccctgatcattt

SEQ ID NO: 308 - DNA, 517 bp, Hordeum vulgare
tcttgcataggcacacttagaatgttatcttattcttcaaaacaattcataatgtacaaccgagacaggctttgaaggaagagcctgttctctggactggaaaagtgccaactgaacaggggtatttctcaactaggaaaacaagagcggtcgaatgtactaactatattcctatactctttggtttgaaaaagaagaatttgaacatgggtaattgcccaaaaagaaaagaggtctctggcgaatgaggtatatttgtaaactgcctgacgtggccgtatattcttcttcatttcctgtaaaacatctacaagctggcgcctgtactatgtacacctaaggcactgggagagcaacttttccatgaaaatcaacctaatggaaaacttgtggagatgtgtaatactcgctttcactgaaatatggtctcaagtcctcttggcacatgaaatccaaagggaaagatacaaggtggcctttgaccaactgcaatctctccatagggtcggtacctttg

SEQ ID NO: 309 - DNA, 516 bp, Hordeum vulgare
gtcgagttcgtctccccggcgcaggatggcggacgaggaacatactcaaacttctaggaagagggttgcagaaaaacaaatcaacaaggatcatcctgagcctgatgatgactcgtcggaacaagaaacaggaacatttaagaaagccagtgaggaagtgatggcaacccgaaagattgtaaaggttcggcgtcagcagccgtcagcagctccttcttctaatcctttctctgcaattagattcacccccagtgatcctgttgttcaagcaaatatcacagtctcagaacctccaccttctgatgttagcaatggaagtgggaaagagtcagatgcaaaaaacaagtccagtgccctaactgaagcaccctctcaacttgatgagtcagatagcaaggcagaagacacagtggatggaactggtgagaacaaagtggttgttgaagaacccaaggaagataacaccaggacatctggaattgagggcaaaccagaagatggagatgctgaagagaa

SEQ ID NO: 310 - DNA, 558 bp, Hordeum vulgare
gtttactaaaattatgactttaattaaagttcgacagaccacccaccgttccagagtccagaccagcaacaggacacaccagaaaccaatacgttttaactcaagacaagactccgggaagagcaaggaacacctgctctgacacatacacatcaaaacgcggaaccggggtgggtttcaaacgtcggaagccttcggggagctctctgggctcttcggcgcgtctgaagccttcttcgccttgtgcgtctccactgcagccttgaaatcttcccggatgcccgcatccttaaacttcagagcaaatgtggtgagcccgctcggtgattcgctgatgctgttgatgcaagcaaacgtcacgcccttcttgtccatgtccttcagcgtcatgtcgtcgtaaaggcttgcattcagaatgagccggtagttgcccttggccctcatgacgagccgagatctctcgccaccagataccgggatgttcagcttcagttcaccctttcctctttccttccagccaccatcgaggtactcatatattgcagagtcagcagtgaa

SEQ ID NO: 311 - DNA, 518 bp, Hordeum vulgare
gacgaggactctctcctcgacatgaaggcgaagctatacaggttcgataaggacgggaaccagtggaaggagaggggcacaggcaccgttaagctgctcaagcacaaggagaacggcaaggtccgccttgttatgcgccaggccaagacgcttaagatctgcgccaaccacttagtgatctcgaccacgaagatgcaggaacatgccggcagcgacaaatcctgcgtctggcacgcggcagactttgctgacggagagctcaaggatgagatgtttgccattcggtttggcactgtagagaattgcaagaagtttaaggacttggttgatgagattgctgagtcgcttgcaaaggatgaagacggcgaaagcgtagaaggctcttctgcagctggactgctggagaagcttagcgtaaatgaaagcaaacctgaggaaagcgcagcaaaggaggaatcatccaaggagacagaaaccaaagccgcgacaaccccctcagagtagtgggcagagcagcg

SEQ ID NO: 312 - DNA, 549 bp, Hordeum vulgare
gtaattatattaagttgtatggcaatccattaaccggccgatgcaactaaaatacccacaattaaaacccaaaatgttccaaactcaatactcatggactacatttcgagttctcgacaaaagcaagacaacaccatccaaaagccaacctcgatactgcgagcagatattttacatataacaataaatactcaaatgcgtgaacacccagtgggggtgaagatggactctgctcaagacaccttctgactgtctcaaagttctcagcatatgtcatgggcaacgactaccaacttccatcgacaggaaggacccacaaactgactcttgccactgagcaaaagctcagcagtaccgttctgatgtgcgctgctctgcccactactctgagggggttgtcgcggctttggtttctgtctccttggatgattcctcctttgctgcgctttcctcaggtttgctttcatttacgctaagcttctccagcagtccagctgcagaagagccttctacgctttcgccgtcttcatcctttgcaagcgactcagc

SEQ ID NO: 313 - DNA, 390 bp, Hordeum vulgare
ccctcatcctccctcgccgtccaaacccaatcagaaatctcaagcttagcgcagcagcaaaacaatggcggagcagaccttcatcatgatcaagcccgacggcgtccagaggggcctcatcggcgaggtcatcagccgcttcgagaagaagggcttctaccttaaaggcatgaagctccagaacgtggagaagtcgttcgccgagcagcactacgccgatctgtcctccaaacccttcttcgctgggctcgtggagtacatcgtctccggcccggtcgtcgctatggtctgggagggcaagagcgtcgtcgccactggacgcaagatcattggcgccaccaaccccctggcctccgagcccggcaccatccgtggtgacttcgccgtcga

SEQ ID NO: 314 - DNA, 366 bp, Hordeum vulgare
ttttttttttttttttgcaacctcatatcaaagcaataccatatataaaatatagagcagcagataccgcttgcatgtgcaagcacaaagagataacttcagttcacacaaacaaggttcccgaaatacaaatctcaaaactgtaaacagccaagactagtttggtagatgctcgcgaatcctgccctcaacgactgatgacacatcttaagcctcatagatccagttgtgctagctgctcctccactcagcaaggccctcagggaaccagagggcgatctccttcctggcattctcaactgagtcgcttccatggatgacattcctgccgatgtcgacggcgaagtcaccacggatggtgccggg

SEQ ID NO: 315 - DNA, 496 bp, Hordeum vulgare
ggctgcaggtttttttacgtcatccattgtacctgtcagaaatggcgccaccccagtaccgcggtgcgatcaacaatgggttcgagctcagcatcagcatcggcattctcattgcaaacatcctcaactactgtgtggtgaaactcacggcaggatggggctggaggatatccctatccatggccgcagtccctgctgcattcctgaccatcggtgcaatcttcctccctgagacgccaagcttcataatccagcgggacggcgacaccgacaaggcgagagccctgctccagaagctgcgtggaaccacctctgtgcagaatgagctagacgacctgttctctgctagcaacctctcaagggcagccatatatccattcagagacatattcaagaggaagtacaggccacagctcgccatggtgctcctgatccctttcttcaaccagctcaccgggatcaatgtgatgaacttctatgccccggtgatgttccg

SEQ ID NO: 316 - DNA, 526 bp, Hordeum vulgare
atggcccatgtaggaactggcaacagcagctgcaggcctgtcaggcaacccaactagatgtaattatacttacaaactcttctgctagttaaaaatcctgtactatgtttttccatgcaggtttgatggaatacattcaaattcagaaatcgctaggagctcggcgagtgggttttcctttcttgcttctccttttccttatcatcttcctccccaacaatcttcttccagaaccaatgcctcctccagacctgctccatctgctccatgggaagcttcttggtctctggcaggaacaggtagaccactagcgtcatcacgcaaatccacgcggcaaagacgaagaacgtccccgactcgatgcggcagaggactgccagaaacgtctggccgatcacaaacgtcatcaagaagaccacggcgaccacaatgctctgccctgctgatctgatctccagtgggcagatctcagtcgggacgaggaacgtgagtggtccccatgaccatgcaaagcccgccacaaaca

SEQ ID NO: 317 - DNA, 518 bp, Hordeum vulgare
cctgaacggccctatcggcgaagaggggaacgccgggaagcagtcggatcgcgcagccatgtccgcggacgaggccgcactcaaggcctgtcatgagagaataaaccttagtgtagctgcctcgcatcaagctgagaatgggtctctcaccacagttagttctaagaaatcagaggaggcggcctatgcatttcttcctcctatcgagtcaactgacgcgcaccttcatgagtttgcagaggccatgagaactgttgcaaaagcactgcgacaagttgcggaagggaaagctgctgctcaagcagaggcggctgagtggaagcgcaagtatgagtcagagaaggcagtcaaggcacacatgcagcacagtgtaattaaaggctgcagcaactgtgtcaaggataagctagagcatttggctagtaaactgacactggagacttcctcggctgatgaaacaggctgctgcggaaaccatgggatctgctcacgtcaaattctccaggatcagtgtcctg

SEQ ID NO: 318 - DNA, 549 bp, Hordeum vulgare
gtgtacatgggtagctgcgactcttactaatacattgcctatactaataaaactctagatattacatggtggcaaactgaccaagttcgaattccacgagccgacacctaataaacatatcaataaacccttttatgcgtacggaatagtagaagaatattcaaagacccataaagaaccgaaccaacacaggagcatgcatgatgcatatccacttcattttcgctgggctgtgaggagatgctctgaaatatcgcatctaccgactcatccgccatctcgagttccaatgacacgcaaacttcatcgatcaggcaggaccatccagagcctggctcttcctgaggttccagtggaggccctcgtggatgcttcgcaggaagtcggttgtcgagtccaccaggcatgccgtgggcacgggccaaggagagacactgcagatgagggcgtcgcctggtcctagctgaatcctacccttgccgtcgaaggacgcccaggcttgccctctgctgttgaacggtacttgcacgcgcaaagtcacgtattccg

SEQ ID NO: 319 - DNA, 418 bp, Hordeum vulgare
cagaaggaaattgagattacctcatgcaatttggaagctgcttctgatgaagctggtactatccaagaaagcagccaggaagtcgatttggtatgtgttgatgctgctgctgaaatcgaaccgcagccagagattacaaattgcaagtcggaagattcttctgaacaagagtcttgtattgcccaagaaagcagccaagatgctaagcctgtatgtgttgatgctgctgctgaaatggaaccagagatagaggttgcaaattgcaaagtggaacattcttttgaagagtctggtactgcccaagaaagcagccaagacgtcaaacctgcatgtgttgatgctgctgctcaaatagaatcagagactacaaactgcaacttggaagatgcttctgaagaaggtggtatcactggacaaa

SEQ ID NO: 320 - DNA, 408 bp, Hordeum vulgare
ttttttttttttttttttttggacgaatgagaattctcaacatttgaacatgacacaagcagtatacatatacgataactatcacttcccacaggatacatgcactctgagaagagatttattggctaatttcaggcaaggccatgcagcagctcagcacccttgacattttccgcaactcacacaaatatcagtatacataaataccaagcatcaggactatgagacatacatatatatacataactcggctgttgagccactcctttgcagctcagcaactagactagacaggaaactcttcgtcagtgagtagtttaccctctccatgttaccttaaccagagaaagatctctagcaagcgatcgatcgatctccggtgactagtaagtaagtagttattctcat

SEQ ID NO: 321 - DNA, 462 bp, Hordeum vulgare
gaaggtagttgtcggcgaccagccccctccctctcctgtcgacggtggtcgaccccgatggcaagtcggcgggaacggaggcttccgcccgcacccgctttccagatggagaaccccttcagcgtgaaggttcttcaggtcttcaccggcgccggcgtcggctgcggcgtcggaattggcgtcggccgcccaatctacctaggtatgataccgggccttcagcaagttatgagtgccacaagaggtgcaaccgattctttttctggtgtcacaagacatgttaattctgctctaaagaaagcagggttaaagaatattgaagcgggcattggatgtggagttggtataggacatggttttggaataggaattgccttgaaaccacgagcaattcatggaattcaatcatcgattgcagaacttttgtccaagttaacttcaaagctgagggattcccctggg

SEQ ID NO: 322 - DNA, 550 bp, Hordeum vulgare
tgtttaaacttattatgtgattgtatgacagccagcccacatcattcgttgtaccgagcagagacatcaaacttcaaatttttcaccatctacatggaacataatgtatagatcagataaagtgcctcagcaaaaaatagctggcctggtcgttttgtcgagaatatcatgcagaaagctatgactattgctctagtgaaatattcagctagtggaaaaaatagcaaatacttggctacaaataactagagctgatgccactgctatctgttcgatttccgacttcgacggcggcagtcaaagcactccgagcatggatagtaggccttcactccacttgttcgatccagttgtaatttagttggtgaaatcttaagctcctctatgagcacctgacgcagcttttcattctcgtctcgtaactcttcgataactctttggtgcttcagaaccaactgaagtacattatccgtcccatgcaaatttacagacgcatccctgatgtccgtttttgtatcgttctggaacaggggactctgcagaaagttgg

SEQ ID NO: 323 - DNA, 552 bp, Hordeum vulgare
gtacccccgggtctgcagggaattcggcacgaggggcggtggatcattgccaagtgactatgatagatgccggtctttgctgtctggtttagaaggcagtgaaagtagtggttgtgtgtaccctgttcaggatgattgtagaaccacagtctggacatatcaggagaataatgatagagcactggattcgtttcaacctgatgaagagttaaaaaggaagaagaagatatcatatgttaggaggcgtaaagatatatacaagagtttagggcctggtaataaagctgaggatgctaccttgttggcctttgggacacttttttcagcaccatacaagggatcagagtcttattttgatatccatgaatcaccaaaggatcatagattacagaatctacttgagaaaattgagttccttccttttgtcccagagatcatggctgcggggaaggagcttgctaagagcaagattaaggagccttttctttgtgcacaactaagattgttagatggccagtttaagaatcactggaaatctaccttttctgccct

SEQ ID NO: 324 - DNA, 533 bp, Hordeum vulgare
  UNSURE (8): n stands for any base
caacgatnacatctctagcttaagccagcttctgggactaccacagcttatttatcactgtaagttgtgcattacagtgcagttagatatacacaaatagttagaatttttcattcatctccgtgaaatctgtttgattccaacagtcgtttctcagtctaaagtctgcaatgattcagctctctgtagtgcaacagcccccactgaaattaactcgttaaatagcatcggttagttttctggcagcttgcgcaaatgatgtagttctcctacaatttgcagacattgttcttcctcattgtttctatgcttcctgctatggttgatccaacagtccccacaaatccaagtgatgcacagctgcaaacagattcttcgatatataataaaatttccggcagttgaactgaatcacaatctttgttcgtgtttcctctgatctttggaaggaatccagaccttatgccatgttcagcagccataagcttctcggcagtctgtagaacatcattttccttcagggtgtacagttg

SEQ ID NO: 325 - DNA, 552 bp, Hordeum vulgare
gtccccccgggtctgcagggaattcggcacgaggctcgtccccgccatgaagaacgtgcacggcgcgctggcctccgccgggctgggccacatcaaggtgaccacgtcggtgtcgcaggccatcctgggcgtgtacagcccgccgtccgccgggtccttcaccggagaggcggacgcgttcatgggccccgtggtgcagttccttgcccgcaccggcgcgccgctcatggccaacatctacccgtacctggcctgggcctacaacccgagcgccatggacatgagctacgcgctcttcaccgcgtccggcaccgtggtccaggacggctcctacgggtaccagaacctgttcgacaccaccgtggacgccttctacacggccatggccaagcacggcggctccaacgtgaagctggtggtgtccgagagcgggtggccgtcagccggcggcacggcggcgaccccggccaacgccaggatctacaaccagtacctcatcaaccacgtcgggcgcggcaccccccgccacccgggcgccatcgagacctacgt

SEQ ID NO: 326 - DNA, 554 bp, Hordeum vulgare
  UNSURE (12),(13),(32): n stands for any base
taggtaatattnncggtccttcgccgatatantttatactttattattttggacaaatttcgtcaagttttgacgaaattttgaaccctacaatatagttcctaggtacgcacacatgcgtgtacgtatcaagtgcatgatcaatcgaggaagggggagcgtttgcatatgcttcccttccatcgaaaatcatacgtactggtacactagtatagcaagccactactcgcgtacgcatctgagctgcctcagcggtcgcatcccaagttcccaacccaagccctgtacaatacataatgtgcgcatacgtacggcgtacacgctcttatacgcgcgtgcgtacgtacggacatacgggcactaggtagctgctacctcatcagaagctgatggggtagacgtgctgcatgttggggtagaagagcccccagttctgctccacgccgttgtccttctggttctcgttgaacatggagaagacgtaggtctcgatggcgcccgggtggcggggggtgccgcgcccgacgtggttgatgaggtactggttgtagatc

SEQ ID NO: 327 - DNA, 501 bp, Hordeum vulgare
cttgcatcagcctctatctcatccccacttcctagccgcctcgtgccctcgtcctctcccatctccggctgccccgccgccacgaggccacgaccgccgccccctccccccagcctcgctcactcccgcggggatggaaaaccccggtggatcctcgttgccagcctttcttgagctccagcgcacccgtgttctctgcaaggccgatgcccccactcatacagaagggtttcaatactcgggtgcctttgctgctatgggagttgatactagtgtctcagtcgagaagttctgcagtaacttcaaaatcgagataaatcgacttacagaggaggatatggagtttgatatgattggtgttgatgcgtcaatagctaatgctttccggagaatactcatttcagaggttcctacaatggccattgagaaagttttcatggttgacaatacctcagttatagcagatgaggtcctttcacaccgactaggccttattccact

SEQ ID NO: 328 - DNA, 500 bp, Hordeum vulgare
tgcggacttccatttactttcctaatgcaccccatatattcaccgaatccagatcctaggttccactcatcaaaccccaccatggtggctggaggagacaaggggaaccaacacaagggcgacggtaggaagaataagctttcgttctcaacacaacatagcaatagaaaaactacatcagaatagtactcaaaactttgtatcgggctcaagaaagttcagaaatcactctctcgcacttctcctcaaggatcttcacggcctctgtgaagagcacctctgggggtagagctccggtggactcgattgtaaagatgaagtggtctctaacacgccgtagctctacttgatcatcagtcggtctaacacattccctgcaaagggtgcatgctcttggctttgcaacaactgctctcttcttcccgtttcccaggtcttcaatgtcaaaaacattaactgggcattttttcactagctcctccgcatcaccatctttaatt

SEQ ID NO: 329 - DNA, 520 bp, Hordeum vulgare
gttcaactgaaaataaccagtagatgatagcgagtctgaggaaacttcgcgttcaaaaagcagcaaacaaaatgaagatgggaaggttgaggaaacaccactttcaactgttattgaacctgaagatgatgaaaactcagagtcctacaaacccagggttacaacgtggggaatgtttccacggccacaaaatatttcaaaggcgtatggtggtggaagaaatataagccttggtggagagactcaaagtgctgaagagaaggcagctaaagataaacgtaccagagaattactagctgcatatattggtggaaaaaacaagacactcgatgcaaaaacaaaggcagagtgcaccaaggcattgaaggaaggtgacgagcttatgaatgctggaaggctgaaacaagctttgccttattatgaaaaagtgatgcaggctgcggactttaagaccgaacttcatggaatggctgctctccagtggtccatctgtctagattcactctgcaggtccaaggaa

SEQ ID NO: 330 - DNA, 542 bp, Hordeum vulgare
  UNSURE (15): n stands for any base
gggcatcatcatatngagctgcgaagcatacacttcatgttgtttccttttcttacagcatcaaggattttctcagagcgataaaagcaacgaagaatatcggggagacgaggaagaccatgtaggggacgatctgcccaatccccacctcgggctcgtccgggttcgcgtagtagttcctctgcccgccgaactggtcgaagtacccctcgtagcccgtgttgcggggcaccggcacgccatcgaccttcaggaagtccgccgcctgaaagctgaacatgaacatttttgccttcttgctgactcgatcgtttgggtggtatttcagcttgctatacatgcccatggcttccttggacctgcagagtgaatctagacagatggaccactggagagcagccattccatgaagttcggtcttaaagtccgcagcctgcatcactttttcataataaggcaaagcttgtttcagccttccagcattcataagctcgtcaccttccttcaatgccttggtgcactctgcctttgtttttgcatcg

SEQ ID NO: 331 - DNA, 535 bp, Hordeum vulgare
ggctgcagcagacaggagaaggaacaggcccagttgcccgctctcttgaaaacttgaatcagaaaaatgaaggcaagacatcatatcaaaaggaaaaacagcaaagcaataaccgcccacaatctcagagatcctatcctaaacctcagagatcttatcctaaaccatatgtgtcattttatggctcacacttgcaaaatcagatgtacccaaatgttgcaccagagcaagcagtgtaccatatgtggaaccaagtgcaagcaacacagcagaagcccccttttccgatggtccaaactatgggcaacacaaggtttcaaccgccaccaactatgctctccatgtaccctcctccacctagaaggcagttcgccgtgccagccagccaagatgctttagctcttcttccatgttttcctgaaactcctcctgtccttcctcggtacttctcgccttaccctgccacatatgtaccaagaagtccattgccagttactgtgcacacagtgcacagggaaaggcaagggtatactga

SEQ ID NO: 332 - DNA, 547 bp, Hordeum vulgare
acaaaagaaggtccttatcttatctcaactcaaacacacacagagcttccgttttgtacattattgttcgcattcaattttctcgacaacaacagcagtatatatgaacttcgaacaagcctggtggtcgcaggcatgaaccccctccaactcttttgtaaagtccatcctatctaactaaataccaacgtgaaaacaaggtgaccaaaactgctatactgccaagtccgagccctaactaaagctcgctatccttctctcaacttgctgtcggagcatcgctcacatatggagcttattgagttctgaactcgctgttgaaacgtcgcccgcgtgtcttgtgttcctgtgggcctcggggtcctccctggagaggatctgaactgcaggtcgcgctcgcgctgcttctccagggctagagttcgacgcagcatttggcctagctgagcacacagggatagaagttcggactgtaacaggggccgccagccaagggggccgctgctggtacaacaaacctgatgaactcataggagtcgcagatcca

SEQ ID NO: 333 - DNA, 504 bp, Hordeum vulgare
cacatcaccgtcgccggagcgaggtggagaagaggtcgtctgcgcgcgggatggagtcagcggcgaacaagcgcagcagcatcgaatccggcgccacggcggccgaggaggaggagaagggccgcaagaggggccacggatccaccgcgctgttcgtagcggtggactacgccttcctgctcgccttcgccgggttcctctcctacctcgttgtctccccgatcctcccttccgccacctagataggtcgcccgtcgccgtttgcttctggacgcgatgcgtgtgaaatcccgagatcttggctcgggatacggtcacctcctcctttgcctcgtttgatgcaatggattctgcctctgtaacaatcaaaatatgagatgacaagtagctctgatgctgtttctttgctattttgcatgacgaattgtgatgctccagtcttcccgtgttctagtagaataataaaatgctccagtgttcctttgttcaaaaaaaaaaaaaaaa

SEQ ID NO: 334 - DNA, 476 bp, Hordeum vulgare
ggacactggagcttttttattctctagaaacgggaagactggagcatcacaattcgtcatgcaaaatagcaaagaaacagcatcagagctacttgtcatctcatattttgattgttacagaggcagaatccattgcatcaaacgaggcaaaggaggaggtgaccgtatcccgagccaagatctcgggatttcacacgcatcgcgtccagaagcaaacggcgacgggcgacctatctaggtggcggaagggaggatcggggagacaacgaggtaggagaggaacccggcgaaggcgagcaggaaggcgtagtccaccgctacgaacagcgcggtggatccgtggcccctcttgcggcccttctcctcctcctcggccgccgtggcgccggattcgatgctgctgcgcttgttcgccgctgactccatcccgcgcgcagacgacctcttctccacctcgctccggcgacggtgatgtg

SEQ ID NO: 335 - DNA, 496 bp, Hordeum vulgare
ctctggtgacaggttgcggcgccggcgacgaggcactgagcgagatggcgagctcggcgctgagacgatctcttccacgacgcctgctcacttcccacccatcatccgccgcagcctccttgttccgccgctccttcctgtccggagagggcgcggtggagagcgcggacgactttgagaaacgtatgtttgagccatcatcagatgacaaggcattcttcgggaagctcgatggggttgggaactcgtttggaaggcgcggcacgggctttggaatgagtgcttttggtcggccccagtttggcgagagtagtaatggtgggtccatggacgttttcgattcctcgaatgatggcatgaacgagaagctggacgacgcggcccgcacctttcatatgacggacgaggttgacgaagatgactacgatttcaggccggatgtgaattacaggcgtggctcgacttacagtgtcaaggatcttgaccttacaaaacc

SEQ ID NO: 336 - DNA, 543 bp, Hordeum vulgare
ctggagctatacttattattgtgccccgcaccattctccttcagaggcgaacctaaaacgaggcatgagtgagcacagagcatatctccttcagaacaaagaacagagtaacagttcgtcgcaatatccttaagtcgtcagccgctgcatttttagacagcagcggtttactaactgggcgtcgtagaggcgataacgcccacactgtttacacagcctccacatcgggcacagcgtcggcaacgggatcttcaggcccagcatccttctcgacaaagccatacccgtactcctcctctgaagcatcctcctctgcgcttctgccaaacatgaacggtctcttgcccatcgtcgtgaaaggcatcagtcccagcgcacgcgccgtcttaatctccctcgcaaccttgcgttgagctttcgcgcttatcttggtctgattcctcttgatgataatgccagcttctgtaagaaagttggagaggaatctaacattcctaaaatcggctttccttagaacctcctttgtagatgtttcaaactggg

SEQ ID NO: 337 - DNA, 548 bp, Hordeum vulgare
gtacccccgggcctgcaggcaattcggcacgaggacgcgatctgaaagaaaaatcgccagaactgaacatgtcgtcggagaaacaggagacgacggcggcggtgcgcgtgctgggcagatggccgagcccgttcgtgatccgggtgctgatagcccttgggctcaagggcgtcgaccacgagctcgtggaggaggcgatgggcaacaagagcgagctgctgctcgcctccaacccggtgcacaagatgatccccgtgctcctgcaccacggcaggcccgtctccgagtccctcatcatcgtccagtacgtccacgaggcctggtcctcccatgccccggcgctcctcccgtccgacccctacgcccgggcggccgagcggttctgggcccagtacgtcgacgacaagtttcctacggcgatcagggtgctgaggggaaggctgggcggagacaaggacgaagcggcggtccaggttcgcgctgctctgcagcgcctggaagtcgccttggtcgagtgcggcggagggaaggattacttcggcggcgac

SEQ ID NO: 338 - DNA, 451 bp, Hordeum vulgare
ttgcgcggcaaggctcgcatggctcctcttgttattttttttatatttctaataacagtattgagaggcgcattgctgccattgcatcaagagctcgttttcttcataaaaaaaggaggggtttacaccaacagccagcaggctacttattcttgctacgccatcgagcactgtcaagtgtccacgacagttcgttcacttggaattagcactagccgccttcagaacgccgtcattcttgacgctgtactccacgaacctttccacgccaggcatcgcgcccgccaccgccgggtgggcgcagaaccgatccgcccacgcggccagcttaggaaccttggcctcgtcgagaagcctgagttcagcgatcctctccacggccctgatccagccgaggtgcgaccccagagcaatgtccaggtaaccgacgccgtcgccgccgaagtaatcc

SEQ ID NO: 339 - DNA, 966 bp, Hordeum vulgare
  UNSURE (783),(894): n stands for any base
tacccccgggtctgcaggaattcggcacgaggtgaacaaaaatcttcacttgagtttttttgttgttgaacttgttatttctattagaagaatgccaaaacagcatgaaagctacacaagcaccggtctgttgtctacccaaatcagaaaccaatacactaaaatcctaaaacaccaaaaggaaggaaaagcagtaaagcaccacaaacattttcgtttgagttggaaggggaagtgatagttcatcctctatcatttgacccttgatttgcacactgggtattaatacttctctatcatttgacccttgatttgcacaccaggtaaatacttctttgatagattgcaacttcctaaagtgttattcagaagtttgaattacatgtattcagagttatttttgctcttatttcagttagcaattggtctggttgttgccttgaattatcgaaatccttttatcagcccctatgatgaattccagaaattcaagcagcaccctgcgatcagaacacttctggaaggtggaacagttcttcagtatggtgctcgtactttgaatgaaggtggttttcagtcaataccaaatccagttttccccggtggtgcaattattggatgctctgcagggttcctaaatgttccccaaataaaaggatcacataccgcaatgaaatcagccttgtactaaaggtagagatgtgcacaaaaagtatgctttgcggcggaagcaacttttcaggcttttgtttgaaggattcttccatggatactttactgggnagaatcttcagaagtcatggtatatggtgacgaacctctatagagcttcgaaatattagaccgcgtatggtgggtaatatttatcataaagtctccccaaacaacatcttncttttctaattttttggaaaattaaatttccaaggaaatgccacaaggataaggccatgcctttatggttgg

SEQ ID NO: 340 - DNA, 541 bp, Hordeum vulgare
  UNSURE (37): n stands for any base
aacattgtacacaattatttacaccattattatgagnaagtgttagacaggccaattcgggcgtcagaatttctctactaatattcacatcaccgtgtaaccaggccctcctccgccttccgggacggtccactcgatgttttgcttcggatcttttatgtcacaagcaatgaaggcaattttgagcatttatgtgaagcttcgggtcaccattctcatcagatacatatctgcgtgacaacagaaatggtcagcagtaatcagcaacttctgctttggccataaagcatggcacattttattgcacgttatctattccattgggagaaaatggtagttcaagctggcatggccattgcatactcgtaaactcgagctggacaataacgcgactctggtccagcatactgtgggagatttatgctttcaggtactgcaggatccctcaagcggagatgaggaggctggtcatgctcatggtttgtgttgctcctgtacacaagaaactaagtgatagaagtacagattgagaaggtgctct

SEQ ID NO: 341 - DNA, 271 bp, Hordeum vulgare
ttgagaaacttacaagagtttaagatctagggggattcgcttccctggccgcgatgatgagagccttgcgccaatatttactcctccccgttcagtaccggcagctgaaccgtattctgatgcagcacaggatgggtatcaagaaattccagatgaaagtcttgctcctgttcgtgctgccccttctgtacagagggggtgaggcttttgaggtggctcgtaatagcgttgaacttctttccacggtgctatcatcatctccacaaaaaga

SEQ ID NO: 342 - DNA, 536 bp, Hordeum vulgare
aatcgtgatgaacgagcaggcctgtcttcgataccgaaacgttatacaaaatatacatgaaactcaatctgcgatacatgtgagcagccccagcattcaaatttccaataatttggcacgcataacaaccacagaaagaaaaggagtctcacatgaaactcactgcaacgttagacatctaccactatacagcaatccccgagatacaggagaagatagacgcgcaagcacagacctgtatcaaagtttggaaatgcactgagcacgcaacacctttatgacaagtttcagccggatagatatatatatatacccgttgatcataaaccaatgaaatcgtccttctgctccttccggggagttctttcctgctgagaggaggtgccggctttcttaccaaagatcatgtcatcaagatcctgaagcaagtcatccccgccgctagagcgaccaccggacccagccgatttccttgcgggggtgtctttgccaacagcgcgtggggattcctcgggctccaccgtgactggaatcat

SEQ ID NO: 343 - DNA, 494 bp, Hordeum vulgare
gctcaagcgaagcaccaccgcctcctccaccgccccttccctcctctggtcggcgtcgtggattgatcgccgcggcgggcggccatgtgggtcgagatactgtgcggcctggtggcctacaagctcatccgcgccgtcttcttctccgacgacggcctggaccagctcgccggccttgactcctcccactccgatctctgcttcgccgtcgcagccaggctcgagaagctctatggcggccgctgcttcgtcggcctccgcatccccgaccccgacgccggtgcgcgccagcatgtcgacgtcgttctcgtcaccaagagggaggtcatggtggtgctaatcaacaatctctctggttttgttgaggttgacaaggatggtaactggtacaccgaaaagaagcacaagcaggaggttattcctaacccggtactagaagtcagtaggatagctgccaatcttcaatcatacttggagcagaggggagcaacact

SEQ ID NO: 344 - DNA, 527 bp, Hordeum vulgare
attcattcatgtaattatgttcggttacatcttgacttggaaacaggcatggatgtacagaggcaagagaaacacatctcctctgacggagccaggaagtttggaagctgtagcacaccctagattctgcccataaaacttctacttactaggcgctcagtgtcacggaagcgacgctggacagcttgaacttccggactttcttggagtgcaacggctggaaaagaatctcggtgtactgcttcacggagatctctttccattctgaagatgaagtgccctcagctcggtaatctcgaggagaatacagtatttggactcgagaccttccaaaacctccaaaaagagttgatttctggatgataaatcggctaacttttgatctcttcagttttttcaggagtggcatatcttcatgcttgcctttaaattccatgaattcaccaaggacatttttgtcccctctgagttccaacctgtcccacataggcgacgtgctgagaatagaatacagattttggagtaac

SEQ ID NO: 345 - DNA, 543 bp, Hordeum vulgare
  UNSURE (3),(11): n stands for any base
ggnctgcaggnaattcggcacgaggtgggattaatgctgttagtgactgtaaaggggttgttcactcctacttatctatgaaactttcatcagaagtggcaaacactgctttcagagtattatctggctgcaaggtgaacaaagtctgtccactggagttcgacgatccttcttcagtcgctaaggcatgtggcaaggcatcttcaaggccctcatgctgtgcagcgttgcaatcttacatcgcaactagacagaagcaaatctttgtcacaaatttgcaagcaattaactgtgcaaccatgtttggatcaatgctacagaaagctggtgttgggaatgatatttatgggctgtgtgatattgacctgaaagattttagcttgcaagcttttgggcagcaaggttgtctacttcggagcttacctacggacattgtattcgacaacgttacgggtattagctttacatgtgatttgagtgataatattgcagcaccatggccatcgtcatcgtctctccagtcattgtcgttgtgtgctccag

SEQ ID NO: 346 - DNA, 505 bp, Hordeum vulgare
  UNSURE (1),(25): n stands for any base
nataatgtctcaaaaggtacaacangtcctctctagcacatcacaatgctatctgctggacaaaatgggacaaagaagggaaaggctcatttacaagaatgcaacgcgacataatttacaaggcggggcctgcacagcggggaaaattacgatgctcctggctcggtacatgacgtgcttttctcagatggagatggccgtggtgaggagcacaacaggcagcaggatcccgattccagttctggagatacctgcagagcttcctgataatggtgacaccggtaatgcaggcaatgacatttctggagcacacaacgacaatgactggagagacgatgacgatggccatggtgctgcaatattatcactcaaatcacatgtaaagctaatacccgtaacgttgtcgaatacaatgtccgtaggtaagctccgaagtagacaaccttgctgcccaaaagcttgcaagctaaaatctttcaggtcaatatcacacagcccataaata

SEQ ID NO: 347 - DNA, 517 bp, Hordeum vulgare
  UNSURE (64): n stands for any base
gtttgatttaaaggtgaacctgatcctgaattgaaatatcttgccgtcaaatatctccatttanttccccacaactacgaagagagtagtctcccagtctccgtttttgtctacactgtaagttcttcattacttgtaggagcaatatttattatcgcacaatatcgacttaatgtttcacatgtctgaaatttgaactcctcgtttttaagcttgtatgcagagctcgtgtatgtttatggagagtgtatacactgttaacacactgagagtatcactgtacatctgactactgtagcatgaccaccaattttacgagagaattttgatttcgcatcatgctttttcttattaataactgctgccttatgtagtatctgtaatcttatgttttatgggtatgaaaattgtgcagctagtgaataccggaaaggaaagggcaaaagtcagcctagtaatgacctgggcggtagtaattgctactcttttactccaatgttcttatacaaaatttcct

SEQ ID NO: 348 - DNA, 531 bp, Hordeum vulgare
tatgtatgtacagtactgtacagagttaggctcgctggcagtaatcacaatatacaagacaagattggttgcacattaccttccctctgcggaaagcaaattgcaactctgagtttctttttttacatatgcatgtacatgaacaattgagctaaatctctaatcacaccagcaatcacaaaccacacacacattggctcaaaaacagccgctcttgggagtgatcttcctgacgctatcctggagaaactggagcgcgccgggagaaacgtaggccctctccattgtatttacctttggggcctcgaggatcgcccttgggggagacagcgcatgctgcattgcccatatcgcaagcgggcgcatgtatatcagcgatctatagtggccatcaatagtccatccttccggagtttgaaaccaatacccatagccctcttcagaccatcctgcaagaaaaatgccttgtgctgtagtgaaagcctgatcctccattccgtggagcagcatcgttgcagctaaaccgtacgt

SEQ ID NO: 349 - DNA, 264 bp, Hordeum vulgare
ctcccctttcgcttctctcgcgtctcgccacaactttaattcagcggaaaaggccccttccaaccaccggcgctggacgaacgtgggcgatgctccggccatcgccgtattcctcgaggcgtctcctccagagcggcgaccccggccgcatcccgggaatccccccggccgatccgcccgccggcgtcagctcagatgtcgtcgtcatcctcgccgccctgctctgcgcgctcatctgcgtagtcggcctcgccgccgtcgcgc

SEQ ID NO: 350 - DNA, 372 bp, Hordeum vulgare
ttttttttttttttttaaaatgtatttgccttgcctcttttgagcaagctatatgcagcacaaatagtactactaatatattttttacacgagaccacgcacgctctttacaagtctgatgtcatgttccccacatccacacgtactggaggagtcgtgcaagtgcagggccaaaaaggttgtaggaaagagtcacattcacagctctaattattctcctttccattacttcagaagaaaaacttcactgcggcagtactgcagcgtgggccaccagcagaaaggggcagctcaactacccacaccgacctggacccacccgccaggggacatgacgcttcttctactgctactacggcaagaaccccccgc

SEQ ID NO: 351 - DNA, 526 bp, Hordeum vulgare
  UNSURE (6),(15): n stands for any base
gcacgnagggtcggnacacagcacagcaggataacgtcgccgtcgtcctcgccgtcgccgccggtgccgatgacttcgccgtccgcccccgtcctccacagccaaatcctgaccagacccttcgccccctcctgcggcgtctcggcccgcacccccgcatccgtcgcggcgcagccgtcgccattgccgaggagaatatggcgcctgccccagctccgatcgtcgctgcctcctgaaggagccccggcggagcttgtagcagaagactccaagttcgtgccgttgaacgccgaggacccgatgtacggaccgccggcaatattgctcatcggattcgataaaggcgagactgtcaagattcaggagttcctgaaggagctcgacggtgatttcctcaaggtgattcattgtacagaagaaatgacgaaacaaactttgtgggatgccatgcacactgagcagcctaatgtagaagctgtcaagattatgaaatctccacaaagaatatgcatcttttctggtctga

SEQ ID NO: 352 - DNA, 543 bp, Hordeum vulgare
gttgtgtgtggaaataccttaatccacaccagagactgtgaaagattaagtgctctcaacaaaaaagatcttaattacaaatttacgtcaagaaaagtctcagtgatgttcatctcagtttcaaatgtatgttgatctagttataggcctcccatcggtgtgtttgaaacagtagctagtacaagctgctcaacttctccagagattaacattgagcagcagatggagacagttgaaggattgacattttacccaatggatcacttggagcaggcgatttcaagtgaccattcgaggatcagttcaatgctgcctgaatttgtctctgcggacggatcgttacctgagacatacaaccttcatgctgaattctttcccgtcagcatctcatggtcacccattatttcctcgatcacctcagcaagaatcttctctgcgctgttgggaacaagtgctgcgaaagcagcttgttccaaccctgtttcagggaaggcgttgatgaacatcatcatctcctcaccagtcagaccagaaaagatgcat

SEQ ID NO: 353 - DNA, 542 bp, Hordeum vulgare
gtcccccggctgcaggattcggcacgggcacctcctccgcctggctctcctggtccgtgcaccgccgcttcttctccacctacagcctccccccaccaccgcgcaagctttattcgtccggcaaatcgcacccacaccccgccgccgttccctctccgcccgcgtccgcgtgcgcgcctccaactccgaccctccgcagcaggtcaacctctccgtcctccgcttcaccctcgggatccccgggctggacgagtcgtacctcccgcggtggataggcctcggcttcggcgccctcgtcctcctcaaccacctcctctcgccgtccccaactcccgcgcagctcaggtcggaggctctggggctgtgcctggccgcgttctcagcggcgctgccgtacctcgggcgcttcctagagggtgctggtgcttccagccgtgtgccgttgccagaagggagcaggcaggtgtttgtgattcctgatgatctgtcaacggcgcagaaagaggatatggcctgggcgacatatgttctgcttcagaaca

SEQ ID NO: 354 - DNA, 373 bp, Hordeum vulgare
acatggtaccatacagtacacaatgcagcttgatgcttcaaccatatcctacggcatgcattaaacaacaccgcatgagacctaagcagtaggtgcattctcaagcttgtgagaggacacaacagggggctcctgggagaaggctttggaaggacgcccggctggtgatgctctagaacaaatgatttcaagccgcagagagttcacaagaagccattgtagaccaaggtcaccggatgatgatgaggcgttgagaacggctgataggaaccacccaacgctctaacccataccacagcttcagctggaaaaaatggtatggttggaggagctagataaacatgtaatggcattgctgaggtccatcaactaa

SEQ ID NO: 355 - DNA, 520 bp, Hordeum vulgare
gctcaaaccagcaatttttgagaacagtaatgttctccagcaacttcgatgtgggggggtgctagaggcaataagaataagctgtctaggatatccgacaaggcggacatttgaagaatttgttgatcgctttagtgttttacgaccagaagttcttggtttatgtcatgatgaagttactgccacaaacatgctccttgagaaagtaaatctcacaggttatcagatagggaaaacaaaagtgtttctgcgtgctggtcagatggctgaattagatgctcggaggactgaggtcttgagctattctgctagtaaaatccagcgaaaagttcggtcgttcctggctcgcagaaatttcattcagctgcgaatgtcttctgttcagcttcaggcaatgtgcagaggacaaattgcaaggcattattatgaagatctccgtaggaaggcggcttcattaaaaattcagacctactatcgtatgcactttgcaaggaaaaactacaaagatctctattctgca

SEQ ID NO: 356 - DNA, 551 bp, Hordeum vulgare
gaagaaaaattatgttaaactattacagttattacatcaaatatgacagaatatggatagacatggtgtaggtgtcgctctttgttctatatgctacaaagaatgaattactccactctttttgtgacggggatttgggagggtgaagaaattattcccaacccagccaacaaaaaattgggagaaaagaccaatctatctaggaaagaatgatgatttacatggcacaacataactgcagggcagaagggaaaccctaggttgaatttacaacattgatgaggaagaatacatagatctgctggcacagttcagcagaacatgtccaagggaatgaacagacagcatcttggagggctcgatcagcttttcaagaattgggaagagggcctggtcaacttttcaagaactggaaggcagacattgcgacgagttctgatggtggggccacgttttgaaattccttaacatccatggaatctgctatctcctcaagtgatatcggcatgcttatttcatcatccagtaaaaaggcaccctctgaagcatta

SEQ ID NO: 357 - DNA, 517 bp, Hordeum vulgare
caccgcgcgacaccagatggggtgacaccagctcctacggtgctaaaaagaagcatagagttttttgtcagcttccaaatggtgattgggccttatgcaccgtgcttactacctctggtgacgagtctgtactaaaggtttctgaaggaaaagttctaagactgaaaacggagagcctccaacctgcaaatcctgaaattcttgatggagttgatgatcttatgcagctgagttatctaagtgaaccatccgtgctgtacaacttgcagtacagatattcacaagacatgatctatactaaagcaggtccagttttggtggccgtcaatccctttaagaaggttgcactgtatggtaatgagtatattaatgcatatagaaacaaaacaatggacagtccacatgtgtatgcaatagcagattcagcgcttcgtgaaatgaaaagagatgaggttaaccagtccatcattataagtggtgagagtggagcaggaaaaacagaaactgcaaagattgc

SEQ ID NO: 358 - DNA, 537 bp, Hordeum vulgare
agtaattacttacataaactagtggttatgggcggccatgaaaagaagcagccccccagtggaagaacttacaactcgccctccacgaatacatactcatccagcacaaaacactggacaccgcagcagcataactcacaaactctctaggactagcgccggcgcgtaaaatgccggcgcgtctacaccaccatcatcatcaccatcatacaccattgacaaactcacgagaacttggaggtgttgagcctgccccaccacttgcgcttggccgagttgggggaggactcgttgccaccggcactgccgccgccgctcgagagcttgttcaggataactttggtctcccggatgcgggagccaaagtccttcttccacgagtcaaagttctgcttcagccggcgcagctccacatctgggttcaggctcgcgtccgcctgcccggacttgacctccaccaggaacttggcgtcgtcggcgaacacctggctccgctgctccagctcctccgccagccgtccaatgacgctcatgctg

SEQ ID NO: 359 - DNA, 544 bp, Hordeum vulgare
  UNSURE (25): n stands for any base
gtcccccgggtctgcaggaattcgnacgagggtcgccccccgacgccttaactccttcagaacactacgtcctcgtctactccctcatgatgtccggggactggctgcaggggccctacgtgtactacctctacagccagtacgggttcgacaagggcgacatcggccgcctcttcatcgccggcttcggctcctccatgctcttcggcaccatcgtcgggtcgctcgccgacaagcagggaaggaagagggcgtgcatcacctactgcattacctacatcctcagctgcatcacgaagcactccccgcagtacaggattctgatgattggccgcgtgcttggaggcattgcaacatcgctgctcttctcggcattcgagtcgtggctcgtcgcagagcacaacaagagaggttttgatcctcagtggctgtcgataacattctccaaggctatatttcttgggaatggcctagttgccattgtcgcagggctatttgcaaatctactggctgataacttgggttttggccctgttgctccatt

SEQ ID NO: 360 - DNA, 549 bp, Hordeum vulgare
cggcagaaattcctctgcctaggagaatcctcactggcaccaggaataggggatacaggggcacatgctgtaggtttcatcaagaggttggatttaaatacaagtaggatcatcctattagcaaatgcaagaatacgagggaaaatacagatctggtactatgccaaagctctactgtgcagtgtatatatctcaatacatgccgagccgtgtcctctctcctgacaaaactgaataccgtgagcgcacctaacaaagcaaactaaactgggttcacgtcttattcagcagccctgcagacaagcagatgaagttggagactgttccatgcccggttcacgtcaatggccgctggtgtgttttaagggtttagtggctcatcttctgctgtcatctctgtggccttagttgctctgtgaaggtcggacacaaacatcagccgcctctgcaaaattgccgcgatgaagaggaaaatagaacacatgccgaacatgacagcgattgggaaggcattcacattgtaaagcaccacacatacaaacaggttaa

SEQ ID NO: 361 - DNA, 518 bp, Hordeum vulgare
tggtaattatagggttaaaagacttgcactcatctgtgtgcatgctgttcatcagaagaggtatgattggaataatcaacttttgatgtcagtgcaaagcacatcaatgccttttgtccaattactagaaactgtggcttgtttgataaatcctaaattgccgtggaactgcaaagtagttgggtatcttcagcaggaaaaaatctattgcttatttcgtggaattattactgcagtaccgcaaaatgcaagaaatgtggaacaccgtgatatatctgcgctggagcaagttctcatgcttactgcttcacatgttggtgataatcaatgttgttgtccagctgtggatccaagatggagtttttcctcgcagcttctatccattccttttctctggcatcgtttgccacacttcaagaaggttttctctgctaatgggctcagcaaatattatattcatcagatagcttgctatttgcccagtcgtgctgatgttctcccaaatgatatatcagcta

SEQ ID NO: 362 - DNA, 549 bp, Hordeum vulgare
gaagtcaaaatagctacttgatatgaccttactgggcaggggtaccatagccaaatgctaacgtagaccagcggagccaggatataaaggtaaactaaccctggtactctagcaggcaactagagcatccacggatgcagatcatagctggcgcaacactaaaatttaacgacctacgaactatcaagttcattcatcccttgtattattccacaagcggccattcaatcacaacgactaatacatatgtacatgttcatggctgcttacaacagcatctgcgcttgcttgcctttaccactgtctccgccagcccattggccttgtcatggctactaagctgttgcaggcgccgcctctgatttcccccagccacccaaagatgtccgccctttgtttgttgggcttcaaattgggcccaagtcgtcggtgcttcggtcttggttgcctttaagctgttatctagaaactatctacactgtgcacaatgtccgaatccacaatgcaattagctcagatcgaaaccggcttccgagtttattgcataca

SEQ ID NO: 363 - DNA, 517 bp, Hordeum vulgare
tacgcggcgctcgccgactgcgccgtcgcgtcgcgcagaccctggagggacttccccttcgcggggctcctctgcctcgtcggcgcgctgctcgcgctcctcgtcgacctctccgcctcgtcgcacctcgaagcgcacggcctccaccagcagccgcagcagcaggagggccagccctacgccccaatccccaccaccaagaaggcccccgtcttcgagctcaccggagaaatgagccctaggaaacgcgctttcctggacgagagtgaccgcgacgacccggcgccgcgcgacgacaagaatggcggcgacccggaccgggacgacgtggcgctcttcgggccaaagaaaggcggccggttgccccgcagcgatgagcccctggcccctattgtcggctgccatggcgctgggcatgaggtggtggaggtcggggagggggagggaggaggaggcgagggaagaagcagaagatggtgtccaaggtgctggagattgggatagtgttccactcggt

SEQ ID NO: 364 - DNA, 548 bp, Hordeum vulgare
ggaagattggtaatttcatttcaattcccatacggtatttagatatcataggggaagtacatgttcagtcatcaatgaacttcacaaaacctatgccagatgttggaatctgagaatgatccctctacacattttgctatgacctatgcccagagagctaatatcgacatagaagcagatccaagcaccaatgcaatataagaggccttcttcagtttcagagatgacgacatcatcttgttgtggaagaagtcaagagaaatgaggtcgactagcgccatgtagacaaggattccggcagagagtgaaccaagaaggccttcaattattagggcgtttggactgctatcgtcataaccagtcatatggaagacagccatcccaagaagtattcccaatggtgttgtcactgagaacattatgcacatgtaacccactgttgccattccgaaaccagcctgtgcgatgcagccgccgaggcccatcccctcgaagacctggtggaaggagagcgcgacgacgagcggccggatggcacagacgtcctg

SEQ ID NO: 365 - DNA, 542 bp, Hordeum vulgare
  UNSURE (4),(12): n stands for any base
gggnctgcaggnaattcggcacgagggcagcatagttcaaaatcgaggaaagggacatttatgtgcgaattacgagagaagcgagtacgcaccaacgttagatggcttgaggaaacaatcttcatttgctggagaacacactgcatcggctaatgataacaatcttatagctaacctaatgcaaagtcatcaagaattcattcatggcgtgaagtcgcggctgacaaaactagagcttgtgtaccgctgttggcaaaataatgatatcaagggctctgtcagtgctatgcgaagaatgtcggatcatgctgttactgctgatataattaatgttcttattatggaaaagagtactaagtatatcactctagacatttgcacttctgttttacctcttgccgccaatcttcttgaaagcggatatgatagacatttgaactttgccttggcgacgatccttaagcttgtgaaaagcttcagtgcatcaatattttcatctttgtcgtctgctccaccagtcggtgtagacctcgaagcagagc

SEQ ID NO: 366 - DNA, 551 bp, Hordeum vulgare
tgctatcttatacttttttagtgtgctgtcacatagatgcagaggtgaaggtgtatatacagttgctcaccgatcgacggtcacagagacaaggagcgaaaaaagaagaaaatgtcaagcttaggtttcctatatgctaccactaagctgcagcagctgctcttcagcaagtcaacctcgaactggatgttgtgtatatccatcagaagatgccatgcatttctgcccaacttgcatgtactttccgtatatttcttctgtcgtcgtagttgttagtcctacgccgctacatatctcatgtacgaaagaaaagagggtgaattttctgcgtttataaactgcttggcgtcttgaagatatcctgaagaaagaggctcagctcccgtgctgatctcccaaccttgccttctctccttgtcagggagatgagatttgcatttatcttttccagctcttgaaagcataaactgcagcgttccaaccgctgctctgcttcgaggtctacaccgactggtggagcagacgacaaagatgaaaatattgatgcactg

SEQ ID NO: 367 - DNA, 1156 bp, Hordeum vulgare
  UNSURE (1)..(25),(59),(60),(866),(1156): n stands for any base
nnnnnnnnnnnnnnnnnnnnnnnnnggttgtggatgtaccatatgtctccaaagtgggnnccccacaattgggttgattgggactatcgcgcaggacgagacaattcaggtttttttggtgctgggttacgtgagaaggttgacaatttaagtgaaaggaatccttatttagatgattctgaggacgaggggggcgaatcacaaccatgattatggtgttgctgctgacgattcaagggagtgtatcccttacttgttagagtgttgggacagttttagccgtatatatactcccgggggagcagacatgttttttttttttggagaatataccctcgaactaaacacgttatgttttcagtgaatacatacactaaccttcatttatttccttcgtagttcgtacagttgtgtttgtctcttcttaggtgctcggtttgtggttctttttttttccgttttttcctcctcacaccggtcggtttttatctgtttctcttatatcttccaatgttcgtgttattccgtgtttattctccctctactctttttttccgttctctcctttttatacacgttgctaacgctactatttccctccttctggtttctttcttttttctgcctggctttgttttttcccgtccttttttgtgcaccgattatataaatattgtaatttgtcccacttctcgtttcgcttcctctttactttttttccaccccgttatttgctcttctccctgccgcttttcccttatttttattctcgcttccgtcccgttttgcttatttattttttgttattcgttgttgcccgccacggtgctttttcggtgcgcaactgtctccctgttttcttgtgntccccttctattattcttcgccccgcgcttgttttgtttcacgcgtgatatcactctatcttaagcgtatatcaatattgtttctttctttttttctgttcctgtcctctcgcctcctgtgtggatcgcggggtggatgtaccctctttagtgaccggtaagtgggtgttcggagttagttctgttttgttagcatgctatatttaattaaaccattgttttgtgcttcattcccgtgcaccctcctagggcgtctattatccccgctcttcgcctctctcgccgcgagn

SEQ ID NO: 368 - DNA, 435 bp, Hordeum vulgare
  UNSURE (9),(16): n stands for any base
gcttacatnccacaangtttgcacacaacaccacccgagtctgaaactctgagaaagctcatcgtcgccaattcaccatggttgttccggtgatcgacttctccaagctcgacggcgccgatagggcggagaccatggcgcagatcgccgacggctgcgagaactgggggttcttccagctggtgaaccacggcatcccgctggagcttcttgaccgcgtcaagaaggtgtgctccgagagctaccgcctccgcgaggcggcgttccggtcgtcgaagccggtgcagacgctggagaggctcgtggaggcggagcggcgcggcgaggcggtggcgccggtggacgacatggactgggaggacatcttctacctccacgacaacaaccagtggccttccgatcctccggccttcaaggagaccatgcgggagtacc

SEQ ID NO: 369 - DNA, 486 bp, Hordeum vulgare
aagctgctgggcctgacggtgagcccgttcgtgatccgtgtacgcatggcactgcatatgaaacgcgtgggctacgagtacatggagcaggacctgttcaccaagggcgagctcctcctcaagtccaacccggtgcacatgaaggtcccggtgctcatccacgacggcaaatccatctgcgagtcgctggccatcgtgcagtacgtcgacgaggtctgggccgccacgggcacctccatcctccccgccgacccctacgaccgcgccgccgctcgcttctgggccgcctacgccgacagcaagctcttgcctgcgtgggtgggcatcatgtgggcggcgacggaggaggagagagcggagaaggtcggcgacacgctcgcggctatcggccaactggaggaggcgttcggaaagtgctccaacggaaagcccttcttcgccggcgattccgtcggctacctcgatctcgtcgtcggttcgcagttg

SEQ ID NO: 370 - DNA, 552 bp, Hordeum vulgare
tcaacatgagaattatttctatgcatgataaatagaagacctacctgcttgatattaaatatattcctctttaaaaaaataacaagaccatacttgtgatttcttacaaacaacttgacatcctctttggtgtcaggatggaaacctcttcattctttgcatccttgcaactcatgaccagagctggcctaaacaaaaatacgctgtaaactggctaccgggatcaacaatttctacatgcacttttgtgattttgtcacgacagcaactgggcaaccgtggcaccagcccgatgagactgaagcttcttcaggtactccgccgccgtgccaacgtccggcaccaccgccttcgccgtatcagtctcccaaaaccgcttcacccacgcggccaagaagggagccctgcaggcctcaatgaccacgacgccgaacatcttccgcagcacctcgaaccagagcaactgcgaaccgacgacgagatcgaggtagccgacggaatcgccggcgaagaagggctttccgttggagcactttccgaacgcctcctcca

SEQ ID NO: 371 - DNA, 552 bp, Hordeum vulgare
gtacccccgggcctgcaggaaattcggcacgaggcttgcaagttaggggttgttcttgctgtttacaactttactgactttgacagacagattggggagtcagctggtccagaatgcaaagcagcacttcaagaaataacaagacttgttgatggacaacttcagtctggcaacaactcagttaaagaactgtttggagcaaaaatgttagaaaatgatggtgacttcctttacctactagcagacgctgcagctattgcgttccaatatggcaatcctgatgttttgtgctccccactagttgaagcaaagaagaatggtacggatttggtggaagcatttgctcattacgtgaacagttattatgtcgggagatttaaggcatcagttgcatcatatgatcagaagtatttgaagaacacaactccagctgaatcttcatatagattgtggtggtatcaagtttgcagtgaggtttcatatttccaagtggcaccaaaaaatgatagcgtccgctctacaaagatcgatacaagataccatttagacttg

SEQ ID NO: 372 - DNA, 555 bp, Hordeum vulgare
  UNSURE (26),(27),(35): n stands for any base
atattttctacaaacttcttagtcanngtatccangcaaactttaagtggccaatccggttacacgtactagcacatgctatcacggtattctctgcgcgtataacatccctgacctataaggtacacaaggagtctcatatctccactccccagtaccagcaggtagctatgcctgtattattcgtgtataaatacaacagcagtgccgtgcatgtttgcctgcacaggtgatcagtaggtagctatgctccatctgctcccctgcgtggtcaccgtgtcgcgtccttggtcttggcattctgacagccacaggtcgatgtgatccacgatctgcttccttactttgttcactgcttctggggatgagcatttggatgaatcaccttcaatatttgaaggtgcttgagggcatccggagatatcagtgcaatgcccgcagttgctgcactcaattaagtatgatggcagttcttccgatgatttctgcttagaagcatggcgccatgggtcttgagagccatttgcaaaaacaattttagaacctgcaattctt

SEQ ID NO: 373 - DNA, 518 bp, Hordeum vulgare
tttcggccgcctcccccttctcttctccatttcccacccccaaacgacgaactcccgccgccgccggccgctcccacggcgagctagcccgcccgaattgccgtacctcgccagatccgagaccgcacgggcttccggacctcggttcgccgtgcttggagctgagaatggttgaggggaaaagtgttcaagttgaccttgagaaaggacttaatcaaatgcctaatgatagtaatccaactagccctgcaaccattcagaagatgaaacctgatatggaagattctgggagcaaaattgaatcaccaactctggagaagcttgagtctggaagggaggagattgttgtcagctcattggcaactaatttactttcggagaggtacaaggacagattagctgagaagctgttgggaaatgaggatgaaacagacgatgaagatgataatgacattgctttgcctgatggcagccaatctccagcttcaaatgaacttcttgagaagcacaagaatttg

SEQ ID NO: 374 - DNA, 477 bp, Hordeum vulgare
  UNSURE (21),(22): n stands for any base
cgccttgagaaagctatacannctcattttcaagggggcagctgaacaagtacagcaaacacatcattcacatttgtaggagtaacttaaagtgttcacagacattgccagttaacaccatagaaaacatttagtcgaatttctcttgcacggttgcatctaagttacagcattcagcaaatggtaagaaagaagagttcaatgctacatgatgcaaattcaactcacgttacaactcagttcaattccagcattaagcataaaatcaacaaatggagcagctaaatcaggggccaggcaaaagcatgaagaatttatccgcgcttgttgatgcttagtatttcagtaaagcactagatgtgcaatccagatgattccatgctggtcaaatcccgagaaatcagtacatacagctttaggttcttcggctttgcacagattgtctcatctcaaatgacttctgtgagtctttcccga

SEQ ID NO: 375 - DNA, 482 bp, Hordeum vulgare
gatgtgagctccatgacaagtatgtagcatacgtcactgactgtttccaggggcatactctcttccataaggcgcttaaagaggcttttgaagtgttctgcaacaaaggtgtctctggtagttcaagtgctgaattgcttgccaccttctgtgataatattttaaagaaaggcggcagtgaaaagctcagtgatgaagctattgaggataccctggagaaggtagtgagattactcgcctacatcagtgataaggacctttttgctgagttttacaggaagaagctggctaggagattgctatttgacaagagtgctaatgatgagcatgaaagaagcattctgaccaagctaaaacaacagtgtggtggccaatttacttcaaaaatggagggcatggtcaccgaccttactgttgcaagagatcatcaaactaagtttgaagagttcataagcacacaccctgaattgaatcctgggata

SEQ ID NO: 376 - DNA, 487 bp, Hordeum vulgare
gcaggaatattacagagaaaaaaaactatattgacaatacaatcgaacaaactcaacaacaaccgatagtacatttagtgtacaacatttaccaaggcctgccctgatgaaccaccagttttacctgggcagttctaccatagataggccaaggaactggatctgacgaccttcatgtacaagtgacaacagatgtcggtgccaccagcaagagcaatcgacagcggcaccagggtatccatctggagaagccaatgcggtgtgcagtgtgccatggcacaaaatatagcatccttaaatagcagtagcttggtaggcatacacaccagatgttaccgaacccagcatgcagaaccgatgatcaagccaagtatcggtagacgttcgggttctccttgtccctctccaggtaatccctggttataagatcctcaatgcgcttctttattgctttgaagtcaggcttgaacatgcgaccaagctgctc

SEQ ID NO: 377 - DNA, 516 bp, Hordeum vulgare
gagaaaaggcccaggcaagaaataacaggaccatcatctactgtcaatggccctgttcctaccattgatgcatcctatgagaagcttctttcagccattcctgagtttgctggttttggaaaactctttaagtcatcaacacctgttgaattgactgaagccgagaccgaatattcagtcaatgtcgtgaagcacatttatgatgggcatgttgtccttcagtacaactgtacaaacacaatacctgaacaactgcttgaagaggtcatggtgtttgttgatgcttccgaggcagaagaattttcagaagttgcatcgaagcctttaagatccttaccttatgattcccctggacagacctttgtggcctttgaaaagccagaaggtgtccttgccactgggaagttctcaaatatattgaaattcattgttaaagaggttgattcgtccacaggtgaagctgaggatgacggtgttgaggatgagtatcagctagaagattttgaaattatttct

SEQ ID NO: 378 - DNA, 547 bp, Hordeum vulgare
  UNSURE (2),(3),(21): n stands for any base
gnnggattcaacgaggaaaanccaacttacacatagcctatactataattaatcgaaatcccttgtgctttcaccagatggaaagccaaaacaacaaaaaggtcaaccaaaaaactcttgctggtagttttagccatttgcaacaatttcatggatcctgtcactgacctccggatcatctgatctgacagctagcttcatggccacttctttcggcccgctgattccaaatgatagtctcaccaaaactttcacattaccgatgaacacacctgaaagcaggcaagtgtgcgatctcgaattgttttggacaacatcggttccctcgcaaggctgcatgccaaggatgcttataacagcactcacagcctcagccaagttctccctaacaccaagtccatactcatcgacccgctcactttctggatccatgctttcccaagcatttcggaagttcgaaacccccaccttcaacatgtaatcagcagaaataatttcaaaatcttctagctgatactcatcctcaacaccgtcatcctcagcttca

SEQ ID NO: 379 - DNA, 519 bp, Hordeum vulgare
gcgcacacttgccatcgacggtggacgcaccatcgtctcgtcggtgcaccagccgagcagcgaggtgttcgcactcttcgatgatctctgcctcctctccagcggcgagagtgtctactttggagacgctaagcttgcaccgcagttctttgcagaaaccggattcccctgccccagccggaggaacccatccgaccactttctccggtgcgtcaattctgacttcgacgatgtcgccacggccatgaaaggatccatgaagctccgagcagaggcagatcttgatcccctgctgaagtactcaacttcagagatcagagagaggctcgtggataagtaccggatctcagactatgccatgatggttaggaacactataaacgagataagcaaaatagagggtgtgctggaggaggcagtgaagggcagccaagcgacctggtgcaaacagctgcgcacgttgaccaagcgctcctacatcaacatgtaccgtgacttcggctactacaggctgcgcat

SEQ ID NO: 380 - DNA, 549 bp, Hordeum vulgare
  UNSURE (31): n stands for any base
ttaatctcgtatctgtattggttgcagcgancttcttacagtaaaaccaaacttttaaagaatgcactatccgtatgtttatgaacctcgcgaagctgcagacctgcaagcaaaactaacaagtggaaacgcatacacaagtaatagtgacacacgcatgtcacggacggctatcatcttgctgtggtagtaatgatcaactcatctgcatgccggggcggctgctcctcgaactcattgacattgaccagtcaatactgctgtatgggggagttgagcccctcctgcatggccatggggtgcggcgtgttgtgccgcttcgacaaggacgtcatggccagcgactccctgaaggacgcccgccgctcaaggcgcttcacggtgaaccgcgtgtaggccacgcggatgtagggcgcggcggcctccttgaccttgaggacgaagaagaaggtgacgcggtaggcgagtaggaggatgaagatcatggctaggtctagccacttggagtagctgacgctcagccccatcatgttggtgatgatgaactcg

SEQ ID NO: 381 - DNA, 1722 bp, Hordeum vulgare
  UNSURE (11),(39),(47),(65),(97),(145),(427),(435),(568),(852),(859),(865),(916),(971),(1007),(1028),(1055),(1164),(1270),(1290),(1318),(1325),(1330),(1366),(1368),(1399),(1413),(1445),(1468),(1494),(1497),(1510),(1511),(1515),(1523),(1565),(1576),(1635),(1673),(1675),(1677),(1699),(1712),(1722): n stands for any base
tggttctctcnccaggagtgcttgacaaggacacatatncgtgacancgcaatgtgtgcacgacncatactacacgactcacaccacacccagatgncatgatatgtagtgtgagcgatggtctgaagcgcgagtatcacagtgnatctacagtacataatactcgtagttcgatatcaaatcgagtgacagacatgagatcagtgctgttaggtgcattgttcgatacagagacgtcatatatgtctcttcatagctctgtagtctatctatgcactagtgtatgtgcagtgtcatcgtcgctgctcagctgctcaacattcgacatgcttcagcaatatcgtggagtccctgcgtagtcatttcgatatacatcagaccgttcgcgatagttatcttgtggttttgaatgccgtatacgccatcnaattcgcntcctggctgcacacgtccttactgttatcgatgcatcactgtgtaactactttacgatgatactgcgtgctcgcatatattgtgtaagatgtagcattacgtcatttactcagacatctggtagatcctctcntgttccgctatgcagttctcagatcttcgctttctatagtgctcatctgtgactaataatcaattaagactatctagcatctagagtttactatgtctttaatactcgtctagcctcagaagtcatgtcacacgcgatgctgttgtatgcattgcattgaccgcgacgagatggcgtgcagatcggatatagtacggcagtgagctgtatttcggtatccatctatattaatgtgtatacaaatttcagctttagtttgagttggtgtcgaatcacgtgattcnagatctngtatgnacacgtggcgttacgctacacgacgcgtctcatcatacgcgtatgatgatncacgcgtttgtgctgtcacgagtgcacgattcgtgagcgaataagatttagttgnttccaatcatgtcagagcattagaagccgacaatgnttgcccacaggcgtctccatnctatagtaaccgcccagtaatccaaancgtccacgcctatttaatgtacagtgcgtgtcggagactgtagtgagtgacgtgtacattagacctccgatgtcgtcgttgacaatgcgagtattactcgacctgcgtntgctataaccgtgtatttgttactagacaatgtaggtcactccgacctacctagtatgtcgtccactcgtactagtattacgatctcaatgtgtcacacctacagnttcgggttatcgagcatatntgttcacatcgtcatcttatatgatgcnacgctcntgtcntgtgatatgtatatccttatgctgcctcctacaccncnctgatgactccgtattgtacacacactgtgngtgacacgctgcangacactatagtttctcgtctacgtgtaggatntgaacacgctctacacctgactnttgtgttgtcttgttagtgtctctgntgnctttcacaccacnntcancagagccntgctgtatatccgcgtattggtgatatctcgacctatcatantatactaccgngtccgtggtaacatcacacatgagttgctacacacacgtggttgctttcagagctcgcnattagacacacaacaagtctcactctgtgcatgcgtancnancccgcgtaggtctcatatagtngtgataggactantacagtgagn

SEQ ID NO: 382 - DNA, 517 bp, Hordeum vulgare
  UNSURE (44)..(48),(61)..(67),(272)..(277): n stands for any base
tggtgttagtgttagcctgtctttgtggctgatgagacttggannnnnggtttactagcannnnnnnaacactaatgtccattatacaactactagttggtctaaaatttacatgattcctccaaacaataagaaaaacaatctgttattttcaatgctgctaccctcggctgtatgacgaccccttggatgctaccggtcttcgcttctgttgagtcctaaatgtcgacccagattttacgaatctcctgcctgcgctgttgttcctaggnnnnnnttcaaatgcattttcagattttccaaacctcggattgtttcttgcatactcttccctgtttctagcaacttcttccctctttttcatcttgctggagctaggcctatatagaataactgagcggccaatttggtcgacagcaatggatccggttgactcctcaagttgtcgtatcacatcaggtagttctccagggcaattcccatgaatttttagcttgaggagctcgttggactcaag

SEQ ID NO: 383 - DNA, 368 bp, Hordeum vulgare
ggagattaagacggcgcgtgcgctgggactgatgcctttcacgacgatgggcaagagaccgttcttgtttggcagaagcgcagaggaggatgcttcagaggaggagtacgggtatggctttgtcgagaaggatgctgggcctgaagaccccgttgccgacgctgtgcccgatgtggaggctgtgtaaacagtgtgggcgttatcgcctcaacgacgcccagttagtaaactgctgctgtctaaaaatgcagcggctgacgacttaaggatattgcgacgaactgttactctgttctttgttctgaaggagatatgctctgtgctcaaaaaaaaaaaaaaaaaaaaaaaaaaaaaaaataaaaaaaaaa

SEQ ID NO: 384 - DNA, 301 bp, Hordeum vulgare
acaaagaacagagtaacaggttcgtcgcaatatccttaagtcgtcagccgctgcatttttagacagcagcagtttactaactgggcgtcgttgaggcgataacgcccacactgtttacacagcctccacatcgggcacagcgtcggcaacggggtcttcaggcccagcatccttctcgacaaagccatacccgtactcctcctctgaagcatcctcctctgcgcttctgccaaacaagaacggtctcttgcccatcgtcgtgaaaggcatcagtcccagcgcacgcgccgtcttaatctcc

SEQ ID NO: 385 - DNA, 518 bp, Hordeum vulgare
  UNSURE (11),(12): n stands for any base
ggaaccatggnnactccatggtggaaaaatccttctgctaaatcgatctctctcagtcatgatgggagccagcttatcagacaaataagtacagacgatactactttatcagatccagtgaccgcctcagagtctttcatcaatgaaataccagaagggccagaatctcctctcccatcactcaaacagctaaccagggctgagccatctcctctgctcactgttcacttggttgatattctctacagttactgcttcacgcttcgcctctacaatggtgattggcagtctgatcttttgggtgcttcaactgttgccttgtctatgtcgaaagtcatgggggacggcgctaaacctgaggcagtatctgaagcgctcacgacgtgcatagaggagacatgctctcctgtttaccgacacaccggaggtttcaggtttgctattggacttgtggatgatatcgtcagaatcctctccctaggaggcaatgcagtggtttgtgcattgtgtgacttcca

SEQ ID NO: 386 - DNA, 541 bp, Hordeum vulgare
tgtgattaactacggttgccttaatatcagaacttcagaacttcagaaatgtaaactgttacatcttccaaagatgacaatttatacatttaagccactgcacttgaaggtgaagaaaacaaggatcaaatgatacagctgagagataccacaaggtgccgaaacaacgaagtgtggttattccagcagtactgcgttgacaggcttacacctcctcaataagaaccttggactgcgggttgttctttctacctgccttcctcagtccgcttccaccgtccagctcctcaagagctgctttctgcacctcaacgatgcgagccaacgacggccacacctcacttggctgctcatgagcccagcatgtcatgaagaacagcttcctaccggcggcatggagctttttgaagctccgcgccttttctgcctcacccattttgtcttccttgaggatgctctcgccagcttggatgagcctgtggaagtcacacaatgcacaaaccactgcattgcctcctagggagaggattctgacgatatc

SEQ ID NO: 387 - DNA, 518 bp, Hordeum vulgare
agaaagggtaacggagcaggccggaccggagcagcggaagcctcaagccaccaccaccatcctccgattcagatctcccctcccattccaccgaccggacccctctccgtctccatttctccacaccaaacgcctctccgacctcggtgacgacctcctcgtcgtacagggggccatcagcggcggcggcggaggccaatggaggccatccggaagcaggcatccaagctccgagagcaggtcgcccggcagcagcaggccgtgctgaagcagttcgggggcgggtacgcggacagcgtgttcgcggacgagggcgaggcgcagcagcactcgaagctcgagaagctctacatctccacgcgcgccgccaagcacttccaaagggatatagttcgtggggtcgagggctacatcgtcacaggctcgaagcaagtcgaattaggcaataagttatgtgaagatggcaagaagtatggtgttgagaatacctgtaccagtgggagtacactctcgagggc

SEQ ID NO: 388 - DNA, 542 bp, Hordeum vulgare
atattagaacaaaaggaatttcccgagctcttactgataacgtctttggaggcgaaagaacattataatgcacattgtacaacgccaaggacatgtatggctcaatgaacttctagaagacctgggcgactttgctcgccagtacacggtcccgcttttcgatgaactcgtaagggaaccaaccagctttccccctgcactcaccttcagcccatccattgtttgacaccttccggaccactatgtagtcaccggttgccaggttgagctcagtttcagtctcagctcggtatgactggatcgcctcagccaggaagtgctccactgtctccaccaattcggcaactgttggagtcctcatgaatataccgttaacttcttcatatgaaggtggcggtggcatagagttctcaatgactggaggaggtgctccttcaattctttggcgctcagctaccatctctctttcaagttgatctagaatctgtaggaccctttggtggtaacttctctcagattcaaccatcgcgataagtcgttgt

SEQ ID NO: 389 - DNA, 518 bp, Hordeum vulgare
gagaagggggagaatgggaagggaggaggtggcggtgcggaccacggaatcaacgacgcgctcaacgaggtgcgccaacttgctatgcaggtacgcaatctaggttctccacgttcgataactgttcttagtggaggttctggacaaacaggactatcaggactaatagtacctgcagcaactgttggagcactgggttatggttatatgtggtggaaaggcatctcctttggggacttaatgtatgtcaccaagcaaaacatggcaaacgttgtttcaagcatgactaaacatctggagcaagttcagagctctcttgctgctgctaaaaagcatttgacacaacgcattgagaagttggatgacaaattggatcagcagaaggcactttctgggcaaataaaagatgatgttactggcgcacgactgaagcttgagaatattggttcagagattaagaacatcaaagaattggtctggggactggatgagaagatggattcaatggaagccaaaca

SEQ ID NO: 390 - DNA, 553 bp, Hordeum vulgare
  UNSURE (27): n stands for any base
gccaaaagtgggacacgacagcatttntattgtatgaagcaaatccatcaaaacagaatgcacaaacagcaagatttacagacccataaatgaaatggttcaacgaatctcaagtgttacatttatttatagctaggtattgcctaaaaatgcaaggcacaagtgatgccagaatactctctggtctagattccctagtagatactactccctccgtcccataaaagtcccataaaataagagcgttagtgtcagaagctctcttatattacaggacggggggagcacttggcacacgttttcaagtttaaaaaacagcacttcctgcaagcaaataacaaaaaggctgggacacttcacattttaaccagcaaggatctccctttacaatgttccactgagcaacaaatctggatattcgtctcgccaaccccaaagaaaattagttggcagacttcaacgagttcgacctgcttatcttgtcagtggaatcagcattgctgaattcacgataatcccctgtttctatggctagttgcaacccctgtatgcc

SEQ ID NO: 391 - DNA, 549 bp, Hordeum vulgare
gtcccccgggctgaggaattcggacgaggggtgatcggagaggctctatattgtctatgccaggaggtgatattcctcctggtggtgagtatatccaggcagccgctctagtgagccaacctgctctttactcgaaggacctgatagagcagcagcttgctggtccagccatggtacatccatccgaggcagttgccaagggtacaaagtgggcagaactatttgaacctggagtgaagcatgcactgtttgttggcattggattacagatcctgcagcagtttgcgggtatcaacggagtcctgtattacacgcctcagatacttgagcaagcaggtgttgggattcttctatcaaacattggactaagctcttcctctgcatctattcttattagtgccttgacaaccttgctgatgcttcccagcattggcatcgccatgagactcatggatatgtcaggaagaaggtttcttctcctctcaacaatccctgtcttgatagtggcactagctatcttggttttggtgaatgttctggatgtgggaa

SEQ ID NO: 392 - DNA, 557 bp, Hordeum vulgare
tacacaaaatcaaaggttccagggcgaaaagaacagatgatctaagtacatatcctacttcaaaagccggcctacgacgacacgattcagcctcacgatgtaaagtctttcgtatctgctccctttgaagtttcttaaccaaagcatcgcaggttaaccagtgtagtagtagttatgacaacacaaaattaccaccagcgacgcggatcaccggatcagagcaactagtctgtggcttccttgccctgcttcgccccgaccgagaagaactcggtgatgacctccaggggcatgccctttgtctcagggaccttcatgtagacgaatacgaaggctatcatgcaaacgacagcatatattccgaaaactccagcgagtccgatggcgttgagcatcacgggaagagtgtatgtcacgatgatgtcaccaatccagaaggttagtgcgcagatggcaatgcagatgccacggacggaggtggggaaaatctccgcgcagagaatattcgggataggcccaaaacccatgacgaagaagcagaagtagactatgacact

SEQ ID NO: 393 - DNA, 519 bp, Hordeum vulgare
cctcgtgccgaattcggcacgagggtcatatagagcaatcggtggagtcgtgcctcttgtcgcaaagctgctgacacccccagctggtatgaaactgacgtgccctcctgcgattgttgctgcccgtgcagcaatatcccgcacggcatttgcgaaggggcttcgccctcagcccctaccaacaaaagtagtggtgatcgcgctgctcggtatggcagcaaatgttcctcttggcatctggagggagcacaccacaaagttttcagtgcagtggtttgcggcggtccatgctgcagtgcctttcatagggatgctgaggaagtccatcctaatgccgaagagcgccatggcccttacaatagctgcctcgatattgggtcagacaattggttcaagagctgagcgtatcaggttgaagagggcaaaattagcagcagagggccgtggtcatgaacatgctacccggcttgaagctccggtgagcctgaaaactgggagctcaggtcctgtccagctctg

SEQ ID NO: 394 - DNA, 542 bp, Hordeum vulgare
cccaattatgatagtggggacagaatccaagtagccagcaatcctttacaagacacaataacaatgaatacaaagaaacaatttctggaactctgatacaattgtcgcagccgccgcaataagcatgatcatctcatcaatacatggcaccgacagtcggaaccagggctggggacacgacgcctttgaccctgaggccgagcggatcccagagctggacaggacctgagctcccagttttcaggctcaccggagcttcaagccgggtagcatgttcatgaccacggccctctgctgctaattttgccctcttcaacctgatacgctcagctcttgaaccaattgtctgacccaatatcgaggcagctattgtaagggccatggcgctcttcggcattaggatggacttcctcagcatccctatgaaaggcactgcagcatggaccgccgcaaaccactgcactgaaaactttgtggtgtgctccctccagatgccaagaggaacatttgctgccataccgagcagcgcgatcaccactact

SEQ ID NO: 395 - DNA, 537 bp, Hordeum vulgare
gtccccggctgagattcgccgggcatgtcgagtgctgaacaggtcaggaggacggtggcggggatgcgatggaagtccaagctacttgatcacgaagatggccctcttgtgcctgaaaaacttctgattgctgttaaagagtacttggttggcagcaaagaaggaaagagttcatagactcttaccctgcgtcaagattttggacctctgattgctgttgggtactgcgtttggcaacggagaaggaaacagttcatagattctctccctatatcacgattttggacttctgattgatgttaaagagcagcgaaaaaggaacagtgcatagattcttgatccctgcgcatcgatctagagcttgttcatagatacagatctctgttgagatggtatagttgacaaaaatgtgcatgtccttgaaggaaacattaattgatgatttttccaatacgtttcagtcagttatccaataccgggcttaggttacatttcatatatcttgacgaatgagcattggcagtaatcctgtaatgt

SEQ ID NO: 396 - DNA, 545 bp, Hordeum vulgare
  UNSURE (1),(29),(95): n stands for any base
naagacttgcatttccagtacattacagnattactgccaatgctcattcgtcaagatatatgaaatgtaacctaagcccggtattggataactgnactgaaacgtattggaaaaatcatcaattaatgtttccttcaaggacatgcacatttttgtcaactataccatctcaacagagatctgtatctatgaacaagctctagatcgatgcgcagggatcaagaatctatgcactgttcctttttcgctgctctttaacatcaatcagaagtccaaaatcgtgatatagggagagaatctatgaactgtttccttctccgttgccaaacgcagtacccaacagcaatcagaggtccaaaatcttgacgcagggtaagagtctatgaactctttccttctttgctgccaaccaagtactctttaacagcaatcagaagtttttcaggcacaagagggccatcttcgtgatcaagtagcttggacttccatcgcatccccgccaccgtcctcctgaccttgttcagcacctcgacattgcctcgtgc

SEQ ID NO: 397 - DNA, 518 bp, Hordeum vulgare
gtcgtcgtcggtagggtcaagtacggcgtgcctcacctgaccgtcgtcgggccctacgaggtcgacgtcagcctggaggggaacctgatcctgtgccggcagatcgaccagcctgggatgatcgggaaggtcgggaacatcctcgggcagaggaatgtgaacgtcagcttcatgagcgtcggccgtacctcccgtggcaagcaggcgatcatggccatcggcgtggacgaggagcctgacaagaagacgctcgagaagattggggcgatcccggctatcgaggagtttgtgtttgtcgagctatgatggacagttggcgctcgctccactcctcagtcctcactagaataagtagcagctcgtcatctgccacagggagtgaagtgatccttccacgcctccacggcgcctttgtttcgcctccgtttgaataagaacgatgtatttgtatgtatgatctgtgtgtcaatgtgtgtgcctagcgcttgtttgtggagagttgtatcatagtgctgtat

SEQ ID NO: 398 - DNA, 554 bp, Hordeum vulgare
taccaaaatattttgtgtctctatttcaacacagaaaaaattatctagtcaaacaatataatacagcactatgatacaaactctccacaaacaagcgctaggcacacacattgacacacagatcatacatacaaatacatcgttcttattcaaacggaggcgaaacaaaggcgccgtggaggcgtggaaggatcacttcactccctgtggcagatgacgagctgctacttattctagtgaggactgaggagtggagcgagcgccaactgtccatcatagctcgacaaacacaaactcctcgatagccgggatcgccccaatcttctcgagcgtcttcttgtcaggctcctcgtccacgccgatggccatgatcgcctgcttgccacgggaggtacggccgacgctcatgaagctgacgttcacattcctctgcccgaggatgttcccgaccttcccgatcatcccaggctggtcgatctgccggcacaggatcaggttcccctccaggctgacgtcgacctcgtagggcccgacgacggtcaggtgaggcacgc

SEQ ID NO: 399 - DNA, 438 bp, Hordeum vulgare
tgtttggcaggatggtaaatggacagagtggtcccgtgcacgagagaggaaagataaatcaaataagggtgattctccatatgagaaacgccagcggacagcagtgagcgatcctgtgcctgttgttggagaagcacggcccccttctaaagacaagaagagcactaacactgtagtgagcgatcctgtgccaactgttggagaagcacgcccccctaccaaggacaagaagagcactaacactgtagcgagcgaccctgtgcttactgttggagaagcacgcccccctgccaaggacaagaagagcgttaacactgtagcaagcgaccctgtgcttactgttggagaagcacgcccctttactaaggacaagaagagtgttaacactgtaggaaaaccagatgagccaaggccactggctttatctgatagggacgt

SEQ ID NO: 400 - DNA, 549 bp, Hordeum vulgare
tgtacccgtcgttcttctccttggcattgtatccatacagattaaacggagggtttgggggtgattaatggctaatcctacgacacaataatactgtccagtgcaataaagagagaaaagccactaacttaagctagttttatagtacatccacacacacaccaggtccaaaagccttcactcaaatcctatcctttttgcttccatgctcggcaagctaccgatatgtacaaacacgcgtctcggtgccttgaattagccatgagcttttcctcttgaggcagaagtagcactcctgaaattagtcctagggactttttcgccagtaattttggaggctataagagaactctgcaggccctcgagcaaccgtgaagttggttgaatccggcggtttgaccttcggggttcagcagaatctgagctagtcttggctgaaacgtcaggagttttcagcacccttctgttcacgttactatccgcagaaggaacgaatttccttttagctcgattagcagcacttggattcttcttgatagcaggaatggt

SEQ ID NO: 401 - DNA, 377 bp, Hordeum vulgare
cgccctcctggctctccgtgcccaaccccaccaacttcaccgacgacctcctcgcccgctggctcacgcccgggggctcgccctgccgcgacgcccgcacggccaacatctccctcccggctcttgacggcgccgcggcggcggggggtgtgaccgagctgagcgccgccgagatttacgtgttcaccttctgggcgctcgacggcaccggcctgcggcgctgcctcggcggggacttcttcgagattgatctctccggggcggcgtggaagtcgcgcccccccgtcgtggacaacggcgacggctcctacactttccgcctccaggttgcgccccgcttcgccgcgggggagttccgcctcaccatcgtcctcctc

SEQ ID NO: 402 - DNA, 461 bp, Hordeum vulgare
  UNSURE (459): n stands for any base
ttttttttttttttttgacccacagaaattgtatatgcattacgcccccctcaacggtatcggtatacatacttacatgtacctgattttcagccaaagctagctccgatcgaacttcgaccatccttgccagctatagcaagatcagaccagcaacatagctgaatgatcagacggtctcgccatataaaacggttcagctatgcccgcgacgatatgtgtggtacacatgaactgataccacgatttcacctcagcaaccccagttccttggctatcctactctagcacacaattgagctgcacaaacttacagagcatgatggaactttcatccattgcagatggcattgaggagcacatgccccagcatgaggtccacgaagtactggtggccgatcttcccgtcccgccataccaactttgccggtgcacgcccgtagtgcacgccgtcgttgnca

SEQ ID NO: 403 - DNA, 527 bp, Hordeum vulgare
gccgaaacctggttcgaatgggttcttcctcgagcaacgccaacgaagcggcggcagcggcggcggcgccacctcctcctcccgcgccgccggcccccctccacgtgatggacgcggacgaggacgacgagaacgtgaagcagctcaacgagtgcgccgcactctacctctcccttcaggactgcctcgctgactccgaccgcaactggaaggcctgccaagcacatgttcaagccttgaaagcatgtgaggcgagcagaaacaaaaatcagaaaacatgaaatactttcatgcgctttcgtttcaggctaaatgttgaacgcatctcactcataccatcttcgtgaagactataacacaacgtgctggagttttgagctgttgatggagaagatttgcaacatcaaaaaatatagtgtactgtcaactgaaaagacatagatgatctctagattgcttttatttttagcaatcactgaactagattcgatgtttcaaacagtacttgtgatttctaataaatggcg

SEQ ID NO: 404 - DNA, 528 bp, Hordeum vulgare
  UNSURE (15): n stands for any base
tgccgccatttattngaaatacaagtactgtttgaaacatcgaatctagttcagtgattgctaaaaataaaagcaatctagagatcatctatgtcttttcagttgacagtacactatattttttgatgttgcaaatcttctccatcaacagctcaaaactccagcacgttgtgttatagtcttcacgaagatggtatgagtgagatgcgttcaacatttagcctgaaacgaaagcgcatgaaagtatttcatgttttctgatttttgtttctgctcgcctcacatgctttcaaggcttgaacatgtgcttggcaggccttccagttgcggtcggagtcagcgaggcagtcctgaagggagaggtagagtgcggcgcactcgttgagctgcttcacgttctcgtcgtcctcgtccgcgtccatcacgtggaggggggccggcggcgcgggaggaggaggtggcgccgccgccgctgccgccgcttcgttggcgttgctcgaggaagaacccattcgaaccaggtttcgg

SEQ ID NO: 405 - DNA, 541 bp, Hordeum vulgare
  UNSURE (4),(12): n stands for any base
gggnctgcaggnaattcggcacgagggggacaccacgcgccctgagctcaggcagccattggcttttgaagtttggcaacatattagagaagaactcaaaccaactgacaagataaccatcctgaccaatggtcctctcacaaacatagctaacatcattctatctgacacaaaagcagaatcaataattgagcgcatttttatagtcgggagtcatttggctggcggagatggagatcgaggcaatgtgttcactgttccatcaaataagttttcggagttcaatttctttcttgaccctcaagctgccaagacggttgtagaatctggtttagacatcactctcattcccttgagaacacagcgccaggtggcttcttttgaagaagtcacgagatcgctatgtactgctgagaagactcctgaatcatcatttgcatatcgggtcttgctgtcaatgcagaaattgcaaaagaataaccaagcatatcatcacatcgacatgttccttggggagcttcttggtgctgttttcttggtt

SEQ ID NO: 406 - DNA, 540 bp, Hordeum vulgare
gagtctttgctaacagaataactatttccttacggacgtggaattcaccctccaattctcattaaacagaaaaaacacagaaccaaactatcactacaggcaaaacaaacagaaagttccatgatcaccatcttggttatccttctccataactcccttttttctcataggtgactatcttgcagcaagcctgtagcagcatggattggaaagacagataatgaaaaaattgcagtcttgcacaactgctttgaattactcctccggcgaggcagcaagctttgtggtgttgacactacaacaaagggaggagggcaagagagaataatattttcctttccatgcatgcgccagactatttagcagaagcacgttatttgttccacattcttttctgctcatcaaagctacccacgactgcggactgcttcttcgtattgagcagctttgcaaattcggtgtaataagcattcgcgtcgagatgatctaatacctttactacctttccattcgcttggtgcaggacagtttcaccatcta

SEQ ID NO: 407 - DNA, 356 bp, Hordeum vulgare
atcgtccagtgctcaccatcccaattaaagtctttgatcttcagcagcagaggttatagcagaattaaggatgtcttgcagttgtggatcaagctgcggctgcggctcaaactgcaactgcggcaagatgtaccctgacttggaggagaagagcggcgccaccatgcaggtcaccgtcatcgtcctcggcgtcgggtccgcaaaggtgcagttcgaggaggccgctgagtttggtgaggccgcccatggctgcagctgcggtgccaactgcaagtgcaacccttgcaactgctaagctgcaaacggtgtatgcgattgtggtgattgtgtcgtgtgtgaacgagtgtgaataatga

SEQ ID NO: 408 - DNA, 281 bp, Hordeum vulgare
ttttttttttttttttttttttttttttttggagcgaacctgtttttgtatattcacttcagtttagatgggccattacaaagacacacgcacataggctcgtacacgcaaacacataacaatagtgatattttcacaagtcacaagcacaccaagagcaaaccacaccacaacacagaccaaccggctggtgctggtttcattattcacactcgttcacacacgacacaatcaccacaatcgcatacaccgtttgcagcttaacagttgcaagggttgca

SEQ ID NO: 409 - DNA, 442 bp, Hordeum vulgare
  UNSURE (11): n stands for any base
gtccctccggngctgcagggaattcggcacgaggccccaataatgcgcggcatcgcctccgccggaacgctccaccccaggccatctgcggctgtccgatcaaaatccaacgcggcagaccgccccaccctccaccgacgacccaccctccacctccggcggtcaccggaaaactctctgccgtccatccgccgcagcggtcgcctcatgcctcctcttaccgcggccgccctggccaccagcagcggcgcggaatccttcagcgagctggcctctgccgacgatttcgcggccatcgcatctcccgacggccacatctccgtcatcggcttcggctcccttctctccgagcggagtgcgaggagcacgttcccggagctggaggggttccgtgtggcggcgctgcgcgggttccggcgcgtcttcgcccacgccgccccaa

SEQ ID NO: 410 - DNA, 342 bp, Hordeum vulgare
agcagtgtacatcaattcaaaacagggtcacagatcacagcgtttggcgccaataatctgcgcggaaaacaatcgcaatcttagatattctgcactgcagcatcatgcattatttggcgcaaccccgttcatatctgactgccgatttcgtaggcagcagtcacacaagtgagaatttcaatttgtgatggccgtggccgtgagagtcgtcgtctagttagccgccatagcggctttttagcatctccggtggctcctcttccatgatgccagctccggtcgtggccaagtattcccttatcgtggctctccggtcacccacataggtgtggtccaagaagt

SEQ ID NO: 411 - DNA, 518 bp, Hordeum vulgare
caaccgcgttcatactgagtgatattgtggtagtcttgaaagaagtaaatgagaagttcttgaatactggtattaacagaattaaagccaatttgcagagttttgtcaaaaaggggcgaatggccaaagaggattatgacaagaaactttctctactgtctggtgttcttgactacgagcaatttagagatgcagatgtggtcattgaggccgttattgaggatatatcgctgaagcagcaaatattctctgatcttgaaaggagctgtcactctaattgcatatttgccacgaatacttcaacgatagacttgcagttaattgggcaacaaacagcttgtcaagatagaattgttggtgcccacttctttagtccagctcatgtcatgccgttgttggaaatagttcgtactcagcagacttcctcacaagttattgtggacttgctagatgtggcaaagaagatacggaaaacaccaattgttgttgggagctgcactgggtttgctgtcaatagg

SEQ ID NO: 412 - DNA, 551 bp, Hordeum vulgare
tgaggttggtatatatgaaataagggaaggaaacggcacaagctcggcattttatttccagaattcccaaggatcgcacggactgtccctggccctgtagaaacatacacaggtttcgcggacatgttgcaacagtgcgccaggggaatccacaatgcagaaaactactgcaccgacggtaaagatcacagcaacacattacacagcagcagtttcagaagaaaagaaaaaagccacacccaccaacaatcaaaccaacctacgtacgtagcatttttgctgtgcactttattacgtacatctaatatatgattgtatccgaaccattccagctcctgtcatgtccttcacctggactggacaaggcagaacacagcataaaatgggtacacgatctagagccgcgacttgacgccatcggcagccaaggatgtgccacaactagctctggaggctagatattcacagggtttgaagaactctccataatccttggaccacgcatccagtctgcggtacacgtattccgcgccgagagagtcggcccaaaa

SEQ ID NO: 413 - DNA, 496 bp, Hordeum vulgare
ggcggctacccctacgccgagcgagcctccgacaagtaccacggcgtggctaagttcgatccggcgacggggaagcagttcaaggtcccggccaagacgctgtcctacaccaactacttcgcggaggcgctgatagccgaggcggagcaggacagcaagatcgtggcaatccacgccgccatggggggcggcacggggctcaactacttcctccgccgtttccccaaccggtgctttgacgtagggatcgcagagcagcacgccgtcaccttcgccgccggcctggcatgcgaggggctcaagcccttctgcgccatctactcctctttcctgcagagaggctacgaccaggtggtgcacgacgtggacctccagaagctcccggtgaggttcgccatggacagggcggggctggtcggcgccgacgggcccacccactgcggggccttcgacgtgacgttcatggcctgcctgcccaacatggtcgtcatggccc

SEQ ID NO: 414 - DNA, 526 bp, Hordeum vulgare
  UNSURE (5),(29): n stands for any base
caagnacaaggtatgtgtccacaccacgnaacaattaaccatgtacatcaacgtcagtgcaaagaacgaaaactaccatgtttccccttatcaggatcattaaattttctgacgccgactaagtaacctctgaatcatctaacgaccaaaatgtacagggttctctctatataggaggcagctctaggcattctgcaccgtcatgatggcgagggcctctcttgcctgcccgaggatgttgaacaccgtcgcggcgatgtgcgacggcgtcagcccggcctccgccagctgatcggcgggcgatccatggtcgatgtacttgtcgggaagcaccaccggccgccacttaagtttgccgtcgagaaggccgtcgagagccatgaactgagccacgtgcgagccgaagccgccgatggagccttcctcgacggtgatgatcacctcgtgggatttggcgaggctcctgatgagggcgtggtccaagggcttgcagaacctggcgtcggcgacggtgaccctgaggccg

SEQ ID NO: 415 - DNA, 236 bp, Hordeum vulgare
atagtctgtggctccatgttggtgagaaaaagcttgtcagactagcctctctaaatgtgttccgccttatggagtacaatgcatcaattgagttctattgggctcctctcctagttgagtcgaactcagatgatccagacatccatagcatcacggaccgaatgatcacgccaacatcgatcgccaagcatgcagcaaactggataggggtggactattttatcttcaacacttac

SEQ ID NO: 416 - DNA, 542 bp, Hordeum vulgare
  UNSURE (15): n stands for any base
gcatcgaagcttccnttaaatgtacactcagaccggcaggcggtattataactctcaggccatcttggttgtttatagctacagtttgccatcctgcgagcgtaccttcgagcaaatctccgaggtgaaccaacagcatagatttctagacctagaaaaaaatatattatatggccgcaataaccatctttcgtactaatgtgaactaccagatttggagcagatatatatgcatggtcatctttcagattgattctcaatctgccgctgtatagggctcgacacaatgtggccgtaaatgaactcattccatgtgtccggcaagccagggagacaccagtggatgcagtcggcgaacttgcgtgggttggcctgctgctccttcgtcaggagcttaccctgccgcagagtgtgcacagatgtgtgtgcgtccttgcggatctccgacaatgcggttatgttgatgaagtgcacgggtaccttcttcatcgccttcgtcacttcatgagattccgtgaaaagatcccagtcagtgccgacat

SEQ ID NO: 417 - DNA, 1394 bp, Hordeum vulgare
  UNSURE (48),(56),(74),(96),(328),(778),(781)..(790),(804),(806),(808),(809),(811),(813),(815)..(818),(822),(825),(826),(828)..(830),(833),(834),(836),(837),(842)..(844),(846),(851),(852),(854),(856),(860),(869),(878),(879),(880),(886),(894),(895),(904),(905),(909),(910),(920)..(922),(925),(927),(930),(933),(936),(937),(942)..(944),(949),(950),(955)..(957),(959),(962),(964),(971),(978),(980),(986)..(990),(995),(996),(1000),(1002),(1013)..(1015),(1017),(1018),(1022)..(1024),(1029),(1030),(1032),(1034),(1036),(1037),(1039),(1040),(1043),(1045),(1046),(1048),(1049),(1053),(1055),(1056),(1058),(1059),(1064)..(1069),(1072),(1073),(1085)..(1087),(1089),(1090),(1091),(1094),(1095),(1101),(1105),(1107)..(1109),(1118),(1122)..(1124),(1130),(1132),(1135),(1137),(1138),(1142),(1143),(1146),(1147),(1149),(1150),(1166),(1180),(1182),(1183),(1186),(1192),(1197)..(1199),(1204),(1209),(1212)..(1215),(1217)..(1219),(1221),(1223),(1224),(1226),(1227),(1234),(1236)..(1238),(1242),(1243),(1246),(1247),(1249),(1250),(1253),(1254),(1256),(1257),(1262),(1264),(1265),(1266),(1271)..(1275),(1277)..(1280),(1282),(1284)..(1286),(1293),(1295)..(1297),(1301),(1302),(1304),(1305),(1307),(1311)..(1313),(1315),(1317),(1319),(1321),(1323)..(1327),(1329),(1334)..(1336),(1338)..(1340),(1342),(1344),(1351),(1353)..(1355),(1362),(1369)..(1372),(1377)..(1381),(1383),(1386),(1388),(1390),(1391),(1394): n stands for any base
ccaccaataccaatcaaaaaaaaaacaactcccaatccgcccacaacnaccccccnacccaacaacccaaaacnacacagcggccagcggaaaagnagaagggcgggagaggccgcatgtgttttgtgtgtttggcgctgtgtgttttttttgcgttatgcgcgatttcggtctcactcccgcgcccgtgttgataccccagctgggccgtttgggtttgcgcgcctggccgcgtggtgctcttgtctgtttaattatttgatttattttacgtttgtcattcgtgggcgatgggggaggagggtcggaaaacagcagcagtttacangtttttctttttaagtttctctcgtttgttcgcacttgtggttttttactaagacgcggcggcggggggggttgctgtcgcgcgggtttgcgtgtggctgtccgggttatgcgcgagctagaaaggagtcgcacagatgaggactggacgaaaccgagaagaaagacaaaagagacagtttaggttcagttggttgcgattctagttacttcaattgaacacccaaatcatgttttcctttccgttaccttttgcgagtttgactgcgttggcttcgtttttgcgtctttatcggcgttttttttcgcccttcacgttttttgtgtagttcttggattagtgaatagttaagttggttgggggggcgagaggaggggtgcctggtattcgccgcccgcgccgatgtgacctggtttcacagtatggctttaaagaacaaagctttccccnccnnnnnnnnnnggggttttcgaaangncnncnancnnnntganaannannntcnnanntgaannntncagtnncntngatncccacctanatcagaatnnnctaggnttatcagnncggattaannctgnncattgaacgnnnccngncantgngcnnaatgnnnccatnnggttnnntncgnanggcgaantaagatntntttcannnnntagtnncgtnancgtattacggnnntnnttcnnngtatnncngntnnanncgncnntnnagtnannanntcagnnnnnncanntagaaacaatannngnnncanngatatntttnannnttcctattntttnnnggactnancgntnncgannggnnanntctttttagattatcngataataccttgtntnncgngttatngggannntaccnttaanggnnnntnnncngnntnncccccgncnnncaanngcnncnnttnncnnccccnannncggcnnnnntnnnncntnnncattttntnnncggnncnncnatcnnnancngnantnnnnntnagagnnncnnnantntgttctntnnngttcctnttttttnnnnaaggnnnnncnttngncnnagn

SEQ ID NO: 418 - DNA, 543 bp, Hordeum vulgare
caggcaccacattttatttagcacaatagttcagtgttcagcacaagcagaccccggaatgagcaatcacacaccaaccagcacgcctgcgacagacaaagacgcatgtcctataggcatcggctagagctaacactaacgtaaaccccggatgctcgcgtgatgactcgtgaagagtgacacaggcttattagttattacaaaaggagggccgctaattcaggttcacttgaggttcttgttaaaccagtcaatcatgtctgtcagggcctcctcggcgctctttacagcagccgcatcttcgccattatatctcacggtccatccatgagaaaccccagggaagatcttgacaaagtgagcaatccctgagttagatgatagaacctgctcgaactccttgaccaattctggtggggacatcacatcagtttcagctccaagtacagcgatggggcatttcacctcttttatatcatcaacagtaacaaaagaaggatgcgacataacggctgtctggatctcattagctttcgctaactc

SEQ ID NO: 419 - DNA, 517 bp, Hordeum vulgare
ctctttcgtgcgaactcccggcccctttcctcccttcccctctgctccccaggacgcaggctcaggtaggtactgtagcaccggcggacggcggtccggagctgctctttgtccgtggagatcacttcagggctccatctgaaaagacatgaccttggcctccacattgggaaggtgagtagcaaccaatcatggcatcaagggcaatcattaggagaagaaagtatctcttggatcatgttaacgcacctatcctctcgtcttcctcctcttcattcctccatggaacatttggttttaagcctgagccaagaatagcacaacaatttcttgagcaaagcttaggggactcgaagtctgagaaggagaaggagcaatatagtgtcaattttacaaaggggggtctgctaggtcctgataacgggcttctgcgacgtccagctcacgtgatttctcactatggttatggaattggaaggaatgaattcacgttgcctttgggagctagaggtttgtt

SEQ ID NO: 420 - DNA, 543 bp, Hordeum vulgare
attaatacgaacttggaatagatcttataaaattctcagattgttgggtagagtggcgaatcccgtaactaaccaaaaacagtattttctctcccatagcaaccagttgaaatctatgttgccgtttacctgcggatccatgaggccgaacctaactatatgcaagtcatcatcttcacagtaaattatcgttacgaattactggtggttctatcaaagtctgccaagagggacgcaaaaatggccgtcttgccttttgatctatacatgtagcactgctacggagtaacaaagatactccaaagttcctgcctgaactggaacacccatctcacaaagaagtcgtcaaatgtgttcccgactaatgccgtgcttcttcttcttcttcttcttcgttgttttcctcggcttgagacgccagcttcacgatgtcctccacacggatctttccttctttgtctttagaaagcttgctgataagctcttggacgccttctttccctatggtgtccttgagataagctgccgccgccgctacttcct

SEQ ID NO: 421 - DNA, 1083 bp, Hordeum vulgare
  UNSURE (1)..(4),(15),(22): n stands for any base
nnnnttgcatgtacntagtttncggagtgtgaaagccataaataacattgttatttctggtccggacattctcaccaaggttgaggagctgagaagaaatgttgaatcatgcacccgaagcaaatgatatgcatgctggtgaggtttttggcgagagatctattttgaccacggaggcacgggagctccaatcacgacttcagaggctgtcagacgagaggactatttatgtactcgctattcttcacaccctactcaatctccaggtacggtacgaccctttgctttttcccccactccttttctttcatcttcatcttttcctccttctttttcactccggccgcctccccccccccattacccttccaacatttacctcattttcaccccttctctttctctcatactttttcccgctttcttttctccctgtccttgctccacccctcttcacagtccttgactccccttcctctttttctcttttttttacgctcccctctgctttcttatccgttcccccttcttccctcatattcctcgttacttgtctattttccctttttacattttaccctctcctacccgctccacacctctccattttctcttccctcttttacgttacacgctcgctttttgccttttgtctttctttcccttcttcttttaacgctttctactctttttcgtatgattgttgtctgcttgtgtcctcggctaatcttttttttacacttttctttttttctttcgacttctgttgctccatttgttctaataattttttccgttattgattgtgtgttgtctatctgtggtattgtggtcccttccgtgtgaacgcccttccaatgcctacaccctgtctcctttagtgtatcatctacttctacatcctctcttctatcattcgttcttccttttaactccgtctttccctctccgtgttctcccacccttcatgctctgacatcatagcgctgattcaacctgtgtattttcgtctacgtcaaatcatttctcctccctatacttagatttcttcttctcctccttccaacttgttccccccatgat

SEQ ID NO: 422 - DNA, 551 bp, Hordeum vulgare
taatcgtttatttatactatagattaagtctataatctcggtatatatacatatcatgtcagcacgattttaacttgtctcaaatactgatattctgccgccacccaaaaggccaagctattccatgacaagtcctggaaatataagttcactaattttgctcgtacagaatggagacattctaaacgattattaccaccattttttatttatcgagcaaactcaggcaatcctgacgatcttcagccatcttcagttcagcaaagttcccagccatcctcgttggaagcccgctgcttgctgttgtcttcactcactgagcttgcaccttcactgtcacagccatctaacatttcaacctttctcgcgttgacatccggatcttcagccactggccctgcaactccagtgactgtatgtttatctttagactcaacggcttcggtggtcctgtctgacgaactcgcactcttgtgaagcgaagaatgcagtgaagaggagagacttgacattgttgatcgctgcaacttgctccaagataagcgctcatc

SEQ ID NO: 423 - DNA, 533 bp, Hordeum vulgare
ggaattcggcacgaggcaacagagcactgaagaatgatttgaagctacatcctatgtttttgagcaaccaggcaacaaaaaatcaaggaaagtatctatcgcaggacccaactgacccaagtaaatacctggatggtactagggcgtatgtccaaggttcgatgtgggatggttttgctgatgggaaaggtgacttcactgatggtccatatgagattcagtatccagagagctttttcaagaatagtttctacaaatatgggtttaaccctgaagttggttctgtgggggttccagttgctgcaacaattagagcaacaatgcctccagaagggtggagtattccaatttttaagaagagaattgatgggtacatagaagaagtcccaaacccgatatgggattaccacaagtacattccctactcgaaaccggggaaggtgcatgatcagattgaactatatggccatccaaaagatcttgatgatttctgtgaaaaagcacaattggtcaattatgttcagtacagagct

SEQ ID NO: 424 - DNA, 440 bp, Hordeum vulgare
aaggacaactcagaagcgtgacgaatgcaccaaattcaacacaatgtttcgtgctcatagtttgctaccccagacgatcatgttaccaccaagacctgaaccattccaagcgccgccaacatcgtatgccatatcacgattaagttgatgcctacactttactgatgattgttggtttacaagatagctaaacccttcatgtctgcactttattggggatgtacttactttacatggatcttattccagtactcagctcaatagcatgactcacattgtgacagcatggttcagatgatagttccagcctctcagaatgaccctgggcttggatccttcgggtgcctcgaaggagatgtcagttgtcatcttctccccgggggtgagcgaaaaatagttgtctgagtagtgtaccggaaggattctagtgtccctgtaat

SEQ ID NO: 425 - DNA, 517 bp, Hordeum vulgare
gaggcgacggaggtggacgacagggtagcctcccacgtcgacccgttcctcgtggaggcgctcgacaacccccgccaccgcctcatggttttgcggatggaaatggatatacagaaatttatgcagaatcatcaactgcatgaatttgaattccagcattttccaacttcctacctccgctgtgctgctcatcgtgttgcacaacattatggtttagagactacagtagcagatagcttagttgatggttctaatagcaggatagttgcgagaaaaacacctgaaagcaaatatccagccattgctttatcagaagttcccgttaaacaagcaagaaatgatattgaggcagcagagaagcttaagtttgtcatttgtcaaaggcccaaagcttcccaaaatggtgcatatggtgctggaaccaacaatggtgcggccaaaactgttgaagagaggatagatgattacaataaggcacgagcgcgcattttcaatggttccattcctgcagatgtcg

SEQ ID NO: 426 - DNA, 541 bp, Hordeum vulgare
ccaataacaataataaatttcttaacacctagctgacactatccagaagttcgatgatggggaaaaactgactccaaaatagacgcacttaacatgacaacacgacaatagcaggttttaacaaattttgttccaacatcccaggaagtagcatctcctagccatggttgaaggactggtacaccggaacctgagaaatcacatggccaagattgtcgtagcaatggggatacatcattgctggggtaggccattgtgggtaaacagtagttccagaagaccccatcgataaatcaggttgaccaaagtacacaggaggttggtttctcggcatgctaggagactgcatataaccgacaccatactgcataaactgaggcacagcaaaattgaaggcgcctgggctcacaccataatcaggcacggggggcctaacataccttttgtagttacgatcgtagtcaggatcactacgatctttttcagcgtccttaaaaacagcaaccctggaacggctattgaacgtgcagcccttgttctc

SEQ ID NO: 427 - DNA, 502 bp, Hordeum vulgare
  UNSURE (5): n stands for any base
ccaanaacctatccgacgagtccatcttttctcgcaagtatggcattttgggcaaagaggaggctcatgagaatgctaagaggatcgaagaagtgtgctttgcttctgcagatgagcatttcaagaaggagcctgatggtgatgggagttctgctgtccagctatatgcaaaagaaactagcaagctgatgcttgaagtcctgaaaaaaggcccaaggacaaccgcagaaccagaagcacctgttattgatgcacctcttgagcctgctgctactgtgtttgatatatctggtggcaagcgcgctttcattgaggcagaggaagcaaaggaacttctcagtccactaacaaaaccaggaaactcgtataaaaggatttgtttcagcaacaggagctttggtattggtgctgccaatgttgctggaccaattcttgaatcaataaaatcgcagctcacagaggtagatatctcagattttgtcgctggaagacccgaggacga

SEQ ID NO: 428 - DNA, 510 bp, Hordeum vulgare
aaagccgcccgtctggctgcttgcgcttggctcagttcaaaacaattgagccacagtgagctctcttcatgtgaaaattttaacccatactgtggacatttcagaagctaaccggagcaaaaagatatagtggccagtccaccaccctagcacacgactagtcctcctcctccaccttcaggccctgcagcttcgagcccaggccaccgtcgccgttatcgttcccgtccttttcctcgtcctcgtcgtcctcctcttcttcgtcatcttcagggtccccctcgggatcgttctcatccagcgggccaagcacctccagcgagttctcgcctccctttaggatctccttcacctcgtctatcccttcgtcggagatgaaattcgaattgatgttcagcaatgcgaaacctggcttgttcgcgactgcttgagcaaagcaccgggctccagacctctgaaacagattcgtgctcacatcaagctcctccagacctgggtggccttcctgca

SEQ ID NO: 429 - DNA, 518 bp, Hordeum vulgare
gccgaaatgctgacccagatatcctttctcagacatgctgaagaagtatattacatatgctaagttaaatgtgttccccaaaatacatgatgctgacctggacaagattagtcatgtctatgctgaacttcgccgtgaatcatctcatggccaaggagtccctattgcagtaaggcacattgaatcgatcattcgaatgtctgaggcacatgcaaagatgcatctgagaagctatgtgtctcaggaagatgtcgacatggccattcgggtgctgcttgactcgttcatctcaacccagaaatttggtgtccagaaagcacttcagaagaatttccggaaatacatgacgtacaagaaggattacaatgaactgcttctgctccttctgcgcaccctggtcaaggaagcgctgcactttgaagagattgtgtcgggatcaaccacacgcctgactcatgtcgaggttaaagtggatgacctgaagaacaaggcccaagaatatgagatctacgatctga

SEQ ID NO: 430 - DNA, 552 bp, Hordeum vulgare
  UNSURE (40): n stands for any base
ttgcacaccataatgattgtccaaagtaaaaaaaataatntaccaactcatagaaagatggcgtcaggtgcatataacactgaattatgacatcaagaaggtacaaacatctctaaatgccactggaggcacaagggtttcagatagcaaacagtacaccaacaccagaattcccgtaaaacagacacgagcagtcattttgccaacttacactacaagtggacatttctagctggtcacctcgctcttgaacaaagaggtagctgaggttgattgagttgttatgctgctactggatgcttgatgatcccacgcccttcatccaggacaaagctgttgtcgttgaagtgagagctggagaagaagggcctcagatcgtagatctcatattcttgggccttgttcttcaggtcatccactttaacctcgacatgagtcaggcgtgtggttgatcccgacacaatctcttcaaagtgcagcgcttccttgaccagggtgcgcagaaggagcagaagcagttcattgtaatccttcttgtacgtcatgtatttc

SEQ ID NO: 431 - DNA, 515 bp, Hordeum vulgare
gggtggcggaggggttctcgtccgtggggcacatggagttcctgtacgaccaggcgccggagagcatgcgcagcaccgccgccgcgctcttctggctctcggcctccctcggcagctacatgggcacggtgctcgtgacggcggtgcagagcgccacgcggggcagcggcgactggctccaggacaacatcaaccggggcaggctggacgcctactactggctcgtcacctgcctcatggtgctcaaccttggctactacctcatctgcttccatttctacaccatgaagccattggagttggcggaagacggtgaccaccacaaggagtgcgagctgccctccatccacaaaaatggcaacggcggcgccgccagcggcttggtataagaataagatcgagtagtcggagggtatagtataattacgccgaatctggttagtaactgtatactgtagtaagtatatggagtacgtactaactaattaaggatacatgcgtgcacaaccgttgca

SEQ ID NO: 432 - DNA, 493 bp, Hordeum vulgare
gtcacgggcatgcttatactatactacagtactaagctagctccaaggccatttggaagttgcaacggttgtgcacgcatgtatccttgaattagttagtacgtactccatatacttactacagtatacagttactaaccagattcggcgtaattatactataccctccgactactcgatcttattcttataccaagccgctggcggcgccgccgttgccatttttgtggatggagggcagctcgcactccttgtggtggtcaccgtcttccgccaactccaatggcttcatggtgtagaaatggaagcagatgaggtagtagccaaggttgagcaccatgaggcaggtgacgagccagtagtaggcgtccagcctgccccggttgatgttgtcctggagccagtcgccgctgccccgcgtggcgctctgcaccgccgtcacgagcaccgtgcccatgtagctgccgagggaggccgagagccagaagagcgc

SEQ ID NO: 433 - DNA, 521 bp, Hordeum vulgare
aaaagtttcacttgggcctccccccctcgagtcctccggcgagtctctgcggcggcggcggcgatggcttccttctccgaggctccccccgggaaccccgacgccggcgccaagatcttcaagaccaagtgcgcgcagtgccacaccgtcgacgcgggcgcgggccacaagcaaggtccaaacttgcatggtctgtttgggaggcagtcgggcaccaccgctggttactcctactctgcggcaaacaagaacaaggctgtggagtgggaggagaacactctgtatgactacttgcttaatcccaagaagtacattcctggaaccaagatggtcttccctggtctgaagaagccacaggaccgtgctgatctcattgcgtacctgaagaaagccacctcctcttgaaagggcatgatgctgtgatcatgtcattacgagtgaattcattttgcagtaaaataataagattagacattaatagtcactctggtttaatggggtgggtgatccacgagacaatt

SEQ ID NO: 434 - DNA, 554 bp, Hordeum vulgare
gatctatgttactaacatgggtgtgcattccagtcccaccgccacctggtggtcaaaacatgcgttctgggattttccagcaactgaatcaaaagattgacgaagattttaccaactaaacctaagagatatgaaacccatatcataaaaacgaaattcgcaagataattgtctcgtggatcacccaccccattaaaccagagtgactattaatgtctaatcttattattttactgcaaaatgaattcactcgtaatgacatgatcacagcatcatgccctttcaagaggaggtggctttcttcaggtacgcaatgagatcagcacggtcctgtggcttcttcagaccagggaagaccatcttggttccaggaatgtacttcttgggattaagcaagtagtcatacagagtgttctcctcccactccacagccttgttcttgtttgccgcagagtaggagtaaccagcggtggtgcccgactgcctcccaaacagaccatgcaagtttggaccttgcttgtggcccgcgcccgcgtcgacggtgtggcactgcg

SEQ ID NO: 435 - DNA, 551 bp, Hordeum vulgare
gtctccccgggcctgcagggaattcggcacgagggctcgcagatatgccgccaagttaatgcctacataaatcggcccttggatggcgatgcaatttctattgaagcagaaatgtcacacgaagatacagctgatgatgacatctcttccagagctgggaatttagttgatcagagcatgaccgctgatatggctggtgaagtgacttctgccgctggacctgtacgactggctgaccttcagagaatattgagctctatacagccatctgatgctacggcagatcctgatgctggattgagactaggagacatcttgaagcctgatttgatattgccactaattgaaactttgcccattgaacagttggcatcacatcttccggagggttcttggactgctggtgatattcttgagctgctgcaaagtcctcctttgcgacagcaactggatgcttttactcatgtgctgcagactggccaaatagatcttgctcaatttggagtggaccctagtaaatataaattcacagttgcttcgttcctggaggc

SEQ ID NO: 436 - DNA, 542 bp, Hordeum vulgare
tgaaaagttattttaggacagacagagcatatgtattcaatgtcgcacaacggtaccagctagaacctcagaagcatttttgaaaatatatccatgtcacgcaattgtaccaaccgaaacctatggaagcattttttagaatactcaagtcacgacacggaatcaactggtaaatatggaagcgactgaaagcatctaaaattcacagccaaaatagtatctagattcggagggggtgccaaataaaacgtcctgtgatttgcgtgccatcagatttaaaaattgatactttccaccgcagatgacggcatgagcaactcacatcaaggctacagccctaggtgcaccccgcaatcaactctcgtccatgggatcatttccaccatctttcttggtctttgaatcattgcctccatctgtacaagcgtttgccacagagtcttccaatgcctccaggaacgaagcaactgtgaatttatatttactagggtccactccaaattgagcaagatctatttggccagtctgcagcacatgagtaa

SEQ ID NO: 437 - DNA, 517 bp, Hordeum vulgare
cattggcgtgttgtctgaatccacacggtttatgccatcgatttgctcgggttcggggcgtcagacaagcctgctggattctcttacaccatggaaacatgggccgagttgatcctggagttcttggacgaggtcgtcaagaggcccaccgtgctcgttggcaactctgtggggagccttgcttgtgtcattgctgcctcagattctaccagggaccttgtccggggactcgttctgctgaactgctcaggtgggatgaacaataaggcgatcgtggatgactggaggatcaagctgctcttgcctctgctctggctaatcgactttctgctcaaacaaaagagcatcgcatcggcgctcttcgggcgtgtgaaagaaagggagaatctgaagaacatcttgatgtctgtctacggaaacaaagacgccgtggatgatgaactggtcgagatcataaggggtccggctgacaccgaaggagctctcgacgcgttcgtgtcgacggtgacgggcccgc

SEQ ID NO: 438 - DNA, 510 bp, Hordeum vulgare
  UNSURE (10),(42): n stands for any base
ttgggtccgnacgttctttggtttggttttagctccaggcgnacgatttaggtcggcttattaaagttattcttgtataatataatcatgtaaagacagattcttgaaggttcataaaaaatacacatgtatgtatgcacatctgtttggctgctcgttaggtcactaatcaccacttacgttaccgccacctcaggctcggtcgccgacgggagagtggccagccatggaagcagcttctcgtgcacgaggtccggccgatcgtcgtgcgggcagtggccaaccccctccagcatgtggagcctcacgttgggaagctcggacgggaggcacgagaagtacttccccacgggcccgtcgatcggggtgaagggatcctcgtcttcccacagaaccaacaccggaactttgatccccggcatcagggctatcgggctaggccccggcgggcccgtcaccgtcgacacgaacgcgtcgagagctccttctgtgtcagccggaccccttatg

SEQ ID NO: 439 - DNA, 555 bp, Hordeum vulgare
ccgggctgaggaattcggacgaggttggaatatcttgccaggccactgagaacatccaaataagagaatgctttggtatgcgccctgaaatgactggagtgttagtgagtagaataaatcctctatctgatgctcacaaaattctgaagaaagatgatatccttcttgagtttgatggcgtgcctattgcgaatgatgggacagttccgttccgaaatagggagagaatcacctttgatcatcttgtgtccatgaagaagcctgaagaaacagccgttatcaaagtactaagagatggcaaagagcatgaattgaatgtgacacttagacctttgcaacctttggttcccgtgcatcagtttgacaaactacccagctactacatctttgctggttttgtttttatcccgctgacccagccttatctccatgaatttggagaagactggtacaacacttcaccacgccgactctgtgaacgtgcactgagagagcttccaaagaaggctggtcagcagttagtaatattatctcaggtcctcatggatgatatta

SEQ ID NO: 440 - DNA, 541 bp, Hordeum vulgare
tataattatccgcagatcaaagaataacatgtcagcagaacttgtacagtttggaacaaagtgtcttggctcctggaattcctatttcctatgttctgcttttgcgatgatacataatctgaatttaacgtaaagttgccaaaacccgtacggtgccgaaacaaagaatgataaatagttgggaggggagcaaagaatgatagtgttacaactcaggctgaagaacttgggttcttcttatttgctgaagacttcctcctcttccttctgtcaaaactaaatcagccaaacaggggcccaccgcaaccgatgggctcatggcaactccaggtagttctcagcctaccgcatcacatctgtctggaaaagcaatggagctaatatcgatgcttccgcataaactgtgtagctacctctatgaaaatgcgtcagtttgtgcatgacacctcagtctcaccactgcttgattgttcatcgacaaggtcactcgacctggctgatggaatcctgtgccgcttgaggatccgagacgtggcaagcc

SEQ ID NO: 441 - DNA, 484 bp, Hordeum vulgare
aatgcaaacatggttccaatgtttatgatggcgaatggaactttggcttcgtactctcattcacactgatgtgacgaagtatctgtctttcaaagctgttgatggaagctatgtcttcagcaaagggaagattcacaaggttcctgccactgacatggaggctctaaaatcccctttgatgggcatatttgagaaacgtagagcaaggaacttcttcatttatgtccaagattacaatgatgctgatccaaaaacacatcaaggattggaccttacaaggatgacaactagagaattgatcgcgaaacacggattgagtgatgatactatagatttcattggccatgcgcttgctcttcacagggatgatcgctacctaagcgagccagcacttgatactgttaaaagaatgaaactctattccgagtctcttgcacggttccaagaggctcaccttatatttacccattatatgggttgggtg

SEQ ID NO: 442 - DNA, 550 bp, Hordeum vulgare
tgtagacacatcccaagacggtacataacatgctaaagccattgttagtacagaataatgtttacaacccagtggatcaataaggaagttaacgaaggaaaccagcaccattccacagataataatttcgcgtagtgctgctagcaggcgtggacctgaactcctacacagtacacagctgatgtcacaagtgaccatcacgcagtaggattctggtggtgtacctccaggaagtatgtcttgaagaaaatactgggtttgatgagatctaatactcttctgcagcgctggcagcactgagatcgacactaagatcaacagtctttccagtaatcagtgtgtacatattaagaacatctgtcacagttgtctcaaagtgagtagtggcgtcataactcgatgagacaaagcaattatcgagagaaggttcattgactggttcatatctgtcatacatatcaaaaaacaattcatctactggaccaagtagatcaattccaggctttagttcagactgtgggttatcagtctccgcttcggcagacacaaa

SEQ ID NO: 443 - DNA, 397 bp, Hordeum vulgare
acggttcacgtgagtcccgttcactcgtccggttcacccaaaagcaaatatactatctccccaaccccaagcacacaagccggagcagattaggcatcagaatcgtcaccgccgcgaatcccgtaccaaattcgtaagctagttctcgcggcatcggcggccaactgaatctcccacccgcggaagagtaaaagaggaccagaagccaaggcgcgcaaagaaggcttgcaatggcgcttcgctgctccctgcccgcgacctgttcgacgttttgcctcaaacgagcagagcaccccagttcgcacgctccccatgcgcgccccgtcttcagcttcggctcttgcccgcggtccaggccgagcctgggacccgcgctcgccgcgcgcgcccgggcact

SEQ ID NO: 444 - DNA, 398 bp, Hordeum vulgare
tttttttttttttttttttgagaattaaggttccttgtaacagtaactctactcttgatgtaattactatgtaaattcgaaagttacactgatgtaaaatactactagtagcacgaagtacccttcctttcacgacatcagagggaccttctcttgcccctggccgtctgattcgctcaagcaaggtggtctcgccgccttgtagtagaagaaggctatcatcctcgccagcacctcggccgaccggacagctttctctcggtacagtatcttgcctgcattggtgaagagcaactcagggaagccggacaccttcagagcggccacgaggcctggctccgcacaggcatcgaccgcgacacaccttggtgaaggcagatcgtgttcccaaaacgtct

SEQ ID NO: 445 - DNA, 305 bp, Hordeum vulgare
cgtgttcccatcccccaggtgtctgacaccgtggtcgagccctacaacgccaccctctcggttcaccagctggtggagaacgcggacgagtgcatggtgctggacaacgaggcgctctacgacatctgcttccgcaccctgaagctgaccacacctagctttggtgacctgaatcatttgatcagtgccaccatgagcggtgtcacctgctgccttcgcttcccaggacagctgaactcagacctccgcaagcttgcagtcaacctgatccccttcccgcgcctccacttcttcatggtgggctt

SEQ ID NO: 446 - DNA, 552 bp, Hordeum vulgare
tcacttgcttgaaacctacataaaataattcacgcaaagaaacatagcatcgagtgaacatgcctacatacgaacgcagtacaaatccaacacatgccaagacacacaaacaagcagcatagtttgtagccatggtaccctctagtccctacgaaaacaagctccagttgtacgaaaagcacaataccacataaatggagatgcaattgtcaccgatcttactcctgctccagctcgtcctcttcctcgtactcgccctcctcgtcagcagtggcgtcctggtactgctggtactcagagaccaggtcattcatgttactctcggcctcagtgaactccatctcgtccatcccctcaccagtgtaccaatgcaagaaagccttcctcctgaacatggcggtgaactgctcgctcacacgccggaacatctcctggatggaggtggagttgccaatgaaggtggacgccatggagaggccacgtggtgggatgtcacacacgcttgacttgacattgttcgggatccactccacgaagtaggaagagttcttg

SEQ ID NO: 447 - DNA, 516 bp, Hordeum vulgare
cagaatcgggaggcggctgctcagcggcggcgcggcagaagccggtgtctgccggtccaagggaaaagctccgttgatgtccctcgaagctatacatcagttgcatattttcatatttgtgctggctattacacatgttgtattcagtgttttgacaatgcttttaggaggggcaaagatacatcaatggaaactgtgggaggatgccattcagaaagatactgcaggaaatgggcccaagaaggtgaacaatgtacgcaatttcgaatttatcagggagcattttaagggtattggcaaagattctagaatattgagttggctgcattcgtttttcaagcagttctatggatcagtaagtaaaaccgactacaccacaatgcgtcttggttttatcatgacccactgccgtggaaacctgaaattcgatttccataaatacatgctgcgggttttagagtctgattttaagaaggtggttgggataagctggtacttgtgggtcttcgtggtgat

SEQ ID NO: 448 - DNA, 550 bp, Hordeum vulgare
tttttggaccggatttcttttctgaccttgcgaccgcaatgttttagggcagcaagaagtaaatctacctgtataatgatagcacattctaagtgctttcattgcagcaccaaaatagacatcatagccattgttctagacaacgctactcactactgatgctgcatcattctatgctttcaccgggggcgtcgttgccttcccgtgctggtcgtttcatcatttcaatcttagcagaaggccctgctgaattgacggcacccgtcaattctgccgggccattgctcttcttgaatcccttcttcatcttagccttctgagcccaacccagaacaccctgctgcacatgctcattgaagatctccttcttgtagaagcttcccatctgtgttacaattgcatacagaggcagggtgctgtagctgcagagaagctggatgatgagcccaataacaagcctcggcacaatgaaaccgacttgccccatgatgcaggagttgaatccatatgtggtcagtatccagaagaagaatgcaatctcaaaggcgtt

SEQ ID NO: 449 - DNA, 10 bp, Hordeum vulgare
  UNSURE (1)..(10): n stands for any base
nnnnnnnnnn

SEQ ID NO: 450 - DNA, 946 bp, Hordeum vulgare
  UNSURE (803)..(805),(809)..(863),(866)..(946): n stands for any base
atccggtacaggaaataattaagcaggagtaagatgcacaatatcgccatcaccacgaagaatttaggtcgccgcaaccgtcataaaggttggacgtcgtgacgggggtcgagtgtggatacgcacatgacaacacacccacacccatccatgcctttggctgccaacattatgtttatttatggaaatgagttgcatgaaaacatgccataacctgaaggttatcctcttcctgtcgcggacgaggagctgcgtcctcgagtctatgtaggccacgaagaaggtgagggcgatgtcgacggcgaagaagatgtcgacgaccatgtcggccacctccagcccccccttgggcgaggcttccatgaaggccacctcgaacgggtacacccatgccgagtaggccaccaggatcaccatgaacgtctcccagcacctgtatctggagtcgaggggcgagacgaccctctcgtcggtgccggaagtcgactggctgaggctgtggccgagcggcggcagcatgagcttggacaggttccggaggttgaaggagcctgagccgaagcccgtgctcgagccgctggccccgccgctgctgctcttgctctggaagctggggatcttcattgctcccgtcccggaacaagagctgctgcaatctcttgggcaacgtatagctagctaattggagaactaactagacggagcacgtaccctcgtgccgaattcctgcagcccgggggatccactagttctagagcggccgccaccgcggtggagctccagctttgttccttatagggggnnnattnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 451 - DNA, 493 bp, Hordeum vulgare
gaaactttggatgctgctggtttctcaaggatgcttatgtgctctgcaagatatttaaaaagagtgggcttggcccaaggattggtgagcaatatggggctccttttgatgaaaatgaatgggagaatttggatgttggaagttctatcttctcttttgcaccctcgtccggtgtagaggatccacaagtcgaaagttctgccttggctactgcagttattcaggaaccattcgcgcctcagcagtctgttcaattttctgaacatgttaatatctgttctaatgaggacaataatgcgcctcctgaaattgatggaatttggttggaagaactggcattgtttttgaatgattctcccaaccatgacatagctttgcctgagaattctggtctccctccaatgtctgagcttgaggctcaagcttttgagatgaatactgctgagctctatgatcaattagcaggacttgcccagtcaggggatatgtgtaa

SEQ ID NO: 452 - DNA, 520 bp, Hordeum vulgare
ataataataatagtaatgaagaggttcaaaagtttgctttgacagaatatatagataaaagaggacttaagctacgaagttgtcatcaagttattacagaaagatctacggtggacggcagcatatccatccagataagacatcttccaaaccagcagaaacagtttctccgcagaaaagcagtaagctcggtcgcttgtccagtattgtggtcgtgattgagacacaaccaagttccggcttcttcaaaagagcagcagcgatgccatgatgcaaacaccattgtttggcaatttacagcacggaccaacatcaaaggcatcaatagtcgcatcagacaatgattggacaaccaaaccagaaacagcagcaacttccaagagcaatgaccaaagataacagacttatacctcaaaagttgctgtctaagagaatgggtctttcatggttgggttcaagcaattggagtttgcaggcttattggaaacagaaggcatgtcatcaaaagtgctaggcattg

SEQ ID NO: 453 - DNA, 517 bp, Hordeum vulgare
gatgttggaagttctatcttctcttttgcaccctcgtccggtgtagaggatccacaagttgaaagttctgccttggctactgcagttattcaggaaccattcgcgcctcagcagtctgttcaattttctgaacatgttaatatctgttctaatgaggacaataatgcgcctcctgaaattgatggaatttggttggaagaacttgcaatgtttttgaatgattctcccaaccatgacatagctttgccagagaattctggtctccctccaatgtctgagcttgaggctcaagcttttgagatgaatactgctgagctctatgatcaattagcaggacctgcccagtcaggggatatgtctaatgtaaacttccctgctggcgacgtgggtgttactgaaaacgatttccagcaatcaaactctggatttgctatggatgatgattatatagggctggatgatctgtttgctcctggggaaaccttctcttatgatttttctggggaaaccttctcct

SEQ ID NO: 454 - DNA, 552 bp, Hordeum vulgare
gattttacaataataatagtaatgaagatggttcaaaagtattgctttgacagaatatatagataaaagatggacttaagctacgaagttgtcatcaagttattacagaaagatctacggtgggcggcagcatttatacctcaaaagttgctgtctaagagaatgggtctttcatggttgggttcaagcaattggagtttgcaggcttattggaaacagaaggcatgtcatcaaaagtgctaggcattggtggaagcgatccacttgcttcaaaagttgattgagtagcaccatcaccgtagtgactgccattagttgattgatccaatgggtactgcaaaaactgattgtttggcacagacaaatcataggagaaggttccaccagtcaaatcataggagaaggtttccccagaaaaatcataagagaaggtttccccaggagcaaacagatcatccagccctatataatcatcatccatagcaaatccagagtttgattgctggaaatcgttttcagtaacacccacgtcgccagcagggaagtttacat

SEQ ID NO: 455 - DNA, 517 bp, Hordeum vulgare
cacaaagcattctaccactagaccgcacaggtaaagctcgagctttgcgctaagagagttcatccgcagccatgaagggcaccaagctggcggcgatcctcatcctccaggccgtcctggtcatggggatcctctcccacgtgaacgccgacttcttccccaagtgctgcaacaactgcaggtccttctcgggggtcgacgtctgcgacgacgcccaccccaagtgccccaaaggctgctccgcctgccgcgtggtgaccccgagccctcacaagacgttccgctgcgccgacatgaagagcaccgtcgacggcacctgcggtggcccatgcaaaaagcactgatcgcttcagggcttcaggctcggacgaggtgtgccgcctagaataaagctcagatgagatgagcagtcatcgtgttgctatgcttgtgtgtgggccgcgttatacggccaacaatatgtacgctgtttatcgtcactgtgttttctctctcgacaaaaagctggtgttgcttg

SEQ ID NO: 456 - DNA, 512 bp, Hordeum vulgare
gcacaccagctttttgtcgagagagaaaaccagtgacgataaacagcgtacatattgttggccgtataacgcggcccacacacaagcatagcaacacgatgactgctcatctcatctgagctttattctaggcggcacacctcgtccgagcctgaagccctgaagcgatcagtgctttttgcatgggccaccgcaggtgccgtcgacggtgctcttcatgtcggcgcagcggaacgtcttgtgagggctcggggtcaccacgcggcaggcggagcagcctttggggcacttggggtgggcgtcgtcgcagacgtcgacccccgagaaggacctgcagttgttgcagcacttggggaagaagtcggcgttcacgtgggagaggatccccatgaccaggacggcctggaggatgaggatcgccgccagcttggtgcccttcatggctgcggatgaactctcttagcgcaaagctcgagctttacctgtgcggtctagtggtagaatgctttgtg

SEQ ID NO: 457 - DNA, 488 bp, Hordeum vulgare
gtacccccgggactggcaggaattcgcacgagggttgagctgtacaaatttgctccttgggaccttcctgataaatcctgtctccagagcaaagatcttgagtggttcttcttttgcccccgtgacaaaaaatatcctaaagggtctaggacgaaccgtgccacaccaaatggttattggaaaacaagtggaaaagacagaacaattgagctgaactctcgcattgttgggttgaagaagacattgatttttcatgaaggcaaagcccccaaaggcaacaggacagattgggtgatgtatgaatacaaaatggaagatgaaactttggatgctgctggtttctcaaaggatgcttatgtgctctgcaagatatttaaaaagagtgggcttggcccaaggattggtgagcaatatggggctccttttgatgaaaatgaatgggagaatttggatgttggaagttctatcttctcttttgcaccctcgtc

SEQ ID NO: 458 - DNA, 510 bp, Hordeum vulgare
  UNSURE (17),(470): n stands for any base
caacaaaacacactggncacgattagtataataatagtagtaatgaagatggttcaaaagtattgctttgacagaatatatagataaaagatggacttaagctacgaagttgtcatcaagttattacagaaagatctacggtggacggcagcatatccatccagataagacatcttccaaaccagcagaaaacagtttctccgcagaaaagcagtaagctcggtcgcttgtccagtattgtggtcgtgattgagacacaaccaagttccggcttcttcaaaagagcagcagcgatgccatgatgcaaacaccattgttgggccatttacagcacggaccaacatcaaaggtccatcaatagtcgcatcagacaatgattggacaaccaaaccagaaacagcagcaacttccaagagcaatgaccaaagataacagacttatacctcaaaagttgctgtctaagagaatgngtctttcatggttgggttcaagcaattggagtttgcaggc

SEQ ID NO: 459 - DNA, 1468 bp, Hordeum vulgare
  UNSURE (23),(93),(821),(951),(1328),(1379),(1406),(1420),(1442): n stands for any base
tttccgcttttcagggcaccttntatatacgcctactataaaaaaaaaaattttttatggaaactagaaagaacattacgtatacgtagatanctacgtgacgtacgaagcagtaaaccgaataaagcttagccacggaatggaactaacaaacaaaacccctaatcacgacaaacgtaacccagactaacacaaaaacggaactaacatgagcagaggaagcaccggaacatgaagccagaaatacaatagagatacatggagatgcaaaaggatctcagtcataggggctcaccgaatgcaaaatactaatcacaccatcatctgggtcaagaacaaggacctaataaaaatgcacaatgaatactgaaaacacactaaaatagaaccctatacacacataccaaagtgcacctgaaaccaagtgagataaagaagatacatactgaagagacaacataacagtggataaatggaaccggaatgcaaggctaatggcgcatcatccaaataatcactcagtgatgtgtcatacgtcaaaacgtcacaaaagaaggatatcaagcacaaagatataaaaacagatgagaatcatagtaaaatattagacaaacacataacacataaaggtacaacagaaaaatatacataatagaccatcaacaatacaaagagtaaacataaacaaacacagaaagcccattaacacacaagaagctacataagagagtacgcgtattacgctacactaattataaattatcaagtccttattagtcatctatattatctcgatacatagatgtaaaaaaggaaggacnagatccgtcaagatgcaacagatgacgccaataatcagtagagatagaaacttacggtagagcaattatagagtcagctgaacatatatagaatagagtagttgtgggcacagacggaaatcaagaaganttggcacgatacagatagatcaacagttacaggaacaacgaagtgtaaataataatagtacatcacacccaattagcaaaaccatagtagacaaactgacaataaagacgatgaagtacatccattatattgacgctagaaatcacgaacatacagatataagataaacacattacaactgcctaaacgatagatcttaggtcgtatcatttatacgatatatatagaaaagaaacgacaaaaataaatgaaagttatacaaaaatataacagcaaagcataagtcatgataatacatatcagacgacgagcgtcactttagacagacagtatacaagatcatacggcatgacgaagaaatgtatatatctgaaccnattcattacataataacacatcgataaacacacacgagacatcacaagagnacgcgaaaagagtaaattataactagnactagtatgtctancatgtgtgatacaaaacaacanacaacgagaatatcacctcacaacag

SEQ ID NO: 460 - DNA, 532 bp, Hordeum vulgare
catggcagatttcttgggtttctttacccatttatgtcccaaataatacagatccaactggcacggggaacaacaaataacatgatagttcagatatttttaactgagaatattgcaaccccatccctacaactagggaaagtactacagcgacattagtgcaggcaatatcctatcaggacgacaaggcatggaacctaaccatcagtgacaggcctgcctacgatgcagaaaacaacacaacaaccagacagacacccacattcactaccatatttacatgcatgtaatggcaggtacccagatgacactacggaagggctgagacaacaatggctgcacgggccgatgtttcattcattggagctcagtatgctagtaggacgggtatggaactggttgtctgtcagctcgacggctaacatcattcagaacagaaccaaatacacgtctactatactcatatgtaccatcacttaatcctctacttgctaccccacttgatgcttgggaatgaaaatcataagaatga

SEQ ID NO: 461 - DNA, 517 bp, Hordeum vulgare
gggagggaagaaaaatctccgccccagcggccggggccgtgtcggcaagccccagccatcggcgccggcctaataaagtcggccggccggatatagccacccttcctttccccgcacgcacgcacgcacgcgccacgccagcttcgtcagcatcctcctcgcccgcccctatagcttcttcctcctcgccaccctcaagctcaaggcctccgcctgcctcggtccggtgcgcggtggccacgggcgtccctccctcttcgacaacaaccctaccctagccgcgtctcctctccggctccgggtcgaggtgctcgcgctgggggtacattgatacttcaagtaaaattgaaaatggttagtgcgaggtcagtacacagggaattggatgcatgcttcagcaacctcttggtgtctagcggtggcggaagggggcaggctgaaattggtggcgctatgcctatgttgtcaggatggaaggaccttccaatggagctgcttatgcggatcgtatctgttg

SEQ ID NO: 462 - DNA, 493 bp, Hordeum vulgare
tacatttccggttccggtttattacacatcttcctccacgccgggaccaaacctccccgcaaccgcaagaggcacacggcgttcgccacaaccaggagcgcacgcacatcctcagtacgcatggctggtggcctgcatggcgcttccggcacggtggcgttggaggccgcaggcacagtggacgttagtcaggctgaggcagccgctgatgatgagggagtgcctgtctgggcaagtgtggagcgacgggaaggagtcgcagaccgcctgaaccgcgggaggcgtcaaggccgtgcactggctgatgttgaggtttgccagcccgtcgacgtccttcgagctgctgctgctgctgctgctcctcatcgtgccccacctccctcgtttgctcttcacgcagctgtttgcgagggagtacatggcacggtccgtgatgttctggcagtagtacaggcccaatgatcgcaggtgcaggcactccgcttgcaagagc

SEQ ID NO: 463 - DNA, 525 bp, Hordeum vulgare
gcacgagggcgaagcacgccgcacgcagttggctgccaccacgtcgcctgccgccgccgtcggagaaggaggccggacccatggcgggccgcaacggcttcgaggacgacgacgtcaaccccttcgccggagggagtgttccccctgcctccaattctcgactctcacctctctcccacgagccagcgggtttctataatgtggacattcctatggattcaacaaaggatgtgaagaaaaaggaaaaagaactccaggcgatggaagccgagctaaacaaaagagaaaaggaattgaaaaggaaggaagaggctgcgtcgcgagctggcattgtcatagaagacaaaaactggccaccctttttccctctcattcaccacaacatttcaaatgagatacccatccatctacaaaaaatgcagtaccttgcattttcatcatttttgggaattgctctctgcctcttctttaatatcatagcgactacaacagcatggattaaaggagaaggtgtcatggtttggt

SEQ ID NO: 464 - DNA, 551 bp, Hordeum vulgare
gggagaggaaatacgaaatgccttcagtaataagcaagtaaatcgtctttgctaacagaaacagaaggccgcatcaacattgtcatgaaaatgaacaagtaattttactcccacgcaaacatatgcagatatattcctccgacaaggttaatcgatcctcgctaccaaccacatctaaaaccatgtcaacaaatggaaataacaccaccttaaagtatccacacaacaaggctccttatatttgtattaacagaagagcaaaaagatatagctgtctgctttcgatgatccaaatccgcatggtgcagcgatgcacaagactacaatgcccagtcagcggacatcttgtctccttccactcactaccctggctataagtctggcgggcggttttcttcatcagaacgcagaactcagggcaccgcgtgctgcctgctgtttcatctcctgggcttttccacttccacggaagtacatgtacacttgctgaatgacacctatgctcagcaatgattcaaggcagaacaatccaaatccaacgaagtagaata

SEQ ID NO: 465 - DNA, 518 bp, Hordeum vulgare
cttcgtcgtcgtctcgtccgaccgcgacacgtagtcacgtcgtacgctgttgaaacttgataggatagctagtgagccatggcgacgatgagagccgcgctgcttggcaccgtggtgctgctgtgcgcgctccgtcacggcggagcgcagcggtacgaggccatctacagcttcggcgactccatctccgacaccggcaacctctgcgtcggcggctgcccgtcgtggctcaccacggggcagtcgccctatggcgagaccttcttcaaacgccccaccggccgctgttccgacggccgcgtcatcgtcgacttcctcgctgagcactttgggctgccgctgctgccggcgtccaaggccggcggcgacttcaagaagggcgccaacatggcgatcatcggcgccaccaccatggacttcagcttcttccagtccatcggcctcagcgacaagatctggaacaacggccccctggacacccagatccagtggttccggaagctcctcccgtccgcctg

SEQ ID NO: 466 - DNA, 533 bp, Hordeum vulgare
gttttatttattctgtggaggcaacctgattaattacccccataaaattcatcatattagttgttacatccacacatagacatgacgcatcgatcgatcccaccacgcacactcacaaaacgcatcaagtcaataaataaaacaataatacgtaaatcaacattagagcctacggatgatcagtgcaagatgcgggggctgcagtaagggcccttgagccagccattggcgatggagcggtacgccgcctcggtgagatggatgccgtcccagatgaggtagttgtgcgggtcagagcaggcgctcgccccggccatgccgcaccttgccttgttgttgtagttgtacttgccctgcccgccggctccgcagcacaccttcagcccatacttgaggccgaaattctgaggggcccggatcatctggatgacctgcgcgtagaagtcggcgtacatgatcctggtgtgggggtatgtcctctggaggttggcgaggctccgccggagcagcgagttgtggtgggcggagagctc

SEQ ID NO: 467 - DNA, 550 bp, Hordeum vulgare
gtcccccgggctgcaggctgaccggtggactccgtgtgcgcggagcgaagtgggagccgagccaagccgagtctcctctccttccccttcctcgcagcgccctccccgtccgaattcggggccggatcgagcaggcggagagcttgaactgagctatggacaacttgtggcatctcggagatgagttccgtggtcaatcaaaggtggtggaggaccgccaatggtctctcatgacatcaaagctggctgagatcacaaagtcaaaggctgagaggatgaatgactttgagtatgcaaggatgaacactgtccctgatgtgaagcaatgggataagctatcctaccaccaagaagacaacaagatggaccacctcaatcttggcctcatgaacctggatcttaagatgaatgatctcaagatgaatgaggctgccatgaagtaccctttccgcaacatggcctataacatgaatccgatgtaccccaagggaaacaatggtaatgtcaattcattcaagatgaatgttggggtcaacaaatatcccaataa

SEQ ID NO: 468 - DNA, 555 bp, Hordeum vulgare
gcgacagcattctaatagcagcaaccagtaaaattgcaagggttttaacttcaacacaggcagtacaaaaacagcatccaagtaaaatgcaaggggttccaactttcccaaccaaggtacaaagacaacagatacactccagcatgatgatacaaaaaccgccctcactttggggcattcatgatgcatcacaacagtatcccccccatctttcgggggggtttccccgctggcggcgggcatactgcactacaaatacataaataaggagaacatacagatcaccgagattacggacgaacggcaccaacacagagacaggctcacatcttagaggcctacttcttccaagtaccaggtcctttctgggggaaatgcaaccaccaaccaacagcttgcgctttcatggacgacggacagaacagaacattgtgaaaacatcttccacaacttacagggatgatatttactaaaaagaaccacagagcaaccacacccatgttccgaagcagattaggcgtcttctgacttgcaaaggtctagcagtgacagtgt

SEQ ID NO: 469 - DNA, 470 bp, Hordeum vulgare
gcacgaggccaaggtcgctgctgctgttccaccgaaaggcgaggagcggcggccgtggggaggagtgtgaggccgcgagctcgagctcgagctcggccctgaagaacaagaagaaggcctccttccctaccccccgagctcaagcccagagcaaagcccacttatgcctgcctatggagtcatctaaaactgatgccggtgataagcatttggagagctacctgacactgggtttgacaataccacagtcaaagaaaggggataccaactttccaaaggtcctgtcgcttcttgccacatatctgggcagatcagttcagaagaatgaacaattactaggttctgatagaataaaggagacgaccactatttttcatggacagagagtcccagatcttagtatacagctctatgcagagcgcattttcaagtatgccgagtgcagtccatcttgcttcgtgttggcactt

SEQ ID NO: 470 - DNA, 528 bp, Hordeum vulgare
caactcgattgtgcaattaaacgagtggtttgcaagaattacagtgttacagaagtaaaacagaatcgaatccctactaatcaaacaccctcagaacaatttaatggcaatccgaatgcacaaatgtcagatctaaacgaataatcagtaatctttgcaaaactgcaggtcgtaaatagattggtcagctacatccttggagagcctggctgctgtagctctggcgcactagcttgctctggcaaaactcgtcagcgctgctgttgctatagctcaaatctttagatcccttgacacaatgaacctgaaccgggagtctctctggtgacaccggtgcgtgtttctccagctgcaagcagtagctcccaaatgtctctaggttcactttcagcctgaagtccagattaaacaacaaatccagctcaagccgattcatctcgactgtgctgattcctccaaccctagcgtagaacgcattgtcgaaaaacccatcatctgtgaatttggcagcaaccaccacacttgtga

SEQ ID NO: 471 - DNA, 518 bp, Hordeum vulgare
tggacttatggggctttctggaaggtgccttgctttgactgttggtttacatggggtttcttctcttgacttcatctttcctgatttgctttgaacattgcacttcctagacattgttttctctggccttggtaactacatgtccttccagatatttacatcgatgagagataatatagtttgctatctggaactggtgtttccctaactgatagcagatatttacatggatgagagataatatagtttgctatctggaactggtgtttccctaactgatatctcccagccaagtcctaactgacgatttaggtccaacctgatgatgaattggattggtggatgtagaaggttcgaaggttgctgcagggcatcaatctagacgggccatcctacaaccgaaaaaacccagtgctctctatttgatctcttgaagaagcttctgttgtcttagatgctttgtgcttgtagcattgattgtgtttttttgcttccgccttcttgtggttgcagattgt

SEQ ID NO: 472 - DNA, 550 bp, Hordeum vulgare
agcttcgagtcgagaagcttaactctcattttttttgtatatatagcaataatccctaacctctttctgcgtatcaagccatcaacattacccaactatagaagtcaggagaggatcagaaaccaaaaatacgacatattttgatggctaccagcatagcttgggctaaacaatctgcaaccacaagaaggcggaagcaaaaaaacacaatcaatgctacaagcacaaagcatctaagacaacagaagcttcttcaagagatcaaatagagagcactgggttttttcggttgtaggatggcccgtctagattgatgccctgcagcaaccttcgaaccttctacatccaccaatccaattcatcatcaggttggacctaaatcgtcagttaggacttggctgggagatatcagttagggaaacaccagttccagatagcaaactatattatctctcatccatgtaaatatctgctatcagttagggaaacaccagttccagatagcaaactatattatctctcatcgatgtaaatatctggaaggacatgt

SEQ ID NO: 473 - DNA, 519 bp, Hordeum vulgare
gccgctaatggcgcccagcctaactaccaggccgtccccccttccctctcctcgcctctccgtcccgaagagccatcgccccctcctcggcgtgaggtgcggctccggctcgcccggaagtggcgacgacggcgcaccgccggtcgtcagggcggcggttagcgccgtcaccgagctcctcagggccttctctcccaagaagccaagcccagctgttgaagccgtcgacgcagagtcggagtcgcctcgcagcgtcgacgacgtggttgccgttcttgaagccgactaccggcgtgcttatttccttactgggaacttcactttgggcatatatgctgaagattgcttgtttgaagatccgacgataaagttccgtggaaggtctagatactcccagaatctagatttgctagtacctttcttcgacagcccttcgctccaacttgaaaatatagacaagggcttgagggtcgacacgaagtttatcatagcatcatggacgttaaggacatatctgag

SEQ ID NO: 474 - DNA, 548 bp, Hordeum vulgare
ggcatggcaaattaggcctgaaatatttgtatacatagaaggagaagcatgtgtgcaacatttattttttggaacccccatcgatcaagagaaaaataattaaaagcttccacgatctcctccctgataatacaccattatttttggtaaaatatccatggtataaccatctggtcccagggttttctctgttggcactgcttcccatatttcattctccggaaaaaaagcagaagaaatcgatacataaggaatctaaatggttatttatcatcggtgttcgctttcaaaatcgttcataacgcatcaccatttgttgcactttaaaaatccttatccgcttatctagtatctataagtgcagaattagacaagtacacaagcgtaatcatgagtttcgtgatattatagattgtcaggtggccaaggttcacttgtcagctcagctgcccttttgcttcggagccgagacgaataactgtccgatcgcctccaatgcagagacgtcccaactctctgcgtgcctaacaaccttatattcttcatct

SEQ ID NO: 475 - DNA, 517 bp, Hordeum vulgare
ctagcctgtaacttcctccctgttcttctttggtttggcctaccccgagcaaaaggaggactaggactaggagcaggggggcgcctctactccatccaatccgatccaatccactccaatccacaggagaaaagccaggggtcagccgcttcctggtttgacttttcaccgtgttctacgcttgatcgacggaaggatttgcgatatggcagaagctgccatcacgcggtactggtgccatgaatgtcagcaggccgttgaggaggccatggtggaggagctcaagtgtccattgtgtgacggtgggtttgtcgaagagatgatcggtgagcattttgaggcattggcaagccagctatcagagcaagggccaactcagtgggacccgctggacaacccttttgagcagccaggatcgccgggggacagcgatgatgaagataatagtgatataggccgtgagtttgagggtttcatcagaaggcatcggcgggcatcggcactgcgccgtgtgctt

SEQ ID NO: 476 - DNA, 555 bp, Hordeum vulgare
ggttgcctttagcctaacacctgatgcaaagtggaaatggagcgcaaatcatatgtcaaagcagtcacaaactttgtaccccgttgttcatccagatagatgatcgataagatggaaagaagagttctactgacaaagttgcatcactattctcagatgtacgatcattattcacagcagtagagaagatcaactatgccctgcatttgggttggttccagaagcaggaggcagctgctgatcagtcaaagtagccctgacagtttgcggctcaggtgtcgagaataggccattaaaccaagggacaagggcccaaggtctgttactgtcctctctgtcatttgtgttactgtcctcgccatcgtttgcagggccatcagctctgacctcctcatggctgctctctattcgatcaacgttgctagtctcgcttaagtcttttgtctcatcagatggcagctcaaaccgacaaactgggcaggaactatggagttcaagccatggcaggatacatggtgagtgaaacttatgttcacaaggcaactgcttagcctg

SEQ ID NO: 477 - DNA, 519 bp, Hordeum vulgare
gttggagctatttttgcaagacttgtgtgataggacatataatatcacaattgaaaaaggggtcaaaacagtgagttcatcgcatttgaaacagtgcattcatagttatgatgtgtatgattttttgaagaacgtagccagcaaagtcccagatttgggtgcacctcgattctaatgctgatgataagcttggcaaaagaaggaaacatggtgaagatgaaagcgaggaggaaacaaagcggacaagaaatgaggcagcatgccacacaagcaacggcagagggcgtgggaggggacgcgggagaggtcgccgtgccgggcgtggagctgagagggagattgaacaccatgaattagctcgcactgaatttagcaacccaggccacctaaaggtagagactggagatggttttgacacaactgaaaccaaggagcatacccctttgagcaatgccagggcctccttaaggaacattgacttgaacttagatcttgctgactatgaggaggatacagtgg

SEQ ID NO: 478 - DNA, 548 bp, Hordeum vulgare
gaatacctctgatctagagcggccgtgatttacaaccggtgaacctgtctagttatatggttgctacacaaaagatactatagctactactggctactgagccatcaacatatgtgacatcctaaattacttctgcagcgtctgcgggtacacatactactaagagaattgctactacattgtcaagctgggcctgctaggatgtacatcatgtcatgtctacctactaaatccacgctggagtcaccgtcattcttcattgtcatagtcttcgtcctcctctaatctatggtttgacgacagcgcaaactggaccggatccaaggccatcttgttcatctcaggcagttgccagcccaggagatccttggtctccacttctttcaacagtgaaaccgacggccctgaagtctggacttgcgacgccacgatcaccaccggagctgcaggatcggcttgcggtgccactgtatcctcctcatagtcagcaagatctaagttcaagtcaatgttccttaaggaggccctggcattgctcaaaggggtat

SEQ ID NO: 479 - DNA, 488 bp, Hordeum vulgare
gcggtgcctcgtcgcgctcccggcggtcgccgtccccggccgccgctcacagcccaacctcaaaccccgatgcagaagcactcacgtagctatcctcggaagctgccgctgcggccgccgccatctcctcggtgcatcatctaccgccggcctcctccatctcgtcaaccctccgtgcctcgccgccccagccatcgacccggacgtgatgcttcagcgggtgcacccagcgaggccgggctggtacgagaagctctacgcgacggccatggacaagggcatggtgtcatatgaagccgagcttgcagattgcgcagtataaatcgaatctcttctcccaattgtcagttgaggggaagaacattctggagcttggtgttggaacaggccccaacttaaagtactacgcaagtgctgatggggtaaatgtaattggggtggatcctaacatgtacatggaggagtattctagagcagcagcaacttct

SEQ ID NO: 480 - DNA, 551 bp, Hordeum vulgare
  UNSURE (30): n stands for any base
gcaattgacaagataaccattctgtgatgntatcgacttccagtacagcactgcgcgccagttcaggccattcaactaatctctacccatggacatgaaagcacttgcccccaagacccagcctattctgttttccttttttacaagttttcatcaactaatgtgaactatcatcacttttcatggccttcggcatctcgtcgtctttgtagcgcatacacgggatccacctccttacaagccacaaaacttggaaaatgttaggtgtggtccaggtttcatctgtacttgcctatctccattttcttcttaagtgccttctgtccatggtatatgaacgagtcgatgatgccagcgacagtgaagatccctccgactatagcacacaggtttgtcaggtagtggaggaaggatctattctcctctgtaaatatcacctttatcggtgagaaatcatagaagaaaaatactccaggttggggtctcggttgaacatttccatctctaaagtgctccgttactgagaattggtttgaatcgatcttgcgccc

SEQ ID NO: 481 - DNA, 517 bp, Hordeum vulgare
aagcggttcatgaatgcaaatggtgacattgacgaagaagggcaggaattcaagcttattgtcaacaatgggatcaaaattggtgcatctctctctgttgctgaatacatttggtacctgagatggctgtgtccacttaatgaggagctttacaagacccacaatgagagaagggatcgtctgaccaagaagatcattgaagagcatgcgcaggccctcaaggagagcggtgctaaacagcactttgtggatgcactgttcactctcagagagaagtatgaccttagtgatgacacagttttcggacttctatgggacatgatcaccgctgggatggacacgacagtcatatcagtcgaatgggccatggcagagctggtcaggaatcccagggtgcagcagaagctgcaagaggagctcgacaatgtcgtcggccgtgaccgcgtcatggccgagaccgacttccagaacctgccgtacctgatggccgtcgtcaaggagtccctccgtctgcacc

SEQ ID NO: 482 - DNA, 549 bp, Hordeum vulgare
aggtagaacgatctgccgtcgtcactttatgagattcaaaaaaggcagttcaacaactcacgatttacaacaacacgagctccatccaggacctaactgaaagcagcgagcggtgtaacaacactccaaggaaagcagcacatgccgctcagatctcaaccgggaccctcttgtacagctcctccttctccaggcgcggcgtggcgatggcctgcagcggcgtgcccatgaaggtgacgagcccgggggactccatcatgctaatgtcctccggcctggtgccttccggcagagaccacttgaaatggtgcagcatgtgcccgatcatggaggcgacgaggttgatcccgagctgcgcgccggggcacaccctccggcccgcgccgaagggcagcaccctgaagtcactgcccttgatgtcgatgctctcctccaggaagcgctccggcctgaactccagcggactgctccacaccttggggtctcgggccaccgcccacacgttcaccatgacgttggcacccttggggatgttgtagccgccgacct

SEQ ID NO: 483 - DNA, 526 bp, Hordeum vulgare
gcacgaggcagcagcaaactttggagccccagcatcccagcatggcaggtcctttcatggcaggtcatttgggtcctcggccattggctgttgctacaggtgctatcatggaatcgatttacccggatggccagattacttcaccaatgctcgatgcacattctgatcctcagacacctgggcgcaagcgtggtgcctcagatggtatacctgataaggtcgtagaaagaaggcaaaaaagaatgataaaaaacagggaatcagctgcaaggtccagagcgaggaagcaggcttacactaatgagctcgaaaacaaggtgtctcgtctagaagaggagaacgagaggttgaagaagcagaaggagttggagatgatgataacctctgcgcctcccccagaacccaagtatcaactccggagaacaagttctgcacccgtttgaggtcgatagtaaattttgtagattacactgctcgtatgttttccgtggttatgatagaaacagttggtagcctgaggtgttgt

SEQ ID NO: 484 - DNA, 552 bp, Hordeum vulgare
gtatggcaccataatgacctatgatgagataaagacagtcataacttatcatatacaaagaaggagctctgataaaattaaaacatgtacctagcagatttacacacactgacaaagcctcggaacagacagatcatctgggacatgctaggggtcgcctagggctgctactcatctacaaactctgaaccaccgggctgggataagctacaacacctcaggctaccaactgtttctatcataaccacggaaaacatacgagcagtgtaatctacaaaatttactatcgacctcaaacgggtgcagaacttgttctccggagttgatacttgggttctgggggaggcgcagaggttatcatcatctccaactccttctgcttcttcaacctctcgttctcctcttctagacgagacaccttgttttcgagctcattagtgtaagcctgcttcctcgctctggaccttgcagctgattccctgttttttatcattcttttttgccttctttctacgaccttatcaggtataccatctgaggcaccacgcttgc

SEQ ID NO: 485 - DNA, 551 bp, Hordeum vulgare
  UNSURE (20): n stands for any base
gtacccccgggcctgcaggnaattcggcacgaggaagtcgtcgggcgagaaggcggacgagaaggtcccctcctgggcccgtccgggctccgacgagcctcctccgtgggctcgcaacgaaggcggggcctcggggcaggaaggcgacgccgcccaggtcccgttctacgcctacctgctcgcgtccgccgtgacggccatcgccgccatcgggtcgatattcgagtacacgaacgggcggccggtgttcggcgtggtgggcaccgacagccccctctacgcgcccatcctcggcttcttcgccgtcaccggcatcccgacctccgggtacctgtggtacaaggccgtgcagacggcgaacaaggacgccgaggagcaggatcgcagggatggcttcctctgatctggttcgcttgggagagcaatgaacacgctgaacatatatcgtagtatccgtttttggtacttgggctgcatgccgatccagcagagcagatgggttagcactgggaaaaacagcagcagggcaggtggactaagagcagaagatc

SEQ ID NO: 486 - DNA, 550 bp, Hordeum vulgare
atcgatggattcgatatattatgagtcttatatacaccactcacatcaaggcgcgaaaaattatgccagggaaaactgaagggacacgtttcctccattcaaatgctgacttcagatggcgagtgctccatgtgtagaagaggaggaagaagagacgagatcttctgctcttagtccacctgccctgctgctgtttttcccagtgctaacccatctgctctgctggatcggcatgcagcccaagtaccaaaaacggatactacgatatatgttcagcgtgttcattgctctcccaagcgaaccagatcagaggaagccatccctgcgatcctgctcctcggcgtccttgttcgccgtctgcacggccttgtaccacaggtacccggaggtcgggatgccggtgacggcgaagaagccgaggatgggcgcgtagagggggctgtcggtgcccaccacgccgaacaccggccgcccgttcgtgtactcgaatatcgacccgatggcggcgatggccgtcacggcggacgcgagcaggtaggcgtagaacggg

SEQ ID NO: 487 - DNA, 541 bp, Hordeum vulgare
  UNSURE (16): n stands for any base
gtcccccggctgcagnaattcgcaccgggcgatggcctctatgaatccagagtcttggaaggagagaacaaagtttggcatcaactgcttcaagtacaggctgcagcgtgaacctggacagcgtgatggagctgcgatatggaagaggacacagcgatggatacaaaatgcatcaacaagaggcacggttatacaacatgacctatcatctggggctgaaactttcccagtttgtgttgtcaatgaggtagagcatgagaaaggacctgggcatttcacctatactactcaggtcaaatacccgagacccctcagctccatgaaagccttgcagggttgcggttgccagagtgtttgcctacccggcgatgcaaactgtgcttgtgggcaacataatggaggtgatctaccgtacagctcagcaggagtgttggtgtgccgcaagccagtaatatatgaatgtggtgaagcttgccattgctccctgaattgtcggaacagagtaagccaaaagggggtcaggtgtcactttgaggtcttc

SEQ ID NO: 488 - DNA, 559 bp, Hordeum vulgare
  UNSURE (46): n stands for any base
ttgttcgagcaaggtacaagcacgggtcccagttaagacagacggntagccacacagcaatggatggcaaagaaggaagacagattagcagcagtacatccatcactacacgcaaccaccaagtatcaggacaaatggtgggcacaaagccaccatccggcagaacagaggccaagtgtggcattggcacgacatgggcattctacagctcgaagactatttactgtcttcgcagtttgaagcgatgataactggccatctccgcagaagctaacatgacataggtagaatctaggtagcggcagaaacatctagcatattggttcgcatgttgatccaccacaatatacatgtgccataagtgaatcaaaataacccgcgacaggttaatgatccacacaggcaggtcttgctacgattggtcccggctccaaccacaccatagtcataagttaactccgtcataggagggatgtgattaagtgcaaagaacattatatgtgggtgcttgtcatctccatggtcgtattgcactggttgccagaagacatttggggag

SEQ ID NO: 489 - DNA, 516 bp, Hordeum vulgare
  UNSURE (504): n stands for any base
gctgtcacttctgaccagagactggggaaagaaggcttgaggctggtgccatggttcttgctgatcgtggtgttgtctgcattgatgagtttgataagatgaatgatcaagaccgagttgctatacatgaagttatggaacagcaaactgtgaccattgccaaggcaggaatacatgcatcgctgaatgcgaggtgtagtgtaattgctgcagcaaatccaatatatggatcttatgatcgttcaataacaccaacaaagaacattgggcttccagattcactgctctctcgttttgatttgctttttattgttcttgatcaaatggatgctgagatcgatcgccagatttcagaacatgttgcacggatgcatagatactgtgctgatgatggaggagcaaggtcctttgataaagaaggatatgctgaagaagatggtgatgccaatgcagccatatttgttaaatatgatagaatgctacatgggcaggatagaagacggngcaagaaggcca

SEQ ID NO: 490 - DNA, 555 bp, Hordeum vulgare
  UNSURE (23): n stands for any base
tttgctgatgtatgtgacctggnttaagtaatttaattgcattgaatcatgcaaaccacacataatcagggactaggtatcactaggtaagacggtacattacattaataaaaaaaagtaccatcaaatttaaacccgactgataaaatcaagatacaaagtacatcaacagacagctcggctccagattaatagtttccacgaaacctcacggagttcagacaacccggagaacagatcaggacaaagcatgccacaatcagcttgtccaatgtcgaaccatgttgcgattagatgatgcggacaatgccatcccgaatcattatcctgtttgcatcttgcatcctctccaggatgaactctacttgtcctctagtgtaagcaacagctgcatctctgttgactgtttgctcaacttcatcaatggacatttgatcaacatgatttgcaagcacatgctgtccaagaatcgcctcaaatgcttccattctctgtgaagaaacatcctgatcatttgatgcattgcctgagcctccatccacatccattgggtcg

SEQ ID NO: 491 - DNA, 552 bp, Hordeum vulgare
gtactcccgggcctgcagggaattcggcacgagggtcagcgtgtgatgtccccattggctcgtgaagacggtctgccgctcttcaagtcaactccagcttcgccgtacaggggcagcacggctggtcagtcaattttcatcatggagagcccatcagctccccggaggtcatccggtgcaacccctctcggctcttcgcctgcaaacggcgacacggggatgaaggcgccggctccatctgtcgtgcacagagaaggtgaagatgaatcataacatgcggcggcccaacaattcgcttatcatgaggtcaagagtcttgctcagtccatcgtggaggtggacttgtatatttgttgtaaagaaaatttaccacgcatctcttaatctgcggcctagttttcttcttcttggggtgctaatcgcccttccatgagagatgcatcgagcattcggttcctgccctattgtgtaattctgtagatttctgcagtgcaaagtcgcttttgggatggaactgcgtgattggtccttgtatgtttagccctccgttcc

SEQ ID NO: 492 - DNA, 550 bp, Hordeum vulgare
ggaatctctaaaaaatattatatttaggaacggagggctaaacatacaaggaccaatcacgcagttccatcccaaaagcgactttgcactgcagaaatctacagaattacacaatagggcaggaaccgaatgctcgatgcatctctcatggaagggcgattagcaccccaagaagaagaaaactaggccgcagattaagagatgcgtggtaaattttctttacaacaaatatacaagtccacctccacgatggactgagcaagactcttgacctcatgataagcgaattgttgggccgccgcatgttatgattcatcttcaccttctctgtgcacgacagatggagccggcgccttcatccccgtgtcgccgtttgcaggcgaagagccgagaggggttgcaccggatgacctccggggagctgatgggctctccatgatgaaaattgactgaccagccgtgctgcccctgtacggcgaagctggagttgacttgaagagcggcagaccgtcttcacgagccaatggggacatcacacgctgaccctcgt

SEQ ID NO: 493 - DNA, 518 bp, Hordeum vulgare
gttggtggtttgaaacttgctggtgtggggtttatttctagtgttggggctggagtttcctcagatctcctgtatgctgctcgaggagtgctgaaaccttctgtgagtgtgggagcagggcgaaagagagctcctgttttgaagtcggcagctgtttatagttgctttcttggaacatcagcaaatttgcggtatcaggtcattgctggcttattggagcatcgactgggagagagcctggcaactcagtataatcagccacttcttgctggcctcttgtcctttgtagcaaggacagccaactcatacttgggaacacagcaatgggttgatcttgctcggtacactggaatacagaagattcaggaacagcttccttctgatgaggtcactacaccacctgaaacatcccagttagacagcggtagaacagatgtacagaacccggatgacagcagcagcagcaacaacaacagcaccgcagaccaatcgagtgacccgaccaagtgatttggttg

SEQ ID NO: 494 - DNA, 558 bp, Hordeum vulgare
  UNSURE (11),(27),(29),(32),(33),(38),(39),(47),(53)..(55): n stands for any base
ttttccacagncattaataaaatggcncnatnntaatnnccccgagnatgccnnngatcgtgttctccttacatatgtacaaagtacaggctacaacagtatatttactctagaaaaaatgattaactgcagtactttatgtttttcccatatgaaatagtccattcttgggcggtccaatagcccattgtggactttgaagccgatggaaagcaaccaaatcacttggtcgggtcactcgattggtctgcggtgctgttgttgttgctgctgctgctgtcatccgggttctgtacatctgttctaccgctgtctaactgggatgtttcaggtggtgtagtgacctcatcagaaggaagctgttcctgaatcttctgtattccagtgtaccgagcaagatcaacccattgctgtgttcccaagtatgagttggctgtccttgctacaaaggacaagaggccagcaagaagtggctgattatactgagttgccaggctctctcccagtcgatgctccaataagccagcaatgacctgataccgcaaatttgctgatgtt

SEQ ID NO: 495 - DNA, 514 bp, Hordeum vulgare
aaaagtcacttcatcagctaaaggaagctgaaatcagaagacagatcattgcaccagactccagagggttcactcctcgacattatgcgtaatgctcatgatcttctttctagctgcagcatagaggttccaaaggtcaaagacaataacgagtacttgcattccgggctaccattcctcatatttcttcatcctgctttaggtccattttgggatatcgtaaagcagaagttcataggtggctccatcgctaaaggttcagaattgcaaatagaggtggcagaatttctatgggaagatgttgagctggatgggagccttattattctagccgataacattatgggttcaacaaagaggaatactgatggtgaacaaatactacactatggagccaggtgtgggagatgcaaactgcagaatgttaaaattgtgaacgaagggatcaactgggattctcccagtaatgtctattggaagcatcatgttgaaagatcagaatctttaaagatca

SEQ ID NO: 496 - DNA, 534 bp, Hordeum vulgare
  UNSURE (6): n stands for any base
ctttgntgtgcagtccactgtacaacagtctatataagcctcatttttttaaccttttacagcagcaactacatgctggatttcagctaaccaaactactagtctaacgtgctctccatatgatttatacctagccgggaccaatgaatcaaggatctacaattggtactatctccttacagctctaccatattcaacttcacatgggcgccatcaaccgaatactcccagtaccaggatccgctgtccatcgtctccttgcttataggatccaacttaccaacaaaacctgcttcgtcctgaaagacgcacattctatgaccgtcgggtacttcaaacatgtggttacccttcaagaaaacatcttttgcctcaaattctgcatttccatgaagaatgatctttaaagattctgatctttcaacatgatgcttccaatagacattactgggagaatcccagttgatcccttcgttcacaattttaacattctgcagtttgcatctcccacacctggctccatagtgtagtatt

SEQ ID NO: 497 - DNA, 483 bp, Hordeum vulgare
  UNSURE (7): n stands for any base
ctctaanatcaattcttcactgtttgcattatctaatgtcatttcagctctcaagaagaatgagcctcgggtaccttatagagagagtaaattgacccgcatactgcaagattctctaggaggcaacagccgtgctgtgatgatagcttgcctgaatcccgtggaataccaggaggcagtccacacaataagtatggctgctcgttcaggccatatggtgaccaacacgccttcgacaagcaaggaacagactccaaaagtaaagctggacatggaagcgaagttgcaattgtggctggaatcaaagggaaaaaccaagagtgtccaaaggaggaatggacttctgtccccaactgtatggaagactccttcttccatgagccatatgaagcaaccactatctgcccgggtgtcgggtagagctaaagcaatggaccaagacggtgctaaaataaagaaggtgctttttgattcagaagtcca

SEQ ID NO: 498 - DNA, 549 bp, Hordeum vulgare
gccattcataccaagattcatataaaatttgaattacataggaagacaaaccattcaatatggaagattccagagaaaatttgcatcacctcagcaagataagttacaagagaaaaattgcaacaagacccattgctctaggtttagtagcaacagcaacagcaacaggcctgctgttgaattgagagtaaaactgcaattatgtcaacaacatgctgacagttaacagcacaagtacaacaccatacgttggtgacacggatggtgaaccaatatgacccagcatctccaaggtggtagattacaggtagcagtccattctagtgatcatttgaagattccggtggctgttttgcgtaggatatcctggatttgtttcgttgatagacctatgtttcccaagtccgaaagagatcggaatggtctgggtgaatcctcccggagctcgagaatgtagtctgctctcttttcaccaattcctttcagttgctgtagctcttccttgttcgcaacatttaagaactcaagatactgttgaataagagattc

SEQ ID NO: 499 - DNA, 542 bp, Hordeum vulgare
gtcccccggctgcaggaattcgcacgagctctcggtggcgtcctaatagctgcttcttctcttctctctaccttcttcttcggtcagctctctcaagcaaaagcgaagggccatggagggcctcatcccgttcatctacagggccgtggcgcagtacaggaaggagggccaggtctccctcgccgacctcctcttcgacgacccctcctcctcgccgacggccacctcggcctacttccgtctccccggagactccggccggcaccagctcttctcggccgactacggtacggcggcgcggcggtctcccgcgcaccgtcggctcaccatggagcacggatcgtggtgaccgaccgtggatgatgcgacgccgattgctgaggagctgcgagtattgttggcctagctaagctaatacgagctgcaaaactagcagtttgtgtgtgttatgcatgcatgtatttgtgtttcagttaagcttgtaaaatgatcggtccgtgagtcggtgagtatcaactgtaaataattatgggatgcataag

SEQ ID NO: 500 - DNA, 549 bp, Hordeum vulgare
tgaagacaggatgctgtgatcagaatcttgatgctttgtacgcatttttgcagcgttgcattgcagcaagtcatgttataaccttctgtcttctgtcttgtgtaaatacatggtaaaccttttattgccatattacactccacgtatgcactccgacactatacatacatcttcttcacaggcagggcctccttcggaggtcctgcgcttatgcatcccataattatttacagttgatactcaccgactcacggaccgatcattttacaagcttaactgaaacacaaatacatgcatgcataacacacacaaactgctagttttgcagctcgtattagcttagctaggccaacaatactcgcagctcctcagcaatcggcgtcgcatcatccacggtcggtcaccacgatccgtgctccatggtgagccgacggtgcgcgggagaccgccgcgccgccgtaccgtagtcggccgagaagagctggtgccggccggagtctccggggagacggaagtaggccgaggtggccgtcggcgaggaggaggggt

SEQ ID NO: 501 - DNA, 512 bp, Hordeum vulgare
caggccgcggcggactgggaggcggcgccccggtgcttcccgctggggaaccccgacggcgcggcgctcaccatggggagctcgccacggttcccgatgtacgacggcaacgacttcggttggggcagggcggtggccgtgcggagtggccgagcaaacaagttcgacggcaagatgtcggcgttccccggtcaagccggggatggcagtgtggacgtggaggtgtgcctcgccccggacaccatgggccgcctcctctccgacgacgaattcctgcagttcgtgtcacatgcaccttgatggggtgcaccgcatctggctgtcttgtatgttgtcctacggtaccagcgcataggatgtgacatggctaccactgatcggtgtggtcgccggacatgtcacatgtgtgtaacacatgttgctgcgcagcagatatgtactggatttgtataattgcaaggtactatcaagaaagctcctggtcctctgttatttttaaaaaaaaaaaaaaa

SEQ ID NO: 502 - DNA, 477 bp, Hordeum vulgare
agctttcttgatagtaccttgcaattatacaaatccagtacatatctgctgcgcagcaacatgtgttacacacatgtgacatgtccggcgaccacaccgatcagtggtagccatgtcacatcctatgcgctggtaccgtaggacaacatacaagacagccagatgcggtgcaccccatcaaggtgcatgtgacacgaactgcaggaattcgtcgtcggagaggaggcggcccatggtgtccggggcgaggcacacctccacgtccacactgccatccccggcttgaccggggaacgccgacatcttgccgtcgaacttgtttgctcggccactccgcacggccaccgccctgccccaaccgaagtcgttgccgtcgtacatcgggaaccgtggcgagctccccatggtgagcgccgcgccgtcggggttccccagcgggaagcaccggggcgccgcctcccagtccgccgcggcctg

SEQ ID NO: 503 - DNA, 514 bp, Hordeum vulgare
gtacccccgggcctgcagggaattcggcacgaggtggaaccagatcttgctgttcgtcgacgtcgcctgctgctgcgcggtgctcttcccggtcgtctggtccatgcggtcgctccgggagacgtccaagaccgatggcaaggcggcgcggaacctgtccaagctcactctgttccggcagttctacaccgtggtgattgggtacttgtacttcaccaggatcgtggtgtttgcgctcaggaccattgccagttacaagtaccggtgggtgagcatcctggccgaggaagtggcttcgatggcgttctacatgttcatgttctacacattcaggccggccgagaggagcaagtacttctctctcgacgacaacgaggaagaggccgcggagatggtgctccgggaagaggaattcgagctctgaacatctgtaattacccgcgacaatgtcctgagccgcaattaccctctgagattgctctcttggcgccctgtttatctgatctcccctctg

SEQ ID NO: 504 - DNA, 494 bp, Hordeum vulgare
  UNSURE (10): n stands for any base
acaccccctnaaatatgaaatgggaattacttacggcaacttccaatgcaatgagtggcttatcatattagtagtacaacatcacttcgagttgtgttaacagacaaacaaaaggttcatcagaagtcaaagtgccggaatgaaatgactggttaccacgcagaaatgcagcgaacttcaaactttgcctgaactgtaacacttgcacaatcaatttcctatgcacttatcaagtaatgacctccttttgcatgtatcctgtatggtatcccgcgtgtctcaacgacaaaatttgaagctactgtgaaagaggaacaaatactacagtacaatcttacagccgtgcagcacatacaagacgatgatgagctatacctgatatctgtgtaagggcagtgtgctaaaatctcagaggggagatcagataaacagggcgccaagagagcaatctcagagggtaattgcggctcaggacattgtcgcgggtaattaca

SEQ ID NO: 505 - DNA, 543 bp, Hordeum vulgare
  UNSURE (20): n stands for any base
gtacccccgggcctgcaggnaattcggcacgagggcggccgggacttctatgacagctctccacacaagcaggccaatgaatcatcgagaaattataaggaggataacacggatggctccctggctaccagaggtgattggtggcaaggttcactgtactactaaatactttgcagtggactctcctattgtgaacaaggaataaaaaggagcaggtcgagctggtaggctgtagagttgacatgagtcatcaggcataaaaagaagaagtcatagtggggctacatctgttctgtcggtgatggcagtatttagatgcatcagtcacctggacagatgtagacatatatatgtatttcccttttgtttgccctatgttacctgatttgagtgctgaagtgtaatgggactggcagggcagcagcaaaagcaggtcctacgaaacgttgctgctcttttgcaactgcaacggactggatcgcttgctgcatgctttatgtatccttgcccatggtgtgttttaggaatatttggattttcaca

SEQ ID NO: 506 - DNA, 557 bp, Hordeum vulgare
gcacacttgtaccaagttactatactgattactcaggaagcaaatgctagactgaaacagatgtgaaaatccaaatattcctaaaacacaccatgggcaaggatacataaagcatgcagcaagcgatccagtccgttgcagttgcaaaagagcagcaacgtttcgtaggacctgcttttgctgctgccctgccagtcccattacacttcagcactcaaatcaggtaacatagggcaaacaaaagggaaatacatatatatgtctacatctgtccaggtgactgatgcatctaaatactgccatcaccgacagaacagatgtagccccactatgacttcttctttttatgcctgatgactcatgtcaactctacagcctaccagctcgacctgctcctttttattccttgttcacaataggagagtccactgcaaagtatttagtagtacagtgaaccttgccaccaatcacctctggtagccagggagccatccgtgttatcctccttataatttctcgatgattcattggcctgcttgtgtggagagctgtcatag

SEQ ID NO: 507 - DNA, 550 bp, Hordeum vulgare
gtctccccgggactgcagggaattcggcacgaggctgcgaccggagctctccagacctcttcctccgccgtcagcccggagatctcccggcttctccctccgccatcatggggaagacacgtggtatgggagctgggcgcaagctcaagacccaccgcaggaaccagaggtgggctgataaggcatacaagaagagccacttgggcaatgagtggaagaaaccctttgctggatcgtctcacgccaagggcattgtcttggagaagattggtattgaggccaagcagcctaactctgccatccgtaagtgtgctcgtgtccagctggtgaagaacgggaagaagattgctgcctttgtgcctaacgatggttgcctgaacttcatcgaggaaaacgacgaggtgctgattgctgggtttggtcgtaagggtcacgccgtgggtgatatccctggtgtcaggttcaaggttgtcaaggtatctggtgtgtccctgctggctctcttcaaagagaagaaggagaagcccaggtcttagattgcatttttttt

SEQ ID NO: 508 - DNA, 552 bp, Hordeum vulgare
gaaaaaacactttttaaaaaacaaacattataacagcataatacagacaagcataacacatggaagataaaactcagtagccagcaaagtaacacagcattaatatatatccagatcatggaaacaaaactcttaatagcaactgctaagagaaagcaacagcagagaaggaacaaatctcgctagtacaacttcaggttatataggacattgtaaacatagcaggcagctttcctcctcaaacatccaagagccttaacagtgcattccatccttgcctataaaaaaaatgcaatctaagacctgggcttctccttcttctctttgaagagagccagcagggacacaccagataccttgacaaccttgaacctgacaccagggatatcacccacggcgtgacccttacgaccaaacccagcaatcagcacctcgtcgttttcctcgatgaagttcaggcaaccatcgttaggcacaaaggcagcaatcttcttcccgttcttcaccagctggacacgagcacacttacggatggcagagttaggctgcttg

SEQ ID NO: 509 - DNA, 288 bp, Hordeum vulgare
agcccaatcgttccgccacggccagcccgcgattcccatcccgccccacctcaccgcccaccgcccaccgccacgccacgccacgcgctccccgtgttcccgggctttacccgagggcctctcttcctgctcttcttcttcctcctcctcctcctaacggcgtcgtccgaacggacggcgaggaggagaacccttcgcctggcctggcctggcctgagtctcgcccggcctctctggcggttgatgatgtcatgtggcccctctgcttcatctcggacaggctgttca

SEQ ID NO: 510 - DNA, 366 bp, Hordeum vulgare
tttttttttttttttttcaggtaggaatacatggcaccacgaggccaccattttattcgtggatgtatctgtacatatgctacatctctgcccggccatgatggcacgaaacttgtgctcgaagcagttcgtgctccacggtgtcgctgctgcgccgtttgcagaagcttaggccttgctgggttcttctatcttcctatcggctgtaagaatgttctcaaactacataccggacttgacaagcggtaatcataactacaggggacatgtacagagtatacacaggtgtgaggctggaggctggtgagcagtctatggagagccggccggcagtttacgcgacagcttcgtcccgttctttccagt

SEQ ID NO: 511 - DNA, 442 bp, Hordeum vulgare
  UNSURE (3): n stands for any base
ggnaattctgcacgagggcttaaataggttggcataagtaccaggccgtatacatgcacgtggacccgtgggtgttgaaggtctcttgactacgcgatggctcttacgaggtaaagggcaaattgtgaatggtgacaaggatgttgtgtacacccataagagtcttcctttgcaatgagatatgtggtaaggattcggcgaaaaccctctgaaatatgattatttcatcggattacaaggaaagggaactgatgaaccttgtgaagattgaggggcggtggattaattaatttgtacaaaccatcattgtggtggtttggtagatcagtttgtatgagcttggaggctccggatttccagggttataataaaaaaacaaatcaacaattagtgagagagtactagtgtgccgatactattaagcagtatgtttctcgggacc

SEQ ID NO: 512 - DNA, 552 bp, Hordeum vulgare
  UNSURE (23): n stands for any base
cacaaaaaaacacgcagctccanattagatacctctggccccatgatagataaagtataaaagcaaccgttacactgcaccgagcaattgcagatgctgctggattaacggtcccgagaaacatactgcttaatagtatcggcacactagtactctctcactaattgttgatttgtttttttattataaccctggaaatccggagcctccaagctcatacaaactgatctaccaaaccaccacaatgatggtttgtacaaattaattaatccaccgcccctcaatcttcacaaggttcatcagttccctttccttgtaatccgatgaaataatcatatttcagagggttttcgccgaatccttaccacatatctcattgcaaaggaagactcttatgggtgtacacaacatccttgtcaccattcacaatttgccctttacctcgtaagagccatcgcgtagtcaagagaccttcaacacccacgggtccacgtgcatgtatacggcctgtacttatgccaacctatttaagcctcgtgccgaattcctgca

SEQ ID NO: 513 - DNA, 431 bp, Hordeum vulgare
ggacaaagaagatgagtttattagttgtctgtctagcaaaatcaacgaggcaataggtacgtgcttccaaggtggaatactaggttctgatgttgaactccctaaagctgttgtgaagactgttaaacctcaagttaaaaagaaagtaggagaagcagcacaagaaaagaagggaggaacagtgcaagatttagtttacacgtgtaatataagtttccaactgtctgcagtaactaagcgtgcattgcctgaagaaaaacgtgcagtattaggggacctttctccaaattgtattgcagaaaggctggtgttgacaatggaacatcatggagaaatagctggttttgcagtgaaagcttgtaatggccatctgaacttctattcagctactattcaggcaattcagaaccatactagcattgatgcatgtg

SEQ ID NO: 514 - DNA, 528 bp, Hordeum vulgare
  UNSURE (8): n stands for any base
gttctagnccgttcgcttaataataacattaagaacccgcgagtataaaaataagttgctcgtggcgcagcacaaatcgctgttcgggcagttgccactggaaccaaccaaaagagacaagactttttatgggtgccaacaatagcgtcgatttccaggcatcgcatatctgaataatttccaggcatcctcgcatctggtttcctacaggactagtatatagcccaaacaccccgagaggattgattgtttactgctcagctgatggaatataccacgcgatcagacagctccttcccaaccaccttggcgtatctgctcagctgcctttccagctcactcaggtgtttcctctggattggcccaacaacgctctcaagttccttgtatttaactcgggagccgctcaggtccatgataacatttgcaacatctacgtccgaacagtcctcggctgcatcaccattggattctgaatgaaccatctcttcatccaccatcatgtctgattcgtcatagtctgacccc

SEQ ID NO: 515 - DNA, 517 bp, Hordeum vulgare
gaaaaaacatagaacaatgaacctgttacatacagacatactggcgtgctgctttgaatcgttcgtgctcacgcagatccatggagacgaaggccaaggacgcatggcgcctgccgctggtgctcttcctcggccagctcgtggccttctccatggccgcctgcagcttcgcctcctctttcattgccaatctgggagttgatgcaccgctcgcgcaatcattctgcacacatctcctgttgaccttggtttatgtgccgatcctcctgcgtcgacggcagaagctgcgaataccttggtattggtacttggcgctggccttcgtcgatgtccaggggaactacctggttaccgaggcgtaccagtactcatccatcaccagcgtaacgttgttggattgttggactgttgtatgggtcatcatgctcacctggtacgtgctaggcacaaggtattctttctggcaatttctgggggcaaccacctgtgtggctgggctagcgcttgtgctcctttc

SEQ ID NO: 516 - DNA, 543 bp, Hordeum vulgare
caaacacttgcagttttttgcactagatgaacaggatatgtatcatggtaaacatagttttagatttttcatgaacaaatcagtaaaatcaactgagaattggttgattctcagtcgactaagatatagagatcctttatgaatctgcagagggcttagcacatgaaatctatgttgcttcttctgagcagccgcccttacttgcaaggatgtcgcagcccagacgcaataagaaatttgatgttgcaaccatggagctgactttgtacattggcgcccttaacagatgtgagcttcttgttgcttcctttcttctctatccaaattacaaccacttcctgttgagttatcctcacttggaagttgttgatagtgagctgctgcttctgtacttgtagctgttccatcgaccgaagaactctcatttagtgagtagatgatcaacccaatggccacgactgtgaatgctagatagtacaaccagtttatctgttgttgatagaaatatactcgaatggcgactgcccacatgtcagatgttaa

SEQ ID NO: 517 - DNA, 366 bp, Hordeum vulgare
agacgcagccgcttcacttctcccaggtaaagaaaaggttcgcccatggctccgtcgcagcccaagtcgggcctcttcgtgggcatcaacaagggccacgttgtcaccaagcgcgagctgccgccgcgcccgtccgaccgcaaggggaaaggtaccaagagggtgcatttcgttaggagcttgatcagggaggttgctgggtttgctccatatgagaagcgtatcactgagcttctcagggttggcaaggataagcgtgctctgaaggtggcgaagcgaaagttgggcacccacaagagggccaagaagaagagagaggagatgtccagtgtcctcaggaagatgagatctgctggtactggaacc

SEQ ID NO: 518 - DNA, 220 bp, Hordeum vulgare
ttttttttttttttttttttttttttttttgggaaagccaggctttgcaaattagatcaaaaatctcacaggacaggaggttcaacatagcataattttagctggcggataacagtttcaagtctagtaggttctacatgtagtaaaaactggccaccagaacagaagattgccattaacttcacgagcttgggatactctactccttcttctcggttcc

SEQ ID NO: 519 - DNA, 1140 bp, Hordeum vulgare
  UNSURE (1),(14),(15),(18),(19),(23),(25),(28),(30)..(32),(36),(51),(52),(66),(73),(379),(689): n stands for any base
nccaactgggaacnntgnntctnantgngnnnacancaagactatctaacnncacaaccactacanatcgaanagattttgtggcgtggccgtactctaaaaggcagtaacacaaactaaaaggacaaatgcggagctcaccttaagttgcggggcgacaacatccaagacattatcatcacgtccactcgttctctttctcttcgtttctgtggttacctcttctcttttttttttgtaccttttttttttttagtggggggggggtcttatttttttttttttttttcccttttattctttttttttttgtctgtcggtccttcctgattgtcttcttttttcttttttttctttttttcgtgcgcttttgtttttntttcctacttttttgttttgttcttcttgtgttttttaggttttgttcgcgtgtttctgttcctttcttttcttttttttttgttttttttttttctttatttgctttttctttttttccttttttttggtttttttttctattctttttcttgttttttttgttgtttctttcgttattgctcttttagctcttattcttcctttcttttgtgatcgcgctttcgtttgttgttgtttttcttctctctcctcagctatcccacccccgcctcttgtttccccgtttgctgtttagttcggtcgcgccntgcggtctcttccgtcctttttcctattcttatatttaatgtcctcccttggtatagatttctgcttttatgttgtcttcattctatgttccgtcctttccgttattcattttcaattcactccttctttgcttttttcatcttccccaacactctttcttttcacttttttcgttttatgctccttttcttctcaatctttagttttttttcttattcgcctttctcctcgcgattttattgtttgctctctcttgcctttatacttcctcttttcttcttctctgccttccgtctcgccgtcatgcgtcttttctttcccttatctcttcttattttatttttcttccattcaccttcttcttttctcgttcttatttttatattttaaatattcgttttctgcttcctccctctttttcttctctcttaataatatactcctatctct

SEQ ID NO: 520 - DNA, 490 bp, Hordeum vulgare
ccaactccacattgtaatggactttgcttcacgataccatttaacatacagagagagggagcgaactaaacaaggcagattcaactaagattcggaatctgcaggcggcgacgaagactggcgacgacgaggggcctagccgccgaatccgtagagggtgcgtccctggcgcttgagcgcgtagacgacgtccatggcggtgacggtcttgcggcgggcgtgctcggtgtaggtgacggcgtcgcggatgacgttctcgaggaagatcttgaggacgccgcgggtctcctcgtagatgagccccgagatgcgcttcacgccgcccctcctcgccaggcgacggatggccggcttggtgatgccctggatgttgtcgcgcagcaccttccggtggcgcttggcgccgcccttgccgagacccttgcctcccttgccgcgcccggacatggctgacgatcctcttcgagctgtaggggattgtggaagttgg

SEQ ID NO: 521 - DNA, 390 bp, Hordeum vulgare
ggcctgagggtcgactcggcgatcctcgccgtcgtcatcgccttccttctccccctccgcctgctctccctcttcgcccgccagaactcctccggcagcgtaggcgacctccgccgatcctgcgccgccctcgccatcgcggccgcgctcctcgccaccttcttcgccctaccccgctacgacggcggtcgcacgggacagtgcgccgcctccgttggttccgcttgggaggagggtgtcggccgagaggttcggttggagatcgagcagctgcagctgcagctcaaccgattggaatcgttctggaaaaacaatgcaaaagcaccggatgacaaaggtgatgcttcagaggaatatgtcgaggttgtgaaagcgatgggactggacatt

SEQ ID NO: 522 - DNA, 396 bp, Hordeum vulgare
cgaatgtccgtccatcgctttacaacctcgacatattcctctgaagcatcacctttgtcatccggtgcttttgcattgtttttccagaacgattccaatcggttgagctgcagctgcagctgctcgatctccaaccgaacctctcggccgacaccctcctcccaagcggaaccaacggaggcggcgcactgtcccgtgcgaccgccgtcgtagcggggtagggcgaagaaggtggcgaggagcgcggccgcgatggcgagggcggcgcaggatcggcggaggtcgcctacgctgccggaggagttctggcgggcgaagagggagagcaggcggagggggagaaggaaggcgatgacgacggcgaggatcgccgagtcgaccctcatggccatggac

SEQ ID NO: 523 - DNA, 495 bp, Hordeum vulgare
  UNSURE (20),(43),(44): n stands for any base
gtctccccgggcctgcaggnaattcggcacgagggggatgatnngctccgaaaaagaaaagaggaaggtggtgttagccttgactacttacaaggtttgcatgagaaacatgagagctggctatttccttcgaaaggaggaggcagtggtgtattatcagttagtcagctgcccacgcatatggatggctccttgcctccaggaatacgggatcgtgtcttttacctggaaggagatcacatgcattctagcatccaaaaggttcctgctctggtcttggattgtgaacctgacattgatttcaacagagacatacaagccaaacgaaaatatgcccagcaagttgcggagttctttgaattcgtgaatagcaaaaaggaagcgccatccgagcagacaagcactgagaaggaccgcatgaatcccaagatcatgttccctaacagaggtggtttgtgggtccctgacggcgtgccacctttcgcaggctctgca

SEQ ID NO: 524 - DNA, 553 bp, Hordeum vulgare
tgttccaaggaatcttttctgtaaagttaatcctgagcacacgtccggcgacattttttgaaccaaacacatgacgcacaggtaggtaacattccagatgacaatcacaacaagaagcaagtggacaacgtgctaagccaacgacggtgtaacagttctgaaacctccgaacagaatgcagccagcaacaaaacatgcggtacaccaccatagtgcagacaaacagaagctcgtgctaccacggaatatgaaactaccagtgagagggccaatttacaagacggaggcgcagacacactactactctacatcgtcggctaggcactaggcgaactaacaagtctacggaaaaacatcagcgatttttacaaggtcagtgagctgagggtcttgtgtttggttgactgtcacaacttgcttagcctcatggcacgtgtgtcattagacttggtcatcgtatagctcagcatgccacacttgtggctctttcttttctcccttggccgcaagtaggctcatttccgaaaaaagttagcatgattatgactttttt

SEQ ID NO: 525 - DNA, 554 bp, Hordeum vulgare
gtcctcccgggcctgcagggaattcggcacgaggccgcactccgccgccgcgtgcgatcaatggaggaggtggaggctgccgtgacggcgcacctggaccaggtgtcgggcctcgtccgggcgctctcctccgagctccgcagcgggatcgggcccgccgccgacagcctcctcgccttcgtccgcgccgtcgactggacggagccatggctggtgtgcttgatggcattccacgcgaccctgctgctgacggccgtcgggttgaggaggaatgccaacttgcagttcttcttcttgtttcttgcttattcaggagtgtatctcgctgagaagataaacatctacctagcagagcactggaagagcttcgccagccggaattactttgaccgttctggagttttcatctctgttgtctggtctggcccccttatcttcatatctatcgtcactgtggttagctctctcatgacattatgtcagttaatggtgaaatggaagagagcggaactaaggcatcgggcccgtcttgctggtgacaaacaggaatgatg

SEQ ID NO: 526 - DNA, 559 bp, Hordeum vulgare
  UNSURE (33): n stands for any base
ggaaacttgtatcgatatggttctgcaaatgtntatatccaataccaaacaagattacatcctctagtcagctacaaataaaacgagatggagtcagacacaacatcttcttttctgatctagtagtatacctacctgttaccggagtttgatgaccccgagaataatatagatatactactactaagaaagtccagctgaagattacatgatatgctgatggtagatcaaacatttacagtacttggttattgtgcatccttctgagatccaaacactgatgaagatcaataattcaacattccagtttctctcttacaaaataggatattgcatcattcctgtttgtcaccagcaagacgggcccgatgccttagttccgctctcttccatttcaccattaactgacataatgtcatgagagagctaaccacagtgacgatagatatgaagataagggggccagaccagacaacagagatgaaaactccagaacggtcaaagtaattccggctggcgaagctcttccagtgctctgctaggtagatgtttatcttct

SEQ ID NO: 527 - DNA, 288 bp, Hordeum vulgare
gaaatctatgacagtgttgatcaagaggctgtcctacatatccttgttcataaggtcattctagtttcattggaaaatggggttagagaaggcaggcattcggtgcatgattggctggctatccttataactcggtataatgatgcgttgagatcggatccacgaaatccagaatcacacattgatatagacttctcacaatgtccacatctgcaaacgatacctcagtttgtttttggattgttgaggagccctcttcttcgtttgcatgaagaaggcatccaccca

SEQ ID NO: 528 - DNA, 543 bp, Hordeum vulgare
ccagttctggggcaagcccccagcggtatattgcattactgtaaaactaatgtgatatccttttcatgagtatctttgctactgtcagaaaaggtgaaaaagcaaccgatatgagatgtacagtaaatagaagaatagaaggttttactctgaaagaccaccctacaacattgagctattctggtattgacacaagcaactactgtaagatgaaaacaaacctcccctccttattactccatgactatatctctatcaattttaggcgagtaaagttaacagtctacgccaaaaggttaacaaggagctcttgacacaatctacaccatcttcggaacccacagggccatagcagtcagaagctaggcagctagctgccactttcttccttgaggatttctgccacttcattccttataccctcacggaatgatataaaaccattaccacttgcataccccgaaccatcaacatcttgctcttcaataagatagttctcaaacagtgacgaatcgtcctgtcctccacgcacaaacgtaagct

SEQ ID NO: 529 - DNA, 10 bp, Hordeum vulgare
  UNSURE (1)..(10): n stands for any base
nnnnnnnnnn

SEQ ID NO: 530 - DNA, 492 bp, Hordeum vulgare
  UNSURE (13),(35): n stands for any base
aatggaactgatntgtgccccaccccactgctctncgccagaaaccccagagccaacaatgttcatccaaaactatgaagggatcttatctggtcattcccttcgctatctgcctaactataagcagacagtaaaacatataaaaccgacaccttattacagggccaccaaactgcctctaattaatcaactcaccaagtatattcacatctgatctgaagcttaccagaaggaacagaatgagagagggagacaatgttacagggttcccccattttatcttccgtcgggtgctctggcctcaaatgagcgaatcggacttggcaggcaatcttctgtagaagttgaacgggacagagggcatcctgctgcggaaccggggatggcgcagcaagtagagcatagtgatgaccagcaaaacctggaacggcgtcacgtacagcacgatggccacgaccagggacaggaatatgaagatggcggtggcgcgag

SEQ ID NO: 531 - DNA, 439 bp, Hordeum vulgare
caatcgacggctacaggaggtgccttctagcaaggaagacttgttactacaagctgttgcccagcaacctattagtgtaggaatatgtggcagcgctagagcgtttcagctatactcccagggtatctttgatggtccgtgtccaacgtctcttgatcatgcagtcctaattgtgggatatggttctgaaggtggcaaggattattggattgtgaaaaattcttggggtgaaagatggggaatgaagggctacatgcatatgcatagaaacactggctcatcgtcaggtatctgtggcataaacatgatggcatcgttccctacaaaaacaagcccgaatcctcccccttcaccaggccctggcccaaccaaatgcagtgtttttacctcctgccctgaaggatccacctgctgctgctcctggcgagccttgggattc

SEQ ID NO: 532 - DNA, 553 bp, Hordeum vulgare
gcacgtattctctttatttattatgggtgcttgtctcacatctaatacaagctgagtaaaaatagaccatccgtgtaaagaaaatctcaccgaacccatcataggctaatccgacatgtacaatcataaaaacacaatacaataatacagtaccagctgcgtgattcacgagtgtacactacaatctcgagtactggacatctctgtttttcattcaactcattagacatctccttgcaaggcaaccagcagctagaggtggcagggtacttgaagaacgcagtgaaccccgccacttgtataagaccgtgcatacatgtgtatctgtctgtgatccatcccttctttgtatgctcactgatccaacagttccaacaaaccattccaagaggggaccttggagaaagcttgcttcctcttgattccttctatactggagaagttgccattacccttcaagcaacgccccctagctgtgtcacatataggatagtcatgggggcaacaagaacggttatcgctgcagcaaactgcattatctagttcacagcag

SEQ ID NO: 533 - DNA, 507 bp, Hordeum vulgare
gcacggggttgttttatggcaagataaaaatcttaaggcgctgtactactgaaggcaactgatgactctttgaagagtgttaacctattccgtggcggtgtcggcgataagcaagtggggaagtacagtgggggcatgaaacggaggcttagtgttgcaatctccttaattggagaccccaaagttgttttcatggacgagccaagcactgggctagatccagcatcaagaaataacctgtggagtgttgtgaaggaagcaaagaaaaaccgtgccattattcttacaacacattcaatggaagaggcagaggtactatgtgatagactgggtatttttgttgatggtggtttccaatgcattggacatccgaaagagctgaaagcgagatatggaggcacctacgtgttcacaatgacaacatcttcggaacatgagcaggaggttgaacagctagttcgccgtttgtcgccgaatgcgaacaggatatatcacatatctggaaca

SEQ ID NO: 534 - DNA, 508 bp, Hordeum vulgare
agcatggtacactgcaattgccaaatccacaagtaaatttgagatatacagctttacacaatactaaacttacacctctagtgtcacactaaccaaaacttatgtatagggaagttcaagcaagtctcatacaccatatatttcacacacgaaaaaaaagaataacgacctacaaatccagtatactagttacgagttgaaaacttgtgctcccttggcaaccttgatgaagacatcctccaaggtggtatcagcaaggccccaagcgtgtatgttaaaacggccttttgcactctcaacttcatggaaaacgtcagctatcttcacctcctgctttggcagctcaaatttctgtgttccagatatgtgatatatcctgttcgcattcggcgacaaacggcgaactagctgttcaacctcctgctcatgttccgaagatgttgtcattgtgaacacgtaggtgcctccatatctcgctttcagctctttcggatgtccaatgcattgg

SEQ ID NO: 535 - DNA, 550 bp, Hordeum vulgare
  UNSURE (21),(32),(39),(51): n stands for any base
gtacccccgggccttgcaggnttcccgcctgncacctgnatgcatcacagnaccttaaaatctgggaagtaagctaaaggatatcgttggggttgcggatacttccctggaagtaagatacattactcgtcacatatgtgacatcgttgcagagcgcggcgcacgcttggccgctgctggcatatatggcatcctgaagaagctaggccgggacaaggtgccagccgacggcagcccgatgccaaggaccgtggttgccttggacggcgggctctatgaacactacaagaagttcagcagctgcttagaggcaactctttcagatctcctcggggaggaagcctcttcgtcgctggttgctaagctggccaacgacggctctggcattggagccgctctcctcgcggcctcgcactcccagtacgccgaggttgactagtcctcttgataacgacgagccctatggattggaccctgagtgtagccgcctcttctgttcttctttttttccctttgaaccttcctaatcgtctggtggtggaattttacc

SEQ ID NO: 536 - DNA, 543 bp, Hordeum vulgare
  UNSURE (3): n stands for any base
canctttattggggaagagaagatacaaaaaaggattaacaaaatgttatggattacaacaccagacaacaaggtgaaaaagaatcggcagaacaggaatggcattgttaaacctccatttcatatgttcctgccactgaaacgtttatgccattagataaacctccagactctctggcgctatactagctacatcccgctgcagagccacaggagagtgtccgcagaatagccgaagaaggtaaaattccaccaccagacgattaggaaggttcaaagggaaaaaaagaagaacagaagaggcggctacactcagggtccaatccatagggctcgtcgttatcaagaggactagtcaacctcggcgtactgggagtgcgaggccgcgaggagagcggctccaatgccagagccgtcgttggccagcttagcaaccagcgacgaagaggcttcctccccgaggagatctgaaagagttgcctctaagcagctgctgaacttcttgtagtgttcatagagcccgccgtccaaggcaaccacggt

SEQ ID NO: 537 - DNA, 533 bp, Hordeum vulgare
ggaattcggcacgaggcttagacgctggttcaatcatcagcttgccaatgctttttcttacggtgtcgtcctgtttcctggagctaccttgcctctgaaactaattgaggctaggtttgtgggagcagtcgagaaggctttaaggcatgttgatgctccagaaacaattggcgtggttctcatgcacggacggccaaatcatcgtaattatgctaatgcttcagttggaaccacagcagagatacggtaacttggacggtcggaggatggttcagtaaatgttaaagcacgtggccagcaacgatttcgtctgatccgttactgggcagatgttgatggggtggtgtggggcgaggttcaaatcatcgaggaagatcctccactaagaactccaagagctgcatttgcacagctaggtgcatctaggagctatcggccacatacttcttcacaagttatgagcttggatgtatcaccaatcaagcaacagggccatatatattcagacccagattgtgatactcctacttcaa

SEQ ID NO: 538 - DNA, 551 bp, Hordeum vulgare
tttacacaacattcatttaccccaacacttttacagtaacatgctttgtttagcattcggaaacttattactcggtctaggtgcataccacctgcatctaaggtatttctctgtaacggagcacggatacacgacactacacacagcacacccaggaaagagggtggtcagtctcccaggaacttcaatgaaggtgaacggcgggtatatatggggctaggctaaaaacgagagcgcgacaaggatagcacatgcgccacgctctcagtctaggttctaagtctgcggaaacgggggaaaaggcacaattcagaaagggtttgctgtacatggagagcggcatcattcttcctgttgttgtcctgcatctacaatatcggcgatctggcagctgcggatcccccagaagaatttcggatgcagatacctcttggtggcagtgaacagccagcctatgttggagtcgcaggaagagcacgatgcgatagtccaggcgtatcctggaaaccagctgtgttcctctgtgggatccccctcaatatcaagccctg

SEQ ID NO: 539 - DNA, 520 bp, Hordeum vulgare
gtcctcctgatgatttcaaactggcattgctcacattggagctagagtatactaaggcaaggtccaaccgagttgaggatctggatgccgtcttgcttgcccaacaactccggaagagatttctggatcaggtcatgacaagtgggcaacgggtgccattcgaattttatggaacaaactacatattcactgtcaatcaagctttgctagagggtcaagaaagttccacgcccttggacagaggattcctgtcaagtgatacatacatcatatttgaggcggctcctaattcaggaatcaaggttatcaaccaaaaggaagcagctagcagcaagcttttcaaagataaagagtttaacttggaaaaattggggataggtgggttaagttctgaattcacagacattttccgtagggcatttgcttcaagagtgtttcctcctcatgttgtcagcaaattgggcattaaacacgtaaagggtatgttgctatatgggcctcctggtactggcaagaccct

SEQ ID NO: 540 - DNA, 553 bp, Hordeum vulgare
cagtaaatatttctaggcaccggcgccaagggtctcaaacaaaacaagccctcaggcttagacaacagaatatttatatcgacagaagcatagcaaagagacaattcccgccgaaccgtgaaaatgaaaggccactcgggatcaaaccactctctctacctgtgaagatggcaagctggggaaactgaaataaacaaattcctatagtggagcccagggtcctcggatgtatgtgtgatcagtagcggatgatgtcactcaagatgctaaagaaatggttgaggtctatcttttcctctccggcataaatggcttccgcgcttcccccttgtggcccctgcgcagccatctccacaagcgtgtacagtttcttgatcggcatatcgtccagcgcttctgctgctgtttcaatatctccttcatcgaagacattcaaatgtcgcaacacctttgcagcatcctcctttgtcagtttgggaacctcgtaggtcaccgagaacacaccagacataccaatggagtctagaaatgttgtctcgcttgttgttccaat

SEQ ID NO: 541 - DNA, 426 bp, Hordeum vulgare
gcaaccgcaccactagcgctgccctgatcggcaccgatggcgggcgatcccaccggcggcggcggcggcggtggctccgcggcgggcaagggtccccgctcgtcgacgcgccaccagcagttccgcgaccgcgccaagacccgcgtggacgacctccaggagatcttctccggcctccagtccgcccgcaaggagagccgctccgcagacgccgccgtcctcgaggagcaggtccaccagatgctccgagagtggcgggacgagctcagcgtcgcctcccccgcctcctccctccagaactcgctggggaacaaccagggtgccgcggatccgccgtcggagacgctgcggctgctgcagctggcgattgaggaggaggacgacgccaccagcaagctggcgcagccgatgcagccctcccggcag

SEQ ID NO: 542 - DNA, 396 bp, Hordeum vulgare
ttttttttttttttttaggcaagaaccggactatattttacagtcagaagtacagcatatcaaacatggtatctatccaagatgcctacacttgagaaaaactgcagggccagagtgttgagccccaaattttagttgatgtgttacaatttgtctgagtgcatgagcttggcatatcgcatcctcaggtgccgctagtggggttccagtagaagtcgccttttccgtcggggtaaccatatggaagatgaggtccatagacgacgttgtcattaagaaatgacattgggtccacctgtgatgaatcttcataggcatttgaggtgctgtcctgattgggaatgttgggagccactgtttgataagcattggaagcattggcctggttggggatgt

SEQ ID NO: 543 - DNA, 508 bp, Hordeum vulgare
tggagttctctttccactccgaggagcaaagcttgaggttgcagagggtgtgttctagcccaggtccttactttgcaaaggatgcaggtctagccggcgattccaatccacggagtgtatcctttaaggttgctggtgatggatcaaagccgaagaagagagcgaaatcccccatcccgacgcgcgtcatctccgacgtttttagggaggcgaaagctgccagtaagaggttctcctctccacagcggcaaaggaaatctagctctgttcggttgctggatgatagtcccccttttgccttctcttcgacaagagcagcaagcaaattggtaactaaaagggcctcttcctggccaaggaactccgaagctagagttgcaaaggtcgccgcgctggatgtacttgagaaatggacggtcgaccgttcacagttactcattggccatagatttgcatcgggggcttatagtcgtctgttccatggaatctacaaggagcaacctgttgc

SEQ ID NO: 544 - DNA, 554 bp, Hordeum vulgare
  UNSURE (25),(26): n stands for any base
ggcaaaaccccagaaaaaaatatanntttattgtggttctgtaaagaaaagaaaagggcgtctcgtgtagtttgtgttttaatacaacgaaaaattgatttacagagttatgacctaccacagaacacattctgggaagaggaagacacataatcacagtagcttcggcggcgggggccctgagaaatccggtgggctatatgagagcttcaggatccagctggcaagtctattcttgttttgctcctgagcagcttcctggcagctgggggttggggtcttctcaatggttccatctctatcgagagctgtcttgagattttcaagggtttgaactatctcagtaaacacgggcctcttctcgggttgagcggaccagcattgctccatcaactgttgcaacggtgtcgggcagctagaaggaacaatcggtctcaagttcttattaacaactgcataagctgcttggagcggagtcatctcttcatagggaatcgaaccactaactagttcccacaagacaaggccaaaactataaacatcgactttcggac

SEQ ID NO: 545 - DNA, 519 bp, Hordeum vulgare
cctcgtgccgattcggcacgaggggagaatgaacttattttagcatcagttcttcagggattcgctgatgccattgacattattcttagaaataatgttgacaaaagaacagctcttgaaaatctggatctaatcctattatgccttgatgaaattgttgatggagggattgtcctagaaacagaaggaagtgtgatagctgaaaaggtactagctcatggagcagagggtgcaacgtcaatcgccgagcagactatagttcaggccctaacaacagcaagagagcactttgccaaatctctgctaatgtgacgtgttatgatctcggagatgaagatggcattaatcaatgtgttcatttcattagcaaaggaaaaggaaggaggggaaatgtccggatctgtgggtgtaaaattacgcgttttcgttgacgttatatgattgttcagttttacaagtcttcaaaatttgtgtagacaaggttgtgaaatgtgattgtctcaattttacttggttcag

SEQ ID NO: 546 - DNA, 547 bp, Hordeum vulgare
gtaagaattgtattgatacagcaagtatagtaaaaaacacgaaagtcaactgaaccaagtaaaattgagacaatcacatttcacaaccttgtctacacaaattttgaagacttgtaaaactgaacaatcatataacgtcaacgaaaacgcgtaattttacacccacagatccggacatttcccctccttccttttcctttgctaatgaaatgaacacattgattaatgccatcttcatctccgagatcataacacgtcacattagcagagatttggcaaagtgctctcttgctgttgttagggcctgaactatagtctgctcggcgattgacgttgcaccctctgctccatgagctagtaccttttcagctatcacacttccttctgtttctaggacaatccctccatcaacaatttcatcaaggcataataggattagatccagattttcaagagctgttcttttgtcaacattatttctaagaataatgtcaatggcatcagcgaatccctgaagaactgatgctaaaataagttcattctcccc

SEQ ID NO: 547 - DNA, 518 bp, Hordeum vulgare
cctcgtgccgaattcggcacgaggcacctccaaacgcgcacgcgtccgtccacgaataaaggccgagggcggcgagccaggcccaatcgccaaaaaccctagcgccgatccgatcgagctccgctttcccttcccatggcgggccccccgagccaggcgagcctcctgctccagaagcagctccgagatctagcgaagaaccccgtggacgggttctcggcggggctggtggacgacggcaacgtgtttgagtggcaggtcaccatcatcggcccgcccgaaacgttatatgatggaggctacttcaatgcagtaatgacctttccccaggattacccaaacagtcctccttcagtaagatttacttctgagatgtggcatccaaatgtctatcccgacgggcgtgtgtgcatttctattcttcatccacctggtgatgatcccaatggttatgagcttgcaagtgaacggtggacgccagtgcacacggttgagagtatagttctgagcattatttc

SEQ ID NO: 548 - DNA, 556 bp, Hordeum vulgare
  UNSURE (19): n stands for any base
gggaaatactactgcttgngcattgacaccactccgtgccacacaaatacaatcggtaagtttagaataggcagcactccagtgtttcagagagacaagaccaacatcaccattcgaccgacactgaacggaaaataaacaaggggagaagtgcaagtgctccctccattcggtgaaagcaagagaattgcagcgcttgcggactcccccccatatcatcctcccttttcagaggaattcctgagatttgcgaacaacggtcctcacctttttcttgaactcggccctcttttctctccagtccttagcagcttcaatatttgctggcgactcgtcgtttggactagagagcatcgaaataatgctcagaactatactctcaaccgtgtgcactggcgtccaccgttcacttgcaagctcataaccattgggatcatcaccaggtggatgaagaatagaaatgcacacacgcccgtcgggatagacatttggatgccacatctcagaagtaaatcttactgaaggaggactgtttgggtaatcctggggaaaggtc

SEQ ID NO: 549 - DNA, 518 bp, Hordeum vulgare
caactttccgctcctcgtccggtcgtggtggagccgtcgccgccgacctccggctccccttccgccgacgcacggcagctcgaaggtccgtgatctagtaagctactctcctggggcagcatgcctaagataaagaccagccgtgtgaaatatcccgaaggatgggagcttattgaaccgactctccgtgatttggaagccaaaatgagagaagccgagaatgatacacatgatgggaagaggaagtgtgaggctctctggcccatcttccgcatctctcaccaaaagagccgttatatatatgatctctactatcgaaggaaggagattaaaaaggagttgtatgagttttgcttggaccagggttatgcagacaaaaatctgattgctaaatggaaaaagccaggctatgagcgtctctgctgcctccgctgcatacagacacgcgaccacaacttcgcaaccacctgcgtctgcagggtccccaagcacctgagggaggagacggtgatagaatg

SEQ ID NO: 550 - DNA, 502 bp, Hordeum vulgare
gcgaaaaaacagtttctcacacatagtaccaagttaacaatacatttgcgcggatcacctgattatgcagtagcacttgttctcatcaggggtctaatggggtgattagttttggattattctctaccacgagttggcggcctcaatcgccgctggcgcaccccttgcatccgcagtggacgcattctatcaccgtctcctccctcaggtgcttggggaccctgcagacgcaggtggttgcgaagttgtggtcgcgtgtctgtatgcagcggaggcagcagagacgctcatagcctggctttttccatttagcaatcagatttttgtctgcataaccctggtccaagcaaaactcatacaactcctttttaatctccttccttcgatagtagagatcatatatataacggctcttttggtgagagatgcggaagatgggccagagagcctcacacttcctcttcccatcatgtgtatcattctcggcttctctcattttggc

SEQ ID NO: 551 - DNA, 538 bp, Hordeum vulgare
  UNSURE (20),(48),(68),(70)..(73),(79),(80),(82),(86),(87),(92),(93),(96),(112),(122),(127),(134),(144),(149),(183),(230),(251),(252),(275),(276),(315),(365),(380)..(384),(388),(389),(395),(405),(414),(416),(432),(452)..(455),(457),(469): n stands for any base
tttttttttttttttttttntttttttttttttttttttttttttttntttttttttttttttttttntnnnntttttnntntttnnttttnnttntttttttttttttttntttttttttnttttnttttttntttttttttnttttntttttttttttttttttttttttttttttttttnttttttttttttttttttttttttttttttttttttttttttttttnttttttttttttttttttttnnttttttttttttttttttttttnnttttttttttttttttttttttttttttttttttttttntttttttttttttttttttttttttttttttttttttttttttttttttnttttttttttttttnnnnntttnntttttntttttttttnttttttttntntttttttttttttttntttttttttttttttttttnnnntntttttttttttnttttttttttttttttttttttttttttttttttttttttttttttttttttttttttttttttttttt

SEQ ID NO: 552 - DNA, 500 bp, Hordeum vulgare
gcaaagtaagtatattagagcatctaaattaaataatgatatggccaagaatcaagccaagcttacccagtaacagaataatgtatcgtctgatctcatgcgccatgcatattggctaaactgaactatcggtcagtaaacaatcacaactgctgtgcaatatatacgctgcaagtagcacaaccacctccgccagaaaagacatcgtcggcttggaagaagaggagaactctgacgtcgccggcgatgggccaaacgacgtccggtcgaacccgaggtcgtacaccgacgtgccgttggggtaaaacagcccgtagttcctctcggacgccggcccggacttcatgttctcgttgaagagcgcgaagacgagcacgtccacgggcacgtccggcctgagcggcgtcccctggcccgccgcgaccctcttcatcaggttcccgttgtacatggcggcgttctgcacggtggcgcccacctcgtcggcgtccccgtcggac

SEQ ID NO: 553 - DNA, 517 bp, Hordeum vulgare
ccgtgcttggtgacacactgctgggtctgtacgagaaggagaggctaggcctctcacgatacgccgacgaggagtccaaagaagacgtcttctgggagaccttggacgccgatttgcagtactggaccagatccctgcgcccggtgcagtggtatcctggccatattgcaaaaacagagaaggaactgaaagggcagctaaagctcatggatgtcgtcatagaggtccgggatgctagaattcccttggccaccacccatcctaagatggattcctggctaggcaaccggagaaggatcatagtgatgaaccgcgaggacatggtgtcggccgacgacagaaatgcatgggcgacttacttttctagtcagggtatcaaagttgtttactcaaatggacagctgggcatgggtacgatgaaattaggaagaatggcgaaatcagcagcatctactgtgagcacaaagcgaagagaaaagggattgcttcctcgtccggttcgggctggaattgttgg

SEQ ID NO: 554 - DNA, 554 bp, Hordeum vulgare
  UNSURE (10),(11),(55): n stands for any base
tttgtgcagnnaattggaattacagttccatttattccattacttattctgtaancagcttacaaatatagagttgactaactttcacatgctaatacatatccagctcagacctctagatagtcatgcaactacatggcagtttccgatgtgccgtcagacttgtgatttagggttatagattcctcattccacacataggttgaggtccagagaaattgtcctatcattgcgctacaaaggacattgtgatcaacgtgcgtcgtgagtatgatctctggtaaagtgttgtgtttattgttcatgttggaggtctctccaaggcaacccaaccaaatctgcctttccggaagtcggacaagatgcggaaagctgcttgggtggtatctccattgaacaagtggactgagagcttcgtgacaaacaatttgccgcagtcactgtctacatcgatcttgtatcgttttcgaaatgcctcagaaccaacagccggatgtcttaacaatatctgcacaagaatggctgccacatcagcaaaatcatatgatctttct

SEQ ID NO: 555 - DNA, 520 bp, Hordeum vulgare
tcgacgcctccccctccgacatcaagaaggcatactacgtccaggccaggctggtgcacccggacaagaatcccggcaaccccgacgcggcgcggaaattccaggatcttggagaggcctaccaagtcctaagcgatccagccaagaaggaggcttatgataagcatggaaaggagggcctttcccaggaaaacatggtcgatcccgctgctgtctttgggatgctttttggaagcgactattttgaagactatgttggtcagcttgctctggcatccatagcttcagtggaggttgatgaaggtttaagcagtcaagacgccagagcaaaggttcaagagaaaataaaagggttgcaaacagaaagagagcaaaagcttactcagagcctaaaggatcgacttcagccatatgtggatggtagaaaggatgattttgtgcactgggcgaatgcagaagctaagcgtttatctgaagcagcttttggtgaggctatgcttcacactgttggatatattta

SEQ ID NO: 556 - DNA, 551 bp, Hordeum vulgare
gctcaggccgcaagaaagaatgccggatacatacagagatgcttcgtgtttagcaccacccttttttacagaaaacatggaaaacatacatacaggtgcgtcgagagcaaacctgcggtgccacaatattacaagcagacaataattcacagagatccgaataattcacaaattgttaaatgtcagtcttcagtgcgacgatgtcgttccctccccttccatcggagattccacgcgtaggctgttctcgcgatggtagagagattttgcgccttggaatatcgttccaagttttttcaatgcttttcctcgcaacttcagaacatcttttgagacagtgctatctttaagaactgcttggcatactcgggaaagagttgactcgatatcaaccacattaattttccatagagaattaagcatggcttcctttttctcctcaaaactcttcataagctgttcttccttattggcaccctcctccacctttttcattccatcttgtagctgcatcagagcaatagcacctgaagcagcatgaacttgcgatt

SEQ ID NO: 557 - DNA, 519 bp, Hordeum vulgare
acttgcgaggaattttcagtttcccactctgagggagccaccacaaacatttcttgtgaccatggaggagtacgtgagggacgctccgcgtatggttccggttcgagagccactggaatttcctgagaggcttcttcttacatataaacccgaagaagcagaggaagtttctgtacccgatcctgtcgaagaggaacaaccaccagttgaagaacctgttccagtacagtccgtgcccgaagttgtttcacctccttccaagcctgttgtggctgatactggtgatctactgggcttaaatgatccgagccctgctgtatcagcaatagaggagagcaatgctcttgccttggccattattccatctgatccaagtacttcaacaactagcagcactacttggcaggacaaaggatttgatccaacaggctgggaactcgcccttgttactgctccaagtaacacaaattcgtctgttacagatagtcaattgggtggtggacttgacaagctcatcct

SEQ ID NO: 558 - DNA, 553 bp, Hordeum vulgare
gccacgtcctactgtttattgacatatatctggtgtacacaggtcactacatttctttacaacaagggtcacttggcagagtcccgtgtggcggagcgaatacacatatcattacacaggtagacatacatgaatggccaggcacaatgcatattacagtcacacgaaaaatcgcatttgctcggggtactattagctccagctcctcgcctattgcaagcctatagaaggctaccaccaaatgggttggcttgctgttgttggttgtttgccgccgggaacgcgccgaagccgctatccaggaaagggtttactgctgcagggccagcgcccggatgctgcggctgaattggtggcccgaagggattctgatgtatcatcgttgggatctgctgctgctgctgagacatggcagccatttgaactgacgacggagcggcgacgtgattcgacatcacgaaaggatcgtttgtcatgaatgggttgggagctgatgaaccgtacagctgctgttgttgtgactgcctgtaggctccctggtcataaaggctgt

SEQ ID NO: 559 - DNA, 542 bp, Hordeum vulgare
  UNSURE (3): n stands for any base
ggnctgcagggaattcggcacgaggaacacacgacacacctctagccttaggagcgcaatggcgactaccaccatgtccctctcctcggccttcgccggcaagtcggtgaagaacgtggcttcctcagctctctttggtgaggcccgcgtcactatgcggaagaccgctgcaaaggccaagcaagtttcatcgggcagcccatggtacggtgccgaccgtgtgctctacctcggtccgctttccggggagcccccgagctacttgaccggtgagttccctggcgactacggttgggacaccgccgggctctcggctgaccccgagacctttgcaaagaaccgggagcttgaggtgatccactgcaggtgggccatgctcggtgcgctcggatgcgtcttccccgagcttcttgcgcgcaatggagtcaagttcggtgaggctgtatggttcaaggcaggctcccaaatcttcagcgacggtggcctcgactacctcggcaaccctagcctcgtgcatgcacaaagcatccttgctatctggg

SEQ ID NO: 560 - DNA, 541 bp, Hordeum vulgare
aagcatttccaaaagatccttgtaatttacatcatgatgttacaaaaccacacaatacgtgtgcagttcactgtagtcgccttaatggctacaactcgcagctaactagcgccaacgcctcacttgccgggaacaaagttagtggcaaacgcccatgcgttgttgttgacaggatcggcgagatggtcagcaaggttctcgagggggcccttgccggtgacaatagcctgcacgaagaagccaaacatggagaacatggcaaggcgcccattcttgacctcttttaccttgagctccgcgaatgcctctgggtcatcggctaggccgagcgggtcgaagctgccaccagggtagagtggatcaaccacctcaccgagtgggccaccagcaatgcggtacccttcaacggcgcccatgagcacgacttgacatgcccagatagcaaggatgctttgtgcatgcacgaggctagggttgccgaggtagtcgaggccaccgtcgctgaagatttgggagcctgccttgaaccatacagcctcac

SEQ ID NO: 561 - DNA, 519 bp, Hordeum vulgare
  UNSURE (9): n stands for any base
ggccgtggngagttcaccaaggcgaatatggagaaggtcaacgaaatactatctcattacccaagcaactacaagcaatctggtattattccaatgcttgatcttgcacagcagcagcatggtggatgggtcccagttgcagcaatggacgctattgctaaaatagtcggagttgcgccgatcagggtctatgaagttgcaacattctactcaatgttcaatcggaccaaggtgggaaaatatcaccttttggtgtgtggaactacaccttgtatgattcgtggttcatgtgatatcgaagatgccctgttagaacaccttggagttaaacggaatgaggtgacaagcgatggtttattttctgtcggtgaaatggaatgcatgggttgctgtgtgaacgctcccatgattgctgtggctgactattccaagggttcagatggttacacatacaattattacgaagacctcactccaaagcgagttgttgaactcgttgaaatgctgagaagaggagaa

SEQ ID NO: 562 - DNA, 546 bp, Hordeum vulgare
gaatgaaaaatagtagtatatcaaaatgtacccaggtcataaggagttaacgacaccgttaatgcatgaacgacaggaatataacactgcaggagtagcataacagcaatcaattctcccagggtgtgtccagggccccagattcttatgccggatacaaagctttctttcgcgactgcagctccagaatatatagcactatctttatcagtgggcagtctagctgatgatggagcaaaccaaggggaaaaaagagatggtgacaggtagacgtgtccaattgtcagacaaaagaaagcttcgacaacaacagagatcaaatcgcctgtccattgttggacacaagaaagctttgagaacaacagagatcaaatcgcctatcggttgttcgcgacatacaatgcgagccaacttatttgtgtgcttgcttgcaactcaaaagcaaacctagcaggcatccagatccctgcatgggggaggttttggctcgcctagcaaggtggtcatccctccagcagggccgcagtttttccgctctgggttctg

SEQ ID NO: 563 - DNA, 547 bp, Hordeum vulgare
gtctccccgggcctgcagggaattcggcacgagggagagaggtttgaaagtagcggcgtcgcctaagatagcatccagcaaaaacagcactagcgtagaaaatatagctccaaggagacgatggtggaaaatccgaatatatgcaaaagtgatgctgtgaatgaggatacaccatctgggattctgaatgaaggtatcacacaggatggtccactgaaacaagacattggtggtgggctgagaacaaatgtcagccctcaaaatagcagtgaaagatatacttaccccttggtaaagcgcccaaaaggtgagtccagagagaatcatatgaagaatacctcctcaagcggtgctggaaggccagaaggtagcgatgcagggtgtgtagttctggctcttgaagccgtggacgagaaaacaaaagacaaaatgctgcaggagctaaagaagaggaagattggctgatgatgtttctagctaatgaccctttgaatttaagtcgggccatgattttggctcctgcaagtcaaccagttctttctctgaa

SEQ ID NO: 564 - DNA, 536 bp, Hordeum vulgare
ttatataaacgataaattgaacaactagtcactcatctatggaaacaacaactgacacaacaatgtacacaaccaatgacagcacaggtgccaaaggcactatgagacgttcaaggagacaacagcacccaagcccaaggcacgatgaaatgttcaatgtcttccatctctgccataacaatgcactgttgcgacgccacttcaagattttccaggagtaaaacacccaccatgtgggtaacgaatttcagagaaagaactggttgacttgcaggagccaaaatcatggcccgacttaaattcaaagggtcattagctagaaacatcatcagccaatcttcctcttctttagctcctgcagcattttgtcttttgttttctcgtccacggcttcaagagccagaactacacaccctgcatcgctaccttctggccttccagcaccgcttgaggaggtattcttcatatgattctctctggactcaccttttgggcgctttaccaaggggtaagtatatctttcactgctattttga

SEQ ID NO: 565 - DNA, 908 bp, Hordeum vulgare
  UNSURE (1),(12)..(14),(18)..(20),(25),(26),(29)..(33),(35),(36),(41)..(44),(46)..(48),(50),(51),(66)..(74),(88),(101),(103)..(110),(112),(113),(115),(117),(118),(128),(129),(134)..(138),(146),(161)..(166),(177)..(179),(192),(194),(221),(222),(234)..(236),(238),(250)..(252),(258),(469): n stands for any base
nttttggtactnnntagnnnctaanntgnnnnncnnaaccnnnntnnngnnttttgctagcccaannnnnnnnntttttgggtggggnccccaaaaaactntnnnnnnnntnntntnntttttttttnnttttnnnnngggggggncttcccatatatttnnnnnnttttttttttnnntttttttgttttntnttttttttttttttttttttttttttnnttgggggggggnnngntttttttttttnnntttttnttttggggggtcttggggtttttttggttgttttttgtttttgtttttttgtgtgtttttttttttggtgttttttgtttgtttttttttttttgtgggtttgttttttttttttttttgtgttttgttttggttttgtttgtttttttttttgttgtttttttgttttttgtgtttttttttttgtttttgtgtttttttttttggcttngttttgtggtttggttgttttgtttttgccatttttcttttttttttatgagttttttttttcttttttttattgtgtttgtaattttttacattttttttttttttgtttttttttttttttttgtttattgaatttttttatatattttttctggttattatcttttttggttttgtatttttttttttttatctcttcttcttttccttttttttttttttttttttctttattttcttttttttggttgttatttctattaaaagttttaacttggatttttttttgttgtttttatttttcttctttttttctttctttttttcagttttttagtattttttttttttttttttcgttattttttttgttttttatatctctttttttatttctttcacattttttttttttttatccttccaatttctttttt

SEQ ID NO: 566 - DNA, 555 bp, Hordeum vulgare
  UNSURE (18),(19): n stands for any base
ggcgaaacaagtattatnncttcatttgaaggtaaaggtctgtcaacaagggaacaaaggaccacccaccccgtcatctaggcacccacccgtccaaagggttttgattttcttgtttcttacaaaagaatttcgacgacctgaaagaataaaaccatctcacaggcattttgatgatgatgatgatgatgatgatccaaagctatatctatctacattctccacagttcagttgtatgcctcggacccctggagcagcagggatcagagagatcgatggagcgagcgagcttcctcctgtaagcaccgagcaccaaacgttgcctccctttacagagggctcctttgatgctcgcaaagtagtagtatcttcagactgaaaaaaataaagagaacctccggtcgtcgctgccgccatggcatcactccacttgctcgccgatcaggtcgaggcccatgaccaggaacgagacgccctggaacaggaggaagtagaagtggatgccctgggccgacagcacgctgcgcgccgccgccgtcagcaggaggaacgac

SEQ ID NO: 567 - DNA, 517 bp, Hordeum vulgare
cgggaagaagctcggggagggcgcgttcggggtcgtgtacaaggcgtccctgtctgaccccaaagtggcggacaagcaaggtgacgtggtcgtgaagaaggcgaccgagtatggcgcggtcgagatttggatgaacgagcgcgtcaggagggcatgcgctagcagctgcgcagattttctttacggctttcgtgagagcaaaaccaaaggtaagggcgaggaatactggcttatttggcgctatgaaggcgaggacacgctttctgctctcatgcaaagcaaggagttcccttacaatgttgagactaagattctcggaaatgttcaagatttgccaaagggaatagcgagagagaataagattatccaaacggtgatgggacaactcttgtttgcccttgatggacttcattcgacggggattgttcacagggacataaaaccccaaaatgtgatattttcagaagaatctcgcaccttcaaaattatcgatcttggagcagcagctgatttacga

SEQ ID NO: 568 - DNA, 546 bp, Hordeum vulgare
gagactggacatgccacgcctgcctactcctccttggggatcaccggctccaccgatgctcttccgctggctggtgagctcgtccatgctctcgctgatcgtcctcacgatcttcctctgcacccgcagcatcgacgccagcacgttccgctgagcgctgtctttcttcggcttgatctccctgagctcttgaagctgtgcctctgtgaagcctcctccctcctccgttcctgattttgccatgaggccaatgatccaccgtgccgtctcgctgtagtccttctgggtcgcgcggaacagctgcagcctcaggttctgcatcaccgagaggccgaggagcccttcgctgttgaaatatggatgcgccaatgcagccttggcgctggtcctttgccgtgctttgtatcggaccattgaagtcaggagttcccatccgatgccgccgtctagatccaatatgtcgaagcccctgcgaaggtctggggtggctcgtggttccaccaaattcctccaagcttccaggtcgtaattgcatctcttcagttg

SEQ ID NO: 569 - DNA, 551 bp, Hordeum vulgare
  UNSURE (11),(18): n stands for any base
gtccccccggngctgcanggaattcggcacgaggggcatcgccccgcgacctcatgctcctcggcgacacctgcacccggggctgtcggttctgcgccgtcaagaccagcaacaagcctgcgccgccggacgccctcgagcctctgaaaacagccgtcgctgttgcgagttggggagtggactatgttgtgctgacaagcgtcgacagggatgacatccctgatggtggaagcggccatttcgccgaaacagtaagggctctcaaggtttgtccctgacgccttagcttgctgattcagtcggtgaatctaccatatgatagttttgggggcttctgttcaggagttgaagcctacaatactggtggagtgtctgacctcagattttcgaggcgacctcgaggcagtcgcgtctttggcaaactctggcctagatgtgtatgcgcacaacatcgaaactgtgaggagtatgcagaggatagttagagatccccgagcagggtaacgcgcttctctcacttactttttactgtatgttgctcagtctattgt

SEQ ID NO: 570 - DNA, 453 bp, Hordeum vulgare
caaacatcacatacaggcatacagttatctgtctaaacaactgatacgaacaggtaaaaacggaacacgccagagtgacaagagaaattacgtcatgactgaatgcaagatgtaagcaatcgtaaaaccgacgagcgccaatggagcataggaactttgaagaatggtcaacgttgcactgcgctccgttctgcaggccccaaacaaaattaactcttcctgcgtgtagaaaactctgacatgggatagaatcggccggggaccatcagatcagattacgatgcagcggacacaagctgggcttttttctgtcggacaaaattttggacaaatatctcccccgcgcggtacgaggaccggaccagaggtccactagcaacatacacaaatcctaaagattccccatactccttccaaaaatcaaacttctcaggagtcacgtattctctgacc

SEQ ID NO: 571 - DNA, 457 bp, Hordeum vulgare
cccgtacctcgagaccatcactgtatacaggaggagctgcgcggtggcggtgccatccgatccgatccggccggccgacccgcgccggaatcaatcgacccgaggagctcgcgatcgcgatcatgaacggagggatggggggaggaggcggaggcgggcggcaggagctgtcggcggacaacgttcgggggatagtgctcgcgctcctctccagcggcttcatcggctccagcttcatcatcaagaagaagggactccgccgcgccgccctcgcctccggcatcagcgcaggggtgggtgggcactcctacctcaaggagcccctatggtgggtcggcatgatcaccatgatcgtgggagagatcgccaatttcgtggcctacgccttcgcccccgcggtgctggttactcctcttggtgcattgagcataatcgtcagcgcagtgctggcccattt

SEQ ID NO: 572 - DNA, 546 bp, Hordeum vulgare
gagacggcgctacgaatgtacagattcatagttagatgcatgaaagctccgcctgatcgctctgaacaagtcaacaaactcaaactgtacaaagagaagaagaagaagaagaaatgttgtgaacaaaaatgaaaagggaaaaaagaaaaattacggatgaggagagaaaaacttggcaacaatctgtgcacatgtcctatctggtgaaactccgccgtctcccggataccgtatcttccagcttctgcaataccaaattatgtacaggccaacacaacacaatggagtagccggcaatgtgttgattacagctgctccgtcatccatcgctgccatcctccaatgtggctagtacatctcctgccgtctcaagactttctcttcgtcgtcggttctcctcgcatcatcctcgacgtgcctcagtagttctccgttcaatcttgttgccgacgtgggagacagcggtgcataaaggcctattctcgattgtgggattctttcgtaatcctttgtgacatgcaacaaaatggtaccggacaacacgac

SEQ ID NO: 573 - DNA, 976 bp, Hordeum vulgare
  UNSURE (1)..(5),(10)..(14),(34),(36)..(39),(41)..(44),(46)..(53),(58)..(60),(71),(72),(198),(227),(236),(240),(750): n stands for any base
nnnnnttttnnnnnaaacgacgttacgtttcccnannnnannnncnnnnnnnnccccnnncaccccaccgnntcttccacccaccaacagtgttaacccggctctccgcgaatttttttccggggcgccccccctcttgggccccccccctttgggggggccctctttttggggggcgcgtctcttttttttttttgngaaaaaaccccaaaaaccccccccccccngcattttgngggnggggggtggaatgaagtaacccccccccccccttttttttttttctttgattgatgatattcatttcccttaggcgatagagagaggcccccccccttcctcctcccccacactcttttcccccccccccccccccctccttgcgctcccccctttgggggccctccctcattccccctacccctcctttttttccccttccccccttcccggccgtatggtgtaatatattggttattttcttgaattaaaaaaaacacatactccccccccccccaacaacgatacgccttcgtcttctccttactgcactatatcatctttctctccccatccacgttatccccttatatcccccccccccctcacttaccaattcctctttttttcacccccccctttcttttttttgatatggtttaaccataacccatttttttctttaccccttcttctccgtcgtcgtaccccttctcttgtttccttcctttcccccttccccttctcctncccatacaacacccatatcatatctatttcccccccctccccctcttctttccttccggtctgtttgccctttttttataaattaattcacaaacactccccacccggcatcaccgcccttgcctcccgttactcctctccggtctccttttacgggcttatccaatcaaaaaaaaatcccttcaattcctcttttttcctcaattttgctccgctaccccggttt

SEQ ID NO: 574 - DNA, 520 bp, Hordeum vulgare
  UNSURE (4): n stands for any base
aatnctgaaccgtagtagcaggttttctcacctacgaagcacaacggccatgataataacatggcaagtgtaacaaactctaaattccaacaaagagaaagaagcaaactagtatcgtagacaaatccgtcgacgacaagacttatagactcgcgatgttttctcctccacctcacaaaaattgtacctaggagctctctgccctcccacatttcaggtctcttccttcacaagctgctgcggtttttcgctcagacgggggtgtgcttcagagcgggcagggtgggacttcgagcgtcgcgccggcttggatctggccccacccgatgaggcgccagtgcttctcgacacggcggctcagggccaccttctcacccttgctggtgcagacaggcgcggtgagctggagcttggcgagatcgttcttcacggcaaccacgcgggcgccagtggacatggatccgatgttaagcatcaggatctcgcccttggtgagcttggagaccttccctgccttctc

SEQ ID NO: 575 - DNA, 518 bp, Hordeum vulgare
ggtcgtccaagagcagctgggcggccatcgctcttcgccgttccagtcgctgctgtccttggccccggtgtctcagttcgtcttctacacgccggaggacggcttcgccatgaaagacgtcgcttccgacgatcagttccccgtagataacctcaacgattcgcagggccagctatcgctgagctcggagagaagctttcttcactcaggaggccagggttgatcgataaaacgacgtacctacgtcgtggatatgcatggtctcaagctggtcaaagaaggtgcgtataaattaatagtccatgatgctccgggagcagtattttactgtctttataggtaagttatgctgtgatttaagattacttgagagggggttatttgggagtattaattgggtaagatgatgatcgagttaatgttttgcagcctctctgcaatgcagttcgttgcttctttgttaccacaagaagtaatcgtccatgtatcgattggctttgtgtaataacgatctggga

SEQ ID NO: 576 - DNA, 551 bp, Hordeum vulgare
gagaaaagcgaacttatattattaagcagaaactcccgaaacaaaatcccagatcgttattacacaaagccaatcgatacatggacgattacttcttgtggtaacaaagaagcaacgaactgcattgcagagaggctgcaaaacattaactcgatcatcatcttacccaattaatactcccaaataaccccctctcaagtaatcttaaatcacagcataacttacctataaagacagtaaaatactgctcccggagcatcatggactattaatttatacgcaccttctttgaccagcttgagaccatgcatatccacgacgtaggtacgtcgttttatcgatcaaccctggcctcctgagtgaagaaagcttctctccgagctcagcgatagctggccctgcgaatcgttgaggttatctacggggaactgatcgtcggaagcgacgtctttcatggcgaagccgtcctccggcgtgtagaagacgaactgagacaccggggccaaggacagcagcgactggaacggcgaagagcgatggccgcccagctg

SEQ ID NO: 577 - DNA, 517 bp, Hordeum vulgare
attggttgtggctcatgttatgcaagatgtgcttgatccatttacatcaaccgttccattaaggatagcctacaacaataggctagttctggcaggtgctgagctaagaccatctgcaattgtaagtaagccacgagttgatttcggtggcagtgacatgagagttctacacaccctgatattggtggatccagacgctccaagcccaagtcacccatcactaagggagtacttgcactggatggtgtcagacatccctggaacaactggtgccagcttcggccgagagcttgtagtttatgaaagaccagaaccaagatctggtatccaccggatggtatttgtgctgttccagcaactaggcaggggtacagtttttgcaccagacgtccgacaaaacttcagctgcaggaactttgcacggcagtaccacctaaacgttgtggctgcctcatatttcaactgtcaaagggaaggtggatcaggcggaagaaggtttaggccagaaagttctcaa

SEQ ID NO: 578 - DNA, 549 bp, Hordeum vulgare
tatgactgagattataccataggttcatatagctgaagatacatataatgctgctgcatacttagatgatacaaggcattctatatactgcacattatttgtgatgcaacattacagtacagcatacagtggtctgtactctgtactatactagtatctgatctctactccccttgagaactttctggcctaaaccttcttccgcctgatccaccttccctttgacagttgaaatatgaggcagccacaacgtttaggtggtactgccgtgcaaagttcctgcagctgaagttttgtcggacgtctggtgcaaaaactgtacccctgcctagttgctggaacagcacaaataccatccggtggataccagatcttggttctggtctttcataaactacaagctctcggccgaagctggcaccagttgttccagggatgtctgacaccatccagtgcaagtactcccttagtgatgggtgacttgggcttggagcgtctggatccaccaatatcagggtgtgtagaactctcatgtcactgccaccgaaa

SEQ ID NO: 579 - DNA, 556 bp, Hordeum vulgare
cccgggcctgcagggaattcggcacgagggaacacacgacacacctctagccttaggagcgcaatggcgactaccaccatgtccctctcctcggccttcgccggcaagtcggtgaagaacgtggcttcctcagctctctttggtgaggcccgcgtcactatgcggaagaccgctgcaaaggccaagcaagtttcatcgggcagcccatggtacggtgccgaccgtgtgctctacctcggtccgctttccggggagcccccgagctacttgaccggtgagttccctggcgactacggttgggacaccgccgggctctcggctgaccccgagacctttgcaaagaaccgggagcttgaggtgatccactgcaggtgggccatgctcggtgcgctcggatgcgtcttccccgagcttcttgcgcgcaatggagtcaagttcggtgaggctgtatggttcaaggcaggctcccaaatcttcagcgagggtggcctcgactacctcggcaaccctagcctcgtgcatgcacaaagcatccttgctatctgggcatgtcaag

SEQ ID NO: 580 - DNA, 553 bp, Hordeum vulgare
ggagggcagatacagccaatttcctgaaagatccttgtaatttacacatgatgttcaaaacccacaatacgggtgcagttcagtgtagtcgccttaatggctacaactcgcagctaactagggccaacccctcacttgccgggaacaaagttagtggcaaacgcccatgcgttgttgttgacaggatcggcgagatggtcagcaaggttctcgagggggcccttgccggtgacaatagcctgcacgaagaagccaaacatggagaacatggcaaggcgcccgttcttgacctcttttaccttgagctccgcgaatgcctctgggtcatcggctaggccgagcgggtcgaagctgccgccagggtagagtggatcaaccacctcaccgagtgggccaccagcaatgcggtacccttcaacggcgcccatgagcacgacttgacatgcccagatagcaaggatgctttgtgcatgcacgaggctagggttgccgaggtagtcgaggccaccctcgctgaagatttgggagcctgccttgaaccatacagcctcac

SEQ ID NO: 581 - DNA, 526 bp, Hordeum vulgare
ggcacaggtcgtcggcggctggcgctccgctggcgggatcgaggcagaagggagccggtgctccggtggccggcggggcatgtttactgggcgcgcccgcgctacgctgtcggcactggcccggacgggaatgtggctacgtgaaggtgctcatcccgtgctcctgaagcccctcaagcaggccctgcccgcgcggtccgagctcgtcgtcaccagccgcattcgccatcgtgagcacgcgccaccattacctgttcgtcgccggccgtgttcgctggccatgagcactgtcacctgtccgcaagcacgagtcctctccggcctccaccgtccatgaacagcggctcaccggagggaccgtcggactggggtctcgaggaggagtgacggggagggcgagtcacactggggaagtgaaggagcggcgctgatggccccggacgccggatccatcgacctcaccgcatggatccttcgaggaacctgccactgccatagggcgttcaacgtgctgttgatgtttggg

SEQ ID NO: 582 - DNA, 477 bp, Hordeum vulgare
tttggggttatatgagaacaattctaataaattcagaatacagctatatgcagcatcggttgtggctacatgacaacattttgttttatcgttctattataaaacaaagagaagccaagcaagttctaacccacatgtcgtcgttgtgctcgtttgcagtttctcacttgtacatacagttaagtgactcaggtcgtccgggggaagcagcgtcatttcttctagctagttcagacatcgtcctcttgctgtcttacagtcttgcggtactggcaacatccatgacgattccacacaccaggaatcttggatagttggagctgcatccacgcgccaccaaggtgactcaactcggtaatggcactaaccacaaacattagactaacattacagcgaggaagggaaaagacaaagaagattgcaagtcgctacaattgtgaaatccactcctactcacttggtcattttgtcaaatgc

SEQ ID NO: 583 - DNA, 272 bp, Hordeum vulgare
gcacgaggcacccgggacgccactccgccgcatgagccgggccgcctcccagccccaccggcgtccgcagccatgggagcccagcagagcgtcaatgccggcaaagccaaggtggatttgcacgtcgacctcacccacatgctctgcgaggccctcctgctgccgcccctgagctccagcgccaccatctcgcagatcgtcggaaggatctccctcaagcacccgagcctgtttgggaggagcgagaagttggacgtggtactggataaggg

SEQ ID NO: 584 - DNA, 507 bp, Hordeum vulgare
  UNSURE (5): n stands for any base
tactnaacagctggtacagttcatgcaaaaaaaaaagaggaaaatagaggaaaagaagacatatttctccctcgactaaggggccgaattatttttgtacgaaagaataagacggcgtgacaccttcgaccgacgacgctgtgcaggccacacctttgttctctgcagatgtcgtcccatggcatgtccgtgcagcatccaacagcagcagaagaaaaagaagataacgatgaactcgaatgtacagccctcgaatgcctccgacaccggcttgttgcgtccaggcacgttggaatggaaaattgctgggaatgatctcatgtcatggcttgtaaactctatgctatgtcaggtatgtgctggatgatctatgagccagcaccaccactgttgatgctgaagtagaaggtcttgcgactgaaggcgttcatggcgtagtcgacccggatttgacctatgtccgtgttgaagtggacaccgtacccgaacccaacaccgaatcccggt

SEQ ID NO: 585 - DNA, 518 bp, Hordeum vulgare
ggaagagaagcactcatcgatcgatcgaccgttcgttcctcctccgccgccgccgccgccgccgcagcgtcaggtgagggcccagggagtaggtttgggtgcgcgcgctccggccgggggctccgacgactcggggccgtgccgttggtatatgcaacagaggggcctctccaacaaccgccgctcccgcggcttctcccgatcccgcctcgccgtcgagggcacctgaacctcaacaaaccccctcttctctccctctctcttaaccactcacgccttcttccttccttccaaacaaacaaacaaacagactcgcattcgcatcccatctccctcctcctaccgtaaaaaccaaaacaaaacaaccaaaccttcgactcgaaagaaaagaaagaaagaaaggaacaagatggagaccatcaccgtcgtcgagaatgcgttcggggaggtggagcgcaaggtgcagaagagctactgggaggagcactccaaggacctcaccgtcgagtccatgatgc

SEQ ID NO: 586 - DNA, 549 bp, Hordeum vulgare
tgaatcttgatccttcctcccactcaaacttactattgcatcccttaaaacaatctgcggtgactgcctgattggagagtgaggtgaggaataaagtgagagtggcaagatggtcaattcaagctcactagtgacgcatccaaatattctcaagaatcggatggtgccaagggcatgtgatcatttatttacatcaaaaatatagtagggtataggatgtcattttatagtgtttcctttaatcatatccatatccatagtctattatgtgtagtagcacctagtagctccacatgtccactagtcataacatataagatcgccgtccaattcgacgatttgacaatccatgctcaattatagcgtaggtcttcacgttaacaagctatatgttcaattatgtacttcctccattcctctgggcgctcctccttgtcgaggtccttggcgcgggagtcgagcatcatggactcgacggtgaggtccttggagtgctcctcccagtagctcttctgcaccttgcgctccacctccccgaacgcattctcg

SEQ ID NO: 587 - DNA, 446 bp, Hordeum vulgare
ctggaaccatcgatcggtaggaagcaaccgtcgctccatcttacccatcgccgtcacatccatccaattccaagctcgtcggagttgctccggcgccaacaactgccgggaagattaggcgcacgcacgctcgtccggccggcgttaatgggacgtccgacgtctgggggcgcggagcagcccaggctccgcaaggggctgtggtcgcccgaggaagacgagaggctctacaaccacatcatccggcacggcgtcggctgctggacctccgtccccaggctcgccgggctgcaccggtgcggcaagggctgccgcctccgctggctcaactacctccgccccgacctcaagcgcggcaccttctcgcagcaggaggaggacgacatcgtcgcgctccaccggatcctcggcaacaggtggtcacagatcgcgtcgcacctgccggg

SEQ ID NO: 588 - DNA, 409 bp, Hordeum vulgare
tttttttttttttttttgcgctttaatggtgtgacccttgtctcttataaaaatgaagggagaaagtagggaaatatttttgaatacgtaaagaaagaaaaagatcagaagtattgttccaaattgaactcgaaatttgtgtggaggctttcttggtagggtaaggagaacttgtaatcgagcggctcgtcgtgctgccgctccatctccgccttggcccagtgcggcacctcgccgtccagcacgctgcccacctcgccgccgtagttccagttgctgctgttgctcgagctctccccgtagcccaggttctccgacacgtccagcacgcagctgtagtcgccggcgtccttgcaatccccgaactgggcgtacagtgcggcgccgaggtcaccgctgagcccgccgc

SEQ ID NO: 589 - DNA, 459 bp, Hordeum vulgare
acacgttttaatatttagatacatatatttctaaataaacctaagccaagaattttgaaactagggattacatacaaagtagttcctccgttcctaaatatattttttttagagatttcacttcaaacaatttacggatgtatatagatatatttttaagtgtaaattcattcattttacttcgtatgtagttcgtagtgaaaatctctacaaagacttatatttaggaacggagaaagtaaaatgaatgaatctacattttaaattatgtccacatacatagcttgtattaaaatatttaaaatatccgtatatagcttgtattaaaatctttaaaatgagttatatttaagtacaaaggaagtaacattgtacagcaaaagagatattgttgggctactccgcatatggatgcaaacaagtgaagatcgagtagatttattcccagatggaagtaat

SEQ ID NO: 590 - DNA, 529 bp, Hordeum vulgare
gaatattgatttctgctctcttcatctttatgagttacagtaatagagcataagaagctgatgtatctattgatccacaacaggtcaacaacgcactaatggatcttataaaggccaccaagtctgcggtgacgcctcacgagtggtcttcccagccagaaaacacatcaggtatgcttaacagccgacggctgaacgtcgcaaaattctttggaaggctatgttggaaggcacacctcttacgctgaccctttaccaccagaaaccggggcacttatttctgcaaggcctgtaaccttcacgatacgaacaggcgaagctggcagcgctgctgtagcagtgtataacctacttgcaaagttgcaactaagctttctttatgtcataggcctgatagtgatggggtttgagcatatgaggaacattgtaagagtaatgaagcccgtgagggtcgcagcgatcgagtcataaggtaaatataatatccttgttctacttaaactgccttgttttctaattcttggcggat

SEQ ID NO: 591 - DNA, 553 bp, Hordeum vulgare
gaggaattcggcacgaggggacggaaggctaagcttgtacaaagttgaaaagcttagcaaggaagaatacaaagaggtgccagtaaaacttgggattgaagagccaaagaaagggagaaatgcgtggaatggtatgaggtaccatcacttggacgcgcagcaacttgagtctggtagttggatagctgtaatggatggtgatcgtgttccttcaggcgattcaacgcgaaggtccatctctggttacctgggtttcttgctagccgtagttctggtcacttttgtgggttttgtgaaaggtgcaatcaattgctacattcctccaagtttctgggctgccacggcaaggagaaatgaattgtcccgtatcttgcctgtctaccgcttgaaccagaaagtccgcagatattctaccagccttggcagatatgtcacagcaaccaaagccaggctcaacgagaaaacatggtccaacaagctcttcttttgcgtgatcgctctcttggggaccgtgaacatctgcatcgctgtgcatttcttacttggtggcaat

SEQ ID NO: 592 - DNA, 533 bp, Hordeum vulgare
gccattgacagctggtcctatatgagcatttgatccaacaagttcctggagaatcagacactgggaacagatcttgatctactgcactctaggcttctagcaaaatctaatagacacttctaccaacaaggttatagcattccccgtcccatgctgcaaaacttcccacgagaccaccaacaaaaaaagttctaagcatttgcatctgttggctgtgtactatttcccgcccccactgtccagagtccaggctatttgtcccagccatcttgtcgcctgccaaactcccatttctgaggcagagggccgtatatggaggagaacttggccaggcacttggtcctcacgtcatagtgcttctgggtgtcgcggctgatggcgacggaggagagcttggaggtgtcgatggcccacgccgggtgcacgtactccacggtcctcctccccgtcccggagctagcgttcgcgtacatgaagttcatcagcaggtcctcacagttgaagttcttgtgcacgtagtccctaccttccct

SEQ ID NO: 593 - DNA, 559 bp, Hordeum vulgare
gtccccccgggcctgcagggaattcggcacgagggcttcatggtgcacatctagtcagccatgaaagaccagaagaggtcaacaacgcactaatggatcttataaaggccaccaagtctgcggtgacgcctcacgagtggtcttcccagccagaaaacacatcagaaaccggggcacttatttctgcaaggcctgtaaccttcacgatacgaacaggcgaagctggcagcgctgctgtagcagtgtataacctacttgcaaagttgcaactaagctttctttatgtcataggcctgatagtgatggggtttgagcatatgaggaacattgtaagagtaatgaagcccgtgagggtcgcagcgatcgagtcataagacacagaggacatgtaaattatccccgaaacctgcgaggagatcatatttcatgtctcctccatatacctcggagatgagatgaatttagagtagcatctccgaaagaattgaacctatttttcctcctcccttgagaaagctctctgctgtcgggcggaagaatacgagacaaataaagagag

SEQ ID NO: 594 - DNA, 549 bp, Hordeum vulgare
ccgtatattaagcttgtatttaaaatctttaaaatgagttatatttaagtacaaaggaagtaacattgtacagcaaaagagatattgttgggctactccgcatatggatgcaaacaagtgaagatcgagtagatttattcccagatggaagtaatcacaggatggtacagaagaacggtgggtggcagcaccagccaccagcgcaacatgcggccgtgcatatatggttacagccgacagcttaattacactcatcatacaaggtacatccatttgctctctccgagctaaataacacaccaagcacatctcaatcacgccctgtgacagcttctgtccaggtgcataatgcaggtatagctcctctctttatttgtctcgtattcttccgcccgacagcagagagctttctcaagggaggaggaaaaataggttcaattctttcggagatgctactctaaattcatctcatctccgaggtatatggaggagacatgaaatatgatctcctcgcaggtttcggggataatttacatgtcctctgtgtct

SEQ ID NO: 595 - DNA, 516 bp, Hordeum vulgare
ctcaacttctccctcaaggttcagacccctcctctttctctcccgcccccttttactgggcctgtcaatgaccagtgccagttgcatttcgttgagccgccgcgcgccgtttcccgtgctgccgctggttgttggttagacgcgatctcgtcggtgtttcgtgagatgctgccgctgcggatttggggatcgtttttcagttccttgcttgattgatccaccacttgctatgcctagcatggtttgtgatgccaagggggattacaagtccggccatgtcgttgcctgcttcatagggagcatccagtgctgctattcatctccatgctccacactgcggtgcggggaggtgaattctcagggaggtagagattagattcggccgtgacatgtctttactgacgacacataagatatagtatgagatttggtgggctttcgctttccatggatgaatgtctgcctctcagaatggcaaggaataaagcgctctgctgctcgtgactcttgtctcca

SEQ ID NO: 596 - DNA, 524 bp, Hordeum vulgare
atgtcggctgacaagacgccacttatataacggtacatttgcaatgcgtcattcctacctgctaaattctcaacagaaaaacttgaccaaatagattctcaccagccacgcctgttgatggaattccacaaactagcctataaaagcgcaagaatatatgcaccaataatatcactctctagtgtttatacatgactgatctctacggcttttggagacaagagtcacgagcagcagagcgctttattccttgccattctgagaggcagacattcatccatggaaagcgaaagcccaccaaatctcatactatatcttatgtgtcgtcagtaaagacatgtcacggccgaatctaatctctacctccctgagaattcacctccccgcaccgcagtgtggagcatggagatgaatagcagcactggatgctccctatgaagcaggcaacgacatggccggacttgtaatcccccttggcatcacaaaccatgctaggcatagcaagtggtggatcaatcaagcaa

SEQ ID NO: 597 - DNA, 518 bp, Hordeum vulgare
agcagaaggctggccgggccacggaggccaccaagcagaaggccggcgaggccaaggacaagacggcacagacggcgcaggcggccaaggaccgcgccgccgagagcaaggaccagacggggagcttcctcggcgagaagacggaggcggccaagcacaaggccgccgaggcaaccgaggcggccaagcagaaggcgtcggagacggcgcagtacgcgcaggagaggtcctccgacgccgcgcagtacaccaaggagtccgccgtcgccggcaaggacaagaccggcagcgccctccagcaggccggcgagacggtggtgaacgccgtggtgggcgccaaggacgccgtggccaacacgctgggcatgggcggtgacaacaccaacaccagcaaggacaccaccactgggaagatcaccggggatcactagacgcatgcattcgcgctcagtttaaatttgctttcctttagtcgtttggtcgttcgcgggccttccacatatatttgtatgtttcca

SEQ ID NO: 598 - DNA, 542 bp, Hordeum vulgare
tgatcaactttattagtgccacctttcgactgtcctcgttatccatctacatcgaagtacattgatcgtaactcattacagaaccggacacgagtaccatcaaatcaaaggcaagctcaacactgaaattcgggaaaagagtggaaacatacaaatatatgtggaaggcccgcgaacgaccaaacgactaaaggaaagcaaatttaaactgagcgcgaatgcatgcgtctagtgatccccggtgatcttcccagtggtggtgtccttgctggtgttggtgttgtcaccgcccatgcccagcgtgttggccacggcgtccttggcgcccaccacggcgttcaccaccgtctcgccggcctgctggagggcgctgccggtcttgtccttgccggcgacggcggactccttggtgtactgcgcggcgtcggaggacctctcctgcgcgtactgcgccgtctccgacgccttctgcttggccgcctcggttgcctcggcggccttgtgcttggccgcctccgtcttctcgccgaggaagctccccg

SEQ ID NO: 599 - DNA, 521 bp, Hordeum vulgare
cttcatggtgcacatctagtcagccatgaaagaccagaagaggtcaacaacgcactaatggatcttataaaggccaccaagtctgcggtgacgcctcacgagtggtcttcccagccagaaaacacatcagaaaccggggcacttatttctgcaaggcctgtaaccttcacgatacgaacaggcgaagctggcagcgctgctgtagcagtgtataacctacttgcaaagttgcaactaagctttctttatgtcataggcctgatagtgatggggtttgagcatatgaggaacattgtaagagtaatgaagcccgtgagggtcgcagcgatcgagtcataagacacagaggacatgtaaattatccccgaaacctgcgaggagatcatatttcatgtctcctccatatacctcggagatgagatgaatttagagtagcatctccgaaagaattgaacctatttttcctcctcccttgagaaagctctctgctgtcgggcggaagaatacgagacaaataaaga

SEQ ID NO: 600 - DNA, 553 bp, Hordeum vulgare
tatttaaaatattccgtatattagcttgtattaaaatctttaaaatgagttatatttaagtacaaaggaagtaacattgtacagcaaaagagatattgttgggctactccgcatatggatgcaaacaagtgaagatcgagtagatttattcccagatggaagtaatcacaggatggtacagaagaacggtgggtggcagcaccagccaccagcgcaacatgcggccgtgcatatatggttacagccgacagcttaattacactcatcatacaaggtacatccatttgctctctccgagctaaataacacaccaagcacatctcaatcacgccctgtgacagcttctgtccaggtgcataatgcaggtatagctcctctctttatttgtctcgtattcttccgcccgacagcagagagctttctcaagggaggaggaaaaataggttcaattctttcggagatgctactctaaattcatctcatctccgaggtatatggaggagacatgaaatatgatctcctcgcaggtttcggggataatttacatgtcctc

SEQ ID NO: 601 - DNA, 518 bp, Hordeum vulgare
gaccttttcaactccaagacttggctggatatggagtagccttagcagtaaaggatatctatgcagctgcctttggaacacggaattttgactctgttctagtggatttgatggcggagaccgggcggcagggaaaaagcaatggaaaaggttactacctttatgagaagggtgcgaggccaaagcctgaccctagtgttcaaaatgtgattgacgagtacagaagacaggcaaagacaatgcctggtggaaagccggttactttatcggatcaagatatattggagatggttttcttcccagtcgttaatgaagcatgcagggtcatggatgaaaatgtggtgatcagggctgctgatctggatattgcatctgttcttgggatgggctttcccaagtacaggggtggcctcatcttttgggctgacacggtgggagcatcttatatacattcaaagcttagcaagtgggctgaaatgtacggtgatttcttcaaaccatcattgtatttggaggaa

SEQ ID NO: 602 - DNA, 551 bp, Hordeum vulgare
ttaacataaactctactttacaacataacccaatttattatatatactccctccgtccgaaattacttgtcgccgaaattaattaaaatagatgtatccagaactaaaatacatctagatacatccattccttcgacaagtattttcagacaaagggagtagttacagacatgcacagtgatgaggcacagaaactacaacaataaaaagtatgccaagacatttattctttatttttcttattgttgtatcagcccaggtaacaaactgggaacgtgatgtaatgtccaatacacactacagataacacttcccttggaggtcttttgaataccacatatggcagttggtcgagcagtagctgtgccaggttccgattatatgcagcgcctcacatgcgtgacctcgtcgaaacttggtgagccgtccgtggcgcagccagtggtcggccgcttttcgctctttcctccaaatacaatgatggtttgaagaaatcaccgtacatttcagcccacttgctaagctttgaatgtatataagatgctcccacc

SEQ ID NO: 603 - DNA, 521 bp, Hordeum vulgare
gcaccactcccatcccaccggagcagagcaaggcggcgccgcggcgacctcatctccggccaagggaaatgactaccgttccgggatctctggtctgggagctcgtgaagaagaacaactgcttcttgatcaagcagttcggcaacagcaacgccaaggtacagttcagcaaggagcccaacaacctctacaatgtccactcctacaagttctcgggcttggcgaacagcaagaccgtggctgtccagccatcagcgggagaggacaaggctgtcgtcctgtccacgatcaagaccaagaagcagaacacccctgccaagctccagcacaagactctgatgcgcaaggagttccgcaagatggccaagtctgtcaagaaccaggtatgcgacaactactacaggcctgatctgaccaagcctgcccttgcaaggctgagcgccgtgtaccgcagcctccaggtttccaagcctggagtcaagaagaagaacaggcagccaactaagctgtaaactcattaa

SEQ ID NO: 604 - DNA, 550 bp, Hordeum vulgare
tggtaacaaaaccttcttctacctgtagggtacaactagggcggatttgtacatggttcttccagggtctcacttatgactcaaaactgttggaacagacatgataacatgagtgccaaaaggcaaccttaatgagtttacagcttagttggctgcctgttcttcttcttgactccaggcttggaaacctggaggctgcggtacacggcgctcagccttgcaagggcaggcttggtcagatcaggcctgtagtagttgtcgcatacctggttcttgacagacttggccatcttgcggaactccttgcgcatcagagtcttgtgctggagcttggcaggggtgttctgcttcttggtcttgatcgtggacaggacgacagccttgtcctctcccgctgatggctggacagccacggtcttgctgttcgccaagcccgagaacttgtaggagtggacattgtagaggttgttgggctccttgctgaactgtaccttggcgttgctgttgccgaactgcttgatcaagaagcagttgttcttcttcacgagct

SEQ ID NO: 605 - DNA, 981 bp, Hordeum vulgare
  UNSURE (1)..(3),(15),(23),(26),(873): n stands for any base
nnnttggcaatgtgncgatgacnacngagtgtgcaggccattcgagcacgagggtatatatatatacagataactagtctcgagttttttttttttttttttttttttttaaacttccccccccaattcattaaaacccccggggaaacccccccctttaccaggggggggttccttaaactttgggaaatttgggggggccccccggggggttttccccaaaccctgaccccaccccaaaggggtttgggttgggtttttcccaaaaaccttccccccaaaaaaatttttttgggggccaaaattttaaaaccgaaactttgcccttttaaaaacccctttttttttttgcccaggcccccaaacaaactttgaaaaacaaccggcccccccaaaaatttagggggtaaaaaacccttttttttttcctttcctttgggccccttccagcccaaaaaaaaaccctgggccggggaaaaaaccccgagaatcgggtttttacacccaaggaccggccaaaaacctttttcccatttgggcccaaaaaaattttggtggggcccccccccccctctccccaagggggccccccttgtgcctttatgggcctacacaaccttccctgggggaaccctttttcggggggccctcctcttttaaagtaaactcctctccactacacctctctcgggaaaatttttgacccccccccgggtctccctctgttttaacccccttgatgtttttttcttccctccagggtcctcaccacccccgtatcccccgtttgtgtacccccctcttttctcccctcactcccttttttggttctttttcccccccctctccccccttaccttcttccttcctctncctcccccacacacacccacaccacccccagcagttatcccgtcaatccttcccacttctttctcccctcctcctttctccttccccctcctctttcccccatcccta

SEQ ID NO: 606 - DNA, 546 bp, Hordeum vulgare
tttgctccacgattcagttaaactacagaggaaacagcgaactagacaagtcgaggttccatcagacttgtggaatctgcagggggcgaccaggaggcattcaccaaacactgaagccaacacaaataggatttggtttgagtctactccaaaacgctgacgccaacagaatcggatttgggggcaaaaattcagaagcgagacattgcgctactgaagaacactgttaatatctgaccagtcgcacgaacaaacatcgacagacaacacggaccacacaagaattcaagggtaaacaaacagcttcaatttccattccatcgtagcacatccagacgacaaacgaaaccaaggccagggcaaagagcagcgagatgcggcgattacaacccaggaccggccacgaacactactaccactgtgtgccaaacaaagctagctgatggcctagccgccgaatccgtagagggtgcggccctggcgcttgagtgcgtagacgacgtccatggcggtgacggtcttgcggcgggcgtgctcggtgtaggt

SEQ ID NO: 607 - DNA, 414 bp, Hordeum vulgare
agccccacaccgtctactacgccagccaggacgccgcctccggccgcttcttcgtcgccggcacgcacccgccgccaggctccctcaactgagtagactagccaccaacgacggagcacgtcgagatcagcacgtacggggcttccatcttgggcaagctagccagctcgggcctcggtgccgtagcagccacaagttcgtagttaaactagtgcactactggttcaggttcggtttcccgactgtagtgttgtgtactgcggtgtgcactgtcggctcgatcaccaggttttatccctcgagcataattagtggatcgaaagagcccggccggggaacgtaactcagtccactactagtgctgcctacttaaccgtgtaataaaaatacccatgtgccgtttccctcaaaaaa

SEQ ID NO: 608 - DNA, 410 bp, Hordeum vulgare
ggtgaaacggcacatgggggtatttttattacacggttaagtaggcagcactagtagtggactgagttacgttccccggccgggctctttcgatccactaattatgctcgagggataaaacctggtgatcgagccgacagtgcacaccgcagtacacaacactacagtcgggaaaccgaacctgaaccagtagtgcactagtttaactacgaacttgtggctgctacggcaccgaggcccgagctggctagcttgcccaagatggaagccccgtacgtgctgatctcgacgtgctccgtcgttggtggctagtctactcagttgagggagcctggcggcgggtgcgtgccggcgacgaagaagcggccggaggcggcgtcctggctggcgtagtagacggtgctggggct

SEQ ID NO: 609 - DNA, 518 bp, Hordeum vulgare
ggaaatatgttggacaaatgagtaatggctatcgttggccatttggcccggttgcaataatcacaccattcaatttcccattggagattcccttactgcaactgatgggtgcactttatatgggaaataaaccagttctcaaagttgacagcaaagttagcattgtgatggaacaaatgatcaggttgcttcatgagtgtgggttgcctgcagaggacgtggacttcataaattctgatggtatcacaatgaacaagctgctattggaggcaaatccaaaaatgaccctcttcactgggagctcacgtgtggcagagaaactggctgctgatttacaaggccgaatcaagttggaagatgctggttttgattggaaaattcttggtccagatgttcaagaggttgattatatttcatgggtttgcgaccaggatgcttacgcttgcagtggtcagaagtgctctgcccagtctatgctattcatgcacaagaattggtcgtctagtgggctacttgag

SEQ ID NO: 610 - DNA, 550 bp, Hordeum vulgare
ttaattcaattcttttactagagtaacatctaaagctccttaacaaccctcgtggtactccattcataattatgacctttactttgttcttgggagtcgagattctcccaattgcctacacggggcttccattattcaacacaacacggtaccagtcctcgaccagctaattcggtccgtgtagccttcttctccatcaacagcgtgttcttctagctagccgtcctagacatatcatgtagccgaaggaagtgcccagttcttgggcaagggaccaatgtcatatatgatctccctgtggcaagaccagacgagtttgatggcttctggagtgccaatccccgcgcctcttgggtcaccggcaggaccaaaccagtggttctgtggagcgccagtggtccttgctcgaattccagcatacgtcgtaccgttaactgatttcccgagtacttcctgcaggaataatttgtcgtttgaaactactgcagctgtcagatgcgcattcatcctctcgcaggcttctaataccaattcaagttgatcctcggag

SEQ ID NO: 611 - DNA, 550 bp, Hordeum vulgare
gtctccccgggcctgcagggaattcggcacgaggctccgatcccccaggagccgtcgcgtcccggaaggagcagcagatccatccatggcggcgctggggtccaagctggcgcagctgcaggccaaggcctgcgaggcgacgcggttcgcggccaggcacggctgcgcctaccacaagaccctcatggagaagaacaagcagttcgtcgtgcagccgcccaccgtcgagaagtgccaggagctctccaagcagctcttctacacccgcatcgccagcatccctggccgctgcgaagcattctggaaggaggtggaccaagtgaagcagctgtggagaaacaggagcgatctgaacgtggagcacgcgggcatcgctgcgctgttcggcctcgagctctacgggtggttctgcgtcggtgagattgccggcaggggtttcaccttaactggctacagcgtctgagcgccctccttccatgagtacctttccgcggccgtcgattaagagctgaagactctgttagccaatcagtttctcgtgatgcgcgtt

SEQ ID NO: 612 - DNA, 550 bp, Hordeum vulgare
tggggagatactttcttctggaggcgtaatttgccctgattttaggatacaagcaaggcaaacattgcagacatctcatctgtccaggcttcattcaactaagtgtgcgacaaattattagacctcatcgacgagtcgaatttaccgagccgtgtgtaccttttcaccagcatcaagaatagtatttcagaaaaaccaaaacttcgcaacgcgcatcacgagaaactgattggctaacagagtcttcagctcttaatcgacggccgcggaaaggtactcatggaaggagggcgctcagacgctgtagccagttaaggtgaaacccctgccggcaatctcaccgacgcagaaccacccgtagagctcgaggccgaacagcgcagcgatgcccgcgtgctccacgttcagatcgctcctgtttctccacagctgcttcacttggtccacctccttccagaatgcttcgcagcggccagggatgctggcgatgcgggtgtagaagagctgcttggagagctcctggcacttctcgacggtgggcggctgcacg

SEQ ID NO: 613 - DNA, 513 bp, Hordeum vulgare
ccgtcgcgctctgcccggcgtcggcgacgcgctcttccccgtctgcctcggcttcagcctcatcgtcatgtacgacgccacgggcgtccggcgacacgccgggatgcaggccgaggtactcaataagatcgttgaggacctgttccaaggccaccccatcagcgaaaggaagctcaaggagctgttagggcacaccccatcgcaggtcttcgccggcgcgtttctgggcatcctggtggcctggttctgctgccagggttgtatcggtgccatatgatgtatgccttactgcttcagaaatggagtcattttgtaccatcattgggggaaacataggtgctttctttttcgtggcataatattggctgtacataattgcatggatggtattaccacttctcaattcatagttgggacttggctctgatttgaaattaaagatgcagaggagactgagccacccaatgcctctcggcgttgacgttggtgtgcatggcttgtcttcgaaattct

SEQ ID NO: 614 - DNA, 502 bp, Hordeum vulgare
caaagattttggcctttttggtgcgatgcacaacatcactgaagaatttcgaagacaagccatgcacaccaacgtcaacgccgagaggcattgggtggctcagtctcctctgcatctttaatttcaaatcagagccaagtcccaactatgaattgagaagtggtaataccatccatgcaattatgtacagccaatattatgccacgaaaaagaaagcacctatgtttcccccaatgatggtacaaaatgactccatttctgaagcagtaaggcatacatcatatggcaccgatacaaccctggcagcagaaccaggccaccaggatgcccagaaacgcgccggcgaagacctgcgatggggtgtgccctaacagctccttgagcttcctttcgctgatggggtggccttggaacaggtcctcaacgatcttattgagtacctcggcctgcatcccggcgtgtcgccggacgcccgtggcgtcgtacatgacgatgaggctga

SEQ ID NO: 615 - DNA, 523 bp, Hordeum vulgare
  UNSURE (4),(8): n stands for any base
cacngggnaagattggtaggaatgatacagaacaccgagaagaatatactccttttgaatcaagctcgtcttcaggcaatggaacgtgctgataaaattcttaaagaaaaggaagcgttgcagagaaagataagcattttagagacgaggttgtcagaaacagatgcacaacataagctttcaagtgaagggaatttcagtgagtctccactagcattggagtttgatgttctaaaggaagagaacattctactgaaggaggacatcgaattctttaaatcaaaacttatagaggttgccaacacagaggagggtatattcaaattggagaaagagcgtgctcttttagatgcttcccttagggaactggagtccagatttatagctgcacaagcagatatgatgaaacttggtcctagggatgcctggtgggagaaagtagaaaaattggaagacttgcttgagaccacagcaaaccaagtagagcgtgctgctgtgatattggacaacaatcatgatctgc

SEQ ID NO: 616 - DNA, 529 bp, Hordeum vulgare
tggactgcaaaacgtcttacattatggtacagaggtactagtactttctaacatgacagatgcttagggttcaggtctctgaatttcttgctcctttcatctcacggaccataagatttctgcataataatacgactctgcagtctgcaccgcacatatacagttcaattacaacccctcgacaaaatatacatcctacaatttacaccaatttatgccaacaacattgcacgtactacgatcttaacagttcatggtagccaccccatttttcgcccccgttctgtcttcaataaaacagcgcatataacagccgcgctgatacctgaaatgtgcgtcgagagcatggagcttcttcctatataattccgttttcatgatcccttgatgatttcatcttgcgctgtttgtgttggaagggcagggccagggggtgagagcttggaggcgtcagggaaccaacaaccgtgtttgtgttcgctcatgctgctgccctcgctcgagccactgccttttggtatatgtcttc

SEQ ID NO: 617 - DNA, 477 bp, Hordeum vulgare
gaaggcccctgcgcctgagaagcagggcgcacgggaggatgcaccaaaggcagatgagaacaaggccagcaaagatggtgctgcagttgtggaagaagaaaaggaagaggataatgagatgactcttgatgaatttgagaaagtaatggaggagaagaggaaagcacttgatgctttgaagaagtctgaagagaggaaggtcgaaattgataaggatcttcaggctatgcaactactttccaccaagaaaggaaatgatgaggttttcatcaaactgggtgctgataaggaggctttgaagaagaaagagaatgctgaacgtgaagagcgtgctaagaagtctgtgagcatcaacgagttcctgaagcctgctgaaggagaaaggttctatggtggccgaggccgtggcggcaggggccgcggggatcgtggaggcttcagaggcggattcggtggcgggggttatcacaacccgcc

SEQ ID NO: 618 - DNA, 549 bp, Hordeum vulgare
gcattatagcctacaaaattctgacaaacgacggcaactgggatatacaaagtctgacaggcacatggatgaatggtccggatacagcaaagttatttgttgtttcgacaagggttcacgcagaaatatatggtaatggcaaaacttaaacttgacagagtcggcgatattgataaaggggtggtactcgagacggcacagcaatctcacttcccaccgagggttgggaactggttctggtcctggattgccggagcaggcggcgggttgtgataacccccgccaccgaatccgcctctgaagcctccacgatccccgcggcccctgccgccacggcctcggccaccatagaacctttctccttcagcaggcttcaggaactcgttgatgctcacagacttcttagcacgctcttcacgttcagcattctctttcttcttcaaagcctccttatcagcacccagtttgatgaaaacctcatcatttcctttcttggtggaaagtagttgcatagcctgaagatccttatcaatttcgaccttcctctct

SEQ ID NO: 619 - DNA, 515 bp, Hordeum vulgare
cgatttgagggggacaggctacatcgagaaagaagagcttcgggagttggtggtggcactcctcgacgagtccgacctgtgcctctccgatagcgccgttgaggagatcgtcgacaatacgttcagtcaagcagactcgaatggcgatgacaggatagaccccaaggagtgggaggagttcgtcaagaagaacccagcatcgctcaggaacatgtcactgccctatcttcaggacattacgacggcgtttccgagcttcgtgatgcattcggaagtcgacgattacagcggaatcagcaaataataacttgccttgatgccttatgatctgtcccgggaggccatgcgttcagaagtgcgtgagctgcacctcgaaaatccggagctcgaacggggggagaaaacacgggaatcaatctgggagcagctggtgagcttgagacgatgaccagatagacaacgacttcttgttgatgcgagatgggcgtcagactatgagaaaggggctgtgtacg

SEQ ID NO: 620 - DNA, 549 bp, Hordeum vulgare
  UNSURE (52): n stands for any base
ggtgaacctttaaaagacttttatttaggaaggaagagatacatcatattgntgctctattacaatctcttgatgcatcaccgatgcatcgaagcaactaaagaaacaacatacatcctctggcattttaccatacctacaggaggttgcccctcataagccaaaagatacgaagctagtaacagtgcccaacagccaaaatgaccaaaaccgctcgtcactgctccgtgtttcgacaacctctatgcacacttgacgtaggtacaccgtacacagcccctttctcatagtctgacgcccatctcgcatcaacaagaagtcgttgtctatctggtcatcgtctcaagctcaccagctgctcccagattgattcccgtgttttctccccccgttcgagctccggattttcgaggtgcagctcacgcacttctgaacgcatggcctcccgggacagatcataaggcatcaaggcaagttattatttgctgattccgctgtaatcgtcgacttccgaatgcatcacgaagctcggaaacgccgtcgtaatgt

SEQ ID NO: 621 - DNA, 515 bp, Hordeum vulgare
cttgaaggtgtggatgttgttgtcatccctgccggggtcccaagaaagccaggcatgactcgtgatgacctgtttaacatcaacgcaggcattgtcaagtcgcttattgaggctgttgcagacaattgccctgaggcctttatccatattatcagcaacccagtcaactccacagtgccaattgctgctgagattctgaaacagaagggtgtctacaacccccagaagcttttcggagtttccaccctagatgttgtcagggctaacacatttgtagctcagaagaaagacctcaagctcattgacgttgatgtcccagttgttggtggtcatgctggaattacaatcctacctctgttgtcgaaggctaggccatctgtcaccttcacggatgaggaaaccgaagagctgacaaagaggatacagaatgctgggacagaggtggtggaggcgaaggccggtgctggatctgctacactgtccatggcctatgctgctgccagatttgtcgagtc

SEQ ID NO: 622 - DNA, 527 bp, Hordeum vulgare
  UNSURE (3): n stands for any base
ttncacgggtttggtcaacttcggaagctacaagaacagcaggtgtaatgtgtcaaacaaaataaggccccggaacagggagcgattcggggcttcacgccctcatgcaatctagaatcataagaaaccgaccgacaactgagaaatatatctgctccagggcatactccttcctacacgatgtcaacactctaggctgcaaaacttaagacgaggacaatcattttgcctttattctcttcatacggagttatcgttctcctttacctcaaacggacgcggtggctccctgctgcttgtgcacaaactcgatgcccttctcgatgctggccttcagttcaggcttcaatgcctcgagtgccttggcctcgtactcggtcactccctccaagtcggaagagatgatggactcgacaccattcttcccaatcttaactctggacgcaaagaatggcagctcagttagctcagactggacatacgtgcactcgtaaacatctgggtcaccagccaatgcgcgaagtgac

SEQ ID NO: 623 - DNA, 526 bp, Hordeum vulgare
cccagaatgctggttgttgatcctatgaagaggattactatacgtgaaattcgtgaacattcatggttcaaagctagacttccacgctatttggccgtgcctcctccagacactgctcaacaagttaaaaagcttgacgatgaaactctgaatgatgtcatcaaaatgggatttgacaagaatcagctaactgaatctcttcaaaagagattgcaaaatgaggcgacagttgcatattatttactcttggacaataaacttcgtacaaccagtggctatcttggagccgagtatcaagagtcaatggactcatctttctcccaaatttcacctgaaacaccaagttcagcttctgaagctaggcagtatggttctcccgggtttggcttgaggcaacattttgcagctgagaggaaatgggctctcggtcttcagtctcgagcgcatccacgagaaatcataactgaagtgcttaaagctctgcaagagctaaatgtttgctggaagaagattgggcactataaca

SEQ ID NO: 624 - DNA, 555 bp, Hordeum vulgare
cagccaaaacgtccaggacataatatatggtctacaaggcgtcatagaacaccattggtgacaggcggacgaaggaataggttgcctcttgcccgtcacctctggtttagtaaataagtcctgaaccatcaaaacaaaaccacgtggttctctagcgtctacataccccaggagtagattctactggaggattatgatagctatgtacaccttgactgtaacttcgcactctgcaggaagctgcggggctttgcagttgggaagtcaccatcttcaggatcaaaggactctcagctgggttagaaaggcagaacacaggtccagaaagaggagctgtggtccactaaccctttgcaagtcgagaagatacttatcatcccttgttttgtacagctgaatttcaaacttcacgatgtgggttgatttgtcaccgaggccatcagcttcaattatagcagactccacaccgaatccattgttgttatgcatcatattctcaaaaaagccaggactccacctgcacttcatgttatagtgcccaatcttcttccagca

SEQ ID NO: 625 - DNA, 498 bp, Hordeum vulgare
ttcacaccttcttcagcgagcctggtgctgggaagcacgtcccccgtgcagtctttgttgatcttgagcctactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctgtccgacaactgcactggtctccagggcttccttgtcttcaatgctgttggaggtggaactggctctggccttggttctcttctcctagagcgtctctctgttgactatggaaagaagtccaagcttgggttcacagtgtacccatctccccaggtgtccacctctgttgttgagccatacaacagtgtcctgtccacccactccctccttgagcacaccgatgtctctatcctgcttgacaatgaggccatctatgacatctgccgcc

SEQ ID NO: 626 - DNA, 517 bp, Hordeum vulgare
  UNSURE (3): n stands for any base
ggnaccaatatgttcttacaacacaacaggttgtaaaacaaacaccacaaagcaaacattcaaacagacagataacagataaagccgcttgggcagatcataggatagcagtagtacgccttgggaaagcaccaggaggcaggctctagtactcatcaccctcgtcaccatcctcaccatcgtcgaactcagcaccaacttcttcatagtccttctccagggcagcaaggtcctcacgggcctcagagaactctccctcctccataccctcacccacataccagtggacaaaggcacgcttggcgtacatcaggtcaaacttgtggtcgatgcgggagaagacctcaacaacactggtggagttggagatcatgcacacagccctctggaccttggcaaggtcgccccctgggacgacaccaggtggctggtagttgataccgcacttgaagccagtggggcaccagtcaacaaactggatagtgcgcttggtcttgatggtggccacagcagcgtt

SEQ ID NO: 627 - DNA, 983 bp, Hordeum vulgare
ttgtcccccgggactgcaggaattcggcacgagggaactagtctcgagttttttttttttttttttaaaagacaaagcccaagcccaattgtccaaaatccatgggataagcaacaggggggagtcacctacttttacttaattccagaccctttgatcctcacccatgacaaattgttagggcatcgccctcaggattttgttccccccactggggaggtttgtgtcgagagttttacacttagtttcgacaaacatgtttgcggggagttggcctaagtttttgctcgctccacctcggtctggggggattgcatggggatggggatggggatccagggttgacaaaattgggggctttgccatccccccaaaaacaacgatttcaatgccttcacccccaaaaagataaggccttatcacatcctttgggttccccatgaagatttccccaatttaaagagggggggtggggacatacacacagaaaaggtccttttgaccaaaaaagttctggagagagactgatgaggtaatgaatccaaaggctttttccccaatacgaggatgcccaatgagaactgcctccttgaaggccgtgttgttttgatctggggaaataacaacactaatttgcttggccccattggaaatatggcccacaagggatggcccttaatgaccctttccccatgccaaggaacagagcctccaccccaagaggccttgaagacctcccccaaaaaattgaagtccccgaaggggtgtgagccacacccaaaaaggggatttcccaatggggctaaaatggaggagaagaaacccctcgtccgaaattttgaacaggagcttttgcggccctggtattccttaaagggggaaggtgcccttctccgggattttttcgcccatattacaccgcgggtggttttttttgggggggcaacaacacacgggggcccggttaatattataaacgctcc

SEQ ID NO: 628 - DNA, 510 bp, Hordeum vulgare
gcaacaggcgtgagtcacctacttctacttaattacagatcctttgatcctcacgcatgacagattgctagtgcatcgcgctcaggatcttgttcgccgcactggtgaggtatgtgtcgagagttttacacttagtatcgacgaacatgtatgcaggtagtttgcctcagcttctgctcgctccacctcggtctgtgtggattgcatgtggatgtggatgtggatccagggttgacaaaatctggggcattgacataccaccagaaacaacgatctcaatgccttcacgcacagaaagattaggccttatcacatcctttgagttcaccatgaagatatcaccaatataaagatggttggttgggacatacacacagtaaaggtcctcttgaccagaatagctctggagagagactgatgaggtaatgaatccaaatgcatattccccaatacgaggatgccgtatgatgactgcctccttgaatgcctgtttgttttgatctggtgata

SEQ ID NO: 629 - DNA, 518 bp, Hordeum vulgare
gctccctcatcaccggcgagctcccatgttccgctacgccgacggtctgccgctcgagaggttgttcgcagaaaaaccccacaaggactcatgcagggctgttcgatttgtggactcgggaactgtgattctgacggggtctgctgatatgtcgattgtcgcttctgatgtagaaacaggcaaagtcattgcccgtttggatgatgcacatggtgacgccataaaccgccttgtgtgtcttactgaaactacagttgcttcaggcgatgatgcgggttgcattaaggtgtgggatactcgacaacgatcttgctgcaacacttttcaccgccatgaagattatatatcagatatgacctatgtagctggctcagatcaaatattggccacaagtggtgatggaactttatctgttaacagtctccggggtaacagagtaaaatcgcaatctgaattttcagaagacgaactcctatctttggtgataatgaagaatggccaaaaagttgtttgtggaa

SEQ ID NO: 630 - DNA, 553 bp, Hordeum vulgare
tcccaagtagagtacaccgtttgattttatttttttttaaagtagagtacacgttactacggcatatccagttcactcaccgccacaccttaaacacacctcaccactaaaaactagagattcctccccacctcctacgacgacccaaaaatgcttcaacctaaacatcgaaacctcgcaaagtcaacccgacgcgaatttcaagggcggtgcgtctgcccgccctacaaatccgcaaagaagtccggcgcgaatccgttcagcttcttgcccttgcctttcttcttgctcctcgacccgttggaagagctcggctccatgtccacgtccatcccatcgtcgtcgctgtcggcctgagccgtcaactggtcgtcatcgacggcggcaacgttggcttcaggcaactcctcgtgttggacagcgttggcggcgttggcttcaggcagctcgtcgtcgtggtcaacggcgaccgcagtggcttccggcatgtcgttctgatgattcaactgcgggccgcccaggagttcttccatgtcccagagctttatcattt

SEQ ID NO: 631 - DNA, 402 bp, Hordeum vulgare
cttcataggcagcttaacacctacgtgagttccatttccattcactgatcgacagctttcatttccaaaatccagttcttgcatgaagtttcttcctgcttgggttttcggaagatcgacccggagcgatgggagttcgccaacgacgacttcatcagggggcacatgcacctcctgaagaacatccaccggcgcaagccggtgcacagccactcgctgcagaaccaggtgaacgggccgctggcggagtccgaaaggcgcgagtatgaagacgagatcagccggctcaagcacgagaacagcctgctcgtggcagagctccagaagcaggctcagcggcagtgcgggctaggctggcaaatgcagtcgctggaggacaggctgatgatgatggagcaacgg

SEQ ID NO: 632 - DNA, 463 bp, Hordeum vulgare
tatactcgcgactagctgtacagtgacgaagaactacatatacaaatgcatctagaacgaaaattcctatagagtatgtggacatgtaatacatgctaaactataatttacagacggaccatacatcagtggaaatggtaggccagccatcaggtcttctgagcagaagcgaggtgtcccatttgctgagtgatctgatcaacattgtcccggtgaccataccagttgcagtctatgccgatctttacatcgtcctttgattcatggctttcctggaaggcatagccgcactgcggcttgggcgtgtccacgaggaaccgctcccagaagagatcattcgccgccacggccggttcacggggaactccggtctcggcggtcgtctcgtcctgtgaagtgtctgtggtgctggcctcagagctcagatcggcttcggacatggtcttgtgcttgtcttgttgaa

SEQ ID NO: 633 - DNA, 431 bp, Hordeum vulgare
aattcgccgtttccgattttttaatgctgttccccatacaatggagcaagcccatggcgcgctgcctgctcctccgccgccacctcacggccgcttctgccgccgccgccgccgcagccacgccgccactccccgcgaggagcgtccaccgggtgctcgacaggagcgcgcacaccgaccgtatccaggagctcgcccggctcggccgcctgcgggaggcccgggaggtgttcgacgccatgccacaccgcagcatcttcgcctggaacaccatgatctccgcctactgcaacaatgggatgcccgaggacgcgaaagccctcgtggatgccatctccggagggaacgtgcgcacgagcaccatcctgctgtcggggtatgcccgcctcggccgcgtgctggatgcccgcagggtgtttgacggaatgctc

SEQ ID NO: 634 - DNA, 470 bp, Hordeum vulgare
cgacctgcaactcgagccatgtggccttttttttttttttttcacaaaaactttgcgtttcattgcattgatagaaaagaatcctatacaatactaagactaggccgttacactgaccacacatggtaagagaacaggaattaggcgacacaggaaatgtcacttttcatcaatagtgtcaacttgcctgcatatatttgatatacattgatagtttatctgtcatgcaacatcgcgctcttgcacgaccaatgaggtggtgttgaagtctttcagctgcacctatctagcttccctttgtttcttcttgttaagctaccatgcaaatgatcacaaggtttgctgtacaatagattgataattgacatgcagcgaaaagcaaatattttaagcactcaccagattccagtccaggcgtttctaggggggttaacagattgttgactatctcaatattgcatccaggaacc

SEQ ID NO: 635 - DNA, 545 bp, Hordeum vulgare
  UNSURE (61): n stands for any base
gtcccccggctgcagcaatcggcacgaggtccgccatctggctgctgtttgaggtcctggngtaccatctcctcaccctcctctgccacggcttcatcctcaccctgggcatcctcttcctctggtccaacgcctctgccttcgtcaacaagtgccctcccaacattccagaggtgaagatccctgaggacctggcggtcaatgttgcccgctcgctgcgctatgagatcaacaggggctttgctagcctgagggccattggccaaggccgcgacctgaagaaattcctgattgtggttgcaggcctgtggatcctctctgctcttggcagctcctgcaatttcctcaccttgttctacatagtcttcatggtactctacaccgtgcctgtcctgtacgagaagtatgaggacaagattgatgcttttggagagaaggccatggtcgaactgaagaagtactacgccatcttcgatgagaagtgcctgtccaagattcccaagggtccgtccaaggacaagaagcagcattagaacagtagagat

SEQ ID NO: 636 - DNA, 551 bp, Hordeum vulgare
gccacccaagagcaccttattgtacacagtctcctgaagtacaaacatcactgccatattacaccaacacaacttgcaagtgaggatattgagcaaaagctggcatgattactaagttcgtagaagttgcacgtcacactaatgaccgtgccaggattttgaccagatagtggtatctactatcacctacggacatggaatcacaagttcacaaccatccttgaaaaccgacgagtagtgatcaactttgaagataaatctgcgcagggtaatctctactgttctaatgctgcttcttgtccttggacggacccttgggaatcttggacaggcacttctcatcgaagatggcgtagtacttcttcagttcgaccatggccttctctccaaaagcatcaatcttgtcctcatacttctcgtacaggacaggcacggtgtagagtaccatgaagactatgtagaacaaggtgaggaaattgcaggagctgccaagagcagagaggatccacaggcctgcaaccacaatcaggaatttcttcaggtcgcggcct

SEQ ID NO: 637 - DNA, 514 bp, Hordeum vulgare
aaagctcgacagatggtctttcttgatggcgatgtagtagtaagaagggacataactggcctctggtcaatcgatatgaaggggaaggttaatggtgctgtagagacttgtggagagagcttccatcgctttggccgttacttgaatttctcaagtcctgttattgcaaagaattttgaccccgatgcatgtggctgggcttttggaatgaacgtgtttgatctggctgaatggaggcggcagaacataactgaactctaccacttttggcagaagcttaacgaggacggactgctatggaaacttggcactctccctccaggtctggttacattctggaacaagacattccccctcgatcgatcatggcatgttctcggtctaggttacaacccacatgtaagcagtagagacctggagcgtgccgcagtcatacattacaatggcaacctgaagccctggcttgagattggcctccccaagttccgaagctactggtcaaagtaccttgact

SEQ ID NO: 638 - DNA, 553 bp, Hordeum vulgare
  UNSURE (9),(10),(23): n stands for any base
gtgtgcagnnaattattattttncccctactggcatgtaatctcaacccctacaaatacccaacatgggataccgacacaaaaatcaagagagacaaatagatcaaacactgaactacctaggctagagtcagaatggcttggagtcggaggtactggtcttgcttcacggattgatgttgcattcccgcagaaaaggctgatcatagtcaaggtactttgaccagtagcttcggaacttggggaggccaatctcaagccagggcttcaggttgccattgtaatgtatgactgcggcacgctccaggtctctactgcttacatgtgggttgtaacctagaccgagaacatgccatgatcgatcgagggggaatgtcttgttccagaatgtaaccagacctggagggagagtgccaagtttccatagcagtccgtcctcgttaagcttctgccaaaagtggtagagttcagttatgttctgccgcctccattcagccagatcaaacacgttcattccaaaagcccagccacatgcatcggggtcaaaattcttt

SEQ ID NO: 639 - DNA, 518 bp, Hordeum vulgare
caacggcgccaccgtgctctccctcgacaccgacttcgacggctgtatgaggctcatcagggaggtgaccgccgagctgcccatttaccttgccaattcgctcaattccctcaggctcgagggccagaagacggcggccattgagatactgcagcagttcgattgggaggtccctgattgggtcatcgttccgggaggcaatcttggaaacatatatgctttctacaaaggattcgagatgtgccgtgttcttggcctggttgatcggctgccacggcttgtctgcgcgcaggccgccaatgccaacccgctgtaccactactacaagtcaggatggacccaattccagccacaggtggcccagccgacatttgcttccgcgattcagatcggcgacccggtgtcggtcgaccgtgcggtggtcgcactcaaggcaacaaatggcatcgtcgcagaggccacggaggaggagctcatgaatgcaatgtccctcgccgatcgcacaggcatgtttgcct

SEQ ID NO: 640 - DNA, 474 bp, Hordeum vulgare
tatccgtagaacacaacgcggtacaagagataatcaaccccaccccctaaccattcccagggacacgcctacaagagtctcactcacctacaagatttcaaatcaagggtttgaatgctccacacagcaaaccaatcacatttgaatcagatgcacaagacagtcgaatcgcagaagccaatcggaggggtcagcagcagcaggaggacgagggcatgctcaaagcttacccttgagcctcttcttgaggacgtccatgacggcgccgaagtcggccttcacgctgaccggagggttggcatacttgcaggccatgtcctcgatcttctgatcgtggtagtcgatcttggactgggagaacttgaggccgtgcgccgtgctgacgaccaccgtacggtcattcgccccgatggtgccctcttcccggagcttgaagagcgccgcgagcgcgaccccggtatgcgggcaggcaaa

SEQ ID NO: 641 - DNA, 518 bp, Hordeum vulgare
gtcgtttcctcctccattccgcctcaacatggctcttcaggtgtggatggtcggggagaacggcgaggacctcaacaaccacagggagctcctgcctctctccaagctccaagagattggcgtgttatattggcatttggacccaaagaagtccgaaagtgaacaagagctagcgaaaatccgcaaagacaggggatacagctacatggattatctggatatatgccctggaaagttggcaaactttgaggagaagctcaagaatttcttcacagagcacatgcatgccgacgaagagatccgctactgcttggaaggcggcgggtattttgatgtgcgcgacaaggatgacaagtgggttcggatctggataaaagaaggggatatgatcgtgctgccggctggaatttatcatcggttcaccctcgacgccgccaaccatgtgaagctcatgaggctcttcctcggagaaccagtgtggaccgcccacaaccggcctcaggaggaccatccggtgc

SEQ ID NO: 642 - DNA, 549 bp, Hordeum vulgare
gaaccactagatacttatggccctcgtagcacacacgggcaattacaagtgaataataacaagtaggtagcgtatctatttggtttaagattacaacatggtttcgttcaagtgtatgtatatgtccatgggcgtttataatacatagacgagggatcacaaaccaacttcaatgtgctgccaaagcatgaccagcattgtcgtccgtgagcctcttgacatactcttgccgcaccggatggtcctcctgaggccggttgtgggcggtccacactggttctccgaggaagagcctcatgagcttcacatggttggcggcgtcgagggtgaaccgatgataaattccagccggcagcacgatcatatccccttcttttatccagatccgaacccacttgtcatccttgtcgcgcacatcaaaatacccgccgccttccaagcagtagcggatctcttcgtcggcatgcatgtgctctgtgaagaaattcttgagcttctcctcaaagtttgccaactttccagggcatatatccagataatccatgtagc

SEQ ID NO: 643 - DNA, 519 bp, Hordeum vulgare
cccggttccacttccgtctacgcttcccgatcccatcccatcccctttgcgccctgtttcttttctcctcgtcgccggaacctcggagccgccccctcatccccaggagggccagggagcaatcctcccccgcgcggccactcgacgcggcggacgtcgctctccaaaccgccggcggcagcgcaccgtcgccgtcccggttccgcccgagctcgattcggtcccataacttggcccgctggttgagttggcctacaaagtccactgagaaagatgagagcagcagtagctcgctcgctacggcagcttcgccgtttggctcgtcaccacgcagatggccgcacaccagtaaacagattgaccaggcagcagaacgccctcatcttgcgtagttcggcatcccgctcactgtgcacagtgcgccataatgatgaacttggcagatttgtgagcccagctgtggagtcactgaggaacatgttctccactgccgcagctgattcgattaaagatgttcca

SEQ ID NO: 644 - DNA, 532 bp, Hordeum vulgare
tttgcagatttacatgcgaagtgcttacatcacggcacactgtgaaattacatgcaccactgacaggaaaaccacatttctcccattcctccctgagccgggcgggttaatatttataacaaaactataatgcggtcttagaacacgaaaccctgccactcatgctagtacgacatcgccaccgtcatctagagcgtgcaggggctgttgccattttgcttcgaagtcctccaagtactctctgctgttgagctctgtcaacctgctaatcgtacgatctttggcgaatcctagctcattgtccacacagagatcaggatcatcacttttccgcgagcgtgaagatctaggtgaactttttttgtgcttcagcgaccgtcacgacgttctcgaatagctctatcggctcggcctcggctgtgcataatagcctccccttgttctcatacattacatcaaccaacgtgacaaaccgatacgctgcagttctgttatgatatccaaacttagggacaccttcaactgcaagggt

SEQ ID NO: 645 - DNA, 553 bp, Hordeum vulgare
  UNSURE (20): n stands for any base
gtacccccgggcctgcaggnaattcggcacgagggatgccgcaaacacttctatgatatgtgctcgagtgtgtcagttcccttcaagtcagcgcgtgatctcagcctctggctatggagcacacataacaaagttaatgagaggttgatgaaagaagaaaaggatatgggaactggcgatccatcatttcctaaggctatctggcctccaaaggcactctgctcatcttgctatcgttcttcaagcaggacgagtgatggacccttgcaggttgactggaatgaggatgaagtgtttccattcttggttaactactatgggaagacgctcgtatcatcctataaagaaacctacatagagtctcttcaagggaagacgcaagtaggtgcggcactttctgacgatgcctcctcctcgcatgctgcaagagtcccaattggagctgccctgggtgttgccgttgccagctgtacatttggagcactagcttgcttctggagaacccagcagaagaacagaaagcaaagaaagaactggaactgaaaaacagccc

SEQ ID NO: 646 - DNA, 538 bp, Hordeum vulgare
caaggcgtaggattaaattgagttataatttgaaggatcaaatgggcagcaacagctcgcccgtatccaccgatcagatcacaactagtatatggtaaaaacagaactacattttgagcctacaacaaggtgcaagttacgtcatcatgcttctgtaagtttttcatctgtataaatgacagctccatcattgaattgtgtgcgctctctgtgaactacttaccaggatttttaacccatccaggaaatataaattcacggggggcacctctgatgaagtgctcggtgagcaaccggtgggctgtttttcagttccagttctttctttgctttctgttcttctgctgggttctccagaagcaagctagtgctccaaatgtacagctggcaacggcaacacccagggcagctccaattgggactcttgcagcatgcgaggaggaggcatcgtcagaaagtgccgcacctacttgcgtcttcccttgaagagactctatgtaggtttctttataggatgatacgagcgtcttcccatagt

SEQ ID NO: 647 - DNA, 518 bp, Hordeum vulgare
cgatttgctgcctcagacaattccaggttataaggcgccatttcgagttcttccaactggaatgcgtacaagccttaccaactcggagctgactaatttgcggaagttagcaaggaacctcccttgtcattttgctctagggagaaaccggaatcatcaaggcttggccgcggctattgttaagctttgggagaagagtttggtggtgaaaatagctgtcaaacgtggaatccagaacacaaataataagctaatgtcagacgaaataaagaacctaacagggggtaccctgctccttcgaaataaatattacattgtcatatatcgtggaaaggacttcctcccaacatctgttgctgccgccttggctgaaagagaggagttgacaaaagatatccagaatctagaggagcagagaagatccatttccattgaacactctccggaggatggttttgaagggcatgctctcgtaggaacccttgctgaatttcaggaggcgcaggcccgttggggaa

SEQ ID NO: 648 - DNA, 493 bp, Hordeum vulgare
aacgagctataccaagtgtttgtacagatcctacaaaggctaatcatgagagtcccaactgggaagcgatccatctatcagacttgcagcagcctattgatgtgagcactttcgctctggatgttgcttcacaccaaacatacacaggcttcagaccaggcctctcgacatagcgaccaagagaaggacatgaccgcacgaccagtggttgaagttgatcctcttgtgtactgctgaggctgctatgtgaagatgaaaccacgcaccataaactctatattgctctattgttggggaccatctagtccatactgtgaacagacaaaacagactgtctgaacatctaaaaaaaaatcactgccgtggcaaagcgtgcgattccacctagttgtcttcatcttccgagtctgattcatcctcttcctctttatcgtagtcctccataccctcatcatagcctgctgtatcgtcttcactttctgaatctgatcca

SEQ ID NO: 649 - DNA, 512 bp, Hordeum vulgare
ggctggactgcataaagtgcttcgatgcactatggttctgctataccccgctccaccagctgcagaactactaccgccacggggattttgacacctgcttcggcaagtggggcgatctcgttgactgtctctcgctcaagacgaagcggcgggctgagatagaggagatcctcatagcgcgggagaaggccaagccacacatctggaccttccggactgttgaagaggcgcaggcgaactggtggaagatgtacaagcacaaggtggtgatgtcgtcaccgccgccgaagactgcaggttctgctgtgcctcctcctggatccggtgttctttcctgataattggaagtcaggggagcctacagaagcgtcgattgcgcttttggtgcgctgtgcttagaccgttggtctttgctcaaacttgaatgtaccctggcagggtaaataattggaaccttggatggaatggtaccttaatcctgttctgtaaatcatggcaggcaactgaaaaaa

SEQ ID NO: 650 - DNA, 504 bp, Hordeum vulgare
gttgcctgcctgatttacagaacaggattaaggtacccattccatccaaggttccaattatttaccctgccagggtacattcaagtttgagcaaagaccaacggtctaagcacagcgcaccaaaagcgcaatcgacgcttctgtaggctcccctgacttccaattatcaggaaagaacaccggatccaggaggaggcacagcagaacctgcagtcttcggcggcggtgacgacatcaccaccttgtgcttgtacatcttccaccagttcgcctgcgcctcttcaacagtccggaaggtccagatgtgtggcttggccttctcccgcgctatgaggatctcctctatctcagcccgccgcttcgtcttgagcgagagacagtcaacgagatcgccccacttgccgaagcaggtgtcaaaatccccgtggcggtagtagttctgcagctggtggagcggggtatagcagaaccatagtgcatcgaagcactttatgcagtccagcc

SEQ ID NO: 651 - DNA, 522 bp, Hordeum vulgare
cggcagctaccaacccagcggttgctccttccctcctcaagcgcggtcctcccgtcgatctcgtcggagcggccggagatcgggccgcggagatgacggtgatcgacatcctcacgcgggtggacgccatctgccagaagtacgacaagtacgacgccgagaagctcaacggcgccaacgtcgccggcgaggaccccttcgcccgcctctacggctccgtcgacgccgagatctcccagtgcgtagagaaagcggaggcggcgaggcaggagaagaaccgggccgcggtcgtcgcgctcaacgccgagatccgccgcgccaaggccaagctcctcgaggaggacctgcccaagctgcagcgcctcgcgctcaagaaggtcaaagggctcacaaaagaggaacttgcgacccgtagtgatctggttgctgccttacctgatagaattcaatcaataccggatggtagttcttccgcgacaaagaaaaatggaggttggggagcctcaggatcccgttctggtg

SEQ ID NO: 652 - DNA, 516 bp, Hordeum vulgare
cgatcaggtcaggtcaacacacatataatcatcactgcttcatcaacaagcataataataatctaacaacaccatgatattacacagatgagacgaaaggaattactcgtggcacacgttgaaacccatcacaacaggacatgacaagcagaggagccaatgcaagacactaccgactgcgacatgagcacaccgttgcacctcactcacttcttgagcacattgtaaaggtaggcagcgataccaagtatgacacagagcaggacaatgtcgatgcagaagttgcgactggatctcatctgaagaatagtctgtttcagtctcacgttggtgttcttcagatctgcattggctcgatccaccttgtcatccatttcatccatcaagggaacttgcctatccaattcctcgttcatatccgatgccatgttcttcagagttgccagcccttcaccaataacatccaaaccttcatcctgcttcattctacgcatctcatattcctgacgaaacttg

SEQ ID NO: 653 - DNA, 524 bp, Hordeum vulgare
gcgcctggcaacggtgggtccccgagtgctgtcctggtggggttcggtggcgtcggcaagaccaccctcgcgacgaccgtatacaacagcccaaagttgggtggcatccaatgtcgcgctttcattccggtgtcccaaacatacgacgttcgttctcttctggagtccatgctgaaacagcttttagcttcggctaaaaaagataaaaatgatgatcccctcaagaacattaaagactgggatgaaagagatttatttgtcaagatcaaacaacatttggctgacaagaggtacttgatcattctggatgacgtttggcgagcagctgcatgggatcagctaaatgtagctattcctcgtaataataatcagggcagcataataattactacacgcagtcaggaggtagcggaaaattgctgcacctcttccaatatctataaaatgaatcggttagacaagggtgattcagagaagctattcttcaagacagtatttaatccagggcaatgcccgattgatct

SEQ ID NO: 654 - DNA, 540 bp, Hordeum vulgare
gaaacagtgcactataaaggcaaaacaaaatagatattcaagttcgatgcgcgccaggaaaacccactagttgaactaccactttgtaatagtacaacctatgggacgaaaaacctggcgcaacaatcgatcgttcaacctaagttcagaaaatacagagcatgtagttatacacatcacaagatataagcgtgaggacacgtagaaggcggcacacgccaagctggtgttgcctcgtcatcttcatcttcgcatcgtagtgcaggcatatccacctgctggtcggttggctcctgctcactgctccccgcccctgggccggtgttgtccacttgctgggcgggtccttgtggagcttccgtagtaggtcgatcctccctggtgactttcagatgatttggatattctttggccgcctcaaacacctggtcaaagatagactctacaatgacgccgaagaactcaacttctcttagatgatgcaggttttcttttccaatgccatgaatgcctctactgggcaccctcaggaaagccaat

SEQ ID NO: 655 - DNA, 527 bp, Hordeum vulgare
tgaggaattcggacgagggcctccgcccccgcttccgcccccaaacccctcggccgccgccggcgagatggcgctctacctgcacttcgagtcggcgtcggggtacgcgctcttccacgcctacggcatagacgaacttcggtcagagcgtggacgccgtccgctccaccgtgctggacctcaaccggttcaatcaaggccgtcaagctcgccgggttcacccccttcctgtccgccgtcgacgccctcaaccagtgcaacgccatctccgaagggatcatgaccgacgagctgaggaacttcctggagctcaacctgcccaaggtcaaggaggggaagaaggccaagttcagggtcggcgtcatggagcccaaggtcgggtcccacatcaccgaggccaccggaatcccttgcgagtccaacatctatatccaggagctgctccgtgccgtccggctgcacttcgaccagttcattgaacaactcaagccatctgacctggagaaggctcagttaggtctggggca

SEQ ID NO: 656 - DNA, 548 bp, Hordeum vulgare
ttctctgtctcttctcctgcggccgtgctggcaggcttataagatccatggcgtaccgtcagcctcagatttcgacttctttttcttacttttcttggcagacacatgtacaccattctccttctccttatcctcctctgagactgtgctggtcataccatcaattgcagctttcattacatcaaggttcttgcgtggtgcaacacccttgtcgtaaaagtctaatctctcctcgacttgttcacgcaatttctcaccgaaaatggagctactcatatctgagtaacagtcaatgcgcgaagcaattgagcatttgtttgccaggtatctagccattcttcccttgttcttggtcgatgcacgaccaataaaagatgagtggaatatgaggccatacttcggtgtgtttccacgtgttttaagagctctgaagagcgccttctcagcacctagtatttggagagtggaggcagggcattttgcaagatttgaaagactgccagcatgagagattaaccgagctccaaccatttcaccaatcaatgacg

SEQ ID NO: 657 - DNA, 365 bp, Hordeum vulgare
gctgctgctgctacgcttggccgtgctgcttcttgcgggtgcggcgtccagccacgcccagaagtacaacgcggtgttcaacttcggcgactcgatcacggacacgggcaacctgtgcacgagcgggaagccgacggcgatcaccttcacgcagcccccctacggcgagacctacttcggctcccccacctgccgctgctccgacggccgcgtcatcgtcgacttcctcagtaccaagtttggggtgccgttcctggcgccgtccaagtcgtccaacggcacggacttcaagcagggcgccaacatggccatcacgggggcgacggccatggacgcgcccttcttccgcggcctcggcctgtccg

SEQ ID NO: 658 - DNA, 365 bp, Hordeum vulgare
tttttttttttttttttggaacaaagcaacaccaatttattcgagagttgcctccggtttcttcttcttgggcaacgtatagattataatttcagcaccaccgtaccatatatatgacactgaaacaaatttccttttttcctttaggtaaactgaacctcaaatcaaacaataaataatactactgtactaccacagctccataatagataaataaatagaataaaagaatgtttaggtgtggaggatggccgggctgcagtagggcccgttgagccagccgtcggtgatgtgcttgtacgcggcctcggtgaggtggatgccgtcccagctgaggtggtcggccgggctggcgcacgccgccg

SEQ ID NO: 659 - DNA, 534 bp, Hordeum vulgare
ggcaattcggcacgaggcttaacctgctgttaaaggctgctcctgagtttatcatatcatcacagaacacagcttgttacaaaaagggcttgcagacatggatctgtttgtaattgattcagacagtgagtcatacagtgaaacgagtgacagtgaggaccaagaagaatgtgaatttacggaccatgcgcagagcatcttatcaagcttggacgagagcatcggcaagattgatgatttccttacttttgaaagagggtttcttcacggggacatagtctgccctgtgtctgacccctcaggtcagctgggtcgcgttgttggggttgaaatgtttgtggacttggagacatactctggtgatgtaattgaagatgtcaacagcaagcagctttcaagagtgagatcctttgtctctggtgactgcgtggttatgggaccatggattgggcgggtgatcagggcatttgacctggtcaccgttgtgttcagtgatggggcaaagtgtgaaatgctgttaagggactctgaggt

SEQ ID NO: 660 - DNA, 554 bp, Hordeum vulgare
  UNSURE (100): n stands for any base
gtttcacactgtgttattattattgcaggcacatcagatagctcctctgccaactatacagacagggtacttgctatctcaacaccacacacaaatttancatacttccgtcatactatacagaggagcaatttcacaaaccaaactacacaccagctgcttctgtctttcatctggcaccctttcagttcatcacatcaatcatgcacaagttttcccatcttacaagatgccattacacaacataaggatcatgtgccaggcagcatgcttattgcaaaacctatacaatagcagtgttgcagtgggcatgtcgtcgccgccaccgcgacacgggagacacgccctctctgaagtcactggacacaggcgatcccggcttcagagaaggtggtgaccagcttcggcagtagcttgccgagcatgatcttgaatccggtcgagcagctcttgcagccatcatctgatatgtacgtgctgtcgcaagcatgaccgatgagatcaccgccgaggtatgcattgcaggcttcgaggatgtgcggcgcgcggcaagt

SEQ ID NO: 661 - DNA, 274 bp, Hordeum vulgare
tcggtctacaccaacaagaggggagaggggaaggaaggaaggaaggaaggagatctcaattcccgctccccgccccaccaatggcgccgtcgccgccgctcctcctcctcctcctcttcctgctcctgatccgggcgtccgccgccgcgcccccttcctactccgcccactgcgccgccccgcccgccgtgccggacctccccacgggcgccggccactcctcccccgccccggccctcgcgctccagctctcctccggctacttctcgggcgg

SEQ ID NO: 662 - DNA, 397 bp, Hordeum vulgare
ctcgagccatgtggcctttttttttttttttttttggaactgcgaaccttgcctgatctttgtttccttctgccgtatacatgcatgtatgtataagttttcaccccaaacaggccgcaaatgtaaggtatatattcatccatcagggaacaggaaaaacaatatgcctcaatctatatgtaaacccctcctctacattcatttaatcatcttgcgacgaagctgtaggaacttgctaagggctgaccgtggaaaccatctcgtattcgctcgacggcttcctgctcttggagcagaggaagaaggcgcccccgagccactgctgaaagaacaggagcgtcgccagcaggatcgcaccacaaggtatgacgatgtcccatgcgaggctgaagaggtc

SEQ ID NO: 663 - DNA, 550 bp, Hordeum vulgare
gtcccccgggtctgcaggcgccggccctcgtacctctcctccccgtccccgtgctggcagcagggagatatgttgaaccggagatccaaatgcactagcagaaagctactgactactgttactggtgcaaagggtgatgaatctgaatttgatagcgtcaatgcaccacttgagccccaaacttgggaagggagcttcttgtgtggcttattgaagaaccagcctcaaatttttctagtagctgcagcaaggcaacttcagcaactgtctattcaaaggaaagacacactgacccgctgggaacatagtatcggttctcccgaggactgtcttcacaggagaattgctgaaatgaaggagcaggagtgcaggactgctattgaggacgtcatgtacatgttgattgttcataaatattccaagattgaggttccgatggttccgaatctatcaaaaatcatcaataatagaagattacatatatggccaccaagggaggcagatcttgaatccattcatggatctgaggtgctatgtcaaattagggagc

SEQ ID NO: 664 - DNA, 546 bp, Hordeum vulgare
tattaaaaggctcatattttagcacctgcaggtaagatttacatgcgcagaaaagaagaaggtaatttcctaaaatatatacaaggtctcaggaatcttctgcaaactcttcttccagcgagctccgtatctacactgctcaggtatcttctggagatcaattttcagctgtcctgcaacttgtatatctcatcaacatagtcttcggtatcccaaaggaaggaaccgaatgcaatggcttcaagcagcagcctttttagggatgccggatcaagtatcaccgcctcgtcaatctccgtggagcccatcttttctccaaagagtgcccagctgtgcttctcgatgagattacaagcctcgttagtccgcagcttcgcgcataactccaaggtctttgggtcgaagcccatcatgtaactcttcaggtcatgaggatcaacaacagaacttggtttcgaagaagaaaccgtttccacggaaccgccaaaggcctcttgatgttcctttttacgggtagttgcaagttgagcattgagaagctgaatc

SEQ ID NO: 665 - DNA, 552 bp, Hordeum vulgare
gtacccccgggcctgcaggcaattcggcacgaggcccgtcccccgtccgtccgtccgtcccctacacatctcgttccccaacctcccgataaggcggacagcgaccgagagaagctccctcctcgcctcgcctcgcctcgcatcctcctccctcccctgtctcccaccagctgatccgcgcgcggggtcgggagaggagcggcgcccgcgagagccggccctatctccttcttacctatctatctacgccggcatggactcggagcactggatctcgcgcctggccgccgccaagcggttctacgcggcgcagctcggccacgccgatcgggcggggatggacgagctggacatggacggcgacgagaacgccggcaggcccgacttggcctgcccctactgctacgaggaccacgacgtcgcctccctcatcgcccacctcgaggaggagcaccccttcgagccccacgccgcgccttgccctatctgctctgaaaaggtttctaaagatatgcttaaccatatcaccatgcaacatgggtacttgttcaa

SEQ ID NO: 666 - DNA, 548 bp, Hordeum vulgare
gtactgctacccttctgctgttgcatagcaacacaacattattatgtaactggtacgacaaaaccaatgcttgtaaacaaagaagcagcggtatggtacggtacacacaccaccgcgacctgcgcagatatctatctcgcctgcgagaccgcgataactgagatggaactcaacacaaagaccggctacaaataacttaggacacctcatgcccacatcaactctgatctgatgcacctccttccttgctggggtgcccaaaccctatcttccatggatatcacatttggggacttggtctgggggcaccgacctttcggagtctgcaccagggcagcggtaacatcggcttgcctctgagttattggtctctgaagagggtggacagcagcaggtcttgcacgaatgccgctctcacgctggcttgctccctttcttcccttgtgagggacgagtcaatacttgaccgccacggccgagcaggtgcgtcttttagcactggtacatcactctgagcaggagtagacaattttgatgtttcctcagca

SEQ ID NO: 667 - DNA, 518 bp, Hordeum vulgare
gttttctaacggggtgtttgggctgtaccagatgcccgactttgtgtgccactgccagctctcaatatcaagggagaagatcaccacagctattttcaacagcttggggaattggttagtttttgggtgcgccaaacttggccaactgctggtgtgggagtggcggtcagagagctacattttgaagcagcagggtcactacttcgatgtcaactgcattgcatactcaccagattctcagttaattgctactggagctgatgataacaaagtcaaggtctggacggctgcctctgggttctgtttcataacattttccgagcatacaaatgctgttactgcagttcattttatggccaataaccattctcttctcagtgcctcccttgatgggactattcgagcatgggatctgttccgttatcgtaacttcaagacatttacgaccccttcacctagacaattcgtttctttaacggcagatcagagcggggaagtaatttgtgctggaacacttg

SEQ ID NO: 668 - DNA, 552 bp, Hordeum vulgare
gtcgtttgaatgcatttcttaataacaaaatttggtccacggacggacgggtacaaacacacaacctcaagagagtagctataacccacttcgtggtccaagaggcaatccttccttcctcgccagacaaaaatgccaaccgtcctcagctcaacttcagccctcaacatcaaacatactgcttaaccagcatacagccactgcccatgtggataacgatcgcaagagtgcacattcggccggccaaacactggttggcattaaaaaatgatactcagctgctcatgtgctcagtcatcaccttggtgttataacaaccagaaacaagtgccgaccatggcctaactctttgtcccagcagagctcagatatttgagcatgtactcgttggaggaacaagtgtccgccagatcctggtgtagttttgttatagacttctgcaacgacttgagagcaggaagcaaagtcctcgaattttgctggatgtagcttccatcaaccttgcatagctcctgagaccacagaaggatgaattccagatggggacagctt

SEQ ID NO: 669 - DNA, 517 bp, Hordeum vulgare
ggcctcgtgccgctccttatctctttcacccccagaaaccttcagcagcaagaatggcagcgccgggctccctagcacttctccaggcgccgtccttcgccgcggccaagtgccggccggtggccatgagccggggagcggcacgggccgtgttcgccgtccgtgcctcggcggcttctgccgccaccaaggacgccgtcctcaggcccttccgtgagaaccgtgctctcaagatcatttcggggctccagaatttcgacaggtccaatgttgcatctgtcgtcacggccgcagataagggaggcgctacccatgttgatatagcatgtgaccaggacttggtaaagctcgcgctggagctgactaaccttccgatctgtgtgtcatctgtcgatccttcagcattccaatctgcggtagaagctggtgcgcaaatgattgagattggaaactacgattccttttatgacgcaggcatcgaattctcttctgagcaaatactgaacctgacaaggga

SEQ ID NO: 670 - DNA, 519 bp, Hordeum vulgare
tcgttccaattctatagatataagaaaaataaagaacgaggaaggcgtaaaccgatctagttatcttagctctttcagggaatcttctctagacctgcacaaaaggctagcagacaggaggaatactaaactgctggaactacatctcctgattccttgctgacttctcgagtttgtccagagaaaagcagtggcgacctagtagtactaattgtgaattgttctcaggtcctcagacacattccttgaggccgtcgtccccagagcctccgcgatgctcctcacctcggcgatcatcgccacgacatcgttgagcttgttaatcgcagagccaactcccacaccagcggctcctgcagttactgccattggtgcagtcactgaacttagccccgatgcgcacatcaccggtatgctgacggccctggagatggagtatgcggctgccaaagttggtgttgccttttcgattagtccaagcaccccaggctttgttggactagaagacttcccaccttc

SEQ ID NO: 671 - DNA, 550 bp, Hordeum vulgare
gtccccccgggcctgcagggaattcggcacgaggatttcatattagaggatgatttagcaccagattttgaggtgccttttctctccatggatctacatgcattggccgctaagctctcaaagattaagccctcccagagactttttatggaggaagatctactacccgaggatctggctgaagacggcgatgatgaaatactgattcaacatggcacaacattggaggctgatgccaaaggcagtttggttcaacataacatcaaggacataaagcctgggaaagatgctgttagtcctcgccatgccagcaacattcattctgatgaccaaatgaaaacacatcatcagtcggaatgttttgcagaagaagctacaacatcattcaaagttattcctccacctgtgcattcagacactgaagcctacacaggaatcacaggtactgttcccaatgcaggccacagagaacagtccaagcttgggatggttgttccagaggaagagcttgacatgcttcttaattcacttgatggaactcacctttcca

SEQ ID NO: 672 - DNA, 511 bp, Hordeum vulgare
gtgcaacgtactgcaaagatgtgactaagtacaggtcacgaaggtacagatcgacatctatctatagatttaacagcagtcagccttctggaccaccgatcagtatgacaatcgcgcaacataacacaggcctagcaccgaactgacacaagccggcgagtgaagcgcatggatatccatttccccatctcgatggacctccacaccaacgggtatatgggagcttctgaagacagctttccaaaaaggtttgctaattagtctcatgagctgaacaaaagcacagtaggcctgaagccaaccggcacctcttcaccgtcgacagtgtttcttctacttctacagcgagtcaaaccacgaatcaaagtcagctgatacatttgaagaaccagaaggtggaggcacgtttgcttttgagatgttctgttgcccttgcacaggtgtggtttgtttctggtcactcaagcagaaaggagtgtaggcaagcaaatcatccactgaatcatcgata

SEQ ID NO: 673 - DNA, 272 bp, Hordeum vulgare
cccacgccgcgccttgccctatctgttccgaaaaggtttctaaagatatgcttaatcatatcaccatgcaacatgggtacttgttcaagaatcgccgcaggttgcgcagatttgctgttccaggcagccagtcgctctctctgctgagccgggatctacgtgaagcccatttgcaggtgcttctgggaggtggtgggcataggtcgagcaacaataatgcggcaaatatttcagctgatccccttctgtcatcatttggccttagcttccca

SEQ ID NO: 674 - DNA, 559 bp, Hordeum vulgare
  UNSURE (42),(43): n stands for any base
tgatacccttctgctgttgcatagcaacacaacagttattanntgtaactggtacaacaaaaacaatgcttgtaagcaaagaagcagcggtatggtacggtacagacaccaccgcgacctgcgcagatatctatctcgcctgcgagaccgcgtgcgataactgagatggaactcaacacaaagaccggctacaaataacttaggacacctcatgcccacatcaactctgatctgatgcacctccttccttgctggggtgcccaaaccctatcttccatggatatcacatttggggacttggtctgggggcaccaacctttcggagtctgcaccagggcagcggtaacatcggcttgcctctgagttattggtctctgaatagggtggagagcagcaggtcttgcacgaatgccgctctcacgctggcttgctccctttcttcccttgtgagggacaagtcaatacttgaccgccacggccgagcagctgcctcttttagcactggtacatcactctgagcaggagtagacaattttgatgtttcctcagcatctaatgt

SEQ ID NO: 675 - DNA, 353 bp, Hordeum vulgare
cttcacctcgtctcgtctgacgctggctcacgccttccatgcgttactgagggagcgggagcgcatgcatcgcgtgagtaaccaggggatggggatgccccggagatccgcctccctcttcgccctcgccttcttccccctgctgctctccacttccctggcagggagacagcggagcttcattgtagatcaggagtctcttggccggcaaggagaggtccaggacgacgctatggcgcagcagctggtgcactcccggatgctcaaggacgtcacgaccagtgactacggcacctacgacccaaccccgtccatggagaagccccacttcaagctcatacccaactgatcca

SEQ ID NO: 676 - DNA, 549 bp, Hordeum vulgare
ttgcaaatatgtctatatatacttagtatagtgtataaatatgtcaagcaactaagttctttgtcacgtacgtactcacctcacgtctagaacaacttacaaatatcagttatcacattagccagactagtttaaaatacctcgatcaatatatccacatatacattcagatggacgtagatatatagatggatcatatcatatcatatcacgcagctagggtgttggatcagttgggtatgagcttgaagtggggcttctccatggacggggttgggtcgtaggtgccgtagtcactggtcgtgacgtccttgagcatccgggagtgcaccagctgctgcgccatagcgtcgtcctggacctctccttgccgaccaagagactcctgatctacaatgaagctccgctgtctccctgccagggaagtggagagcagcagggggaagaaggcgagggcgaagagggaggcggatctccggggcatccccatcccctggttactcacgcgatgcatgcgctcccgctccctcagtaacgcatggaaggcgt

SEQ ID NO: 677 - DNA, 427 bp, Hordeum vulgare
acacacacagacagaacagacagacagggacggggaagctcgtggattaggccaatgggcgcgctccagctgatgccgctgctcctggccttgctcgccgccgcggcgagggcggtcaccgcggcgggggccgggccgcgtccgagcgaggtcgccgtgggcgcgctcttcacctacgactccgtcattggccgcgcggcgcggctcgccatcgagctcgccgtcgacgacgtcaacgcggaccgcacggtgctcgccggcacccggctcagcctcatcgcgcaggacaccaactgcagcggcttcgtcgggaccatcgaagcattggagctaatggagaaaaatgtagttgctgttattggcccacagtcatctggtataggccatgtcatctcccatgttgttaacgagctacatgttcctcttc

SEQ ID NO: 678 - DNA, 405 bp, Hordeum vulgare
tttttttttttttttttgttagagatgcaactgaaataaaccactttcacagcttgagaaacaagccagctgggaagagaattgtttagtagtacaaactgtgtacattggagacaagattctaatgacttgatgaaagaaaaaagattcttagatcatgctacaacaacaagttagatcactttcaaagcctttagcaagttagatcaccatactattctttttgggcaagaactcaattcaacatattaccggtatcgtgcttccttccctgttttgccagctgaaggactgaagtcagagagaacgttctctgctcaagccactggctgagcatccgaggattcagcaggctgcttatctttctcactcggtctccgcttcatcgttctcctgacttctgcc

SEQ ID NO: 679 - DNA, 551 bp, Hordeum vulgare
ccgggctgaggaattcggacgagggagagagttgcgttccggctgtttgtttgtttatggtcggcatcttcatcgggttcacgcccttcttctctgtcgatgtatctcagaagatagtctcgaggctcccgttcgacgatggggtggatgataaggttaaggagttggatgcgatcgtagtgcagaaagaggttgaggtgattgacgagcccgaggttgaaccacagagccctccggttcctgcaatgttggatgatgaggtggatttcgtcgaagctgcaaaacctgctattactgatttggtcatccccgtgaggaagcttctgatagtggtgacaatcacttctgctcggccacaacaggcgtattacttgaatcgtctagcgcatgttctgaaaggtgtaccacctcctctcttatggttagtggtggaatggcctgttactacctttgaaacagcggaaatcctcaggtcttctggggttatgtacaggcatattgtctgcaggaaaaatcttaccagtgtacggaagattgctgtctgtcaaagg

SEQ ID NO: 680 - DNA, 510 bp, Hordeum vulgare
atcttattgctgggttaacagctacaaatctgtggtattgcattcactgtcaacagctgcaatggctgcaggtttttacatctgtaaacgtatcataaacacagaaaatgccgtgggaaaaaaaatctacatgggcagtatgcaccggcgaatacggaggggaaacgaagggcacaaaaagaatacagagagcacgcaaaaagaagaagatgaaagtttggtcaggtagttctgcttggcactgctactagtatgattgacgctacgactttgcgggtcccgtcgcgcaggctgtttcggagggcaatcggttagcagcgctgcggccactagtggtggacagcacaaagtcgaaactcagaacctctatgccaccgcaaaggtttatcatgcttgagacggtgcagaaacggttgcggagacttcctaggttacagttctttgtcgacttcaaggtggttccacaatgaccatccggtggggtagttgagctggggaggttccagggcg

SEQ ID NO: 681 - DNA, 518 bp, Hordeum vulgare
cgtcccccgtctgtccgtccgtccgtccgtccgtcccctacacatctcgttccccaaccagcgataaggcggacagcgaccgagagaagctccctcctcgcctcgcctcgcatcctcctccctcccctgtctcccaccagctgatccgcgcgcggggtcgggagaggagcggcgcgtgcgagagccggccctatattctacctacccatctatctatctacgccggcatggactcggagcactggatctcgcgcctggccgccgccaagcggttctacgcagcgcagctcggccacgccgatcgggcggggatggacgagctggacatggacggcgacgagaacgccggcaggcccgacttggcctgcccctactgctacgaggaccacgacgtcgcctccctgatcgcccacctcgaggaggagcaccccttcgagccccacgccgcgccttgccctatctgttccgaaaaggtttctaaagatatgcttaatcatatcaccatgcaacatgggtac

SEQ ID NO: 682 - DNA, 905 bp, Hordeum vulgare
  UNSURE (779),(895): n stands for any base
tagcaacacaacatttattatgtaactggtacaacaaaaacaatgcttgtaagcaaagaagcagcggtatggtacggtacagacaccaccgcgacctgcgcagatatctatctcgcctgcgagaccgcgtgcgataactgagatggaactcaacacaaagaccggctacaaataacttaggacacctcatgcccacatcaactctgatctgatgcacctccttccttgctggggtgcccaaaccctatcttccatggatatcacatttggggacttggtctgggggcaccaacctttcggagtctgcaccagggcagcggtaacatcggcttgcctctgagttattggtctctgaatagggtggagagcagcaggtcttgcacgaatgccgctctcacgctggcttgctccctttcttcccttgtgagggacaagtcaatacttgaccgccacggccgagcagctgcctcttttagcactggtacatcactctgagcaggagtagacaattttgatgtttcctcagcatctaatgttgggaagctaaggccaaatgatgacagaaggggatcagctgaaatatttgccgcattattgttgctcgacctatgcccaccacctcccagaagcacctgcaaatgggcttcacgtagatcccggctcagcagagagagcgactggctgcctggaacagcaaatctgcgcaacctgcggcgattcttgaacaagtacccatgttgcatggtgatatgaataagcatatctttagaaaccttttncgaacagatagggcaaggggcgcgcgtggggctcgaaaagggtgctcctctcgaggtgggcgatcagggaggcgaacgtcgtggttctcgtagcagtaggggcaggccaagtcggnccctgccgcg

SEQ ID NO: 683 - DNA, 517 bp, Hordeum vulgare
cggccacagactgtagttgaggtaccccctataactagtcaggcaccggagttctacatccaagctcagcaccattggcaacatcaaacagtccaggatgttcactcgcaggcaaggcaacaacaaccacagccccaggtggcacaacagcagcagtaccacaacatgcaacaagttccagctcagatggttcaactgcaaacatcttctccgcaggcccaaagtgcgcctcatgtcgccctgttctatcctccttacggatcccaacagcccgcatgtggtaacaccgagacactttctagaggcatggttgtgcagcctgcctattctacgatctcttcttcccagcgaaagcatcatgaagctgctcctgtttacgtgcaaagcagcgccattgctgttcctatggcagaacatcacatccagcaccagcagacccagcagtttcattcgcccggcaatggctcatttgcacctcaacaatgcaaggttggaccctattcagtccagggcggtg

SEQ ID NO: 684 - DNA, 555 bp, Hordeum vulgare
cacaaatttcttcatatttccatatcgattgcaaacatgcaaatgcaagtccacaacaggttacaagcaagcatacgcgtccactaaaaatgggacaaatgccgacaacatcatcaccactcaactaacctatcattcttatttcatcgcgatcatccagctgaaaaaagtaagctgaaggatacggagtaacaatctgccggctgataaaagatgccagagcaaataccgtagggatgctcaaaatcgagcttcccatcacaataagatggtcacagtatatcgcacgagaaaagtcgcaggagcagatgtagtgcttcacatgcgacttctccatcgtcaattagccagaccatgccgcgttgccaacagagctcagcccgtcatggaaggtgttgtactctacgggctggcctgtggccaccattcggcgcggcatgttctcggcatgatcattcaagtaacccattcgaacagccttgtcagccatgtctgcagggtgattctgcacgggctggggtcctaagtgatggagcatcatcggagcactggcct

SEQ ID NO: 685 - DNA, 895 bp, Hordeum vulgare
  UNSURE (702),(800),(815): n stands for any base
cgttccccgggctgcaggcattctgcacgaggagtcaatgacagaccaagagttctaaagggccagagggactcatatgatgagatggaagtgttggactatttatgaaacctcgaaatttatgtatataatagccagcattttactggaaaagatactatacaagacagttttgggtggacacctggttgacaaaattcttcaggacatatatacatccaaaaataccacggctttccgtaatggttagtacatttcctgttgacaaaactgcatacccctttgagcttgtgcgattcaatcatctaacttcaaaaacttgaaattacttctcactatatgcccctactgaaagataaggtctcgaaaagtagccaatttgaattcgatgattgaatccaccatgtaaaacccgagtgtgtaagttacaattagcaagaacaactccagaatacatcttaaagaaaatgcagaaaacggagtggtatttaaagtttgatgtactcagtggacaacaaatatttgaatatcttctttttcagtgctttccaagactgttcactcagtattacatcgcaaagtatcagtttgctcatgagccaaggaacatcatagtacatcatgagcagcaacactgttatcgtattcaagtcttcatcagaaagtgaaggacgggtgggcactcatccataggaacaggangtaaagttgtgtgggccatacgcatggaggggggcacaatatgggcatttcacttcttgtactttgccaacaactcaactggccttcacctggaaagntaccgtctatgatgntgagagatctcatgatgttgatgatgttaaagatttaagatgtcaaatgagtgctgctacagtggtactggtatatgtat

SEQ ID NO: 686 - DNA, 542 bp, Hordeum vulgare
tacgaattttaatttgaactagatcacagcgtcattcatattaatcaaacctacccaaacataacaaatgttcagccaccattgcataattaatggatatcacaatagcaccgtagcatacatataccagtaccactgtagcagcactcatttgacatcttaaatctttaacatcatcaacatcatgagatctctcaacatcatagacggtaactttccaggtgaaggccagttgagttgttggcaaagtacaagaagtgaaatgcccatattgtgcccccctccatgcgtatggcccacacaactttactcctgttcctatggatgagtgcccacccgtccttcactttctgatgaagacttgaatacgataacagtgttgctgctcatgatgtactatgatgttccttggctcatgagcaaactgatactttgcgatgtaatactgagtgaacagtcttggaaagcactgaaaaagaagatattcaaatatttgttgtccactgagtacatcaaactttaaataccactccgttttctgc

SEQ ID NO: 687 - DNA, 518 bp, Hordeum vulgare
aactactgtagccggcgttgagccgccgtctgtgattatcgatcaaattcctctggtcatggtggctatggtgtcgaggcagagaggagatgagaagaggaaaacggaaggggttcgctccagccggtgcggtaggcgcgactctttactttcgataatttgaacatagcacactgtcaaagctatctctcgcagatgcggtacaatgttagccgagcttgcagccatgtgtgcaggatcaggcccggcgaagcgttttccggcctgaagtgtgctcttagttcagtccatggcctaatctgtgtagattttgagtttatggagtaaactgtgctttcaatttgagttaatggaccaacgatgcatttcactctaatcatagtttagacgggtagtcgaataggtattttaaaggcatcgtgctaatacaaacacctgttgcttgggcaggctgagaagaggaagcgcaaagcacagtattctgttgctgtgaagaggaaggaggcggaacggacaga

SEQ ID NO: 688 - DNA, 549 bp, Hordeum vulgare
atgaatatctaggttgcgtttggtcagccagccaagttcacccaccccaatggttgtgcaactgttacacagaacaaattcaggctataaggggaggaaaaaaaacagggacaaaaggcagcagcagaaacaagttagacgcctgccttgccgtttgtttccagagagaggagctcctcaagccattgcagctctcttttctgcctccatctgttttagctctgccagcctttccacccatgcgcggtctcttgccacagcagccatcttcctttctgtccgttccgcctccttcctcttcacagcaacagaatactgtgctttgcgcttcctcttctcagcctgcccaagcaacaggtgtttgtattagcacgatgcctttaaaatacctattcgactacccgtctaaactatgattagagtgaaatgcatcgttggtccattaactcaaattgaaagcacagtttactccataaactcaaaatctacacagattaggccatggactgaactaagagcacacttcaggccggaaaacgcttcgccggg

SEQ ID NO: 689 - DNA, 389 bp, Hordeum vulgare
aggccgccgctgccgccgccgcggtttctgtttcagattactccggtgatctcggtgacaacaacaacagcaactactcgaggcggtcaccgtcccgctcagtttcatcgcactctggtggtagcaacaagcgccgccgccgcagcgaaagcggcagtggtggtgatggtggtgtcggtgagctggcgagggcgatcgaggcttttgcagagatgtatgagcgcatcgagagtgccaagcagaagcagtccctggagatggagcgagagcggatcgacttcatgaagcagctggaggtgaagcgcatggagaatttcgttgatgcacatgtgaagctcgcaagaatgaagcatgccaataagaatggagggtctgcatccaatggtacc

SEQ ID NO: 690 - DNA, 501 bp, Hordeum vulgare
tcactctcaagggtaccaatctcctaaacataaaggaacagcatcctcatgccacatataggttaacgttagcacatcaccactggtattacaaactttgcagtagccacagataaagtaaaccaacaataacctaaagcaatgttcatctaaactgaaatgaccaatcaactttacctagagccttcctcaacatcaaaggaatgcagggttggaaaggaaaggcagcgcagccatggaggaagccaactccactccgacggtaccattggatgcagaccctccattcttattggcatgcttcattcttgcgagcttcacatgtgcatcaacgaaattctccatgcgcttcacctccagctgcttcatgaagtcgatccgctctcgctccatctccagggactgcttctgcttggcactctcgatgcgctcatacatctctgcaaaagcctcgatcgccctcgccagctcaccgacaccaccatcaccaccactgccgct

SEQ ID NO: 691 - DNA, 552 bp, Hordeum vulgare
gtccccccgggcctgcagggaattcggcacgagggttttccctggagcggtgcaggacgctccctcagcacgcgtacggttgtccatgccgaagggtatcccatcatggatgcagcaaaggatgcaaacccgtcatgtaaactccacacaagactgagactctgggagtttgcagaccgatatatatttgaaccaactgatggtcttgctgacttatatttgtcagttagtcgggccagtggatcaatgagtttagttgaagaattgccaccacgtagcccgtccacaaatcctaaagttcaaacagtttatggtgtgataggagtgctcaaacttgcagttggatcgtatttttttgtgatcactgaccgtgattgcgtggggtcatacttggggcatgcaatttttaaagtgacagggctaaaagtccttcgctgcaatggctcgcttaacacttcttctgagcagaaaaaaatggaatctgaaatttccggactcctggatgctgcagagaagaccatgggcctctacttctcccatgatatcaactta

SEQ ID NO: 692 - DNA, 553 bp, Hordeum vulgare
  UNSURE (19): n stands for any base
ggcgtggaactgatacttnctttgctaactagcaacagctgtttgtttactgggccacaatcgatttgttagcgtggacttaagtaacaaagaataagtatataatatacaacacaatcttcatgagaaaaaggatggacaccaattacatcttctttacatagaaaaaaaagtggagtgctgccattgtttgatgaatgtggatgaatgataatctatcactcgcctgcttccatcaagggcgtgacttgtgggcacggggccggtttgtgaacacccgaccgttgcttctcacaaagtgtgtgatgccaatgcaaagaccagcccagagaagtgacagcagtaaatgacgagcatcgtgccgagcgtgcatcagtgacatcatcatgaatataaaagctccggaaaccaatgcaaaagcaaggcgggcggacgcatagctctctacaaatcctgcttttgctggaggtgccatgtctcgactaacagatgtgatgtaacgtccttgaagaagatccatggcatcctgcttcgtcccgtctacgaagttgtt

SEQ ID NO: 693 - DNA, 255 bp, Hordeum vulgare
gtcctcgtctcgccccgcaccgacttccccgaccttcttttcgccgcggggggacagaggccgctgagggcccgcgccgccgggaagatgcaggtcagggagctggacctcgttcgtggaaaagcccacaccgggaagaagggctggatggggcgcttcgacggcgtcttttttttggacgaggccaggcagatagttggctcggctgttgggggcaaggccgaggataggccggaactggaggagggtgagatc

SEQ ID NO: 694 - DNA, 546 bp, Hordeum vulgare
  UNSURE (72): n stands for any base
gaaggcaatgaatttttaccaaaaatcatcacacatatgtattagtacttagttgtggctggctatgtacangtcctacagtacattagcaaaaagattcactagccgctactcaacaatctccatgacacacagcttgtcaggagagcaagaatccaaaacgcttgtaacatcggtgctcaaccggtgagagttcggcgcctccggctggacggtgacccactggccgtcgacatgctccatgtgttcatgctgctcagggtgggcagagaatctggccttggcgacgtctcggcacatcttgttcaagtggtcgatggaaaggatcaaatcgaaaccatcttccgtcttgtagctggtcttgcggatcttgatgccgacatccacgctgcgggaacttgcagcaccgaagagcagaggatgccctaggactagttcgtcggagaggctgcatatctgtacatactctatgcccattgcatttaacgattccaaaattttatttgatgataatgagctgaaaatcgccccagttccagctggcct

SEQ ID NO: 695 - DNA, 373 bp, Hordeum vulgare
catcagcaacaaagggcggccatccgtttccaggagttaaaccaaaagaagttccgcatgcccctcattctaggaattggcctgcttgtactgcaacagctgagtggaatcaatgctatactgttctatgcaagtagcatcttcaaagctgcaggtattacaaacagtgacttggccacatgtggacttggaggtattcaggttcttgccactctagttacaacctggttactggacagagctggccgacggattctactcattatctcttctgccgggatgaccctgagccttcttgcggttgccgtcgtattttttatcaaggacactgtttcacaagattctcacatgtattacatattgagcatggtct

SEQ ID NO: 696 - DNA, 570 bp, Hordeum vulgare
  UNSURE (16),(32),(34),(40),(41),(52),(53): n stands for any base
catggccccccccttnttgcaaaaggcacacntncaaagnntctgaaacaanntgttgtacaaagaatataccacaactttgtatgcacagaaaaaaatgcccagccttcatcagaggaagaatcctcatggacttgtacaaaagaaaaacaatgcccaactcgcagagcgaagccatgcggtaaaaaattgctacggggctcagcggaacgaccattgtatctcctcgagcgttcttcccttggtttccggcacccagaggacgacgaacacgagcgtgaaggcgctcacgagcatgtacgacacaaatgtacctccagcactccagctgagcagcaagtttgccgtcatcgtaatcccgaaggaagtcagccagttggcgagcgtcgcgaagcttcccgcgagactcttgatgctcacggggaggatctctgacattatgacccatggaatggcacccattccgaaggagaaggcgattacataggccacaatagcaagcaaggagaccatgctcaatatgtaatacatgtgagaatcttgtgaaacagtgtccttgataaaaaatac

SEQ ID NO: 697 - DNA, 517 bp, Hordeum vulgare
ctacgaccgcgtcaaccccagacggcccgccgcctcgagcgcttcaagaaccgccagttcttcaagatcaccaccaccgacgaccccatcatccgccgcctcgccgaggaggacaaggccaccgtcttcgccaccgacgccatcctcgccgccctcatgtgcacgccccgcagcatcctctcctgggacattgtcgtgcagcgggtcggcaacaagctcttcttcgacaagcgcgagggctctcagctcgatctgctcactgtcaacgagactgcgcaggagcagctccctgagaacaaggatgacatcaactcggcgccggctcttgctgttgaggccacctacatcaaccagaacttctcgcagcaggtgctggtacgtgatggcgagaaggttacctttgatgagcctaacccgtttgcctctgagaatgaggaggcggcgcctgtttgctaccgttatcgccgctggaagctggatgatgatattagcatcattgctcgctgtgaagtgcatg

SEQ ID NO: 698 - DNA, 534 bp, Hordeum vulgare
tagaattaatattcaactaccagcatagtcattaatcaaagcagtgcgtgctaagcttagcacatccaagcacaaaatttaagagtaacaagttttctcatggaccaaaataagaccactgtatcaagacaaggcagatcaactctttaatccacaaaaacagatcataaaacagaaaagacacattatctagataaaagcaagatgacccattatacccttcaagcagcggcagcatctgcagtcttctcaccgtcaccaccctgggtagttgctttattagcctctgcctcagcagcagcatccatctcctgtgcagtagcatcgacatcatctgtagccgggcgaacctgctcctcctctggaagtggctcttcaacataatcgttctcaaacgcatcattaggaacctgatagatcctcatctgtggcttggcaggatctttcacaagcacatacttgccctcttcaaacttcatgcatatgtccacaatcgacttgacaattccccacatgtttgcagtgttgaggttg

SEQ ID NO: 699 - DNA, 516 bp, Hordeum vulgare
cggtgatcccgagccctggacgagctcgtcgtcaccgtcgccgcggagcccgagcccgagcctataccggaggcgcagcccgacgtcgccgtccaccccgtcgacgcgggccgcgagcaggaggcggacggcgaagattcctcgggagattcgtcggagcggaaggcggcctccacggaagacgacgctgtccacgacggaccttgtttgagcgtccgttcttacagtatgtcggagaagccatctgatgatacgactggccaggtgaggcctgaaggagatgtttctgatgtgaaagtggaaactgccaaccagaataaaggaaatgagatgccatcagcacagcaagaggaagcagtgatcaagaaaaagtatggaggagtactgcccaaaaagtcaccactcatatccaaggaccatgagcgagcttactttgattctgctgattgggctctgggaaagcaaggaggacatcctcaaaagcctaaaggtccgcttgaagcacttcgaccgaaa

SEQ ID NO: 700 - DNA, 539 bp, Hordeum vulgare
taggctctacgcttttattctgtccgactctggacaacactcggtgcgacaccataatgttcccggtcccaaataccgaattcgttacaggcatcgacagccatggaatggcatagcacggtggataacggcatgtctgcgacacttcagttcaaaattcagcaggcgttacacgacgtccggaatacttattgctagagcaatgaggcggcatgggcatagcaaatggcagagttccgttcaaaaaaggacatgggagctactcgctggattccttgttctcggcggccttggcctcctcggtggactcctggttcggggtcgtagcctccgtgggcgagttggcaccctcttcgctgtcggtagatgcatgaaggaatcggcgtgaacgggcttgctgctgggtaggctgtaatttcggtcgaagtgcttcaagcggacctttaggcttttgaggatgtcctccttgctttcccagagcccaatcagcagaatcaaagtaagctcgctcatggtccttggatatgagtggtgacttt

SEQ ID NO: 701 - DNA, 441 bp, Hordeum vulgare
  UNSURE (428): n stands for any base
gatgcaaatcttgctagccaaaagcagcacatagccatagtgccacactatcactgcatccgagttcgtacgtagacaaggcgagaatgaacaacacactaccagtaacggcacccaccgcacacgcgcccacgccgtcgccagcgccggcgccgaagcttggagcaggaaacatggccagccggtggcgcgagctccacggctcggactcgtggaaggggctcctggacccgctggacgtcgacctccgacgctccatcatcgcttacggcgagcttgcgtcggccgcccacgacgggttcaacctcgagaagcggtcaccgcatgccggcttgtgcctgtatagccgtgaccgcctgctgtccgcctccacggtgacccacccggagtactacaaggtgaccaagttcctgtacgcgacctgcggnggatcaacggtgt

SEQ ID NO: 702 - DNA, 400 bp, Hordeum vulgare
ttttttttttttttttttaaacaaaatgattgaaatgcaaacacacaaccaaacacaagtattaaaaaaaaatacaaaaatagtataggccgtatggatccattggcggcgatgttttatactgtttcgatccttgacttaactatgcttcttcaaagtcatcgagtttccactggccatcggtgcccttggccatgcattttctgtgaatgacccaccagcacgccggcacctggtgttcgtcattcagcaggtcggtagtcttgttcaccagcgccaagtcgcgtggaacaactagttggaagtccgccttgtcgccatgatcccctgcgacgccgtgcaggtacagctcgaggacgtggtgggtgagcatcttgtgaaccacgtagggtgaccggtc

SEQ ID NO: 703 - DNA, 518 bp, Hordeum vulgare
cttgcttcgagtcggccgtgctggccgccgtcgacgacgccatccacgacggggtggacgttctgtccttatccctcgaaatgagcgagaactcattcgctacgttgcacgcggtcaagaaggggatcgccgtggtgcacaccgccggtaacaaagggcctacgatgatgaccatcgagaacacatcaccgtgggtcatcaccgtcgcggcgacgagcatcgaccgctcgttcccgacggtgatcacgttgggaaacagccaacaaatagtgggacagtctctctattaccaagtgaagaacagctcagcatacaagagcgatttcaccaatcttatatgtacatcgttttgtaccccggagaatcttaaaggcaacgacgtgaaagggatgatcctgctctgcaatgacaaaggggccagtttcttcccggcggcacagtacatcgtcgacaatggagggtccggactcatcagctcgccaagaattgtgggtgacctattcaacattgcagaagct

SEQ ID NO: 704 - DNA, 541 bp, Hordeum vulgare
aaaatagcatagcatatttataggtatccttttgattttacaactcatcctcttaggtaataaaatttcaaacacctcatatcatgagagagagagaaaggcccacatgttaggtggcatggtttcctagccactgtgatgtgggtctattttttattaaaaaaatagaaatggcatttttatttcattatgcaacatccgactagatttcttgaattgtaatccgggccacaactggaatccttactgctttttggtcattatgccaagtaaggctaccaaatgtgtagtccccgtgcaacttccacataggggacagcttcacctgatacgtctgaactttgttggcagcgtcgaacataagaacaggtgggaagacctccatcttgactcccatcgggctctgcactgcggcatggtacacagaattgacctcaccgacgttggtcactgtcctatacacggtgatgggttgcctgagatctggaaccgagatggatggtaggttgaggtaatatcccggtagcgtggttgtggtgtt

SEQ ID NO: 705 - DNA, 391 bp, Hordeum vulgare
atctccacgcactctaagccatattcttggagaacacacagcacaccatcagtctctacagggcaatggtggccaccaccatgtctctttcctcttcgtccttcgccggcaaggccgtgaagaacttgccctcgccggctcacattggcgaggcacgtgtgaccatgcgcaagaccgccgtgaaggccaagcaggtttcgtcgggcagcccatggtacggctctgaccgtgtgctctacctcggccccctttccggggagccgcctagctacttgactggtgagtttcccggtgactacggatgggacaccgccgggctctcggctgatcctgagaccttcgccaagaaccgggagctcgaggtgattcattgtcgatgggccatgctcgg

SEQ ID NO: 706 - DNA, 407 bp, Hordeum vulgare
ttttttttttttttttggacaaaccaaacaatttcttcgcacataattctcataatatacatgttggtgttacaactcatgtgacactcacatacaactcgcattcatcactcatgtcttacttcccgggcacaaagttggtggcgaatgcccacgcattgttgttgacagggtcgacaatgtggtctgcaaggttctccagtgggcccttgccagtgacaatggcctgcacaaaaaaaccaaacatggagaacatggcaaggcgtccattcttgatctccttaaccttgagctccgcaaatgcctcggggtcgtcggccaggccaagcgggtcaaagctgccaccaggatagagtgggtcgacgatctcgccgagcggaccaccagcaatgcggtacccctcaacg

SEQ ID NO: 707 - DNA, 889 bp, Hordeum vulgare
  UNSURE (837)..(839),(854),(855): n stands for any base
tgacccccgggtctgcaggcaattcggcacgaggatgggtctatccaggttttatgtgggattgaaagggttgagcatgctgccaaggtgttccgtctgatgaaaggatatgggcatgcacctggaacgaaatcgtatagcctgctgatcgagaagctggctaggcataatttacgggatcgttcaaatgcgctgttcagggaggcattagcgcgtggagttactgtgacaccaggagtctataagattgacaagaggtatgtgaaagagaagaaggagaagaaggtgaagaaaaggctgactttaccggagaagaagatactaaagagcaagcggctgtacaagctcaaaatgagctttgtcaagaagcctaagcggcaaatgaagtcttgagcatacttgcggttgagttggagcggatgatcgttggaagggaaagcatcagacgaagcccgtccacagtttagaagagcagaaaattggtgcctgtgagcgtgcgcccgccatttgcgaacggctaacagacaacattacctttccgatccgagggcttgatatgagctcactctttacttgttgatgtactgccgaatctatgttgatgttccctgcaaatgttgcagcagaaataatgcgtgttttgcttgctagttaccacatcggagaaaattggctactgtcttactatgaggcaactatttgtactagctgacatccttctatcgatgtgtcctacaccctagctgcggttgataatcacatgtctaagactgcttatcacacaaaaactacaaagagattcaagggggaaccctgacacactgcccttatagcttnnnccccccccccccggnngggcccccccctcctaaaaagaaaaaaagaaatc

SEQ ID NO: 708 - DNA, 543 bp, Hordeum vulgare
  UNSURE (9): n stands for any base
aattactangctgaatatgtatgccgcataagtttgtcgctaatctgagaactgcgtggcaatggtttttcggctttttcactgttctgatgatcctaacaaattgctagattgacgcaagacaagacaatgaagatggtcaaatctaacaatgcttctccatagaattctcataatttacatcatggtagtacaaatcaaaccacacaacctcacacttcaacatgagtagctccaggacaccttatttgccggggacgaagttggtggcaaatgcccaggcgttgttgttgacggggtcgacgatgtggtcagcgaggttctcaagagggcccttgccggtgactatggcctggacaaagaagccaaacatcgagaacatggcaaggcggccgttcttgatctccttcaccttgagctcggcgaatgcttcagggtcatcggccagaccgagtgggtcaaagcttccgcccgggtagagagggtcgacgatctcgccgagtgggccgccggcaacacggtacccctcaacagcgcccatga

SEQ ID NO: 709 - DNA, 540 bp, Hordeum vulgare
ggctgcaggaattcgtgccgaggcctcgtgccgaatcggcacgaggaagacccggcatatgctaagcaggtttcctccggcagcccatggtacggagctgatcgcgtgctctacctcggcccactctctggcgagcccccaagctacctcaccggtgagttccccggtgactacgggtgggacacggctggactctctgctgaccccgagaccttctcgaagaaccgtgagttggaggttatccactgccgctgggctatgcttggcgcactgggttgcgtgttccctgagttgctggcccgcaatggtgtgaagttcggcgaggctgtctggttcaaggccggctcccaaatcttcaacgaaggtggcctcgactacctcggcaacccaagcctcgtccatgctcagagcatccttgccatttgggcttgccaggttgtgcttatgggcgctgttgaggggtaccgtgttgccggcggcccactcggcgagatcgttgaccctctctacccgggcggaagctttgacccactcggactg

SEQ ID NO: 710 - DNA, 527 bp, Hordeum vulgare
tctaacaatgcttctccagagaattcaattctcataatttacatcatggtagtacaaatcaaaccacacaacctcacacttcactgtgagcagctccagaacaccttatttgccggggacgaagttggtggcaaatgcccaggcgttgttgttgacagggtcggtgatgtggtcaccaaggttctcgagtgggcccttgccggtgactatggcctggacaaagaagccaaacattgagaacatggcaaggcggccgttcttgatctccttcaccttaagctcggcgaatgcctcggggtcatcagccagaccgagtgggtcaaagcttccgcccgggtagagagggtcaacgatctcgccgagtgggccgccggcaacacggtacccctcaacagcgcccataagcacaacctggcaagcccaaatggcaaggatgctctgagcatggacgaggcttgggttgccgaggtagtcgaggccaccttcgttgaagatttgggagccggccttgaaccagacagcctcgc

SEQ ID NO: 711 - DNA, 291 bp, Hordeum vulgare
aaaaaaaaaaaaaaaaaaaaaaaagggttttggaactcaggccgccgttgcgtcgcgttgcgttgcgttccgtgggagagagagagagagagagagagaaacacacacacagagccgactgaagcccgcagcgcgcagccgaaaccgaagcctcccaccgccgcccccgcgcctcgcgtcacccggtcccgaggggtttgctggtcggcggccgcggcggcggaggagggggatcccgtcggcgaggatgagcggcggcggcgcgggcggaggaggaggaggagggaaggg

SEQ ID NO: 712 - DNA, 426 bp, Hordeum vulgare
ttttttttttttttttaatcagaagaaagcacctgttaggtaaactatgtctccaaggagttacaagactgttctgctccgcgcatataacgaccgaaaaacaaacacatcagtccgacaacaccgacatgtgacacgcaacacgttaaaacgctctgccaagacgacgccgaccctctcctcagcgagccacaagctcagctactctgagctgctttactccgcagccacagtgagccagcaccgcaacaagagtgcgggcggctcagtagctggtgtgctgctgccagctctggtgagatggctgctgctgctgctgctgctgggctgccgcctggtagccgttcagggttccgtccgccgggttctgagggtggtgctcctgcgtcaagcctccctggttatggtagaatgctgggtatccat

SEQ ID NO: 713 - DNA, 550 bp, Hordeum vulgare
  UNSURE (20): n stands for any base
gtacccccgggcctgcaggnaattcggcacgaggagaggccgaacctgatgcagaaactcaagaagtggggaaggagcaaggatgatggcagctatttgtcatctccgtcatcgcggtccctgaccagtagctctccgaagaggagccagaaaccaaaggggcccctggaatctctcatgatcagaaatgcaggagatggtatgtccattacaacatttggaaaaaaggatcaagaatccggtgacatagatgatgcaaatgttgcatcttcattccagttgatgtcgaagaatgttgaaggcttcgctgatgaaaagtatcccgcttacaaagaccggcataagcttgcgacggaacgggagaaggcgataaaagagaaggccgagcaagccagagcacaaaggtttggtggtggctatagttcagctctagttccttccccgagggctgcacttcccccaaaactcgctcaaataaaggagaagaaggcccctgcagttaatgctgaatccggcgagcaatctagtgatatcccgaacaaccccctgg

SEQ ID NO: 714 - DNA, 548 bp, Hordeum vulgare
gactagcaaaactaggtagtggtatctcattactgtggttactttttacaaactgctcggttacaatatgcaaccggacagacaaactcggacaaaaaacgggtataggtatagtatatgatcagaacctgtagacctgacatatacaacttgattcagacaacaatggaatttacagttctcttttgtacagtttagctagccaactaatcgtgccctccgaataaaccagagtggaatccggatgagtccgtgctatgtgtcagatgccggcggagcgggtgcctgcgtgctgctcatcttgcttctcagctcctcgaagactttcatgctgtctgcgtcgaagcctccagcaaactgatgaacacggaaggcaaatctgacgccctggagaagcaagaactccctgttgggctctttgtcggtgccttgcaacgcgtcgagctccgacgtgaccctctccatgtacttccttgccagctgaactgacgcgagtttgatcttgccaacttttccagaatcagataaccaatcgactggtattccat

SEQ ID NO: 715 - DNA, 552 bp, Hordeum vulgare
gtacccccgggcctgcagggaattcggcacgagggtcctcccctttcccctttccccttcccctccaacgccgtggggcggatctacccgccgccgccgccggattcccttctccagccactcggtgacctccgccgccgacgccgaccccaccccgtcccggtctttgcccggccaccaggtcccctcccccccttcgagattttgaagtaaggagagaagtccaaccaaccatggggaagcgaaaggcggccgccaagccaccccctaggaagaggatggacaagctcgatacggtcttctcctgcccattctgcaaccacgggagcagcgttgaatgccggattgatatgaagaatctgattggtgaggctaattgtcaaatctgccaggaaagcttcagcaccactgcaaatgcgctgactgaagctattgatatatacagcgaatggattgatgagtgtgagcgcgtcaacactgtcgaagatgatgatggtgcatgagcatgtgtggttataatactctacgaactcaatgcgttgatgtcattta

SEQ ID NO: 716 - DNA, 553 bp, Hordeum vulgare
cacagcttccatgaaggactatataaacatgtcataagtacaaattcttcgcgggtactgagatttggtgtaatctcaaccgctataccagggcttaaagacaagtacacaatatcatcggttgtgtatcaagcgcaggataaactgcctattaacgtttccatcgaccagtacacccttacaatgctactacagacatggctaatggtggcagtaaatgacatcaacgcattgagttcgtagagtattataaccacacatgctcatgcaccatcatcatcttcgacagtgttgacgcgctcacactcatcaatccattcgctgtatatatcaatagcttcagtcagcgcatttgcagtggtgctgaagctttcctggcagatttgacaattagcctcaccaatcagattcttcatatcaatccggcattcaacgctgctcccgtggttgcagaatgggcaggagaagaccgtatcgagcttgtccatcctcttcctagggggtggcttggcggccgcctttcgcttccccatggttggttggacttctctcc

SEQ ID NO: 717 - DNA, 518 bp, Hordeum vulgare
gttttgctgcctccctcccgtgccgccgcctctcaaccgcgtccccccccatggcgctgccgaaccagaacaccgtcgattaccccagcttcaagctcgtcatcgtcggcgacggcgggactggcaaaaccacttttgtgaagaggcatctcactggagagtttgagaagaaatatgaacccaccattggtgttgaagttcacccattggatttcaccactaactgtggaaagatccgattctactgctgggacactgctgggcaagagaagtttggtggacttagggatggatactatatccatggtcagtgtgcgataatcatgtttgatgtcacttcaaggctgacctacaagaatgttcctacatggcacagggacttgtgcagggtgtgtgagaacatccccattgtcctgtgcgggaacaaggttgatgtgaagaacaggcaggttaaggccaagcaggtgacattccacaggaagaagaacctgcagtactatgagatctctgccaagagc

SEQ ID NO: 718 - DNA, 552 bp, Hordeum vulgare
cacagtgaggccgcaaggcataataatactgatgaaccataaggtggccaacaacaaatccatggcaaacaacatgatgtagatcaatgttcacacaaacagtttgcagcccaccagacaaggcaaggcagacaggaaaacatccggcttgaccactccaaatcaagccttcaacctaaaaaccagactcgcacaagtccccggctctcaaagtattgattgataagacaagactcatgatcctctctctactcgatcagatcgtcatcgtcatctggcagtggctgcgccgctgcagccgcaagctcagcctcatgctgttgctgcatggccaagtcgaatgtcacttccgggggcttaagagccacagcttcaacgaagtgaatgttgggatcaccagccagcttccttgcaagataaaggaatggcttctcaaagttgtagttgctcttggcagagatctcatagtactgcaggttcttcttcctgtggaatgtcacctgcttggccttaacctgcctgttcttcacatcaaccttgttcccgcacagg

SEQ ID NO: 719 - DNA, 518 bp, Hordeum vulgare
cacgttcccctgcgtgctgcgcacctgcgggggcgtccccgacttgaggatggggagggaggtgcacgcccatgtcctcaggttcgggctcggggccgaggtcgacgtgctcaattcgctcgtgaccatgtatgccaagtgcggggacgtcagggctgcgcggaaggtgtttgacggtatggccttgacggactgcatctcgtggaacgccatgattgctgggcattttgagaatcatgagcgcgaggcggggctggagttgtttttgagcatgctggagaatgaggtgcagccgaatctcatgacgataaccagcgtgactgttgcgtccggattgctgtctgaccttgattttgcaaaggaaatgcatgctttagcggtaaaaagaggttttgctgctgatgtcgcgttctgcaactctttgattcagatgtatactagtcttgggaggatgggggaagcatgcacaatattctcaagaatggagaccagagatgccatgtcatggacagccatga

SEQ ID NO: 720 - DNA, 516 bp, Hordeum vulgare
agctatgtttatctaagtagtaagcaggctggtggtgggcacattgccatatcgaaactatccttctacttgctaatgactatatatatcaagttacaatgcttgctggaaaagagttatgtactggtgattcagaactgaggtgagtatgagcacatggccgcatattgtagtcttcttagcctgaacctccgcacgaacaacttccatccctaaaatggtggaattccttggtgtccctgacagttatctctctgcgaacaatcttagaaatcatactcaatataccgtgacagctctggcaagtgtactggttctttgtgacaaaaatagaggtgccaggtgtggtattgatcagaccaaaagcaacagctagtctttcactgtggccacataaaacgtcatccttggatacttctttatcttccaaagaataagattcaacagaatcaaaaccagatgcttccatcctctcatatatgctatgtagaacggcatttatttctttgatctgcg

SEQ ID NO: 721 - DNA, 553 bp, Hordeum vulgare
gtacccccgggcctgcagggaattcggcacgagggagagcagtgctaaagcatttcgattggccagagagcaaaactgatgcattaagagaggccgcctttgagtatcaggacctggtgaaactagagaacaaggctacatcctttgtcgatgatccaaaacttccatgtgaagaagctttgaagaggatgtattcgttgcttgagaaagtggagcagagtgtttacgcacttcttcgtacaagagacatgaccaccgcacggtacaaggagtatggaataccagttgattggttatctgattctggaaaagttggcaagatcaaactcgcgtcagttcagctggcaaggaagtacatggagagggtcacgtcggagctcgacgcgttgcaaggcacggacaaagagcccaacagggagttcttgcttctccagggcgtcagatttgccttccgtgttcatcagtttgctggaggcttcgacgcagacagcatgaaagtcttcgaggagctgagaagcaagatgagcagcacgcaggcacccgctccgccgac

SEQ ID NO: 722 - DNA, 563 bp, Hordeum vulgare
  UNSURE (36),(38),(39): n stands for any base
tgtggttacctttttacaaactggctcggttacaantnntgcaaccggacagacaaactcggacaaaaaacgggtataggtatagtatatgatcagaacctgtagacctgacatatacaacttgattaacacaacaatggaatttacagttctcttttgtacagtttagctagccaactaatcgtgccctccgaatgaaccagagtggaatccggatgagtccttgctatgtgtcagatgtcggcggagcgggtgcctgcgtgctgctcatcttgcttctcagctcctcgaagactttcatgctgtctgcgtcgaagcctccagcaaactgatgaacacggaaggcaaatctgacgccctggagaagcaagaactccctgttgggctctttgtccgtgccttgcaacgcgtcgagctccgacgtgaccctctccatgtacttccttgccagctgaactgacgcgagtttgatcttgccaacttttccagaatcagataaccaatcaactggtattccatactccttgtaccgtgcggtggtcatgtctcttgtacgaagaagt

SEQ ID NO: 723 - DNA, 10 bp, Hordeum vulgare
  UNSURE (1)..(10): n stands for any base
nnnnnnnnnn

SEQ ID NO: 724 - DNA, 540 bp, Hordeum vulgare
gccttaaaaataattgaacaatttataaggaacttcaatcgaacaatttgacaccatttatcacggctacatggccaaaaaccacacaaataaccaatttatccccgcttaccaaggataaaggaccaagaactataccagtaacaagggtacaataagaacaataaaatggaggtgaagaagaaggcacgacctagctagcacaaagaccttcaggctttagaaagcccaaactaaaattcatgagaccggcctagatggagatgaatttctggtcaggccggaccaagcccaagcccagcccaaactaccaaccagacctatttttcaagccgaaaccctgctcaaacataaagctcaccccaggtttttcaggccagggctctagccatcagtccagactgcccatgcccaggtttaggcgtgaggaacacaggagctcatccacagaaaatcgaaacgaaaagagaacacatagaaaggcttgagggctttgagatggacatgaaagatagttcctcaagatggacatgaaagata

SEQ ID NO: 725 - DNA, 462 bp, Hordeum vulgare
gaagaaatatgaacccaccattggtgttgaagttcacccattggatttcaccactaactgtggaaagatccgattctactgctgggacactgctgggcaagagaagtttggtggacttagggatggatactatatccatggtcagtgtgcgataatcatgtttgatgtcacttcaaggctgacctacaagaatgttcctacatggcacagggacttgtgcagggtgtgtgagaacattcccattgtcctgtgcgggaacaaggttgatgtgaagaacaggcaggttaaggccaagcaggtgacattccacaggaagaagaacctgcagtattatgagatctctgccaagagcaactacaactttgagaagccattcctttatcttgcaaggaagctggctggtgatcccaacattcacttcgttgaagctgtggctcttaagcccccggaagtgacattcga

SEQ ID NO: 726 - DNA, 552 bp, Hordeum vulgare
gatcacacagtgaggccgcaaggcataataatactgatgaaccatcaaggtggccaacaacaaatccatggcaaacaacatgatgtagatcaatgttcacacaaacagtttgcagcccaccagacaaggcaaggcagacaggaaaaacatccggcttgaccactccaaatcaagccttcaacctaaaaaccagactcgcacaagtctccggctctcaaagtattgattgataagacaagactcgtgatcctctctctactcgatcagatcgtcatcgtcatctggcagtggctgcgccgctgcagccgcaagctcagcctcatgctgttgctgcatggccaagtcgaatgtcacttccgggggcttaagagccacagcttcaacgaagtgaatgttgggatcaccagccagcttccttgcaagataaaggaatggcttctcaaagttgtagttgctcttggcagagatctcataatactgcaggttcttcttcctgtggaatgtcacctgcttggccttaacctgcctgttcttcacatcaaccttgttccc

SEQ ID NO: 727 - DNA, 502 bp, Hordeum vulgare
gctgctcatgatgtcgctcgactcgccgcatcctcatcgagcggatcgcgcacctcaagaacgacctcggtctgccctccaacttccacgacaccatctgcctcaggtacccgcactacttccgcgtcgtcaggatggacagagggcccgcgctggagctcacggaatgggaccccgagctggccgtgtccgccgccgagctcgccgaggaggataatcgggccagggaggccgaggagaggaatttgataattgaccggccgctcaggttcaaccgtgtcaagctgcccaaggggctgaaggtgtcgcggggagaggcgcggaggatcgagaaattcagagaaatgccctacatttcgccgtacgccgacttctcgcacctgccgtcggggtcccctgagaaggagaagcatgcctgtggggtggttcatgagattctaagcctcacacttgagaagcgcaccctggttgaccacctgacacacttccgcgaggagttccg

SEQ ID NO: 728 - DNA, 551 bp, Hordeum vulgare
gacattttgcagccctgacattctttcattatgtgaaaaagttttacatatatttctattgtgaatgtccgtcgcaggactgtactgaagactgttaccatgcaggttgttcacaaaatgatgttgtaagctaatcacgcactcggtgatacataacactagcaagcaacccagcagggcacatcaaaagacatagtgataggcctttgcaatcagataagatgataaaactaacaatacagatgaagatttctatcagctaaatctcaaaatagctcagtttaccaccgttcccgttgtctgccatcaggaaatacaggaacagacgagtcgtcatcgacatcagtggttctattactctttgactttggtatctcgacttcttgtggacttgagtcatcaccatctccaaagtccggtggcgagccatcactctcgccaacccagccatcaccccagcggtagccgctgttgtcagatttgccaccaagttccccaatcaagtcttccatgtctgagaaatcatcgtcttcttcatcttccatgtcgct

SEQ ID NO: 729 - DNA, 556 bp, Hordeum vulgare
gaggaattcggtacgagggagtcggcatacaaaagcactgttgagggcatcactggaatcatctcaaagaccatctcaaagaaggggatgcttgaggtatacaactccttgagcgcggaaggcaaaaaggagttcaacaaggcatacagtgcatcattttacccttgcatggacatcctctacgaatgctatgaagatgttgcctctggaagtgaaatccggagtgttgtgttggctggtcggaggttttatgacaaggaaggccttcctgctttccctatgggcaaaatcgaccaaactcgcatgtggaaggtcggcgaaaaggtgcgctcgacccggccagatggtgaccttggcccactccaccccttcacggctggagtttacgttgcacttatgatggcccagatcgaggtgctgaggaagaagggtcactcctactctgagatcatcaacgagagcgtgatcgagtcagtggactcgctgaacccgttcatgcacgcgcgtggggtggccttcatggtggacaactgctcgacgacggcccggctggggt

SEQ ID NO: 730 - DNA, 550 bp, Hordeum vulgare
gagaggaagaccctcttggtatacagccatgtccctgctgttactgccactgccggcaagctctaccagaatttcgagagagatgcggcaaaagctacacaaacaaaacaaccaacaacatctaaccggacgaactaacttttattattcgagaagaaacggagacgactcactcgatccaaccccaacagggggctctctctacctgacacagcagctcacaggttcaaacagctagtcgcacgcatacattacagtccatgaattgtccacccatcaaaaaacaactcttcagacccgaatctaggcagactgccggagctccggacgcacgaagtcagcatcggccgtcaccgagatgtcgacggtgggcctcagctcggcgcagacctcgatggcgccgtggacggggtccgacatgaagttgctgatgaggtcctggttgatgggcgcatccttgtccaccgtcacaaacgcctgctgggtcaggatgtagtcgaagcggggcgcccacttcctcgaccccagccgggccgtcgtcgagcagttg

SEQ ID NO: 731 - DNA, 518 bp, Hordeum vulgare
ttcaggtgtaaggtcgtgtacgtctgcagggagcccaaggacatggtggtctcgcggtggcacttccaccggcggctgcatccggagctggcgtttgccgacgtcttcgagtccgtgtgcagcggcaccgtggggtacggaccagtatgggaccacatcctcggctactggagcgccagcacggcgaggccggacagtgtgctcttcctgcggtacgaggagctgctgcgagacccggcggagcacgtcaggaagctggcccggttcgtcgggctacctttctccggcatcgaggaggattccggcgtcgtccatgacatcgtcaagctctgcagcttcggccacctcaagaacctggaggccaacaaaacaggccacctgaatcccgccctcccgatcccgcgcgacgcgctattcaggaagggcgtggccggcgactgggtgaaccacatgacgcccgacatggcgcggcgcctggacgagatcgtcgccgacaagctccatgccgctgggctcac

SEQ ID NO: 732 - DNA, 494 bp, Hordeum vulgare
atgaatacagtgcaccatggtatccacaagatctctcccgataaaaaaaaaatccattcgagtggtcgtcactcgtggaaggtgagcccagcggcatggagcttgtcggcgacgatctcgtccaggcgccgcgccatgtcgggcgtcatgtggttcacccagtcgccggccacgcccttcctgaatagcgcgtcgcgcgggatcgggagggcgggattcaggtggcctgttttgttggcctccaggttcttgaggtggccgaagctgcagagcttgacgatgtcatggacgacgccggaatcctcctcgatgccggagaaaggtagcccgacgaaccgggccagcttcctgacgtgctccgccgggtctcgcagcagctcctcgtaccgcaggaagagcacactgtccggcctcgccgtgctggcgctccagtagccgaggatgtggtcccatactggtccgtaccccacggtgccgctgcacacggactcgaa

SEQ ID NO: 733 - DNA, 552 bp, Hordeum vulgare
  UNSURE (42): n stands for any base
gtccccccgggcctgcagggaattcgcacgaggcatacattnacacatagacgaccaagtagctctcgtcgaagtagaggaggccgccggagttaactcgagcagtttgatatggcgatcaggaacgtgacggcggcgacgcggtcgctggacggggacatgacggtggacgagttcaaggagtggctccggcggttcgacgtggaccgcgacggccgcatcagccgcgacgagctgcggtgcgcgatgcgcaccatccggacgcgcttctcggggtacaagagcaagcgtggcatcgagtacgccgacaccgacggcgacggctacgtcgacgacggcgaggtggacggcctcatcgagtacgcgcagaggagcctcgggctcaggatcgtcgcctactagagaggagtcaagctaggtctattaagggaagctagctccatatctatccatgcatgttacctgctagaataagctttgatcaatcgcctgtaccttcgctttcttgtgtacttattggctaatctgtgccgacgtgtgcgtttgtgatct

SEQ ID NO: 734 - DNA, 555 bp, Hordeum vulgare
  UNSURE (25): n stands for any base
catggaagtaaggagacaagtcggntctagtacataccttatagaccactagcctagccactagtgtattatgaacatgcatgcactgcatggtcggccgactctttctgccggttagttttgcatgtatatattacatggacaccatgcccacgcagccacgcttatagtaaaaggtacaccccaagcaccatatgcacatgctgcttcgttcaatccatctgcttagtgtgcatcatttcttgtccattaaccgattatctcctagatcttcaggtgcttcaacctgtcggcctcgtagctggcgttgtggccggggccgggacatgggggacggtaggcggggaagggcaccttgccggcctcgatacgggcgatgtcatggacgagcagctcgtagtagcgcctcacgtcgtccgccgacttgccgccgccgacagccctggcgatgttgtgccagcggtcgggcgtgtccctgtcgtgcaccgccagcgcctgctcgaacagcttgttctgcttcggcgtccaccccacgctcattgacagagaagccat

SEQ ID NO: 735 - DNA, 416 bp, Hordeum vulgare
cggagcagacggagttcgacgtggtgatccaggaggtgccgagcagcgcccgcatcgcgaccatcaaggtggtgcgcgcgctgaccaacctggcgctcaaggacgccaaggacctcatcgagggcctccccaagaagctcaaggaggccgtcggcaaggacgaggccgaggacgccaagaagcagctcgaggccgtcggcgccaaggtcaccgtcgcctgaccttgacggcgttgccgctacactgctactaggagttccagaattttaccagaattttccttgtcgaaaagacatttctcttgtgtaattgtatccggccagtagcaagatcttgcgtcctttgtatactctgtatcttaatacagtactactctgtttttttgccttcaaaaaaaaaaaaaaaaaaaaaaacct

SEQ ID NO: 736 - DNA, 372 bp, Hordeum vulgare
gagatgtctgtattagatcagagtatcaaaggacgcaagatcttgctactgggccggatacaattacacaagagaaatgtcttttcgacaaggaaaattctggtaaaattctggaactcctagtagcagtgtagcggcaacgccgtcaaggtcaggcgacggtgaccttggcgccgacggcctcgagctgcttcttggcgtcctcggcctcgtccttgccgacggcctccttgagcttcttggggaggccctcgatgaggtccttggcgtccttgagcgccaggttggtcagcgcgcgcaccaccttgatggtcgcgatgcgggcgctgctcggcacctcctggatcaccacgtcgaactccgtctgctccg

SEQ ID NO: 737 - DNA, 476 bp, Hordeum vulgare
gaggcaaaatacatggccaagaaactgcaggaggaggaagctgcaagggctgcagaagaagaaaggaagaggaaagaagaggaggcgaaggtagctgcagcagctgctctcaatcaaaagaagttgaaggaaaaggagaagaagttgctacgcaaagagaaatctcgtctgcgcacacttgtggcaccagtagttgcagagcccagcttcagtctgtcagcggatgatgttgaaacagtatgcacatcacatgatgttgaacatttgaagaaactctgtgatattatggaggacaaggatacagctgaaaaggccaggttgctgaggggtgcactgaacaaagaagaaaactcctcgaatacctcaaaagaagagaaaattcatgccaatggtgtggcgggttctactccaaaatccacagccccacaaggccctccaaaatccacagccccacaagtcattacactaggcaacta

SEQ ID NO: 738 - DNA, 545 bp, Hordeum vulgare
cagcataaatctcgtaacccatagcaggcatcaggtagaagtattactgtatgcaggggggacatcattgtgataaatcataaggtaggtaattttccataactcaaaattttgatctaagcttctatctttctctctctctctctaataggtgcctcgatcatcagcgacttcaggacttgctcctcgtaacaaaccagctgagtcttgacgaaacaatccagaaagtcagcagcaaggaagcaagccctggggtcttcaaaaggcaatcgaccaatcttcttgtgtggcctcagtggtggtctgttctactccgccttcttggtccggaagttcgacctcattgacgaaacctttttcttgcactgcaccactgttttaccagggacagcagtagctactcgctcccatctttggtttgcatccttgggaaatgccttcaaagcttgaacaagggccagcacctgagcctctgaccaggcatctggatctgttgcagaaggtgcctcttcggggacaggatcagcaccagttttctcattggc

SEQ ID NO: 739 - DNA, 443 bp, Hordeum vulgare
ttgcttgctatgtttggatgactggatttgggaatttctcgtactattatatcaagaaagattttagcattgcaagatttgctcagatgatgtggaggctaaatttctttgtggccttctgttgcattgtccttgacaatgattttatgctgtactatatctgcccaatgcacaccctatttacacttatggtgtacgcatcacttggcctgtttaacaagtataatgagataccatcagttatggctattaagattgctggctgcttcttggctgtcattttgatatgggaagttcctggggtattcgaaattttgtgggccccctttacgtttctgcttggctataaagatccagagccttctaagtcacacttacccttattgcatgaatggcatttccgatctgggcttgatcggtacatatggattattggaatgatt

SEQ ID NO: 740 - DNA, 514 bp, Hordeum vulgare
ttacaggagggaacgcattccttgtatgtatagaagaatatatctaagacatgttacaaaacaacaatgtgcacaccaaggttgacagttacacggctgacagctgttacaactcccagaagaatgggttggcttttacaaagaagaaaaaaaatgatcaaaaatttgcgtctccctccgcagtgatccaagttcccaagggcagcttcttaggggagcccctagatgcaaatggatccgggcatccccgccaagcgaacttcttttgtgcgcgtggaagaagcagccttccaccggtatcatttacttggcaattctacatccgtaagaactattcatctatacagccggaatttttagaaggacgagtgagcagcaatacagacatacggagatggcaaccccggcgatgaaattctggtacaggcggttgttgtctctactgggaatgaaggctgccctcagcacgtttgtgatctcaaatactcggtatgacagcaaaagatagattgat

SEQ ID NO: 741 - DNA, 516 bp, Hordeum vulgare
cgaggaaggacttcaaagacatctatgttgtttttgagctatggagtctgatctccaccaagttatcaaggccaatgatgacttgacaaaagagcattaccagttctttctctaccaactactccgagccctcaaatacattcatactgctagtgtttaccatcgtgacctgaagcccaagaatattttagcaaattctaactgcaaactgaagatatgtgattttggactagcacgagttgcattcaatgataccccaacaactgtcttctggacggattacgtcgcgacaagatggtatagagctccagaactctgtggttcctttttcacaaagtatacacctgccattgatatttggagcattgggtgcatttttgctgaggtgctgacaggaaagcctttgtttcctggtaaaaatgttgtccatcagttagacttgatgactgatcttctaggcacaccttctatggatacaatttctcgggtccgaaatgagaaagcaagaaggtactt

SEQ ID NO: 742 - DNA, 542 bp, Hordeum vulgare
attaattagcctgttggatagtacagtagcacattacagacttcatttctgtgttgatttgacctgcctccagccgctaaccagctaattaattttcattcccacctaaataaacagctcatctggccaaaccctccgtcttttttgtgtagcctagagaggttttcatattcatctatgtatgccttcgtcgtcgtccagacgatcctcatccgccaacttatttcaggccaatgcctccggttgctaccgttcctatcaacgagtctggagacgcggcgctgccgtcttcatagccgctagtaagtcgtcggcatgccaaacgggacggtgccgaccttcctgtgggcgctggcggtgcctgccgatgccgcggcagcggcgacgatgccgttgagcgaccgtgtgtatatgtcggtggtctccaccgccagtctgtccagacgaccgttcttctgccccgccggaacatgtcggtaggtgggtgctctcatggccggagcaggcgccgtgcctttggcgtaacccccacaagcatagcc

SEQ ID NO: 743 - DNA, 545 bp, Hordeum vulgare
  UNSURE (16): n stands for any base
gtcccccggctgcagnaattcgcaccgggttgtgtgcagctcctgtaaccagcttctgcagctgcctcccgggaaatgcacagcacccaagcagaatcaggttcagtgtggctcctgctcagaggttgttactttcatcaagcttaagggagtgaaagttcatccggtgatcccatcgtcgtctttcagtgtaccaaaaagtgtgagaagctccgatcgtcgggctccccaaagttctggttggtatccatatcaggatgatgacacttctagtttcgacagctatcgacagaaacagaatttctccgacaatctatcgcagtcttctattggaagctatggcagcagcacaaacaaagagcacgggccaaacaagagcagtcaggtaaaacctgtatctgtcagcaagtctagatttgcagatagcccaaaagatatattatgtcaaggagatgcagagagtcgggtggaagcttcagttattcgcacaatcagtccacaagccccagttttagaggataaacttgttgatcccttttccagcc

SEQ ID NO: 744 - DNA, 547 bp, Hordeum vulgare
aacacttcacaaagcacacaccagccacctgcccacctaggaggaggtggcatgggagtttgatatttacaattggttctacaaggtaggaatattctaccagtgaattacaagcccacaaaaacgcgcagcagttacgaggccacctatgctataccgaggaaaaattgcatcaacaacatgtgcagcagatgagatgagaaacgacgcgacacgaccggaggaacttggagctgcctgcccagatatatgattaggactttaggaggtatacctgatgggtgtttcgggtgaaggaatggaatatgcgaaataggttggatgagtattattcctggagtatcattgctgctgctgctgctgctgcagttgcacacaggctaccagaagtatgatttaaaaggcttcttccagagcagagtccagagatctaactcacatacgcagctttcaactgggggatagcaaagcaaggagacatcatcatagacagggtgctgctaacttatctcttctgggacgtgcatgccaaagccgcgtttcatct

SEQ ID NO: 745 - DNA, 545 bp, Hordeum vulgare
  UNSURE (32),(36),(43): n stands for any base
gtcccccggctgcaggattcggcacggggggncggnggcgagnaggcgaggggcatagcacgggcggcgtagttcggcggccgcgcgacggcggtggggtggttctcgtaccgatgcatcaccatggccgtctgcctcgccaacctcgtcgttgcgctggtcgtgctccgttccctcacctcctccacccccgcgcgcaaacgtgaggcgcccgcccttgcgacccctcgtcgtgcccacgactctggtgctacgtatctgctcttgctctatatcttactacatcttactgataaaatgatgtgatgttgtatttcttcggacctttgatgcatatattgttggcaaagaaaacgctcctggagttgtagtgctgcaagagtggtggggcgttgattatgaggtcaagaatcatgccatccatatttcccagatcgatgatggatacaaggcacttattccacatttgtaccgtgggaaggttgctttggaggtagctgaggcacaacatctgatggaaggactagactggccgggtgcaatca

SEQ ID NO: 746 - DNA, 552 bp, Hordeum vulgare
  UNSURE (26),(27): n stands for any base
gctattgtattaggaaaggttccatnnttatcttgaataagatttttcaattataagttggatatttatctaatgtttctgaagctcattgtatataggagagattcaattcatcttgaatcaagaatttcaataataagttggccatttatctaatgtttctgaagctgggggttatgtatataatttgtatctttataaccaacacaatggtcatcgtcgtggtcatagcagcaggcgtcgaggtcttcacggtgccactgctctccttccacgtctccaccaagttcagagacggtgcgacggcggcgaacctattactggcctttagggccgtcaactttcacgcctgtcagagtatgaccaacctcgccctgggcattgacttcttcagctgcgtgatggtggatgcctcgctctgcctcagaaacatcatgatggccacggttgaccctaccctgcccgtagacatggtcgccatcgcatgcatcaccttcccatctagcccacgctcgccgaccgcctcctatgacctgctccacaactaccgga

SEQ ID NO: 747 - DNA, 541 bp, Hordeum vulgare
cggggctgcaggcaattcggcacgaggctggattccttcctgtcagtcttcacatagctggcctgcacgatgagctgtaccacaacgttgcattgacatcaggagaaagcacctttgtcgacggaggagtggtggcagccgcaagaactctgccgacatggtcggacggtgacctccctgccataccgagcgtggagagaaaatccgctcaggcattgcaggaggaatgccggaagatggcggagtctttctcgaccacgatccaacaggacgaggagatcctagattccgacgagcctatcaggaaaacccgcgaaatcgcgatcaagtaccggctgcaccggaagctgctgctgcagaagatcatcgactcgctggagatctaccaggaccggattctgttctagatagctgtttaggaggcgccagcgtacggacctgtgtcgagtggaaaccgtttcggacgattatagtgctagttctaggtgtgtgtgtcaagtgttctgaaggacaccggcaccaccacccttgcattgttttg

SEQ ID NO: 748 - DNA, 549 bp, Hordeum vulgare
ccctggtgactctgttagggtgcatttggaagtctaggaatgatccataacagtcatcaagaatgtgcaggaaagaaggctctctctctctctctctctctcttttccactcttccagccacctacgacgctgcagccgccttggcaaagctcacttggcacttgctatccctccttctgggcaggacccatcctattgtcatctagccactacagtaccagtaacctatatatgaatctaggtttgctcaagcccttcaaaacaatgcaagggtggtggtgccggtgtccttcagaacacttgacacacacacctagaactagcactataatcgtccgaaacggtttccactcgacacaggtccgtacgctggcgcctcctaaacagctatctagaacagaatccggtcctggtagatctccagcgagtcgatgatcttctgcagcagcagcttccggtgcagccggtacttgatcgcgatttcgcgggttttcctgataggctcgtcggaatctaggatctcctcgtcctgttggatcgtggtcgag

SEQ ID NO: 749 - DNA, 552 bp, Hordeum vulgare
  UNSURE (52): n stands for any base
gtcccccgggtctgcaggaaattcggcaccgagtgggagagggccgacgagngtcggctacatgagcggcggttgcaagagtgatgatggaaatttgagttgcggatattcaagttttagaggaaaaagggcaagcatggaagacttctttgacataaaatcatctaaaattgatgataaacaaataaatctcttcggaatatttgatggtcatgggggttcacgtgctgctgagtatttgaaggagcacttgtttgagaacctcatgaaacacccgcaattcatgtcagatacaaaattagcaataagtgaaacatataaaaaaactgattcagatttcttggaatctgaaatcaacacccacagagatgacgggtcaactgcatcaacagcagttctgcttggaaatcatctttatgtggctaacgtaggtgactctcgggctgtaatatcaaagtcgggcaaagctattgcactctctgacgatcacaaaccaaacagaagtgatgagaggaaacgaattgagagtgctggtggaattgttatgtgggc

SEQ ID NO: 750 - DNA, 546 bp, Hordeum vulgare
  UNSURE (40): n stands for any base
ctgcccacatttgtatactcagttaaacgccatgtacggnaagtcgacatctagtacgagccgccaatgtacatacaactctcattcaacagaaaaaacatacatccagctgctgtaaatttaaaggctaacaacaacatgtatagcagacaaatagaagcaatcaaatttgatcgcccgggggagatatgggaggggagtcgccgctgcccgtcttgctgtgctggaacttgacaacgacgcaggtgatgttgtcgctcgctcccacggccgaaagcggtctccgttagcttccgggccgccgcctcgggatcctcctccatcttcacaagcgagacagcgtcctcatttggaaccacgtcccacagcccatcactggccaaaatcagaaactccaattcatcatctatttcttgttcctgaatctctggttccgcgacaacaaattgcttcaacaagcggttgccaaatgcccgagacattgcaagtacaccaccaaccctccaagttccagcccacataacaattccaccagcactctcaatt

SEQ ID NO: 751 - DNA, 518 bp, Hordeum vulgare
ctactctatgactgcaatgagcagttgaagcaatttagtcatgtcaaccaaaaggctcttgaccaatatgtgaacttcactgaacagcgcgaacaactgcagagaagacgggctgaacttgatgctggtgacgagaaaattagagagttgatatcagttttagaccaaaggaaggatgaatcaattgagcgcacatttaaaggagttgcaaggcacttccgcgaagtgttctctgaattagtgcaaggtggccacggatacttggttatgatgaagaaaaaggatggtgatgctggcgatgatgacatggatgaggatgcgcctcgtgaaccagatcctgaagggaggatagagaagtatattggtgtgaaagtcaaggtttccttcactggcaagggagaaactcagtccatgaagcagttgtctggagggcagaagacagtggtggccttaacactgatctttgctatccaacgatgtgacccagctccgttctacctctttgatgagattgatgc

SEQ ID NO: 752 - DNA, 542 bp, Hordeum vulgare
agcaaacccacataactcttatctatcgggttatcaccaagagatgatggaccaaattttgcagtaatgcagtacaaattcgaaaaacacacatctccaatcacgcaaatgctccctaagcatacttaaataagttttagcaatccaaaggctcctacgcactcttcaagttaacaatccaaaggctaactaaatatacacagctacattaacagtggcatacaatgtccaggggtagacgaacggcaacatgagcccatgtatctttcgtttcctgtgtaaacatcttgctacaagaaacaaacagagatggcgacgttgcaagccgctcctccgtacgatgatgggcttccaaggtaactcaaaatgtaaagaggaacaacatgcacagcagctccttgtgcctctcggtcggcctcagctggcgttgtgcgtctggtcgtgctcgatgaagtccatggcctgctccttggacaccacgttgatgaagctcaccctgttcttgtgcgtcacgccatagatcttgtccgcgaccttcagga

SEQ ID NO: 753 - DNA, 505 bp, Hordeum vulgare
caactcggaagggtcgttggaagggatgctgtcagaaaaatctcctactcctggcgcggcaccgaatgtttcaggccacacaaggaccgtcacttctggtgatatagggtccgagacacggtcaggaaggcgcgctacgacgatcatcggcaacaagaaagcaagcgcgtctagacaggtctttggtttgttgaatgctcaggagagcagaagacggagttccagcaggcgcgacagagcagccaagacgagcatgggggagagtgcagagaagcaaaagcatcatcgtcgctccgtcgctccaacgcattcgggcacgacgtctagcatcgcctggaccggccacccccacatctgcatcaccaccgcgagcaggcagctgaaagacctagtcgggcttgagcacctgaattcgatgaagaatgtagaagcagaacggagcgtgaggggagaagacaccgagcaaggcacgagcgacgacgacgacgcggtaggctctaagcgg

SEQ ID NO: 754 - DNA, 544 bp, Hordeum vulgare
gctctttgcctttcctttactctttggttggtttagcttccaaagctacaagttggcttaaaaccaacacagctgtgctgctggcagatgtgagtgcgaggagggagaagaagaagaggctgtccaactatatagcctccctctgaaatacgttcactcattactcaactagtgaacgttcgtgacttcttgcatcaagtcctcttcttccttccttccttccttcacctgttgttgaggaacactgcgccgcaggctatgatgacgatcacgccgcgcaccccctggttgatcagccacccgtttagcgccgggaacccgtcggatcgccgccgcttagagcctaccgcgtcgtcgtcgtcgctcgtgccttgctcggtgtcttctcccctcacgctccgttctgcttctacattcttcatcgaattcaggtgctcaagcccgactaggtctttcagctgcctgctcgcggtggtgatgcagatgtgggggtggccggtccaggcgatgctagacgtcgtgcccgaatgcgttggagcgacgg

SEQ ID NO: 755 - DNA, 533 bp, Hordeum vulgare
ggaattcggcacgagggagctttataagtgagactaggttcttggctatgaacatggaagatgaattagaagaaattgagatagaagggtttgatgcacaaatccagactttgttctgccaaaatgctatcaatgatctgcttatacaggttaccgctaattctgtccggttagtcagttgcacttctcgggagctagtggatcaatggaatgcaccggaaggattttcagtcaatgttgcatcagctaatgccagtcaggtcctgttggctactggtggtggccatctcgtttacctagagattagggatgctaagttggttgaagtgaaacatgcgcagctagaacatgagatttcttgtgttgatttgaacccagtaggggagaatccacagtatagctctctggctgctattgggatgtggactgatataagtgttagcatattttcacttcctgaccttgaattaatcaggaaggaaaatttaggtggagaaattgttcctcggtcagttctgatgtgcaccttggaa

SEQ ID NO: 756 - DNA, 552 bp, Hordeum vulgare
ctcagcttaaagctttgcattcaagatggttatcaccgtttacattcgcctgataattataccaaactttctgggtgtcatgtttgacaatgcactgctgataaacaacggcgattcaccactaaaattctacatcagcacagataaagttacactcttatcaaagtcgaaaacagaaaaacggaatgttgctacaaacacttgcagaggatcattctcaggccgccaatggtttacaacacagcgaaaacgaacaaataaaacaggatatacacggcacggcgctacctagtgcagtctcgtcagctcctccacccgcttggacagctcctcgacagggaccgccatcgccttggccacctcctccatcttggacctgttgaggtcgaggaatgactcgatcaggtcgccgtccaggaagttgcgggcctccgacgtcttcttgtcgttgtggaacgaccgccactgctcgtggctcaggctgcccacgcccttgatgaacttgaccagggttgcctggagcttctccaggaacacatagtggtcgtgggg

SEQ ID NO: 757 - DNA, 499 bp, Hordeum vulgare
actactaccccccggccttaaacccaaccctaggcctcccctcgcctccggccaccactacccgccgccgccgccgccgccgccgtcggttgccatggagttctggggcctcgaggttaagcctaaccagtccatcaaggtttctcctgaagatgaccacttcctccatctctcccaggctgcccttggtgaggtcaagaaggatgacaagacaaccttgtttgtcaaggtcgacggcggccagaagctagccatcgggaccctctctatggacaagttccctcagatccagttcgacctcgtcttcgaaaaggaatttgagctgtcacacaattccaagacaacaagcgtcttcttctctggctacaatgttttccaacctgcccagggagatgagatggattttgattctgaagatgagtctgagtctgaggatgagcaggagcccatcattccggcagtcgccaaggaaaacggcaaacctgaagccaaggagcag

SEQ ID NO: 758 - DNA, 534 bp, Hordeum vulgare
catatcatagcataccaccaaccaattcaaatttccgaaccacaacagcttccttcgattcgactcatcaatcactaacagatcaacggttttctcccttccctcaggctcaggctaggtagggaacacgacaacatagataatagataggtagcctaaaacaccagcgtaactgatagtctcatagggcaagaacacatcaatcaaaatagtaactgactcaacccagccagccaaccaacatccccctctcctctcctctcctcttcacttggccgcgtgcttggccttggcgtgcgaagctagagcaacctcgctgttgaatgtcttagtgcacgacttgcaggccaccgaccctccagacttgggcgacttgtcgctggttgctggggtcttgcctaccttcttggccgggtgcggggtcgcaacatggacagcccccttcttgtcacctgttttctggcctgatggtgttgcaattttggccttcttgtcagcaacaggggtcttaatatcacttccagccgccctctt

SEQ ID NO: 759 - DNA, 548 bp, Hordeum vulgare
gggctgcaggaattcggacgaggcccaccggagaagacagacgagaccgcctccgccgacttaaaggatggacccgcatgatggagagcctgctgatgacgagttgccaccaccaccccctctgcctcccaacgtggtgcccatcaaagcacaagatgctgatgctgctgctgctccacctccacctccaagcaagccagcaaagcctaggaggcacataatggccaggcctgccaatgggttggggaagaagggtcagcccatccagctgcttgctaaccactacaaagtctctgtcaagccttcagaggagttcttcaaccactactacgtcaatctcaagtatgaggatgatacgccggtcgatagcaagggcatcggcagaaaggtccttgataagctgcagcacacctaccggtctgagctcgcggataaggactttgcatatgatggtgaaaagagcctcttcactattggagctcttcctcagatcaacaatgaattcatcgtggtattggaagacatcgctagtggaaagactgctgccg

SEQ ID NO: 760 - DNA, 550 bp, Hordeum vulgare
gctgtgatgaaacacccacaaatccacaacataccctacttactcagaggatacctccagcctccaaacaaatacacgcctgcctgcctgcctgcctgcctgcaacaccataccatactcaactcggagataggtagatatcatatgatcccacaacaccaacaaacataacattgttcaaacatacatactgccactactccaccaaagtctagtctctagtctagctaccacatcatccaaggtttacgctaaggtaaggtaggttggttggttggttggttcaacgacgccgacaggaacgatagcatgcaccacttccatgcttcccagcagcgacaacaacgcactaccgacttacttgttcattctacgggcacccatacagctagagttccaggtgctacctacatacataagatagatagattgatagacagatagataggttttatacagacacgcggtgacgaaggtcagcatccatcaagttcgacaacagccgagcccatcagcagaagaacatggagctcctcactttctcatgcag

SEQ ID NO: 761 - DNA, 529 bp, Hordeum vulgare
gcacgaggtccatccatccataaaacccaaggaaagaaatccatcccattacaatcccctccctcaccgtcgactcttctcgaatcagaagaagaaggaagaaggaaggaagatggtttctgctgttcttcgtacgatcctggtgacgggcggcgcggggtacatcgggagccacacggtgctgcagctgctcctccagggcttccgcgtcgtcgtcgtcgacagcctcgacaacgcgtccgaggaggcaatccgccgcgtgcgacaactcgcaaacaacaccaacctcctagaattccgcaaggtggacctccgtgacaaggcggcgcttgaagatatcttctcctcccagaggttcgaggctgtgatccactttgcgggtctgaaagccgtcggggagagcgtggagaagccgctgctttactacgacaacaacctcatcggcacaatcaccctcctccaagtcatggcagcacatggctgcaagaagcttgtcttctcatcatcagccaccgtctacgggtggccc

SEQ ID NO: 762 - DNA, 553 bp, Hordeum vulgare
caccctatatatatatatatttatactagtataagtagtaagttattccatgaccgacagaatatatatatttctacaaggcaagggaaccaaccttatttcttctactccataagggagatacgatatgattagttttctaagacgaacaatatattatactattaatcaagctgctgctgatggatcatccgactcactccctatacacatcagtactcttcttcttcctccttcattgtctctgtggtggtggacaaacatatatatatagatggatgagatggtggtgtatgctctactgctactggctctgtcgctggatcagtggccgttgtcgctggatccgtagccgtaggggttcttgcttgcccagttccacaggtctctgcacatctcctccaccccaaacttggccttccacttgagctccttctctgctttggcagtggcagcgtacacagtctcggcatctccagctcttcttccagcataaaccagagggattttctttccgcaagccttctcgaatgcggcaaccatctccagcacg

SEQ ID NO: 763 - DNA, 518 bp, Hordeum vulgare
cggcgcttctccgtcgacgagggcggcggaggcggagaggacggggagaagcggggcgaggaggaggccgcagcgtcggtggaagccaaggtgggggccgcggaggagctgggctcggagcggagccggtcggggagcttctcctcctcatcatcgccgtcctctgcgactcctggtgtatcaagcgagcctccccttttgagcttcagtgtggataatattgatacagttaagttattggaactcctaggcccagaaaaggttgatccagttgatgtcaaggctattaaggaaaagttttttggctacacaacattctggttgacaagagaagaaccctttggtgatcttggggaaggagtcctttttgttgggaatctccgaggggacagagaggaaatctttggaaaacttcagcagcagctacgtgaacttacaggcgacaaatacaatcttttcatggtggaggagcccaattcagaagaggatgacccacgtggaggaccacgtgttagttt

SEQ ID NO: 764 - DNA, 517 bp, Hordeum vulgare
gctggacgtgccctatatgggaggatcgcgacgatcgagctcttccgccctcacaatgaggcccaggacttcctcttcattgccacggagaggtacaagttctgcgtcctgcagtgggacgcagaaaaatcagagcttctcactagatccatgggagatgtttctgatcgcatcggccgccctacggacaatggacagattgggatcatcgaccctgactgtagacttattggccttcacctctatgatgggttgtttaaggttataccattcgacaacaaaggacagctgaaggaagctttcaatatcagactagaagagcttcaagtgttggacataaagttcctgtatggctgtctcagacctacgatagttgtcctctaccaggataacaaagatgccaggcatgttaagacatatgaagttgcactgaaggagaaagatttcgtcgagggcccttggtcacagaacaatttagacaatggagctggtcttttaatacctgtaccagctccac

SEQ ID NO: 765 - DNA, 461 bp, Hordeum vulgare
  UNSURE (427): n stands for any base
atctctcctaccacctctccaccgctccacagagcccagaaccctcctcctcctccggcggcggcggcggacggcggcgatgagcacgtggaactacgtcgtgacggcgcacaagcccaccagcgtcagccactcctgcgtcggcaacttcaccggcccccaccagctcaacctcatcgtcgcgaaatgcacccgcatcgagatccacctcctcacgccgcagggcctccagccgatgctggacgtgcccatatatgggaggatcgcgacgatcgagctcttccgccctcacaatgaggcccaggacttcctcttcattgccacggagaggtacaagttctgcgtcctgcagtgggacgcagaaaaatcagagcttctcactagatccatgggagatgtttctgatcgcatcggccgccctacggancatggacagattgggatcatcgaccctgactgta

SEQ ID NO: 766 - DNA, 464 bp, Hordeum vulgare
tttttttttttttttttttgttttttttgaaacctcaagcttaaagctttgcattccaagatggttatcaccgtttacattcgcctgataattataccaaactttctgggtgtcatgtttgacaatgcactgctgataaacaacggcgattcaccactaaaattctacatcagcacagataaagttacactcttatcaaagtcgaaaacagagaaacagaatgttgctacaaacacttgcagaggatcattctcaggccgccaacggtttacaacacagcgaaaacgaacaaataaaacaggatgtacacggcacggcgctacctggtgcagtctcgtcagctcctccacccgcttggacagctcctcgacagggaccgccatcgccttggccacctcctccatcttggacctgttgaggtcgaggaatgactcaatcaggtcgccgtccaggaagttgcgggc

SEQ ID NO: 767 - DNA, 553 bp, Hordeum vulgare
gtcctcccgggtctgcaggcaattcggcacgagggttccttcattcattcattcattcaccatcccctcccctcctcccctcccctcccacagagaaagagagagagaccaagatgttcgccgacgcggggttcagcttctccccatcctactcttcttcttcctcgccgccgtcagcctactcgggttactcccccaccgtcttctcccactcctccttcgccgccacccctgcatctgcatccaaccacgctgcaccgcctctgcctctgcctctcctgcatcaacaacaacaacagcatcagcatcagcatcaacaacaacatcaagccgccgccgctgcacccgacgccgccgccgccgccgccgccatgtaccaccacctcgcggacatggggcagccatccctgatatcagagtatgacctgggagcagagggcgacctgttcaaggcacctgagcccatagtcgaggaaccgctgctcgccctcgacccggtcgcggccgccatctccatgatgtccggcggggaggacgacaacgccatcagtgc

SEQ ID NO: 768 - DNA, 545 bp, Hordeum vulgare
agagaggagcctgggttttatttatttattagtaccaagtccaagttcaagttcaagcctttgtacacagaggagcctggctgcctagctagggctctccactctcttgcaccaccactgggaggaccatcatattattacaaacgaacacggaaaatagaaaatgtcacccaaaggaacggatttgatggagcgagcgaaaacgaattccaatgggcggcgcggcgcagcacagcggccatcgccctagaagcttctagacgcagacaagtcactggcagctcagcagtagctcaattccttccttgcaacaaccttgtcttcctcatgagtttggcagcaggcggtcttccatggccgtcctacttcctcggcttgagcatgtcgccatcgtccatcttggcgaacctccctcgcaccctcggctggctgtctgctagagccttcctgcaagcatacttgatcttcctgccaaagttcctcttgatcttcttcttcctgtacctggagagcttctgcttcctctcctcacttttcaggtcact

SEQ ID NO: 769 - DNA, 976 bp, Hordeum vulgare
  UNSURE (1)..(4),(13),(19),(20),(22),(23),(25),(28),(31): n stands for any base
nnnnggtcaagcnaacaanntnncnatntgntggcccttaattgcgcctgatagcctgcttcgtcagcatctaaatcctcaagatttatgtttacggaacacccaaaaaacaacatgtctccttttgaacatggcgaagtgtttgttttatatgaggggggggacccgcccccaaataacggaaactatgagaggtttctagaaattaagctgacacgcgacaataacataactactggaaagatctaccagtctgttgttgggggggaaagacattttttttttctgcgttatactgtgcaggttgtcccgttcggggggggggggttctttccccccccctcgttttcccgttggttttggttgtttgttccgttcttcctccctgtcaaaaaaaaatattgcctcctctgctctcctcgcttccttgtctttccccttctcttcgctgcgctcttttttcttctcctcttttccccgtcctgctttctttttttttctggcttttcttcttttgtcttgttgtcccgctctccctgtgtttttttcttacggctttttccttctgctttccgtcggttttgtccttctcctctttttccccttctccttccctgcgtttcttcctcctccgtctccccttcctcttttttgccgcgcgtgtccccacccccttcctcccctctctttatccgccgcgttgctttttccttctttttttttctcgttttagcatgccgttttcgcgttcttttgtttctttgtccgcggtcttgtgtctgcctccctcgtccgtggtttcgagtgcggcaagttagtggggcgccagttggcggcgtgtgccgttctgtctgggcgtgggggttccctgctttttctttcatcgttttagtagctactgctagcgacggtcggacgtggggggcgtgagtagggtgtgtgaggtatatccttgtataactgtaaaataaataaa

SEQ ID NO: 770 - DNA, 541 bp, Hordeum vulgare
tcctctctgcacgataaaactgaactttctaaaatgtctagctcattatttagtccatacgcaaggatcaaaacattcgcctgcatatcagcacagaaccctaatactatacaagttgctcatgtcgtcctcaattttccctgggctctgggccgttgcccggccctgctgatatgttgctcagccattgtcgcagtcgggaagatgaggaccacagaagacaggcaagaccccttggcgaaattgacggtgcgctaaccatgggtactgccattgccgttggcatggcaggttccatttgctacaccaccattggcttgcttctgcgcgtgcccgttctggtgtattaggggtgttgaggagctgtcgccaagcttgtgtttagccacaaccacatggccattgcagctgtcctgcagcacctggtccagttgcccgcacgctgcagcgattagtccgacaaatagaggtgaaggttttgaaggcgttgacttgaactccggatggaattggacgccgatgaagaacgggtgatcaggta

SEQ ID NO: 771 - DNA, 517 bp, Hordeum vulgare
ggttcagctcctctccctgtccctcctcgagaccgtcaccaagaactgcgacaaggtgttctccgaggtcgccgccgagagggttctcgatgagatggtcaggttggtggatgatcccatcaccgttgtgaataacaggaacaaggcacttatgctgatcgaggcttggggagagtccgccgaggagctccgccacctgccggtctacgaggaaacatacaagagcctgaaatcaagaggagtgcggtttcctggacgcgacaatgagagcttggcccccatatttactccaccacgctcagttgctgaagctgaagctggtgcaaacttcacgcaacagacctttcaagatgtgcatatgcatacatatactgccgaagaaacaaaggaagcttttgatgttgcgcgtaatagcatagagcttctttcaactgttctttcatcttcccctcagcaggatgctttgcaggatgacttgacgaccacccttgtgcaacaatgctaccaatcccaacac

SEQ ID NO: 772 - DNA, 551 bp, Hordeum vulgare
  UNSURE (24): n stands for any base
gagatgagtgttcttaacaacttntctaaaaagatgcatgtattggtggtacatcgattgcttgagatgcatccaggaaaccagaacatgatgacaagtgaactgatcaacgcgacaaacagcggagcacaactactgagctaccgatgatcaaccgagtgcggcaaataagtagatgagcgacctgaaccctaatgaatgtccaatcctctaccagatgaaatacattcagacgccatcgtgcagtagtataagacttgcaggtgcaactgccttctcatcccaggaactggcagggacggtgttcagaggttaattaggtcatctttcttcgtgtcctgcttttgagccccatccacatcctcctgggaggagctgccccctcccttcttgccgaatatcatctcgtcgaggtcatcgagcacaccttcgtcttccccaggctttgctcgagtaccggccggttttctgaccagggcctcttcgctcccggcgccggtggggtcctcatgttctgcttctgcggggatcggtatggccaacggctcttg

SEQ ID NO: 773 - DNA, 551 bp, Hordeum vulgare
gtacccccgggtctgcaggcaattcggcacgaggcgaagccgaaatccctaacgccggcgccggcgcccttgtccgttcaccatcgcgcgcccgtcccatagcttggatttcgatttcgatttagggcaagggcaagggcagaccacatgtgccgccaaccgtccacgcctgacttgtctccagatgagcagcttgctgccgaagaaaccttcaagttgtactgcaagccagttgagctctgcaatgttattcaaaaacgagcccttgataatcccgctttcctgcaaagatgccttcattacatgatacaggcaagccgtaaaaagaggattcaactaaccgtatccctttctcgaggtatcgaatgcccagaccagaatatcttccccctttatcttctcttagctacacctactagtgataacatcccacttgaagggcattctcctatatatcgattcagccgtgcctgtttgcttacgtcattcagtgaatttgctagcaccaaagccacattcatgattccagacgtcaagaatatggcaacctc

SEQ ID NO: 774 - DNA, 549 bp, Hordeum vulgare
taaataaaaacttgttttatgaaaaaaaggaaaaacaaacaaactcaacaggcagatcaatcctagctaaagtaaacactcgatgagaatagcccttcctaaacaatcctcatttgtggatggaatcatctcaaatctaccaacatcttgccaagccatggctttgtaattaccctgtaacatacttttggaaatgaaacaccagtaggagcctctcctgctgtttttaactgtcaaaagaaagaaagaaaaagcttctttcagggctacaaacatggatcctctgattctgtttaaaagtaaccaaccaaaaccaacccccatggaatggaaggtgctcgatcgactcatatcttcttcttggggtggggaatgggatgatccacaggtgctcgatcggggaatgggatgatccacaggtgctcgatcgactcacatcttcttggggtggggaatgggatgatccacaggtgctcgatcgactcacatcttcttggggtggggaatgggatgatccacaggtgctcgatcgactcacgtcttcttctt

SEQ ID NO: 775 - DNA, 517 bp, Hordeum vulgare
ttcttcgccgccggcgttcttcccactacgggtgcggaaaagcaagccagtccccaaatcccaactacaaaaagagcagttaatctcctctggctctggctgctaccgtagatctagccctcttttcgttcttggataatcttggttcagttgtaatcggttgtacatcaccacaattaaattcctaggttttgtggccatgtctgacagcgagaaagaggtgccagccgcgtcccggggggccgactgggaggtggtgaccctcaccgcgtccacctacgccgcagcgcccggcggaccccaaggagcagcagagggcaagaggctcggagagggcagcaaagacggccagggaacactgctcatgtcggaccacttcgtgttcccccccagcgagcacgagaacctgcccatagagaccgcccttctcgagcctcaggaaagcaccagcgtggacgccgccgccgccgccttcaagaatgtcggtgggggctacgatgatgatgggtccgagacg

SEQ ID NO: 776 - DNA, 556 bp, Hordeum vulgare
gaaacttacaaggggccgcgccccgttcgtattaataaagagtacaaaggtacgacgactatgaggacaagagcaagaagaaactttggcatctcacaggcctggcaacaagcaaataccctgtcaaacttaatattattacaactagagacccctttcgtcactgttgcaaatcatattggcacggccatcttcttcttggttataatgactccagggtgatctgtgaagactcatcagagattgtatcaacgaagaacaccacaaacagacccaccagtccaggaattcggatcatcaactgactgccgagcgggagcgccatttaaggcagctcatgtgcaacttgtccttgcgccacaagatgacaaggccaaccagggcagcaacaacaaccgcaccccagatagtgttggtctccttagcttggtcatacaggcatgacatgtgcttcttcagccagcactggcagggggcaccagagccgcggcccttgctgctgccactggtgtcctgaggcgcaccagacttgtcctgggaatcatcatcatggaaa

SEQ ID NO: 777 - DNA, 517 bp, Hordeum vulgare
ggatcttctacaagcttggccaaaaccctaacatcgtgtcaaacatccgcaatgaactctcacccattgcatcaagaaaactagcatctagtgcaggtggcattgtgatctttgagcccaccgagaccaaatctctagtctatctgagagccgtcttgtacgagactcttaggttgtacccaccagcagctatcgagcgcaagacggtagccaccaatgatatcatgccgagtggccataaggtgcattctggcgacaccatctttatttgtatccaatccatgggaagaatggagggcatgtggggtaaagactgcctagactataaaccagataggtggctcttggaagatggcaacaaactgaggtacgtaccatctcacaagttcttggcctttaactcgggcccaaggctgtgcctcggcaaggaaattgcggttatgcagatgaagactgtgatcgccgcaacagtatggaactttgatatgcaggtgctggaaggccagagtatcgaacc

SEQ ID NO: 778 - DNA, 546 bp, Hordeum vulgare
acacatttcacttattccttgtcatcacttacatacatatatttattgtattcataatatcacctacatacattcattaataacataaaatataaattagcatgaacatatgcctttataatttggtaataatgtagttgtttctggcgtagcgttgtacgtattggtgtgcataagtacgattatagataaagagagtatagtgttacatggctcgcttctttagctcaattttgagcccatttttcatctcaagaatgcaagatgacttgggttcgatactctggccttccagcacctgcatatcaaagttccatactgttgcggcgatcacagtcttcatctgcataaccgcaatttccttgccgaggcacagccttgggcccgagttaaaggccaagaacttgtgagatggtacgtacctcagtttgttgccatcttccaagagccacctatctggtttatagtctaggcagtctttaccccacatgccctccattcttcccatggattggatacaaataaagatggtgtcgccagaatgca

SEQ ID NO: 779 - DNA, 520 bp, Hordeum vulgare
ctaactgaatttgacagggacatggatgccgagagcataaatcctggtgaacagatattcgagaagacgatttccgggatgtaccttggagaaattgttcggagggtgctggccaagatggctcaagagtctgatctgtttggtcactcattctctgataaactagccgagccatttgttctaagaactccgcatttgtgcgctatgcaacaagataactccgatcatcttggagaagttgaatcaattttgcgcgacatcatcggcgtaaaccaatcttctctggcggcacggaggttcattttagaagtttctgattgtgtcatcaagagaggcgggcggttggctggtgccggcattgccggcattcttcagaagatggagaatgattccaagggactgatcttagggagaagaacagtggtagcgatggacggcggactttacgagaactaccctcagtacagatcgtacatggttgaggctatggcggagctgctcggtccccgggacatggagc

SEQ ID NO: 780 - DNA, 324 bp, Hordeum vulgare
gtacaagacatgacttatggactttctgaacaattaatttacattcctgaaacataccagattctgcagtccaatactaaaaagtaatctcagacatctgagactgagaggagtgatgctgaaagtctccgaagaagatcatgtttatctacctctcagttctgtcgatgcaatatgttcctgagcaagtgaatacatttccggaacccacccgaggttcctagcaggctatagcaaactcttcgcttcgcaagttcctaatgaacgtcacgccgagagctgagctcctgcatattttgagtttgcggctgccaaaagtgccgc

SEQ ID NO: 781 - DNA, 1033 bp, Hordeum vulgare
  UNSURE (1)..(22),(497)..(513),(522),(554),(559),(579)..(598),(613),(615)..(620),(622)..(624),(648)..(655),(661),(663),(669),(674),(677)..(679),(688),(692),(699),(716),(731),(764),(820),(822)..(824),(862),(874),(880),(882),(891),(895),(902),(911),(922),(924),(937),(946),(947),(954),(957),(965),(968),(979),(984),(985),(987),(988),(990),(1007)..(1009),(1013),(1016)..(1018),(1021),(1026): n stands for any base
nnnnnnnnnnnnnnnnnnnnnnaaagggcaaaatgggaaaggaggcccccgagaggggaggtaataataaatagtaggggtatatagggcgggcagttggcattggggctcggcgaagccgcaccgagacgacaccaagaaatacaagcacccacagccagcctccgaaaaagggcgttccacctccagatttagggctgaatagggcaatagagtctgaagaaaaagaatgaccatgacaagtaccagcatgggccgggacaataaacgagggccgccgagtacttgattcgcaattccgcagaaacctcctttctcatagttttatcgttgcaaaaatggatcccgcacaggagccagctaaggttaacgctgagggggcgccgcccacactctacctcgcccgcccttgtctcgtctgtttttttatcccgattcctttcttctttcttttttctcttttatttttatttctttttttcacatctttatgaatnnnnnnnnnnnnnnnnnatagtcttncctagagaggggggcgctcctttctgttttcntaatnccttcccaaagcctcttccnnnnnnnnnnnnnnnnnnnnaatgattgccttggncnnnnnntnnnttaggtcagtaaccgatggagatnnnnnnnngttggncnaggggnactgnaannnctggtagcncacnctgcgcngactgcggcggcgaggnatttaacgtggcaanctgcgagatgttccctgtgtagaaccattagcntttttctaaaaagccgtacaattatccagtgcgtgctcgattatcctcagctgttntnnnggttttatctcctactcaacactacaggccagagattngcgtttatctcnctcgcnantgtccgttntctntcgttcntatacttanatatgtgcganancgcatagcaatanatcttggcnnaagacgnacnacttctcnttncatgctttctnccgannanngncatcatcacatttattnnnatangcnnncanagganctgacat

SEQ ID NO: 782 - DNA, 547 bp, Hordeum vulgare
gcatacaaagcttttttctttaagaaagacacccaaagggcatcttacaaccgataatcatccaggtaaacagccagccagtacagtagaaagacaattggaggcagaacaaccagtgaaaaaaaaaagtagaatgaaaatatactagtcttcttcttcctccgaccgattgccgcccaccaaagtgaaaatcacactgaacatcaagaagttgacaacgaataaattttcaattttggcctatctgtagcatatcttctgctactgttgaaagaaatcagtagaaaacttctgttacattgaatgagaagctaacacagtttgcttgtgtacacttctgatgaacaggaaggaattaccatgtatacacaactaattggggttcaaagccagggcgaccaggtcattcattgtctgcccctagatcctgaaccaccatcctgctcctggggccagggctgccatctttcagatctatgatgattgcttgggaatcttcttccttgatcatatggatatctcgttcttgccccattccgcccattcc

SEQ ID NO: 783 - DNA, 440 bp, Hordeum vulgare
ggccgcgttgggcattgtcgcgtccgccacggcgtggatcccggaggacctcgacgacgggcacttggactacttcttttgggttatggcggcgttcggcgccctgaatctgctgcagtttgttctctgctccacgaggtacagcggaaatgcaacttgtggaaacgccatgcatgttagtgatgcttcacttgcttggaacacaccccatcaggtggttagaggtgtaaccgggtttgaagatagagataagaagatggagatagaataggtttaaacatgtacagtattacttgtcttcttcttcaactctctgcccttatcatgtaggagtactcctatatactccattcgaggggtcaaatgaaccacacaaatacatcattgaattattgagagtcacaatattctctaaaaaaaaaaaaaaaaaaaaaaaaaaa

SEQ ID NO: 784 - DNA, 410 bp, Hordeum vulgare
ggtatttgtgacttctcaataattaatgatgtatttgtgtggttcatttgacccctcgaatggagtatataggagtactcctacatgataagggcagagagttgaagaagaagacaagtaatactgtacatgtttaaacctattctatctccatcttcttatctctatcttcaaacccggttacacctctaaccacctgatggggtgtgttccaagcaagtgaagcatcactaacatgcatggcgtttccacaagttgcatttccgctgtacctcgtggagcagagaacaaactgcagcagattcagggcgccgaacgccgccataacccaaaagaagtagtccaagtgcccgtcgtcgaggtcctccgggatccacgccgtggcggacgcgacaatgcccaacgcggcc

SEQ ID NO: 785 - DNA, 518 bp, Hordeum vulgare
ctaccggcagtcgtcatcctccagcaaagtgcaaacccccatctgctctctctcccccgctccgcttcatcccaccgcctggactgggcgcctccgtctgctcctccgtgccccatccatccgcatccgccaccgtcctccacgccctccggtgcgcatgattcagtaggcaacgagctcctcctcctcctcagccccacacttcccggatcctcgtcgccccggccgagcagagaccggagccccgccgcagatccgcagggaagaatggacgccccgtcggtggcgctgtacagccagctaaaggctgctcaaccattcttcttgtttgctgggcccaatgtgattgaatcagaggaacatgtcatgaagatggccaaacacatcaaggccatcacaaccaaacttggggtgcctcttgtgttcaaatcaagctttgataaagcaaaccgtacatcgtcgaaatccttccgtggtcctggtctggagcaaggcctaaagatccttgaaaaggtgaa

SEQ ID NO: 786 - DNA, 533 bp, Hordeum vulgare
aagcttgaagccacagtaaattaaagtaccgcatacaaagagcaactcgcctagacacggccatattggtgaaaccaaatggcggcgacgaggttattcctattgctatccactgccgaatcattccttgaatggggttaggtcgatcttgagtggtttctttcctttgctgactcgagcgatcgcaatcaattcttccaacagctcctccaaattgcgcaatggccattgagttggcccatcacatggtgaattcaggggatcatcatgtacctccatgaaaataccatcaacaccaactgcaacagcagtccttgcgatgcatggtatgagttctcgtaagcccccacttgcaaccccgccaccatcaagctttttcccagctggttgttgtagcgcatgtgttacatcagctacaactgggcaatttgcttccctcagccactcaaagttccttggatcaacaattagatcattgtagccaaacatggtgcctcgctcacagaccatcacattttgatttccagcaagtc

SEQ ID NO: 787 - DNA, 538 bp, Hordeum vulgare
ggctgcaggaattggacggggccgggctgccggcgagcccatctcgaaattcgcagcgatggcacacgccaacacaaagtttgtcgccggcgagctcactgcttcggaaaacaacgacgaggccggttcgaccagtaacaactcccaagccgagaagccaaagcactggacgggcaacctacccaaagtcttcgtgataggcagcgtggtcgccctggcttgcaccttcgacaagggactactgaccaaggctctcgtgttcggaacggcaagaaggtttgcaggaccaggaagaagataggaaccaaaaattcgcgcctatcatcgtgatgctatgcacattcgttctgatgcacaaccgagcgacgctatccggtattttcttcggtcctgagacgctcgcgcttgcagatgaggacatagggacgaggtttgctcgtggtagaaagcatctgtaagcaggcttgtgtacatactgctgtagctgcagtctgtgaagctgagagctgattaggacatagaaccatggtgataatga

SEQ ID NO: 788 - DNA, 560 bp, Hordeum vulgare
tagacctcaaaatagagccttattacttgcagtacatcatcattaatgatgatggttatgtctcagcatccaacaatccaatcagtctcattatcaccatggttctatgtcctaatcagctctcagcttcacagactgcagctacagcagtatgtacacaagcctgcttacagatgctttctaccacgagcaaacctcgtccctatgtcctcatctgcaagcgcgagcgtctcaggaccgaagaaaataccggatagcgtcgctcggttgtgcatcagaacgaatgtgcatagcatcacgatgataggcgcgaatttttggttcctatcttcttcctggtcctgcaaaccttcttgccgttccgaacacgagagccttggtcagtagtcccttgtcgaaggtgcaagccagggcgaccacgctgcctatcacgaagactttgggtaggttgcccgtccagtgctttggcttctcggcttgggagttgttactggtcgaaccggcctcgtcgttgttttccgaagcagtgagctcgccggcgacaaactttgtgttggcgt

SEQ ID NO: 789 - DNA, 470 bp, Hordeum vulgare
ttatcggcgccgggccgtcggggctcgccgtgggcgccagcctccgcgagcagggcgtgccgtacgtgatgctggagcgggaggactgcatcgcctcgctgtggcagaagcgcacctacaaccgcctcaagctccacctccccaagcagttctgccagctcccccgcatgcccttccccgccgactaccccgagtaccccacccgccgccagttcatcgactacctcgaggactacgccgccgccttccacgtcaagcccgagttcggcagcaccgtgcagtccgcccgctacgacgagacctccgggctctggcgcgtgcactcctcctcggccaagtccggcgagatggagtacatcgggcgctggctcgtggtcgccaccggcgagaacgccgagaacgtggtgcccgacatccccggcctcgacggcttcgccggcgaggtcgcccacgtcagcgagtacaagtca

SEQ ID NO: 790 - DNA, 444 bp, Hordeum vulgare
ttttttttttttttttttacagtaataaaagtcccggccccaggggctccactccgcttccccactgacgagagggctccactttactatatccttcctaccttacataccgtacgtataacctaggtaattaacatcttctttttttttcacatctcactctcactctcactcttactcttacaacgaacgaaatcaacatcatcatcatcatcatcaacaaagtaatcaaggggatttggttagtcgtcgtcgccgtcgagccggagaaggccggccggctttgtgcggttgcttagaagatgacggagatacagcgcctatggcaggcgccggcggcccgcttggtggtgggcttggtctcctcgcgccacacctggccgaggtccttggcgatgcggacggcgtcggcggaggcgccggagaggccgcggcgggtgaagc

SEQ ID NO: 791 - DNA, 140 bp, Hordeum vulgare
gctgctaaacaaaggtaccaacatcataagtatgtctcaaggcacttctctgccgccaaaggataaaggtcctgctgaagatcctttaaaggctgtaggcacaaaacggctgcatactgatgctccttcaagccctgttt

SEQ ID NO: 792 - DNA, 559 bp, Hordeum vulgare
  UNSURE (25): n stands for any base
gtatctagggcttggcacttaagtncctgacaggcttatccaaacgagtcactcttataattacaccatataacaacatacccacagcacagcgctgagtataggtaaaagcaaaaggaaaaggaaaatcctgaaaagaaaagtgctaagcagaacatgtcctttctgcaatgtatacatgacccatatatttttggctctacagacatagcttcaaccgtctcatttctgggacgaccgctgcaaaggatcctgcttcgaaggaccgtttggagaaactttccccaaaacattcaaagccttcatccgttgcagctctttaccttcctccactaggaggtgtattgctctcttctccagctcaatcgcatgcatgcttcgaccggctgctgagagtgtcctaagcattcgcatataaccctcctgggatgaccgatcacagttctccaaatatgtctgtaatcgatcatatctctcactccagtaaggattttggttgcctgatctatgcatatcaccttgaacggtggtactaggaccggccggtggattgttagca

SEQ ID NO: 793 - DNA, 521 bp, Hordeum vulgare
ggcacgaggctgggtcaggaagtttccattcttctgcagcgacagggagtatgtcatcggtcgcaggatatgggcatctggaaagacctactactgcgttacaaagagcgtgcctcgcccctctgttccaaggtgcagcaaacctcgccgtgtggacctctactactctagctggtgcatccgtccagttgaatcaagaaacggtgatggtgcaatgacggcatgtgaggtgctcctgtttcaccacgaagacatgggtatcccatggagcatcgcgaagctcggcgtgcagcagggcatgtggggctgcgtcaaacggattgagcctggcctccgtgcataccagaccgccagggctgccggcgaacccatctcgaaattcgcagcgatggcacacgccaacacaaagtttgtcgccggcgagctcactgcttcggaaaacaacgacgaggccggttcgaccagtaacaacgcccaagccgagaagccaaagcactggacgggcaacctacccaaagtct

SEQ ID NO: 794 - DNA, 541 bp, Hordeum vulgare
caaataagagccttattattgcagtacatcatcattaatgatgatggttatgtctcagcatccaacaatccaatcagtctcattatcaccatggttctatgtcctaatcagctctcagcttcacagactgcagctacagcagtatgtacacaagcctgcttacagatgctttctaccacgagcaaacctcgtccctatgtcctcatctgcaagcgcgagcgtctcaggaccaaagataataccggatagcgtcgctcggttgtgcatcagaatgaatgtgcatggcattgcggtgataggcgcggatgtttggttcctatcttcttcctggtcctgcaaaccttcttgccgttccgaacacgagagccttggtcagtagccccttgtcgaaggtgcaagccagggcgaccacgctgcctatcacgaagactttgggtaggttgcccgtccagtgctttggcttctcggcttgggcgttgttactggtcgaaccggcctcgtcgttgttttccgaagcagtgagctcgccggcgacaaactt

SEQ ID NO: 795 - DNA, 518 bp, Hordeum vulgare
ctactagctcttgagcgatggcatccatggcggtcgtggtcgcgttgttcgtcgctgcggccttagcagcggccggacacggggacgcggcgctcgtcgagcacacctttgttgtgagccaggttaaactaaaccggttgtgcaacgacacgctggtgactgtggtgaacgggcaattcccaggtccaacgatagagcttaacgaaggagactcagtagctgttcatgtcatcaacaagtccccacatggaataacaattcactggcatggagtgaagatgcaactgaactgctgggcagatggagcggcgatgataacccaatgccccatccagccaaacaagaacttcacctaccgattcgacgtcgtcggccaggaaggcacgctgtggtggcacgctcacgttggcagtctccgggcaagcgtccatggcgccttgatcatccggccaagatccggggctagctcatacccgtttgacaagcctgacaaggagatcccaatcgttataggcgaa

SEQ ID NO: 796 - DNA, 528 bp, Hordeum vulgare
tactccagcttgtactagtaactacatttcctttcatgcatggtagaggtccattatatcatacactcagcgattaaacaatactcgatttcgaagcttaaaaatcttggtctaaacaaggcaacccagcctaggctttattcaaacaactgtagaaatacgaaaatctcgaaacaagaacgtatttccgctattcatatgccactctactattgtagttgtagcagcttggaagatcttcaggagggggaggaagagtcgaatccaaagttggaccgttctctaccacgaatgctaccgccatgcctcctgacgagtggttctcaaaatgacagtgcaggaaccacacacctggatttttggtgacaaatcggacgacggcccacccgaatagcggaactaggacggtgttcctcaccggcggatccaccaggttgtacgtcgcgacgtctttctcggcgtcgtatcgcccgagcccctgcgcgaggacgaacatgtcctggccatggaggtgcatggggttagcgt

SEQ ID NO: 797 - DNA, 1301 bp, Hordeum vulgare
  UNSURE (1)..(8),(19),(21),(23),(24),(27),(30),(32),(35)..(38),(41)..(48),(50),(51),(58)..(62),(65),(66),(68),(69),(71)..(74),(76),(86),(87),(93)..(104),(106)..(108),(110),(111),(115),(117)..(119),(132),(137)..(139),(142),(144),(147),(153),(164),(173),(192)..(194),(226),(301),(442),(1274),(1293): n stands for any base
nnnnnnnnttccccaaaancntnngtnttncnaannnntgnnnnnnnncnnaattttnnnnntgnntnngnnnntnttgcgtaagnncccaannnnnnnnnnnntnnntnntgtntnnngggggcccccccnaaaannnccntnttntttttnttttaataatntttcttttnttgtttttttttttttttnnntttggggggtgtgtttcttcctctttattttnttgtgtttgcgtggttttttgtttttttttttttttgttgttgtttttttttttccttttttttgttttgttttnttcgtgtttgtcgtattcccccctcctcgctcggcgggtggtcccctttccgccctttttttttccgtcttttttcttccccccctctctcttttctctattatctttgtcgttttccttttctctgtgtctcttttcgtntctttcctttctttcttttcttttttgttctcttctcgttctgtatcatctatcatttactatcattattaaaattatatctttatcttaaccaattcattcttcatatatccatactatactatacctcgcctcattatatatatcatcataatcatcaaataaacacgacacacacttcaaaacatactcacacaatctcatataaatccatcattatcatcatcttatatctaaacttccacatcgatattttattcttctaaatccttattatatattaatattttcttaattattattcttaccatctataaaataaaattcttcccactctaaaaccccataatcaattatacctccatcacacatatttattatcttccttatatcctaaatgaccattcatactatttatatactcaataacctcaattttaattttttatattatatcatttcttacccttattctctaccctcttttatttataacctatacaatcataatttccaccaaattatcattattaactccgctctcctaatcacttaccaatcttaatacacatatttctccccaactatctattcaattatttctactatttatctctctaaccacacaactccattaacttgaagtacatctcactataacataagctctatctgaacgctataatcatatacccactcacaatcataacttctaaatatatacatcaccaactatatttcattccctacatatcttatctacctctatctatgcaatatatacccactcttatattcgcataactatactttttatatgtacgtatatcancactattacatcaagtatncaatatat

SEQ ID NO: 798 - DNA, 542 bp, Hordeum vulgare
tattgcatatatataacaaggaatggacgcaagctattgcaccgcatatagcgatcacatgcatgcatatatatgcagttttatttttggagcttcatcgcatgcattgatgcatggcatggagacttattttggcacgaaagtaatttaacttgaatcgtacgtgttgtgctgcatattcttgtgatggattggctgctactcgatgcatctcacggttcatgcatggagatcatcgatggagtagacgcattgcttgaaagcctcgaggttatgctgaaagacgggtacgaaggcatcgacgctaccgtctccgatgtaggatggcatgaggaagatgagcccctcgaacgggaagtaagagggcatgatgtacgatggcgtccccgtgccgaagtcgaggtcgtagaacgggaaggtgagccagctatgcacctccaggtccgggcacagcacttccctcaggttcaacgcggcgcttggtgccagcccttcctcctcgatgacgccggagctcgtgaagtcgacgaacgaccggaagt

SEQ ID NO: 799 - DNA, 510 bp, Hordeum vulgare
  UNSURE (493): n stands for any base
gtcggagagcatcaaggaggcccaggagacgtgctcggaggacgccgctagcggggagtgcgcggcggcgtgggacgaggtggaggagctcagcgcagcggccagccacgcccgggacaagctcaaggactccgacccgctcgagaactactgcaaggagaaccccgagaccgacgagtgccgcacctacgacagctgagcgtagctaatttgttgtggacgtacggcggatactcaaggtggacgtgcgtggtatttcttggctcgtggggggccgggaaaactatgtcgatcgactcagcctaccgttaccttgtatgtagtaaaaatgctcgaaatattttcccagggacatacgtgtggttgatatacaattgatgatacatatacgtttattcaaagttgtattacgtatgtatgtgtgcatcgttatgatgcagagacgagagccagatcgaacgctgttttggccatcagatcgcactgcacgcanaaaaaaaaaaaaaaaaa

SEQ ID NO: 800 - DNA, 485 bp, Hordeum vulgare
gtcagtgcgatctgtggccaaaagcgttcgatctggctctcgtctctgcatcataacgatgcacacatacatacgtaatacaactttgaataaacgtatatgtatcatcaattgtatatcaaccacacgtatgtccctgggaaaatatttcgagcatttttactacatacaaggtaacggtaggctgagtcgatcgacatagttttcccggccccccacgagccaagaaataccacgcacgtccaccttgagtatccgccgtacgtccacaacaaattagctacgctcagctgtcgtaggtgcggcactcgtcggtctcggggttctccttgcagtagttctcgagcgggtcggagtccttgagcttgtcccgggcgtggctggccgctgcgctgagctcctccacctcgtcccacgccgccgcgcactccccgctagcggcgtcctccgagcacgtctcctgggcctccttgatgctctccgac

SEQ ID NO: 801 - DNA, 519 bp, Hordeum vulgare
gccccctgttccgctggtgtccgcgagccagacaattctgccagactcggagggcgccatcgacggccaccttcgtgaggttggactcaccttccacctcctgaaggacgtgcccgggctcatctccaagaacatcgagcgcgccctagaggacgccttcaagccattgggcatcgatgactggaactccgtcttttggatagcgcaccccggcgggccagcaatccttgacatggtggaggccaaggtaaacctgaacaaggaacggatgcgcgccaccaggcatgtcctctccgaatatggcaacatgtcgagcgcctgcgtgctcttcatcatggacgaaatgcgcaaacgctccgctgaggatggccacaccacgactggcgagggaatggactggggcgttctcttcggcttcggccccggccttaccgtggagacggtcgttctccatagcgtccccatcactgcctaggccagcgcatgatcgctcgtcctccatttatcttgggcatggaa

SEQ ID NO: 802 - DNA, 562 bp, Hordeum vulgare
taatttatctgaatctctaaatatactgcatatagagaaatagtcccttctattacaaaccatatacggtagaatatagtgcaaacttgtgtgtggacagcaacagtagtagatgtttccatgcccaagataaatggaggacgagcgatcatgcgctggcctaggcagtgatggggacgctatggagaacgaccgtctccacggtaaggccggggccgaagccgaagagaacgccccagtccattccctcgccagtcgtggtgtggccatcctcagcggagcgtttgcgcatttcgtccatgatgaagagcacgcaggcgctcgacatgttgccatattcggagaggacatgcctggtggcgcgcatccgttccttgttcaggtttaccttggcctccaccatgtcaaggattgctggcccgccggggtgcgctatccaaaagacggagttccagtcatcgatgcccaatggcttgaaggcgtcctctagggcgcgctcgatgttcttggagatgagcccgggcacgtccttcaggaggtggaaggtgagtccaacctcacg

SEQ ID NO: 803 - DNA, 291 bp, Hordeum vulgare
tgctggcccttcttcgccgagcagcagaccacgcccgctacgcgtgcgtggaatggggtgtcgggatggaggtcggcgatgacgtgcgccggggggtggtcgaggcgaggatacgggaggtgatgggaggagaaggggtgggaagggagatgaggcggaaggcggcggagtggagcgagatggccgttcgtgcgacaacacaacccggtggcaggtcgctggctaatcttgagagtctgctcaaggatgtactgctggccgccactgggaatgctgggtagaatttggaat

SEQ ID NO: 804 - DNA, 559 bp, Hordeum vulgare
  UNSURE (71),(72): n stands for any base
gcatcaaacattaattgaaaatatattacaatgtacacaatgacaattaatatgattacggcgaggacatnntatctcatcatttccctagcacaaccaactaattaacctacaatggataacttctcatacggccacaacccaaccaaacgatgctaacctcatagccaagttcacgccttattggatcaagagcccatgcagaaactcaaattcgcctttctcccaacctgtcggttggatccacatgcatctcgaattccaaattctacccagcattcccagtggcggccagcagtacatccttgagcagactctcaagattagccagcgacctgccaccgggttgtgttgtcgcacgaacggccatctcgctccactccgccgccttccgcctcatctcccttcccaccccttctcctcccatcacctcccgtatcctcgcctcgaccaccccccggcgcacgtcatcgccgacctccatcccgacaccccattccacgcacgcgtagcgggcgttggtctgctgctcggcgaagaagggccagcacctcgtgcc

SEQ ID NO: 805 - DNA, 550 bp, Hordeum vulgare
gtcccccgggctgcaggctccggcctcctccccggcagctatgctgccaggtgctccctcccctccgccctcaatcgccctctccacgaaccgctcccccaacaaccacgctgtggtggcaggaaatacatgttctttctacagaaaaatgttgccatccccattgtaatcacagcagctgcaccaggcaaaggtggtggcgtgcttgatcgaccagcagagaaagtttctcctggccgtcaatctgaattcgataagaagaaatcccggaagatgtcacctccattccgcgtcgtcctgcataatgacaacgaaaacaggcgggagtacgttgtccaagtcctgatgaaggttatccctgggatgactgtcgacaatgctgttaatatcatgcaagaggcacacgtgaatgggatggcagtagttattgtctgctcgcagccggaagcggaggagcactgcacggcgctgaggggcaatggcctccgaagctcaattgaacctgcaagtggtggctgctgaaaaaaaggtttcttttttgccacttagt

SEQ ID NO: 806 - DNA, 549 bp, Hordeum vulgare
gtatgcatgacttggatatatgatgaagttgtgaatcataatcttaatttactattctctgagatagaaatgttgacatctagctatctgtctatattagtggacatatagggtgcgatatcagccacattggtcgatatttcggtctatatgggatgatatgtgtaaaaatgatatttacaaaatgataggttatatctatgtcggtaaacccccaaactgatatatcggttgcattggctttgatttagaaccatagaggtaaccatgtccatctttaacaacgagcgcctgtatctggatgtgcagtggcacctacaaactaagtggcaaaaaagaaacctttttttcagcagccaccacttgcaggttcaattgagcttcggaggccattgcccctcagcgccgtgcagtgctcctccgcttccggctgcgagcagacaataactactgccatcccattcacgtgtgcctcttgcatgatattaacagcattgtcgacagtcatcccagggataaccttcatcaggacttggacaacgtactccc

SEQ ID NO: 807 - DNA, 425 bp, Hordeum vulgare
acctccattgatcaaagctcggcagctcaggagctcgcagcaatggagcctgaggccgagtccaagcccatccctctcatgacgccgtacaagatgggctcgaccctcgacctcgcccaccgggtggtgctggcgccgctgacgcggcagcgctcctacggcaacgtgccgcagccgcacgccgccgtgtactacgggcagcgcgccaccgccggcgggatgctcatcaccgaggccacgggcgtctccgacacggcgcaggggtacacggacacccccggcgtgtggacggccgagcaggtggaggcgtggcggcccgtcgtcgacgccgtgcacgccaagggcgccgccttcttctgccagctctggcacgtcggccgcgtgtcgaccttcgggttccagcccggcggcgccgcgccggtgtc

SEQ ID NO: 808 - DNA, 456 bp, Hordeum vulgare
tttttcttttttttttttaagaaaaggttccatttgattttcacatggcaatatatggatcaatcattatttatggttcaatgacacatcaaggaagaaacgggtagtcggtgtaaccgacgacgggatcggagatgtagaacgtcatcctgttgtacttattaagcggcgcgttgagctctagcctcttcggcaggtcagggtttgccaggaagagccgcccaaaagagacgaggtcggcgtaccccgaggagaccgccttgtccccctcttcccgatcatacccaccatttgcaatgaaggtgcccttgaaggcctccctgtagggcagcagcctgtgcggcaccacccgccggccgtcgacgagtgccatacggggctcgatcatgtggaggtagaggatcccatggtcattgagcttcgtggccatgtggaggccgagcgcgtgcgggtcgg

SEQ ID NO: 809 - DNA, 526 bp, Hordeum vulgare
gccgcgcccccttcgacctcttcgacacccgcaagaagatgaacaacatcaagctctacgtgcgccgcgtcttcatcatggacaactgcgaggagctcatcccggagtggctgggattcgtcaagggcgtcgtcgactcagacgacctgcccctcaacatctcccgcgaaaccctgcagcagaacaagatcctcaaggtcatccgcaagaacctcgtcaagaagtgcatcgagctcttcttcgagatcgccgagagcagcaaggaggactacgccaagttctacgaggccttctccaagaacctcaagctgggcgtgcacgaggactcgcagaaccgcgccaagctcgccgacctgctccggtaccactcaacaaagagcggcgacgagctcaccagcctcaaggactacgtcacccggatgaaggaggggcagaaggacatctactacatcaccggcgagagccgcaaggccgtcgagaactcgcccttcctcgagcgcctcaagaagcgcggctacgaggtgct

SEQ ID NO: 810 - DNA, 517 bp, Hordeum vulgare
cacggcgagactggcactctaataacaacttctaactggacacggagcgaccaaacgaccaccagaactcaactctaaccatggatagacacacgacagacagacagactctgtttgtttcatcttcttcaggttcatgttcaggttcagtcgacctcctccatcttgctctcctcggcgccctcctcctccaacgagggcatgtcggcgtcctcttcctcggcatcggcctgatcatcgatgttgagcccgagcttgagcatgcggtggatcctggcggcgaaggtgttggggtcgtcgaggctgaagccggaggttagcagggccgtctcgaagagcagcatgatgaggtccttgacggatttgtcgttcttgtcggcgtcggcgcgcttgcggagctcctccatgatgccgttctccgggttgatctccatggtcttcttggaggacatgtaggcgcccatgctgctgtcacggagggcctgcgccttcatgatccgctccatgttggccgtcc

SEQ ID NO: 811 - DNA, 519 bp, Hordeum vulgare
gatcgctcgtcgatgtcggcggcggcaatggcgcgggcacacaagtgatcgccaaggcgttcccgcgcatcaagtgcaccgtgatggactcttcctcacgttgtcgtttccgggcaggcagccgccggtgatgacattctgagtttcgtcgccggtgacatgtttcaatccattccatcagccgatgctgtcttactcaagaacattttgcatgactggggccacgacgattgcgtcaaaatacttaaatgttgcaaggaagccatccctgctagaaatgctggaggaaaggtaatcattattgatatggtaagaggatctgcaaacggtgacaggaaaatcaacgagatggaagccatacagaacttgttcatgatgtacatcaccgggatcgaacgaaacgaaattgagtggaagaggatattttctgatgctggcttcagtgatgattataaaatcctgccagtattgggtccctactcagtaattgagatctacccatgaaaacccggtgaccta

SEQ ID NO: 812 - DNA, 545 bp, Hordeum vulgare
cgcttagtatagagttttgaaatgacgacacatacatatacgactgtcctgcatacatacatatgaacgtgtaggccttcaggtatgggtgcaacttattgggccaattaatatggtataggtcaccgggttttcatgggtagatctcaattactgagtagggacccaatactggcaggattttataatcatcactgaagccagcatcagaaaatatcctcttccactcaatttcgtttcgttcgatcccggtgatgtacatcatgaacaagttctgtatggcttccatctcgttgattttcctgtcaccgtttgcagatcctcttaccatatcaataatgattacctttcctccagcatttctagcagggatggcttccttgcaacatttaagtattttgacgcaatcgtcgtggccccagtcatgcaaaatgttcttgagtaagacagcatcggctgatggaatggattgaaacatgtcaccggcgacgaaactcagaatgtcatcaccggcggctgcctgcccggaaacgacaacgtgagga

SEQ ID NO: 813 - DNA, 454 bp, Hordeum vulgare
cggcacgaggcgccgccttccctccggcgcccccctccggcgcgacctccagcctccgacgacgaccagatggtgagctcccctagcccccccccctccctccttccccctccgggccgcccgaatccggcgggctcggttcgccccggggagtaaacccctgccgagaaaccctagcgagttgctgctcacgtttgtggttctgtgacttccgcaggactacctcaagacggtggtgccgtcgcagctcttggccgagcgcggctccagcctcgtcgtcatcaacccaggtgcgccccgccggagcgaatcccccaatcccccgcctgtcctctagatacgcgctttccttcccctgtttgttccgacgattcacgcctgctggagtccaaactgggtgtaaaaaacaacgtgtttagtgtagttcgagctgatttcgcgaggctcaagcccc

SEQ ID NO: 814 - DNA, 542 bp, Hordeum vulgare
gacagcatcaaaaggctttgtgttttactaatgatttactaatttacaagttacaggtagtaaatcaccctgaaactagagaatgtgtttacatggcaccactaaatctatgaatctcatctccatgtattttactagccatttctagttctgaatgaaagggtaggcagaagacgggccttcatcatctaaatctcttctccatgtcccttgacaaacctcgacatagatgaagttccgccttgctcaactatccgagattacaccgacaattgcagctcaagatagtcgacacctacgcagaccacctattatgaattgtagtaacacatcagttgcgactgaagaaaataggaatccttatattttctgccactcccaacgtgaacgccatttttaatccaatcttctctatggatccaagcatcacggctagtatcaaggacgcccaaaatcacaccacctttccatgggataaacaatggattcctccttgattgtagtacctcaactttctcgacgggttgattcgatggaatagt

SEQ ID NO: 815 - DNA, 551 bp, Hordeum vulgare
gtacccccgggcctgcaggaaattcggcacgaggcaaagaagaggctttcttcgaaccttcacgcagtcaagattttctgttcatctcaggaaccaagatgcgcactttcgccaaaactggagagaaccctcctgatggtttcatgtgccctggtgggtggaaggttcttgttgactactacaatagcttgcaaaccgaaggtgctaccgcccccgccgccgctactgtatgagacaatctgatacatggctttgcgatcatttgttcaccggtcagaaatggtgaacgcaggggatttttaaaccgttcctttttttccgccctttcttttcagttttttttttgtaggttgttagtttgtcgatgccatcagatcctccaattgttcaaattttttctttcaaaatagaaagagagattttgaagcttggcaccggaactcaaaactgttgacaggttgagctgtaaccgtgtgaattttatcattatcgtgtgatgactctgacagtcgaactagccaataaagaagttcattgcaaaaaaaaaaaaa

SEQ ID NO: 816 - DNA, 493 bp, Hordeum vulgare
tatgtggctacgttcgactgtcagagtcatcacacgataatgataaaattcacacggttacagctcaacctgtcaacagttttgagttccggtgccaagcttcaaaatctctctttctattttgaaagaaaaaatttgaacaattggaggatctgatggcatcgacaaactaacaacctacaaaaaaaaaactgaaaagaaagggcggaaaaaaaggaacggtttaaaaatcccctgcgttcaccatttctgaccggtgaacaaatgatcgcaaagccatgtatcagattgtctcatacagtagcggcggcgggggcggtagcaccttcggtttgcaagctattgtagtagtcaacaagaaccttccacccaccagggcacatgaaaccatcaggagggttctctccagttttggcgaaagtgcgcatcttggttcctgagatgaacagaaaatcttgactgcgtgaaggttcgaagaaagccatcttctttg

SEQ ID NO: 817 - DNA, 335 bp, Hordeum vulgare
ctcttctctcgtcccggtcggtcgtctccccccctatccgcctccccaacgaccagagagagagagagagagagagagatctgcctccatcccgagcgcgacagctagggttcctcgccgccgccggcccgccgcccctccctcccagccggccgaggcccccgtctccacccggcagcagcgcctccctccctcccgccccggcgcggccggtcccgccgcccgcagccacgccggggaccggtccataggcagctggtcgcgccttctggtggagggtctcaggccaacaattctggatgcatctatgacatggtggacagggcagcagaagc

SEQ ID NO: 818 - DNA, 279 bp, Hordeum vulgare
tttttttttttttcagctctcaggattcccttcaaagctagaaactccaataccttcagaagcttccgtattataggtcttcgaagaaaggtgtctcgattctgcttcaatatattatgaagcatttggaatccattcatgttgatgatatccaacaggacagagcgtgattttgtttttagaagtgcatcaagaattaacgaaagatcccttgcacttttagatgtacccccagccttgtcacgttctgctggggttgcagcattttcccgttcctct

SEQ ID NO: 819 - DNA, 518 bp, Hordeum vulgare
gcttcgagcacgagcccaagtgccggcagagctgttctccatggacaatgtggttctctcgccccacgtggcggtgtttacggaggagtccaggtcggacctgtgtctgcacaccattggcaaccttgaagccttcttttccggtcagccattgctcactccagtgcatgctgattctctggtgcagtgagggcaagtctggtcctactagatctgtttgggagtgatattatacagattgccacaaatccctacctaagcaaaataccaaaatgacggataagatattccatgaaaggctaacccatttaccccacaaaggtgccactacttccttctctctttattctctctgtagtcctcttttcttgaataatagagtacaaattatacaccttttatttgtattctgcataatcaaatacgagccaccaaggtgataactgcatggtccttaccattaacatgcttgtctgctttatgtgctgctgcattttgatttgaatattatttggcaa

SEQ ID NO: 820 - DNA, 538 bp, Hordeum vulgare
tacacttgactagtacagagaaaggggaatggagattccactcagttttacacaagaataattatttatagcacgtgatgcaagaaatcaggcactatttttgttatacaaaccaggcattactaatggttgccaaataatattcaaatcaaaatgcagcagcacataaagcagacaagcatgttaatggtaaggaccatgcagttatcaccttggtggctcgtatttgattatgcagaatacaaataaaaggtgtataatttgtactctattattcaagaaaagaggactacagagagaataaagagagaaggaagtagtggcacctttgtggggtaaatgggttagcctttcatggaatatcttatccgtcattttggtattttgcttaggtagggatttgtggcaatctgtataatatcactcccaaacagatctagtaggaccagacttgccctcactgcaccagagaatcagcatgcactggagtgagcaatggctgaccggaaaagaaggcttcaaggttgccaatggtgtg

SEQ ID NO: 821 - DNA, 262 bp, Hordeum vulgare
tggtacacggtgaacatgtcggtggacatgaagaaagagttgccccagcaggttgcggtcggcttctctggagcaagcggtatctgcatcgagctgcatcaggtattatcttggtcattcagctccactctagaagacgccactatactagctaccaattcgaagcggctacggtggctagtgccggtgctggtgccttccgcaacagtagcttttattgtgttgctctgcgccgtcactgccctagtatatcggcggtgca

SEQ ID NO: 822 - DNA, 550 bp, Hordeum vulgare
ctcagtgtgtataaactgttttatatatagaggatgatacaaaaaactgttttaaatacagagtagagagaactaaacaacaatatatggggtcgtggtcttcaatctggaaaacagtagagaagtttgtcacgtataacagcatccagcaaggtaagtttgttcatctgccactgctggcccaagacacatcgctgcaaacattggctgatgacgaggacgcattgtagccatgtgatccatggaaaatataggtcgacggccccggccgtgacagtgtcggcagcgtgacttccttcgactgcaagacgttcatgaaccgcacgacggacggccgcgccctcgggtcggggtgcgtgcaccagagccctacgaccagcgcacggtgcacctgccacataccatcgtggccgtcgccgagctgctcatcttcgtttagcctttcgtccactacctcgatgaaggcacccttctcatacaggtcccagacccacttgagcaacgggatgaccactttgtcagctcctgcagttggttgctccgtgtccat

SEQ ID NO: 823 - DNA, 514 bp, Hordeum vulgare
cggaaggccacagagcccttaggcaggcaacattgggaaccctaaattctctggttgtacatatgggagtcaaattggctcatcctcttatgaaacgatattaactgaactttctactctcataagcgacgtcgatttgcatatggccgctcttgcattggaactgtgttgcacaataatggtcgacagaagatccgttaaaaatgttggtttagctgtgatacataaagttttgcctgaggcccttactttgatcaggagtgctctgttgcaaggacaagcactacaggcgctccagaagttttttgctgcactggtgcagtctgcaaatataagctttgaaactttgttgaactcccttatttccactgccaaaccatcacagtcaggcggtctttccaagcaggcactattctctattgcacagtgtgttgctgtgctatgcttagcagctggtgataagaagtgtgcatcaactattgaaatgcttaaaggcatcctaaatgatgacagt

SEQ ID NO: 824 - DNA, 493 bp, Hordeum vulgare
tgtacagcaaaatatactcgataccctacaacgcaaccacatttcagccaaaattggtacagtataatccactaactggcctcagaatcggcagccatgtgtgcccaacttgactcaactatgtcctaacatatatatacacacaaaatccagctctcactcactgcgcaccgaattgtacttctcggcaagtgaagaagtggacgttatcttgctcatcaacttcttcagcttcatgctgtagtcactgccacttatgcggtttagagcggcaattgctcgaagagcactgcgaattaagtcttcgttgcgatcaatctcctgcttcactgcatcacccttgggcttgtgaacgatagttttctcaagaggttcaactaacgagtccagaactgcaagaacagcagaagggcacttgtctgctagctttgagagaatcagatggcagggcatttttacatcataatgatcacctaagccagataagaggaaa

SEQ ID NO: 825 - DNA, 518 bp, Hordeum vulgare
actccgctccctccactcccaccacccatccctcgtcgtgcgggcgctccgcgatgggcggcagctccaacacgaccacgagcggcggcggaggcggcgggaaggacagggacagggacaagggcaagggcgcctcggtctccttcgcggagggcgagaaggtgctcgcctaccacggccccctcctctacgaggccaaggttcaaaaaactgaaaaccgggaggacgagtggcggtatttcgtccattatcttggatggaataaaaattgggatgaatgggtcgcaagtgatcgtttattgaagttgactgaggagaatgttcgtaaacaactagagctgaaaaaccagtcaggggacaaaactgtcaggactggtggacggtcagcacagcataacccaaaagcctctaatgcagatgcaaaagtcgataaagaggacactaagggtcttgtcaaggggaagaagcgcaagaatcagcttggcgttgaggaaaaagaaagaaggtcatcagagagt

SEQ ID NO: 826 - DNA, 525 bp, Hordeum vulgare
tattcttggcccagaccttgtcctaacgaaaacaatacgcgctacacacgggtctgtaaggtgcactcgctatttggtgttgttcggggaagaaaactattcaggatatgcaagagaatacaaagatattctgtaaatgtacactagtgaatccatgtaggtcagtgacaggggtaccacacaatggcaaagattacgtacacagaccaacactgacgttggacaggtcagctacatgaacttggtgttagcaagccgagcggcgatcagctgtcacgggtcacacattcccacaaaatatccatatcaaatcaacaaccaaactagcaaccgtgaactacgcagtacaaatctggctgtagatggcgcatacgacgtatagataccatcgtttgcctcattgcttctacttgccttttgccccatcggcgcctttggaatcgccgtcatacgcagagaggaagaaatggacctggttcttctgcagaaacttgagaatgtccagtaatttctgctgcagtttgt

SEQ ID NO: 827 - DNA, 516 bp, Hordeum vulgare
aggaactttacttcccaatgcctctccttaccaactctggagtaggtcattcgcatcagacaatggagacaagtttgaagctgttgtacctttcatgggtgaatctgtaacggatggaactcttgctaacttcttaaagaaacctggcgatagagttgaggctgacgaggccatagctcagattgaaactgataaggtcaccatagatgtttctagtcctgaagctggtgttattgaaaagtttattgctagtgaaggtgatacagttactccaggcaccatagttgctattgtatcaaagtctgcagcacctgctgaaacacatgttgccccatctgaggaggcgccccaaaaagaatcacctccagcaaaagctgaagagaaatcaccaaaagcagaagagaaacaaacaaaagtagaacctcccaagaagcaagcgccaaagccaactccttcaaaaacctcccctacagaaccacagctccctccaaaagagcgagagcgacgggtgccaat

SEQ ID NO: 828 - DNA, 543 bp, Hordeum vulgare
accatatatctattgctcttgcattgaaaattaaagcaaatttcgtcgtttagggaactacaccccaaacgcgttatcatatcctcaactcaaatcttcatccttcccaggacgcaactctttgtatcagtcaaaaatttgcacggcattattttccagacaagaacaaggcacttggcagcgaaggagatcaggcgcatggggcttatatgtcgaggagcagcctccgggggtcctcgacgacgtccttgatgcggcgcaggaagtagacggcttctctgccgtcgatcagcctgtggtcgtatgtcagcgcgaggtacatcatgggcctggcaaggatgctgccgtccacgaccacggggcgctgcacaatggagtgcatcccaagaatcgctgactgtggggggttgatgatgggcgtgctaataaggcttccgtagacaccaccgttggagatggtgaatgttcctcccgccatctcgtcaattgacagcgccccctcagtagccttctttgcaaggttgtttatccctttttcgatgt

SEQ ID NO: 829 - DNA, 512 bp, Hordeum vulgare
  UNSURE (42),(69),(76),(85),(127),(136),(137),(168),(179),(333): n stands for any base
gccgggaaggccgccagctgcgtcgtccccaccttaagaaantcgacgccttcgtcgcctactggggantcggaangccggagcngagggacctgttcctcgccgtctccagggttctcaaggacangaagggcanntggccaaggagtacttcaagtttctaacaangtacctggccntgttcgatggatcggctgatgaggccgacgcaatcggtgccgaaaggaagaagctgctgagcaatcattgagtttgcaagtcatctgatctctatcagtgtgacctgctcgaaatgccagctgttgacagctcgagaaagatgagaagtatcangccagtttacgagctactgaagatattccttactcagaggctcggatcctatttagagtttcagactgctaactctgccttgctgcaaggatatggactggttcatgaggagtgcattaccaaaatgcgtcttttgtcccttgcttgatctgagcggccattgttctgggaaattcctt

SEQ ID NO: 830 - DNA, 555 bp, Hordeum vulgare
  UNSURE (84): n stands for any base
gagaacaattatactgataaacaggcatccagtatgaacaatcaggaatgtttgtaaacggctgacatgatcatccagtatggncttttgactacaaaattcatgcaacatgagattgcttagcacgacgctgcaaaccaggataaagccagcatgatcatgtggtagaagtatttcggattacaagatgtctaatacaaaaagattgctcatctaatctcacagactatagtctcggtttggggactcccctccgatcagcggatcatcaatccttgcatcccctgcccgccatcttcagtcaccttgttagcttggatcgtgttgatagcatttgcgatgtttcccctccacactccaagctttgaacgtagactctgccattgtggcatcccaaagaccctcgcagtatgccggctgacaatgaccaattgattaagctggtcaactttgcagtccaaaatcttggatgaaattgctttcacaatccaatattccacctcatcatcattaatctcaagggcttttgtaattgcagagtaaggaatttcccca

SEQ ID NO: 831 - DNA, 545 bp, Hordeum vulgare
  UNSURE (31),(62): n stands for any base
gtcccccggctgcagcattcggcactggggncgacattgactgcctcccatacccatcaaanagtgccaccacattttttgacgaaatccgccctgtggagaaagacgctgtcgccgtttctcgtttacggaaatgtggagtgatctttattgggaaagcaaatatgcacgagctaggccttggggtcactggaaacaatccaaactatgggacagtaagaaatccacattcaatcgatagatatactggtggttcttcatctggtccagctgcacttgtctcatcagggttatgttcaggagctattggaacagatggcggaggctcagttcgaataccatcctctctatgtggaatagttggtttgaagacaacatatgggcgcacagatatgactggggtcgtttgtgatgctgggactgttgaagttgcttcacctcttacatcatcagtggaggattctatgctattgtattctgcactagcaggctctagacccatggacaaacttactctgagatcttccccgctgtgtgttcctaac

SEQ ID NO: 832 - DNA, 551 bp, Hordeum vulgare
  UNSURE (19): n stands for any base
gttccaacaggttcttttnttatatatactgctgtaccttacttgcttattgctgctacaatgtttctggtaaaattattttctcagttttttataaactggagaaggtttgttgtgtctatcctgagtcctgacaaatgataaacctctcacacactattgatagtatggtatattgatgatgtttcaggtcttcaggatgtcgtaaaacgtgaatggccgatttcttttcttcaggcagagctcctctactgctgaagccaccctcaataagctagcctcgccccacggacggcctatcagttgcaagccgataggaaggccttgcttgtcatgaccaacaggaacagtaatggcaggcaagccaagaaggttcccggcaaaaatgaattgcatcagcttggctgacacaacataatcagactctccttttaaagcacttggtggtatttttggcgcggtcatgccggttgtaggggttgctatgacgtcaaccttcttgaaagcttccatgtgatagtacattatccttctcctcagagattgagaag

SEQ ID NO: 833 - DNA, 510 bp, Hordeum vulgare
  UNSURE (6),(7): n stands for any base
gggggnncagcgtctccagtgtgagcagcaccgatgatctaaccgaggatgttggggacgacacggaacactacaagcagctgggcctcaatgtggtgtccagcctgggagacgacctccagaacgtgcgcaaggcagcgctcctcgacgcggacgcgctgaccatcacggtggcgagcctcgggcacagactggtgaaggcaaatgagttcttgaacacgggcattaagagcctggaggaggagagcgggttccagcgcaagttggcccagttcatagagcattcccagctgcaggtgacccacctgctggaggaggagaagaagctccgtggtctggtgcgctccatcgtggattacttccacggcagcaccgggaaggatgagggcctgcgcctgttcgtggtcgtgcgcgacttcctggtgatactggagagggtgtgtagggaggtgaaagaggcggccgccaaagccgccgctgccaacaagaaaccggcggtagcggcagcac

SEQ ID NO: 834 - DNA, 552 bp, Hordeum vulgare
aggttaaaagggtgtggcttatatatacctgaaaaaaaagggtttaagacaccctggaaaaagacacctgcatgtataattagttggaggagactaagtaaaagtagacaagatgacattacaagcagtcaattgagctgacctaccatccacaatccttaactagcctacctacgctgcgatctcattctcatcgctctaacaacaaatgtgatgtgaaatgcagaatgatacatacatttatatacatacataacatagtagaggtcaaggttgctccaccgttccttcgtgcgtatgctattgccatccatgagatcccttgccatgatcatgattgatgcagctagcctaggtagccaggtgtcagtcggtcaatcggaatcagaggagctggagctgctgttcgcctttgccctccggccttggatcgcgggcttcagttgttgccgagggtcgcggaaagatggttgcggctgggacggctgcctgccccctttcgccggtgctgccgctaccgccggtttcttgttggcagcggcggctttggcg

SEQ ID NO: 835 - DNA, 479 bp, Hordeum vulgare
  UNSURE (475): n stands for any base
cgcacgagggaaggcctgaacctgctccgcttcgccacacctgtcctgcccctgctgatcttctctgagaaggccatgccggtggtggagcggcttgagatgagtttcaaggtgctggaaggtgtcttcggcatggacaacctcgtgggactccaagaggtgcatctgcaggtgagtgacaaggctggcaaattcaccaggtcggcgctagctcgcctgacgaagcaggcaaggaagtttgccaatgcgcccagggtagtagttgatgagtactacgacgggttaaaatgagattcaaatgagaagtaagtaaacttgtaccagtctgactaaattagtgttgtgttcatggaggagtatttatttgatgttcaaccaacaatttcgttctgcttgtaccagcctgactgaatgacaatgatgctgtgcgataccttgtttgaccgcattttaattgtgcaccatttcgactganaaaa

SEQ ID NO: 836 - DNA, 414 bp, Hordeum vulgare
catcattgtcattcagtcatgctggtacaagcagaacgaaattgctggttgaacatcaaataaatactcctccatgaacacatcactaatttagtcagactggtaccagtttacttacttctcatttgaatctcattttaacccgtcgtagtactcatcaactactaccctgggcgcattggcaaacttccttgcctgcttcgtcaggcgagctatcgccgacctggtgaatttgccagccttgtcactcacctgcagatgcacctcttggagtcccacgaggttgtccatgccgaagacaccttccagcaccttgaaactcatctcaagccgctccaccaccggcatggccttctcagagaagatcagcaggggcaggacaggtgtggcgaagcggagcagcttcaggccttc

SEQ ID NO: 837 - DNA, 514 bp, Hordeum vulgare
cgtccgcgaggcacctcaccccctcccgctccagttttcttgccgggagcagcgacggtagccgccgccgccccaatcgagcgggagagaggggatcagggcagcgggaggaggaggaagaagggcgaggtcctcgagcggggcactgcagagggcgacgaggagcaggatggtttcgctgtcgacgtggttccgctacgccgcccacaagttcgagtactccatctccctctcctggaagaagtacaccgttgggcagatcaacagcactgagatgaccgatgccatctggaagagcttcttccagggcaagctcaccttcccgcagtggatcaaagggggcgaagccatggcccctgtcgttgctcccaccggaggaaccgtcctcgtcagaaagctcgctactttatccccaaaagaactctttgttggggacatcgtcttgttgaaggacccagagaaatccgatgatttaattgtccggcgactggctgccgtgcaaggctatgagatg

SEQ ID NO: 838 - DNA, 517 bp, Hordeum vulgare
aatattattggcttcaccacatcgcaagcgaacatcgaataacaatcatccacgtgcagtttctactcgaagcgacaaacttcaaaaatccgcacaagagaaatgatacaccacaggacgccattatctacattttattgttcttcaccatctcttccacgtcgagctctaccgccaaaaccggtgaatcctggaacatggctacacggctgttgtccactggaccatgatcgacggcagttcttaaagagtatatgactctgccaacaatatcagtcatagggacaggcccaaataagcggctgtccctagcgtcctttgcctttagttcttggttatctgccatgacccagcattcgtccttgtcaagtacaaagggctcatccttctcatcagtagagaccatctcatagccttgcacggcagccagtcgccggacaattaaatcatcggatttctctgggtccttcaacaagacgatgtccccaacaaagagttcttttggggataaagtagc

SEQ ID NO: 839 - DNA, 517 bp, Hordeum vulgare
cgacgatcctagtttcaaagatttaagctcctcgatcgagtaccttgggggctactctctgcacactctcataatcgacgacgagtcatccaagtttatcaattcactggatgatctgtcatcgccaccaaaatttcttgttgccctggagttatctggcaagatggttcagctccccggctggatcaagcaactcagtgctctcaccaagctaaccctttcagtaaccgctctccggacagataacttgctgctccttagcaaactagatgcactgttctccctcacattctcattcagggcagaaaagcaggattcagaaactctgaccattctggcagaaacaagctgtcctctgatggggagatcacaatcccaaatgctggttttaagagccttaagcttgttcgcttcttcgctcctcttttgccagtactgatcatttctgagaatgccatgccagagctagaaaggctagagctgcggttcagcatgctggaggggctttatggcgtgg

SEQ ID NO: 840 - DNA, 550 bp, Hordeum vulgare
tcttggcaattgtcttgaaattgaaatcaatttacaacaacatttgcatcaaagaaaattacgagatcttgttaactgatgatcaaactgcagcgcacggacacacacatacacgacgaatagaacgttcaacacaactttcatacaacgtgcctggatgaagaatcgccatccttcttttcacagtatcacccttcttcgagtgattaaggcagcagtagcgtgaaaatatctcagttctcagaacgggcaagaatgcgatgattttaaacctacaggcttgcaaagaaccatggttcggctctcactttggatcagtcaatcgaggattatcttgggcgccttgccattggtcttcctcttcactgcgctctccacctcccgctgcacctctttcgtcatatgttcaccttctttgtcctccaatgtcagatgcaccaccttgagtcctgcaaggttttccacgccataaagcccctccagcatgctgaaccgcagctctagcctttctagctctggcatggcattctcagaaatgatcagtactggc

SEQ ID NO: 841 - DNA, 421 bp, Hordeum vulgare
  UNSURE (367): n stands for any base
agtcccaccaccaccaccgccccggccctccgcctctgcctccctatctcgcccccgcccgcagcagcctcgccgtcgcccccctccctcgccgtcggacgcgtttccctccgccgtcgccgtcgccgccgcgcttccttcagcggccgccgctgctccttgtcctcagaaatggaggccagcgctggcacagctctgtaccctgcgcaccgatgcaaaaccatatacctggtcaggcatgcccagggtattcacaacgtggaaggcgagaaggattttgcagcgtacaagtcacatgcgctgcttgatgctcagcttacccctttgggctggagccaagttgataccctgcgagagcatgtgacanaatctggactggcaaaaaagattgagttggttgttgtttcccctctactgagga

SEQ ID NO: 842 - DNA, 363 bp, Hordeum vulgare
ttttttttttttttggggatacgcataagtccttattcccatgaatttgggtatgcgttcaaacaacaaatcatcagataaaacataaccaatcgtgacgatcatacacctgagcaacagacggcaagtcctatccatgtcgctcatctattctcagttcattgtcagccagaaccggggtttggtaaagaatcaaagacatccgtgtgctcgacggtcttcagttcttgctagcttcttcagcgtgcttctcgtccgcgacatcgctgggcatatcgagcccggccggtatcttcccagcgaagttgtatgtagagctatccgatcccaggttacttctgtcgaccaacaccatcgaccggg

SEQ ID NO: 843 - DNA, 551 bp, Hordeum vulgare
gtacccccgggcctgcaggcaattcggcacgagggccgccggacctcccatcccctcccgtaccctcctccaacctcaccaccggacctccgctcccttcctcccacctcgcagccccgtaggttaccggatccgtccatccccgacgcatccatccctctcacatcccatttctctctcttgacgcagcttctcgtcgggtcacctgtgacggctgtttcaggcaacgtccggtaaatctcgccattgtgaagcacagtccgaggtcccatgacaccacagggcgctcctatccggctagattcggcgctcatggctcctaaccccacccacaaccttcgcctgatggctagggtttcgggtgtcaggctccgcagccggttgccatgtcgtcctcctctcatctgttgtccagacatgcagccccgattctactacagctcatccctgtcaaatgtgttttgtcccttgtgcaattcagtgacgaacactaataggcgtacaggctgacttccgatctctcttgatttacattcatgcactgattacta

SEQ ID NO: 844 - DNA, 544 bp, Hordeum vulgare
  UNSURE (23): n stands for any base
gaagaaatatatattaaaaaaanattgttggattacaaatagttgatattacatgagtaatatcatccaaatgtgatggataatctaaatattttcttgacagaaaaattgaaaccgaaaacatccatcaacatctctacaatttaactaaaacttaaccgaggaacattatcaaacaggaacatcatgcctacaacttaactaaaactgaaaacaaccatcataactaaaactgaaaacagacatcatcctcatcatcgtgaaccagaacatcatcatctctgttgtatacttgccacacacccgtttagtcgtccatatatcttttgaataaaggatcattacttcagatacattggttgcccggcgagataacgactattacaaagaaagttgtaaccagaaccttgactataaacaccggtctttggcaacgaccgcgtcaaggatgtctcctgtacaccgctagatgcgtggagaaggtagtatgcattagtagcacagatatcaaccctaataaatagttcgcatttgacagcacaat

SEQ ID NO: 845 - DNA, 517 bp, Hordeum vulgare
cggaaactggggctcgccttctggtaacaaggtttctcaaccaatatgtaaccatcggtaacatgaccattcttgaagaaggtggcactatgtacagttttggtgaagtagacaaaaaatgccttgtcaaaactgtcttgcgagttcatgaccctctcttctactggaaggtcgccaccgaagcagaccttggtatggcagacgcatatatcaacggttatttttcttttgttgataaaagagaagggctcctgaatcttttcctgattctcattgctaacagagatgcgcagaagagtaataacagcgctgccagtaaaaggggttggtggacgcccatgcttttaacagctgggattgcatcggcaaaatatttcctccgccacatctcaaggaagaatactgtcacacaaactcgccgaaacatctctcagcactatgatctgagtaatgatttcttctcgcttttcctggatccatcgatgacttactcttgtgcagtattcaaggtggaaga

SEQ ID NO: 846 - DNA, 549 bp, Hordeum vulgare
tggccgagaggagaaaaatgttgagtaagaaaacctcaaccttgagccaaccgatcgacccacaaatgtgttacatgaatcaatcaacgaatcaccctgtggtagcactaatagttcatacaatggtcaatattttcacacactcctatggaattacaatttctcaaccttactttgtaataaatagacgcatgctattatatgtaggtatgaatatggatggtcgttcacttgtccagtgacctaaggctaggctgcaggaagacttgcgaaggggttatcggtgttggccagcttgtcattgccaggtcgcgaaaatacaatctggtaagttccaagcgtccgtgacttgaaaccggccgcgcagtatatgaaataatactcccatacacgaatgaacttgtcgtcaaatcccagagccaaaattgcatctttgttggccataaagttatccctccagcgtatcagcgtcgggtagtaatggtatccgatgttctcaacctgctcgatgcagagccttgacgcagcggacatggcagacgtgatccg

SEQ ID NO: 847 - DNA, 518 bp, Hordeum vulgare
cttctcctcccaggggaggctgaggaggtccaagaacggccgttcgtcgcggctggtggtgcgcgcggacgccaaggagatcgccttcgaccagaagtcccgggccgcgctccaggccggcgtcgagaagctcgccaacgccgtcggcgtcaccctcggcccgcgagggaggaatgtagtgctggatgagcatggcaaccccaaagtggtgaacgatggtgttaccattgcccgtgctattgagctagctaacccaatggaaaatgccggtgcagctctgattcgtgaggttgctagcaagactaatgattctgctggtgatgggactacgactgcttgtgtccttgctcgagaaatcatcaagctgggcattctgagcgtaacttctggtgcaaaccctgtatcactaaagaaaggaatcgacaaaactgtccagggtctgattgaagagcttgaaagaaaagctagaccagtcaagggcagtggtgatatcaaagctgttgcctccatctctgctg

SEQ ID NO: 848 - DNA, 552 bp, Hordeum vulgare
tgtggtcttatcggtatttttattttaaaaatgacgctgaagatttctctgattacaagagtttcagatcaggcgaggaaggttaccgttcgattcgcaaaaatggcaatcctactctagacctttttcactttcagttgatctcaaccaaaattctactgcttggcctgaactgaagcatctaaaaaacacggacgaggcctgaagagctttacaggctcgatcagacggagagctgcccctccgctggctccgcgaccttagccttcggcttgggcttctcgacgacgatcgcttgcgtggtgaggaccattccggacaccgaggcagcgttctggagcgcgcatctcgttaccttggcggggtcgatgacacccgactcgatcaggttctcgtacttgtctgtcatcgcgttgtaacccatctcccactcgctatccttgatcttctcgatcacaacttccccttccactccagcgttgttggcgatcagcgatgccggtgcttgcaatgccttctgaatgatgtcagcaccaaggcgctcgtcgtggt

SEQ ID NO: 849 - DNA, 959 bp, Hordeum vulgare
  UNSURE (1),(9),(55): n stands for any base
nttgttcgntgaaacatggatccccgggtctgcagccattcggcacgaggggtgnaactagctctcgagtttttttttttttttttggggcaaagaggaaggcctagacctttgctaagggtgggtttcaaaaccctgcccttgtcatttgaaaaaaggaagctgttgaggtctgtcacaggcgagctccagccgggccgggtacccgttgtcatggccccctttggagccggaaaaacccctttctttaaccctggggccggaaggggtccgggttataaagggacgggttcagcccttgttaagggagcccatggaagtttccctttttccaaaaaaatctttggttttggccctaaaaacaacgtttttcatggaaacttaactgggggggagaaccttgggttcagcgcaatttgcgggctccctgcaaaaatgtccccccgggatagggttctatttggggagggggttatagaccccctggattttcagggggtcaaaaattcgggggttggaacgggtgaaaagcggggtatttttgggggccaaagaaagccggtcattggggggattgcaaacgcatcgtacccctttcctttgcctcttgaggaacccccctggggcttggaaagattttgccccaaagtgctctccagagattttccccccaggtcattttgaggctcgctctcttgcccccgttttcatcccccgcgcctgtacgttgcatcttctttcgcgcgatcgaacataccgcacaaggggcttcttttttttccttgggcttttcatacatttgtcccgttccttttccgcccttctatcatttgcccgtcctgctatctgtcttgccattgatcgtttcttccgtgcgcttcttaacccttgtccctcgttttgtctccatgtccccctcgcatctattttcgacgccttataaacgctgatacctttgt

SEQ ID NO: 850 - DNA, 541 bp, Hordeum vulgare
aatgactagacctttgctaaaggttgagttcaagaacctgaccttgtcacttggaaaaaggaagctgctgaggtctgtacaggcgagctccagccaggccgtgtcaccgctgtcatgggcccctctggagccggcaagaccacgttccttaacgctgtggccggaaaggttactggttatcaagtgacaggttcaagtccttgttaatggagcgcatggaagtatacgttcttacaagaagatcattggctttgtgcctcaagacgacgtcgttcatgggaacttaactgtggaggagaacctttggttcagcgcaaattgcaggctccctgcaagaatgtcgcaccgtgatagggttctcattgtggagagggttatagactccctggatcttcagggggtcagaaattcggtggttgggacggttgagaagcgtgggatctctggcgggcagaggaagcgtgtcaatgtggggattgagatggtgatggagccatctctgttgatccttgatgaaccaacctctggcttggacagttcc

SEQ ID NO: 851 - DNA, 519 bp, Hordeum vulgare
cttcagtgaagaagagaaacagttgtccaaaccactcaagttgagctgcaagctcaataaggctgcatgcaaactcaaacttaaagactacaaggaagcgaaggaactgtgtaccaaggtgctggaaatggacagcacaaatgtgaaggccttgtacagaagggcgcaggcacacatgcatcttgttgatctcgatttggcagagctggatatcaagagagcactggaaatagatccagagaacagggatgtaaagatgggctaccggaggttaaaggagaaggtcaaggagtacgagagaagagatgccaaattctacggcaacatgatcgacaagctgagcaagctggaagatgatgagggctgcaagagcagccaggggccaagcaagaatcctcgcggcctgtggcctctggcgccgtttttcacgaccgatggcagcaagctgtggctggtcctaaggctactgatccctgtgatgatattggtcgcgctttgtgtcgcttactacgtgcaggg

SEQ ID NO: 852 - DNA, 552 bp, Hordeum vulgare
gatgcacaatgaacattgacacgcataaaatgattgttcatgcaagacacagtcaagagaacaaatatatttaccatgagcatgcaatcgacccaccacgacatgacacggaagcagaacagtaggcgaacccgggcatatcaatcaacgcatcaacagttcatgcagtctatttcatgaactccgccctgcacgtagtaagcgacacaaagcgcgaccaatatcatcacagggatcagtagccttaggaccagccacagcttgctgccatcggtcgtgaaaaacggcgccagaggccacaggccgcgaggattcttgcttggcccctggctgctcttgcagccctcatcatcttccagcttgctcagcttgtcgatcatgttgccgtagaatttggcatctcttctctcgtactccttgaccttctcctttaacctccggtagcccatctttacatccctgttctctggatctatttccagtgctctcttgatatccagctctgccaaatcgagatcaacaagatgcatgtgtgcctgcgcccttctgtac

SEQ ID NO: 853 - DNA, 518 bp, Hordeum vulgare
cagatcctggcggccggaggcgtgtgggtgttccggaaggacggggtgatggagctgaagagcgccgaggtgcagccgtcggcggcgccggcgccgagcaagaaggcgctggtgtacgtgccggcgaacgagatgatgcggtcgctggaggcgctggagcagcggctggggtcgctgggctgggagcgctactacgagaaccgagacatcgtgcagctccaccggcgcgacggcggcgtcgacctcatcgccctcccgcgagactttgccaggttccggtccacacacatgtacgacgtcgtcgtcaagaacaggcaccacttcaaggtcgtcgacatctagacatgcatctttctggttcatgttttggtcgaatctgattgcggtactggatgttgctctattctccttagagtcgtggcggggttttggatgatgctaggttttcgcctcatacccttgtattcctgatgacaggcgcaaggcggtgggtttcctagcattgctctgagctcgct

SEQ ID NO: 854 - DNA, 548 bp, Hordeum vulgare
tgggcttctcccctttcattaaatgctaacggaaatcattgatttgttccgagaccaaagagaaaaagggaaagagagagaagcgagctcagagcaatgctaggaaacccaccgccttgcgcctgtcatcaggaatacaagggtatgaggcgaaaacctagcatcatccaaaaccccgccacgactctaaggagaatagagcaacatccagtaccgcaatcagattcgaccaaaacatgaaccagaaagatgcatgtctagatgtcgacgaccttgaagtggtgcctgttcttgacgacgacgtcgtacatgtgtgtggaccggaacctggcaaagtctcgcgggagggcgatgaggtcgacgccgccgtcgcgccggtggagctgcacgatgtctcggttctcgtagtagcgctcccagcccagcgaccccagccgctgctccagcgcctccagcgaccgcatcatctcgttcgccggcacgtacaccagcgccttcttgctcggcgccggcgccgccgacggctgcacctcggcgctcttcagctc

SEQ ID NO: 855 - DNA, 517 bp, Hordeum vulgare
  UNSURE (15),(16): n stands for any base
ccaccaccacctcgnnacctcggcttcatgggtcttcaaccgggtgacatatccaacatgctggaatggtttgaagaacttggcgtggagatggagatatccgacatgtcgctctcggtgagcacgcagctctccgggggcggcaggtgcgagtggggcagccggaacggcctctcaggcctcctggcacagaagagcaatgccgtccgccccgccttctggcacatgatccgtgagatcctcaagttcaaggaggatgctctcaagtacttggaggatcatgagagcaaccctgacctggaccggcacgagactctcgggcagttcatcaagacgcatgggtactcccagctcttccaggaggcttacctgatcccaatctgtgcaagcatatggtcatgcccgtcgcagggtgtgctcggcttctccgctttcttcgtcctctccttctgccgcaaccatcacctccttcagatctttggtcggccccaatggctcaccgtcaaagggcgttcgc

SEQ ID NO: 856 - DNA, 525 bp, Hordeum vulgare
caaatgtctgatggtatatttgttcacccatgttaaaccacgccttacatgaaccaatcaatgaatcaccctgtggtagcactatgatcgacacttcacacgctccttctatggaaattacaatttttcgaccttaatttgtggataattaaatccagcctctatgtataggtatgggtttgaatggttgtgcacttgttcaatgaactggctacgctgccggaagacttgcgtaggggttgtcggcgtaggcgagcttgtcgttgccaggtcgagaaaacacaatctggtaagttccaagcgtccgtgacttgaaaccggcagcacagtatatgaaatagtactcccatacacggatgaacttgtcgtcaaacccaagagccaaaattgcgtcttttttggccatgaagttatccctccagcgtatcagcgtcgggtagtaatggtagccaatgttctcaacctgctcgatgcagagccttgacgcggcggacatggcagacgtgatccgggccaaggaaggaa

SEQ ID NO: 857 - DNA, 126 bp, Hordeum vulgare
cctcgtgccgaattcggcacgagggagaactagtctcgagtttttttttttttttttttttttttttttttttttttttttttttttttttttttttttttttttttttttttttttttttttttt

SEQ ID NO: 858 - DNA, 524 bp, Hordeum vulgare
ctattactttgggtgaagattaacataatgacaaggaccataaggtccaaatagttcagagaaaaatccgttcttccttttcgggttgcatcccatgtcctggcatagttgatcattgtaccaaatatgaacaattccaatgcatgacctacggaaatagtctcgagagtagcgcttcataaacttctcccattcaaggacatctctttgcatttctctgacacttggcaatctgaaaccaccatccataaaatgggatatccacttggccataagttctgttgtatatatatttgtcaagctctctgaatagccgatgactgcaagttgtggaatcttaggatggatgcactccctataaagtggcacagtcattgatgttgagccaacgactctactctggaagaactctgaagtgaacatgtccttgatcttttgatcacccttaaatccggttccgaagataacgatgtcactctttactggagtgcattcaccttcaacttgcacaccttcttcacaaa

SEQ ID NO: 859 - DNA, 532 bp, Hordeum vulgare
ggcattcggcacgagggtccaaagcaatctacctatgacaccgctacaaaccctgcttctcctacttgtcttccatgccttgctcgccatcaccgccgagtttggcgtgccctctccgccaccagcgccggcgccggctgagccaaaaacttgccctgccaagtgcggggaagtagagatcccctacccattcggcatcggcactggatgctccctgtcagacgactttgccctgacgtgcaacgagacgacgagccctccgaccctcctcaccggcgaagccaaggtcgccagcatcacgctggagacggcgcagatggtggtctacacccacctgacctatagctgcgacttgccgatcaacagcactgcgaccaggcacacaaccagcagtatggccctcaatgtcgccaaacccttcctgctctcgccgtccgagaacgtgttcacggccgtcgggtgcagcttgacggcaaggatcaacggccgcagcgacatcccctacctcaccggctgcatcacgacgtgcgcc

SEQ ID NO: 860 - DNA, 538 bp, Hordeum vulgare
tcctcaggtgttattttttaaattttaatctcagtctgctcttcaacttctgaaaaaaagagactcacctatcgctgctactccagccgaggacactaggagttcacaacccttggcacttttaccatcaccttttcgtccaagattgcatttacactcataatcgccttctgtatcatggcatgtcccttcatggcaaggatacatgttcttgtaaattgtcgagtttgcggatctccgtagctcgcactcattaatatttgtgcatccattttttatgtatgggttgccagtgtatcccttggagcaaccgcagaaatagccgggtgttccattgctggcatttacacaatagctctgagtgctaacacaagcgccgtaggaaacattctcactgttgccaccatgtggcactgacgggcatgttccatccctaattgcccagtcaagaataactggaacaacagggccgcttccaaatctagtgaggaatgtcatattcccaatcaggtcatttttgctgaaactataccagcct

SEQ ID NO: 861 - DNA, 536 bp, Hordeum vulgare
gaattggcacgagggccgggctaccggcgtgggggctgcggctctctcctcttgccttgtaggatgtaggttgttgtcatggttgaagccaataaggtatgatgttagagtgcaaacatctaacatagaccttggagctgggagctatgaaggagatgaagcaggtggccgtagggaacagttggatagttctggtaccaaaagttcaaatgaaccagcaaaaccagtttcgggatctcgttacatgcaagctgttgctgccgtgctacttctgtgcgccctggcatctgcttttatcgttttctttaaaggacagccatctgcagttgtagctgcactagcaaagtcaggtttcacggcagcatttacactgatttttgtatccgagattggggataagacatttttcattgctgcactactcgcgatgcagtatcaaaaggcattggttttacttgggtcaatggctgctctttccctgatgactatcgtgagtgtcgtgattggacggatctttcagtctgtaccagcacaat

SEQ ID NO: 862 - DNA, 551 bp, Hordeum vulgare
gacatgaaccggcctctctttattgatagcacgactacaggtgcaattgcaagtttacagcgagtttacaggcacaggtctctcgagcatacaaaggacgacaacttatggacagttctattgaggtaagtgtttagtgtccaacacagcaaataggaatccagacatcctaagacacatgcatcgctcgtcaaacatgactcaaatttacacatcgagatcttctgaagggtataggaacgcctagttacatacagtaaaattttgcacaactaaaaaacattagagtggggtctgccctccctcaacctttaggatggactaccacactgcaccgcagaaaacttacggattcttcagatatatcagaacacgccgaaaagtgtcgcggcggcaaataacagaaacagtactcctcccagcaggccaaccagcttctcggataggtagttggctaggaatgctcccccgatgatcgcaagcaaggttgcaatcaggtgtccagctatggccccactagcaacgccccagggagactgtgcggcacccaa

SEQ ID NO: 863 - DNA, 518 bp, Hordeum vulgare
gttttaagaaggaaaatgaatttttccaggagaatttagacagaatcaattcaagtttgcgcatgtacttccacaattatgcagcaaatgagtggcttgggttccgactggagctgattggaacactcgtattgtcaatcactgctttcctgatgatcagcttgcccagcaattttattaagaaagaatttgttggcatgtctctttcgtatggcctttccctcaattctctggtgtactttgcaatatcgatcagctgtatgttggaaaatgatatggttgctgtggagagggtaaaccagttcagtactcttccttctgaggcagaatggaaaaaagaggaccatctgccttctccaaactggcccacgaatggagatattgacatcagcgatctaaaggttaggtatcgaccaaatacacctctaattctgaagggcattaatgtgagcattagaggtggtgaaaagataggagttgtaggaaggacaggcagtggaaaatcaactttgattcaa

SEQ ID NO: 864 - DNA, 550 bp, Hordeum vulgare
  UNSURE (48): n stands for any base
gtcgcacgagatctctttcttagatggtggaaacaaaattgtcacaancttaaataccaacagcctttctaaatgacaccacaacaacagcactgggggcatactctccaaacttccacctttatttcttgatgatgtatcacgcggtatatacactcgagcagtcgacctatcaaaaacgactgctatttattccttcataacatacatatacctccgtatccgggagcaagatgctagaggttggaggagcggtcggcgtactcctcgaccatcgccccgaagagggacgacggttgctcgagcaacctcgacggtgcgtcgaattccttcaccagacctgcgtccagaaccaagactcgatcacagtccatgaccgtcggtatcctgtgcgcaatgctgatgattgtacaggatgagaactgctctcgcgtgatcttctgaatcgtcgcgtcagtttgagaatcaactgaagcagttgcctcgtccataaataagatttggttctgcttcaggatcacccggccaaggcacagaagctgtctttggc

SEQ ID NO: 865 - DNA, 516 bp, Hordeum vulgare
aaatatcaagctgggcattctgagcgtaacttctggtgcaaaccctgtatcactaaagaaaggaatcgacaaaactgtccagggtctgattgaagagcttgaaagaaaagctagaccagtcaagggcagtggtgatatcaaagctgttgcctccatctctgctggtaacgatgaacttattggagccatgattgctgatgccattgacaaagtgggtccagatggtgtcctttcgatcgagtcgtcttcgtcttttgagactactgttgatgttgaagaaggaatggagattgaccgtggctacatttcccctcaattcgtgacaaaccttgagaaatcgattgtggagtttgagaatgctagagttcttataactgatcagaagatcacaagcataaaggaaatcattccacttctggagcagactacacagttgagatgtccgctattcattgtagccgaggacattactggtgaagctttggcgactcttgttgttaacaagctcagaggtat

SEQ ID NO: 866 - DNA, 545 bp, Hordeum vulgare
tggtcttatcggtatttttatttaaaaatgacgctgaagatttctttgatccacagagtttcagatcaggcgaggaaggttacctttcgattcgcaaaaatggcaatcctactctagacctttttcactttcaattgatctcaaccaaaattctactgcttggcctgaactgaagcatctaaaaaacacggacgaggcctgaagagctttacaggctcgatcagacggagagctgcccctccgctggctccgcgaccttagccttcggcttgggcttctcgacgacgatcgcttgcgtggtgaggaccattccggacaccgaggcggcgttctggagcgcgcatctcgtcaccttggcggggtcgatgacacccgactcgatcaggttctcgtacttgtctgtcatcgcgttgtaacccatctcccactcgctatccttgatcttctcgatcacaacttccccttccactccagcgttgttggcgatcagcgatgccggtgcttgcaatgccttctgaatgatgtcagcaccaaggcgctcgtcg

SEQ ID NO: 867 - DNA, 461 bp, Hordeum vulgare
  UNSURE (9): n stands for any base
tggggggcnatgttcgacaaagacagttttgttgagacatttgaaggatgggcgaagtcagtagttactggtagagcgaaactgggagggattccagtgggtgttatagctgtggagacacagactatgatgcagctcatccctgctgatccaggccagcttgattcccatgagcggtctgttcctcgtgctgggcaagtctggtttccagattctgctaccaagacagcgcaggcgatgttggacttcaaccgtgaaggattgcctctgttcatccttgctaactggagaggcttctctggtgggcaaagagatctttttgaaggaattcttcaggctgggtcaacaattgttgagaaccttaggacatacaatcagcctgcctttgtatatatccccaaggctgcagagctacgtggaggggcttgggttgtgattgatagcaagataaatccagatcg

SEQ ID NO: 868 - DNA, 516 bp, Hordeum vulgare
  UNSURE (9): n stands for any base
aatactagnattacatcacgggactacagcatatcaagattgaacaactctagatcgccagtgttcttaccaacggtagcccacccaccgccagcattcatctcaaatcttctggaagcgtaactaacacatccaactacacttatcaaccattcggagaagccaaaagcaggttgttcctcgaataatgggagaagactgcaaacaagttttacaaaacaatggttgactcagatcagctatggtcggttacagccgaatagtatcccttctatatatgtacttcaagagaaaccgatatcatgcacattctgcattggatgcgttggtatcatctgatcatttaaggaccttcttgacttcctcaacaaactgtgctctccttgagggatccatcttctctagtagcatagaaagaccctgtggcaaggcctgtagatctggactggagtctgcaacatctgagagcaactgagataccctttgagccctgagttctttgatatactcctggta

SEQ ID NO: 869 - DNA, 550 bp, Hordeum vulgare
gtcccccgggctgcaggcgtcagccgccgctccggcagcgccggcctcagcagcgtcagcaatggcggaaggatcagatgcatgcaggtgtggccgattgagggcatcaagaagttcgagaccctgtcttacttgccacccctcaccacggaggccctcctgaagcaggttgactacctgatccgctccaagtgggtgccctgcctcgagttcagcaaggttggcttcgtcttccgtgagcacaacagctcccccgggtactacgacggccgatactggacaatgtggaagctgcctatgttcgggtgcaccgacgccacacaggtgctcaatgaggtcgaggaggtcaaaaaggagtaccctgacgcctacgtccgtatcatcggcttcgacaacctgcgtcaggtgcagtgcgtcagcttcatcgccttcaggccaccgggttgcgaggagtccggcaaggcataaagtgcaagttgaagtaaccgatatacatgccatgttagttcacattggtcggtcggtagctctgctttctcaattttacttc

SEQ ID NO: 870 - DNA, 556 bp, Hordeum vulgare
gaagatctttggtatttcactaacaacttttgcattagataatacacaacatacgattgagcaaaaaatgcatgagaagaaaacaatacaagacataggcatttccagctgcaaacaaagtatgtatagccggtactatgattctcatatgcatcttcctcgacctacgttggtaggtgcttacatacatatgctcgtatattcacatatgattggaacaagaagtaaaattgagaaagcagagctaccgaccgaccaatgtgaactaacatggcatgtatatcggttacttcaacttgcactttatgccttgccggactcctcgcaacccggtggcctgaaggcgatgaagctgacgcactgcacctgacgcaggttgtcgaagccgatgatacggacgtaggcgtcagggtactcctttttgacctcctcgacctcattgagcacctgtgtggcgtcggtgcacccgaacataggcagcttccacattgtccagtatcggccgtcgtagtacccgggggagctgttgtgctcacggaagacgaagccaaccttg

SEQ ID NO: 871 - DNA, 486 bp, Hordeum vulgare
cccaccttgtcgcacaacatcagctgttgggagcaagaataatgcactcttattggtaaaagtaattcctccagttgcgattgccctgatctctttcatatgctttatggtcactcttctaaagagaaggcaagcagaaacagctccatgctacaaggagacaatgaagaagatttcttacggtgacatcgttaaagctaccaactggctctctccggttaacaagatcagctcaagtcgcaccggttcgatctacattggaagggttgagtttgacacggacttggttgccatcaagttattccatcttcaggagaatggtgcacgtgacagcttcgttaccgagtgcgaggtgctgcgaaacacccgccatcgtaaccttgtcaaagctgtcaccgtatgctcgacagtggacctagagaacaatgaattcaaagctatagtttttgacttcatggccaatggaagcttggacatgtgggtgca

SEQ ID NO: 872 - DNA, 552 bp, Hordeum vulgare
cgccaggttcttagaaatatactctagatacaaataacacaattaggaaatacgtactagttttctaacatagggagctccagtactgaacatgtactctttctaggaacttacatattaataactagagttctgatgcttttcaaatattaataactagaggtctgttcagccaggatttacagcaaagtatccacgtcacagatttttattcaagaacgtgcagatctgcaggttaatcagcagaactcaaagaatgcctctttgatagacaaaattctggcacaaacttcccccattcccggtcgatctttaggcgattccatggaacacaggagggcaacttcaaccaagtgtaccatgtatctccgcataaacactctgccacacgcatgctgctgctcgtgggacaaatggggatctaaaacctctccgagtctacctggaaacgctgagctaacaagcttgtgcaggctcaggccatcggtgaacatcgcatccgtcggtcgcctacgggtgagcatttccagaagcaagaccccgaaaccatag

SEQ ID NO: 873 - DNA, 519 bp, Hordeum vulgare
gtcagccgccgctccggcagcgccggcctcagcagcgtcagcaatggcggaaggatcagatgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtcttccgtgagcacaacagctcccccgggtactacgacggccgatactggacaatgtggaagctgcctatgtttgggtgcaccgacgccacacaggtgctcaacgaggtggaagaggtcaagaaggagtaccctgacgcctacgtccgcatcatcggctttgacaacctgcggcaggtgcagtgcgtcagcttcatcgccttcaggccaccgggttgcgaggagtccggcaaggcataaagtgcaagttgaagtaaccgatatacatgctatgttagttcacattggttggtcggcagctctgctttc

SEQ ID NO: 874 - DNA, 554 bp, Hordeum vulgare
ggcctacggttggtagggtgcttaaataccatatgctcgtatattcacatatgattggaacgagaagtaaaattgagaaagcagagctgccgaccaaccaatgtgaactaacatagcatgtatatcggttacttcaacttgcactttatgccttgccggactcctcgcaacccggtggcctgaaggcgatgaagctgacgcactgcacctgccgcaggttgtcaaagccgatgatgcggacgtaggcgtcagggtactccttcttgacctcttccacctcgttgagcacctgtgtggcgtcggtgcacccaaacataggcagcttccacattgtccagtatcggccgtcgtagtacccgggggagctgttgtgctcacggaagacgaagccaaccttgctgaactcgaggcagggcacccacttggagcggatcaggtagtcgacctgcttcaggagggcctccgtggagaggggtggcaagtaagacagggtctcgaacttcttgatgccctcaatcggccacacctgcatgcatctgatccttccgccattg

SEQ ID NO: 875 - DNA, 551 bp, Hordeum vulgare
gtcccccgggtctgcaggttttggcaggcgtaatggtgagcgcaggagaaagtccgtccgtggttgcattgtcagccaagacctgtctgttatcaacttggtgattgtcaagaagggtgagaatgatctaccaggccttactgacactgagaagcccaggatgaggggacccaagagggcttcgaagatcaagaagcttttcaaccttggcaaggatgatgatgtccgcagctatgtcaacacataccgcaggaccttccttaacaagaagggaaagaaggtgagcaaggcccccaagatccagcgtcttgtgactcccttgaccctccagaggaagcgtgccagaattgccgacaagaagaagaggatcgccaagaagaagtcagaggctgcagagtaccagaagctgcttgcacagaggctgaaggagcagagggatcgccggagtgagagcatggccaagaggaggtcgaagctgtctgctgccaccaaggctccggctgtctctgcttaagatgtttacagtctttcgttattaattataatggcga

SEQ ID NO: 876 - DNA, 558 bp, Hordeum vulgare
caaaactgcattcaattaccaagttatgcaaatttgtccattcagtaaccaaagtcccgacgataaggtaccatgttcacgcaaaacagcatcaattacaactcaacaacgctcaaagtagcagctagattcatatcatccaacaaagtgcttgaaactctttcgccattataattaataacgaaagactgtaaacatcttaagcagagacagccggagccttggtggcagcagacagcttcgacctcctcttggccatgctctcactccggcgatccctctgctccttcagcctctgtgcaagcagcttctggtactctgcagcctctgacttcttcttggcgatcctcttcttcttgtcggcaattctggcacgcttcctctggagggtcaagggagtcacaagacgctggatcttgggggccttgctcaccttctttcccttcttgttaaggaaggtcctgcggtatgtgttgacatagctgcggacatcatcatccttgccaaggttgaaaagcttcttgatcttcgaagccctcttgggtcccctcatcctgg

SEQ ID NO: 877 - DNA, 495 bp, Hordeum vulgare
attagagttggagaaacctagtggacgttgggagacaaggtccactattccgatgcaatcatttgaaaatgctctgactgtgcgcattgttacattgcataacacaaccaccaaggaaaatgaaaccctgatggccattgggactgcttatgttcaaggggaggacgtagctgccagaggccgggtgcttctgttctctttcactaaaagtgaaagttctcaaaatctggtaacagaggtctactcaaaagagagtaaaggtgccgtatcagctgttgcatcacttcaaggtcatctgctgatagctgctggtccaaagatcacattgagcaaatggactggttctgaattgactgctgttgcattctatgatgctcctttgcatgttgtgagcttgaacattgtcaaaaatttcgttttgtttggtgatatccataaaagcgtatattttcttagctggaaggagcaaggttctcaattgactctccttgcaaa

SEQ ID NO: 878 - DNA, 534 bp, Hordeum vulgare
attatcatacaaaaaaagagtcgttataaaggaggcagctaggaaggaacatgcaagacgcccaacaattagaccaaaatcaaccaccatggccatttacagtgcgcttccaaatgttaaccaatatgtacgcatcacggtggctataatttgccgagaaagatcaaactggccagcagaggttacaccatttaatcctatcatacagatgtcatgtttacaagaaggcctggcgcctgggggtctaggtcaccggagttacgaagagtcgctgagcggcagaatcgccgtgtgccgctagctcttccatctgtatcaaggtcttggatccaaaatgatcgctcaaacttcaattcacaggaaacttgtgcccagcgaaatatcactcaagttggaaatgatctgagcgcgggtagtcccaatctgctgcgcaatatccagctgctcttctaacgataacatctcatagtgtgcaaggagctcaaagtcaatgatgttatctggcccaggacgatgtgccttcccgttggattt

SEQ ID NO: 879 - DNA, 401 bp, Hordeum vulgare
gatggaagccataatgtgggattacaatccagaataatggatgcagaaatagatggaggtacgcgtatccatgctgattccatggaagtgcatgtgggtcttcagaaacaacaaaatcaagcttcaaatctgcaggatcgggagagaacaaaggctacccagtttattgatgatgagcataggagcgataatcaaggtcaaggggttagtgcaggtttgattgctcaaagaagttcagccaagtcaatctctgattcaggctctgaccttctaaattccctgacgaaaagtcagatgcacacaatacctgagcaaaactcagctttaggtgttcagaaagtttgcacagcctcttctggtcctacatctccccatgttgagataccacactctttagtttc

SEQ ID NO: 880 - DNA, 382 bp, Hordeum vulgare
tttatttcactggggcatatgctcacacaaacatactagctcaagcatgtcaaccaaaaaacactctactctactgctgggaagaaatggttactctagattacactactgttacatgcgcgatttgctgggcaagaaatctgacagctcgttgtcgcctgctacaaacttgaactccagttcaaagaaacgctttcccaggccacaactcctctttatctcagccccaacaaacttctactgcattcgagggccagaaaggaaatcagctggtccccttccagtcaaatgaggttgcaaaagcggcactgtatgactgtatcagcagacatcctatcaacctgcaaagttaggttgcctatcaccgccagaagaattgtct

SEQ ID NO: 881 - DNA, 533 bp, Hordeum vulgare
aggaattcggcacgaggggccacttcacacaggcaagcaagtggcagcgcggctcagaggttcaagcatggcggctccgagagcgctcgtcctcgccgtcctgctggcgatcgccgtcgccaacgccgagccggcgtccgtcgtcgtcggcctggccaagtgcgccgactgcaccaggaagaacatcaaggccgaggaagccttcaagggtctccaggtcgcgatcaagtgcaagaacgtcgacggcgagtacgagagcaaggcggtgggtgccctcgacggcaccggcgccttcagcgtgcccctcgacgctaacctccgcggcgtcgactgcgtcgcgcagctccacagtgccgcctccaacgcgccgtgctccggccaggagccatccaagatcgtgccggtttccgagggcaccaccttcggcatcgtcgccggtgacaacattgccacgccgtctgcagcgtcgccggagtgccagtccatgaccctgtgcgggcccatcaagaaacacatcatggagcacttccacc

SEQ ID NO: 882 - DNA, 512 bp, Hordeum vulgare
tagtaatttcttgctacacaaaatgacacaaatattacaaacctgggttaaaaaaaaaactgacacccactgacccgtgaccgtcataacagttattccgaattcattctgcaaatactggaaaacgtggtagggaatgataaaaggccaaaccaaccgcgcgtgcggcgatcataaatagcaacgtcactcagcatgaaaccatggggatttcagtgctgggctagctggacggtcgtagaacggaatcagtggtgaccgtggtatccaccgccaccgccgccgccgccgtaggtgggcgtgggagggacggggtggtagtccgggtggggctgcggcttgggttccggcttgggcaccgggccgtagtctgggtggggctggggcttgggctccggcttcggtggcacgggcttcttgtggtggaagtgctccatgatgtgtttcttgatgggcccgcacagggtcatggactggcactccggcgacgctgcagacggcgtggcaatgtt

SEQ ID NO: 883 - DNA, 477 bp, Hordeum vulgare
gtctatctcaatcctctgaggttcaagaaaatttatgacaggaggggtctttgtatctttcatccattcgagagtttctgtgttgcaggtaatgttatgcactcatgcctttacatacttactttgcaggcgtaactaaatacattttctttttgattatgggacaatgggttgctggaattgatgtcttttatatccttgttagtgttattctctctcgaaacaggctttcaccccgctttatatataaagcaaatattccatcatccagacaaccacatccgaccaaagtgagaaaaacataaaatagctggggccacatccttgttagtgttattctaatggtacaatcatccattaaagcttgtttcttgcttatattcgtatgtgtatattgtatttggtaatattgatgtgcatagctgcagtattggtttctttgactgatttagtatttctttgaatgcatagctgcag

SEQ ID NO: 884 - DNA, 549 bp, Hordeum vulgare
gcttccaaatcactacctgatacatgtgcccgaaacaacatatagttcgaatcaaatacaagagtcaacagcagacactacacagcacaaatgcaagcaatgtcgatttgactagttccacacaggttactgaaataacagcagcagccgttatccaaagccgatacaaattcattctgactacatggagggccaatttctacacggaccacagcccacatcatggaagatggaagaacctgcgatggtaacttggtaagacatcgccacatctcagctactggaacataactctagatacctgcaggaaaaataagttaattggtcaaaccaaactgtattatccattcaatgcatgccatgtccaagaaacggtgaatgcatatcattgccattgttcaacttgaaaatggagtctttttataccattagacaaatacaatatttcaaacagagggtagagatagaacaacacaagaatggattatttttattggaatatttctgttcttgacgtgttttagtaattgactactacggacacttgtt

SEQ ID NO: 885 - DNA, 518 bp, Hordeum vulgare
gccgtcggcggcgtggtgccgctgcacacccacccggccgcctccgagctgctcttcgtcaccgagggcaccatcctcgccggcttcatcagctcctcctccaacaccgtctacacaaagacgctctacaagggcgacatcatggtgttcccacagggcctgctccactaccagtacaacggcgggggctcctcggccgtcgccctcgtcgccttcagcggccccaaccccggcctgcagatcaccgactacgcgctcttcgccaacaacctcccgtccgccgtcgtcgagaccgtcaccttcttggacgacgcgcaggtcaagaagctcaagtccgtgctcggcggcagcggctgatcaagctctctgcaaggtggtttctgttggtgtcaccgtgtgggattaactagacgattacaccgccagagatggttttctacctccaccgcgtgcatgttatgttatacagtgtgcgcgcacgcatccatcgtctatcgccaattggagattcgtgcaac

SEQ ID NO: 886 - DNA, 554 bp, Hordeum vulgare
  UNSURE (35): n stands for any base
tccaatctctgtttattggtacgcggtgaaagatnattgatacattttgaaagaagaagaaaaaaatctcaacaaaacattatacaataataatttaggacaagacaattttgacaaaactaaaaaatgttgcacgaatctccaattggcgatagacgatggatgcgtgcgcgcacactgtataacataacatgcacgcggtggaggtagaaaaccatctctggcggtgtaatcgtctagttaatcccacacggtgacaccaacagaaaccaccttgcagagagcttgatcagccgctgccgccgagcacggacttgagcttcttgacctgcgcgtcgtccaagaaggtgacggtctcgacgacggcggacgggaggttgttggcgaagagcgcgtagtcggtgatctgcaggccggggttggggccgctgaaggcgacgagggcgacggccgaggagcccccgccgttgtactggtagtggagcaggccctgtgggaacaccatgatgtcgcccttgtagagcgtctttgtgtagacggtgttggaggaggag

SEQ ID NO: 887 - DNA, 518 bp, Hordeum vulgare
cgcctccgcctccgcctccgcggcgagggacccccccgccgagctggtggaggtgcccctcgcgcagacgggggaagggatcgccgagtgcgagctgctccgctggttcgtcagcgagggcgaccaggtagatgagtttcagcagctctgtgaggtacagagcgacaaggcaaccattgaaattacaagtcgtttcaagggaacagtgcatcagattcagtttgcacctggtgacatagtaaaggtcggtgaaactttacttaagatggttgtcagcggcagtcaagttgtacctcatgatagcatggcttcatcccccgacgttgcacttggagtggatgctacaagtccttcaagggaaggcaatgctccccgtggatctctctccacaccagccgtcaggcatctggtgaagcagtatgggctcaccatcgatgatattcagggtacaggaagagatggtagagttttgaaagaagatgtgctgaattacgccgccagcaagggccttctccagg

SEQ ID NO: 888 - DNA, 552 bp, Hordeum vulgare
tagcttatttcaagtttcaaggtgatgcacacatatgcaccagggtgatcacatagcttgcagcagagaggccacgtcaatcaattattggtcacatatatacttgagttgattgactccctatggccctatctaccaacctcagatggcagagttccctctgcatgcaggcagttatcttactagatcaccgcgtgtgcagcaagagcagctccggcttctccaccaggcttttccactcgttgcaaaaccttgcaaccgtggcaccgtcgacgactctgtgatcggctccgacggtcacattgattatcgaggacgggtaaacgttttcgtcatcatcaaagcgaggaagcttctgaatgcggccaagagcaatgatcgcaacctcgggtaggttgagaactggggacccaaacttgccaccgatggcgcctatgttgctcagcgttatggttccaccagtgatatcgttggtgcttagtctgttgtgcaatgccatctcgtgtaatcttgacagttccttcgtgatctccaatatagaaagtgactgga

SEQ ID NO: 889 - DNA, 546 bp, Hordeum vulgare
gtcccccggctgcaggaattcgacgagggcctggcgtctgcccttgatcggaaacctccatcagatcatgacgtcaaagctgcccgtcgtcctccgggacctggccaggaagcacgggccggtgatgtaccttcggctggggcaggtcgacgcggtggtggtgtcgtcgccggcggcggcgcgggaggtgctccgggacaaggatgctgcattcgcgtcgaggccgagagtcctcatgtcggagatcagtctgtacgggaacctcgacatggccttcgcgccgtatggcgcgtactggcgggcgctgcgcaagatctgcgcggcggagctcctgagcgagcggaaggtgaggcaattttgggcggtgagggacggcgagaccatgtccctcgttgccggcgttggcgaggcaagcaggggcggcaagccgttcagcctccgcaggctgctggtgctgtgctccaactccataaccgccaagacggcgttcggggaggtgtgcagctcggagctccaggagcagttcctggcggtgatggatgaggt

SEQ ID NO: 890 - DNA, 549 bp, Hordeum vulgare
tctgcactattattatttagatagggaaggagtagaaaattaatcacttgttacttaattaccatgataattgccttgacgttatccagttccatcgggacggagatggagtcgatctcccccttgtccctgatgctaagcagagagccgaggacgtgatcacctggccgcatctcagactgagagatgatcttgtcgaggagctcgtcctgctgccggcgggctcgccatagccggcctctcagcccggtgaccacgtcgaggaaccacagcgaagggaagaggtccccgacgcagagccccgtgccgagcttgagcacctcatccatcaccgccaggaactgctcctggagctccgagctgcacacctccccgaacgccgtcttggcggttatggagttggagcacagcaccagcagcctgcggaggctgaacggcttgccgcccctgcttgcctcgccaacgccggcaacgagggacatggtctcgccgtccctcaccgcccaaaattgcctcaccttccgctcgctcaggagctccgccgcgcag

SEQ ID NO: 891 - DNA, 518 bp, Hordeum vulgare
gcaggctttgacccccatcgccgccccccctcctcttcgtctccggccagccaggtagttaacagccatgggcaaagaaaagatccacatcagcattgtggtcattggccatgtcgactctggcaagtcaaccacgactggccatctcatctacaagcttggaggcattgacaagcgtgtgatcgagaggtttgagaaggaagccgctgagatgaacaagaggtcattcaagtatgcctgggtgcttgacaagctcaaggctgagcgtgagagaggtatcaccattgatattgctctgtggaagtttgagaccaccaagtactcttgcactgtcattgatgctcctggtcaccgtgatttcatcaagaacatgatcaccgggacctcccaggctgattgtgctgtgcttatcattgactccaccactggtggttttgaggctggtatctctaaggatggccagacacgtgagcatgctctccttgctttcactcttggtgtgaagcagatgatttgct

SEQ ID NO: 892 - DNA, 549 bp, Hordeum vulgare
cgactccaaatgatgacttatatggtagcaacattaactgatgaagttccaccaacacaaccgaacgatacaatgaccagagctttaagcagttcaaacacttctcgacacaaataacccaagcgactaaaacaactatcgccaccaccaaacaccgccaccgccaccatagatgtggtaaagaacctgacaccatctcatttcttcttgatcgcagccttggtaaccttggcgccggtcggctccttcttttccacgctcttgatcacacccacagcaaccgtctgcctcatgtcacgcacggcaaaccgacccagaggagggtactgggcaaaggtctccaccaccatgggcttggttggaatcatcttgacgaacccagcatcaccgttcttgaggaacttgggcgccgcctccagctccttgccggaccgcctgtcgatcttggtctggatctcggcgaacttgacggcgatgtgggatgtgtggcagtccagcacaggggcataaccgttgctgatctggccagggtggttcataatgatgacc

SEQ ID NO: 893 - DNA, 524 bp, Hordeum vulgare
acgagggtttatacccgacatgatgccctctctgctggatcttctgaatgacgagacgccggcggtcgcgagacaggctgttaaaacgggaacagacttatttgccaaagtactgcaagagctcgttgtccagggtttgttctcgagtggggggatcgaggattcgctcaaatcatcatgggaatggatgctcaagcttaaatcagcggtgtcgctcatggcattccagcctaccggcaatgaaggagtcaggttgctggctgttaagtttgttgagaaaacagttcttatgcacaccccggatcctaatatcacatctgatccaccaaaccaagccacagaagatatgggattcaatatagcatggttaaggggaggtcaccctttgcttaatgttggtgacctagccatggaagccagccagagcctgggactgttgctagaacaactgaagtctcctaaaataagactactcagcacttcgatgatcattgtcttcgttactagtctctctgctattgctc

SEQ ID NO: 894 - DNA, 541 bp, Hordeum vulgare
  UNSURE (2),(3),(23): n stands for any base
gnnaacctttttttactacaatnccttgtttaatgttctgttctacataccacttttgtggactggaatacaggctacccaaacagatggaacctttttttactacaatccttgtttaatattctacataccactttagtggactggaatacaggctaccgaaacagatggacagcagggctcaacaacaactttctcctaccgctattttcaaatttttggtgtagcaaaatgctttatacgaatcgcgcagcaactgaacattgcttctcccacatggtcttgccatgccatctttcccggtactacatcaatgcgggtagcgcctcgtcgcctgggaaatgactccattcggttccagcaaatgcagagaaggccttcccagggcctgcgggggaaatgtcaactggcggcggaggattcctgggtcacttccgtcgtggcctctgcggcagagctgctggtctccgtggcctggttctggctgctctgcgcctcgggtgcgggctgctgctgttgatcttcggcgagacccagaacc

SEQ ID NO: 895 - DNA, 924 bp, Hordeum vulgare
  UNSURE (1),(775)..(923): n stands for any base
ngacccccgggcctgcaggaattcggcacgagggtaggaagtaagatggagcacatcattacggaattggcttatgaggttgcccagaagcatacggctattcgaggagatttagtagttgccccttcagatgacttcttttggttccaccggcctaaattagtccttctgttgatccatgtcgtcctatttcaaaatgcatttgaaattgcatttttcttttggctcttggtgacatatggttttaaatcatgcatcatggggaaaccagcatatgttattactcgaattgtcataagcgtaatttgccaactcctttgtggttacagcaccctaccactatacgctatcgtctctcatatggggaattctttcaagaagactatatttgatgacaatgtgtctgaaggccttgttaactgggctgaaaaggctaggagaggggcaagaaggccaaataaaactactatagaaccaattgacgaggcaaatgttggcgcagttcaaatgacaaatacgcggacaaactcatcggtggagaaagggaccgctaggctgatataattatgtgcattagttgctatacaaagggtcctaatagtaacattttcgacaattgtacaaatatcatttttaggtgccatacgtatcttttgataatgctagttattcatgtgttcaaggcattattaattcttttgaataaaattctcaccttctataaaaaaaaaaaaaaaaaaaaactcggggggggcccggcccaatcgcctgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 896 - DNA, 522 bp, Hordeum vulgare
  UNSURE (18): n stands for any base
gaattaataatgccttgnacacatgaataactagcattatcaaaagatacgtatggcacctaaaatgatatttgtacaattgtcgaaaatgttactattaggaccctttgtatagcaactaatgcacataattatatcagcctagcggtccctttctccaccgatgagtttgtccgcgtatttgtcatttgaactgcgccaacatttgcctcgtcaattggttctatagtagttttatttggccttcttgcccctctcctagccttttcagcccagttaacaaggccttcagacacattgtcatcaaatatagtcttcttgaaagaattccccatatgagagacgatagcgtatagtggtagggtgctgtaaccacaaaggagttggcaaattacgcttatgacaattcgagtaataacatatgctggtttccccatgatgcatgatttaaaaccatatgtcaccaagagccaaaagaaaaatgcaatttcaaatgcattttgaaataggacgacatggatc

SEQ ID NO: 897 - DNA, 553 bp, Hordeum vulgare
gtctccccgggtctgcagggaattcggcacgagggttgttgagtgatgaaccagagagtggaggtttgctttactgttcatggtcattgttatggctcagggccttgtatgatataagatagcatcttgtgtgctgaagtttgtgttttggattgaagttggattgaatcgttaaccatgggatggggaccagagaatttgggaactatgttttgataattgatcctcaatttagcttctttgtttgcagtcaaattaagcttaaagcatctctgatattgactgttggttctccagctattggacttatgggactttctggaaggtgccttgttttgactgttggtttacagggggtttcttctgttgacttcatctttcctgatttgctttgaacattgtacttccaagacatgattttctctgcccttggtaatcatgtgcccttgcagacattgacatggatgagagataatatagttcgctatctggaagactgggactggcgttgttgcctaactagccaagcaatcttatcctatcccctcactgt

SEQ ID NO: 898 - DNA, 552 bp, Hordeum vulgare
aaattgagaaacacttcttttacttacaatccttgtttaatgttctgttctacatgccacttttgtggactggaatacaggctaccgaaacagatggaacctttttttactacaatccttgtttaatattctacataccactttagtggactggaatacaggctaccgaaacagatggacagcagggctcaacaacaactttctcctaccgctattttcaaatttttggtgtagcaaatgctttatacgaatcgcgcagcaactgaacattgcttcccccacatggtcttgccatgccatctttcccggtactacatcaatgcgggtagcgcctcgtcgcctgggaaatgactccattccgttccagcaaatgcagagaaggccttcccagggcctgcgggggaaatgtcaactggcggcggaggattcctgggtcacttccgtcgtggcctctgcggcagagctgctggtctccgcggcctggttctggctgctctgcgcctcgggtgcgggctgctgctgttgatcttcggcgagacccagaaccaccaa

SEQ ID NO: 899 - DNA, 413 bp, Hordeum vulgare
ctcttcaagtgatggggatatctgttgaagaaggcgagtgggctattgttggtgggacgggacaatttgcaatggcaaatggtgtcatccacaaaaagctccatgaacaaaggagcgacggtaacatcatagaactcactatccatgggttttgccctgtgttgaaatcagagagccttctcacaaagcttggaccatggggtggaaatggagggggtgataaagacattttagaggcagtaccaaggcgtctggagagcatcacagttagcagcggctcaattgttgattcaatcaaattttcttatgttgaccagactggacagaagcacaccactggaccatggggaggttcaggaggaaatcaaaacacgtttgtgctcggcgcttttgagtttgtgaaggaagtttct

SEQ ID NO: 900 - DNA, 314 bp, Hordeum vulgare
ttttttttttttttttttttttttgtttaaaaaaactgatcctcttattcatcacaacaaagacaattacatgcccacatggcggctacatcggatcttctggagtagaaaggactactcgatcccatcttgttattcgaattggaaacaaacactgaaaataagaacactagcctctattgcttagagtgggcgcacgtaggcaccaagcgcatcaagatatatcccgctgcgcgcaaagaacccaacgatgctactattcttctgcacggctatggtgaaaggggttcccttcacttctccgaaaggcccgt

SEQ ID NO: 901 - DNA, 872 bp, Hordeum vulgare
  UNSURE (777),(807),(816): n stands for any base
agacccccgggtctgcaggcaattcggcacgaggggcacatcacactactgctgcttttatcagagtggttggttcagagtttgtgcagaagtacctgggtgagggcccaaggatggttcgagatgtattccgcttagctaaagagaatgccccggctataatattcattgatgaggttgatgctatagccactgctcgattcgatgctcagaccggggctgaccgagaagttcagcgtattctgatggaactactgaatcagatggatggatttgatcagacagtgaatgtgaaggttataatggcaaccaatcgggcagatactctagatcctgctctgctgcgtccaggaagactggacaggaaaattgagttccctctgccggatcggaggcagaagaggcttgttttccaagtttgtactgctaagatgaacttgagtgatgaggttgatttggaagattatgtctccagacctgataaaatcagtgctgctgatatcactgctatttgccaggaagctggcatgcatgctgtccgcaaaaatcggtatgttatcctccccaaggacttcgagaagggttaccgaaccaatgtcaagaagcctgagtcagactttgacttctacaaatgaggcaacaaactgttaagaggatgctttattttctactggcgacatgattaacactatcgatgaatttgtggatagtcgcctgataaaaatccttgtatctcggtgctcatgtagtttgcacgttcagtctcaccatccttgntaagctacttgtctgtacaattccttcttnctaaagttnctcttgactaaaaaaaaaaaaaaaaactcgagggggggccccggaccaatttgcct

SEQ ID NO: 902 - DNA, 543 bp, Hordeum vulgare
aaactttaggaagaaggaattgtacagacaagtagcttaacaaggatggtgagactgaacgtgcaaactacatgagcaccgagatacaaggatattttatcaggcgactatccacaaattcatcgatagtgttaatcatgtcgccagtagaaaataaagcatcctcttaacagtttgttgcctcatttgtagaagtcaaagtctgactcaggcttcttgacattggttcggtaacccttctcgaagtccttggggaggataacataccgatttttgcggacagcatgcatgccagcttcctggcaaatagcagtgatatcagcagcactgattttatcaggtctggagacataatcttccaaatcaacctcatcactcaagttcatcttagcagtacaaacttggaaaacaagcctcttctgcctccgatccggcagagggaactcaattttcctgtccagtcttcctggacgcagcagagcaggatctagagtatctgcccgattggttgccattataaccttcacattcactgtctgatca

SEQ ID NO: 903 - DNA, 462 bp, Hordeum vulgare
tcttccgctgacccaccctgagctatatgaagacattggaataaggccacccaagggggtcatattatatggagaacctggaacggggaaaactctacttgccaaggctgttgctaactccacatctgcaactttcttacgtgttgttggaagtgaacttattcagaagtaccttggcgacggtccaaaactagttagagaactatttagagttgcggatgagctttccccctcaatagtcttcatcgatgagatcgatgcagttggaacaaagaggtatgacgctcattcaggaggggagcgtgagattcagagaactatgttggagctgctgaaccagctagatggttttgactcgcgtggagatgttaaagttattctagctacaaatcgcattgaaagtcttgatccagcccttgcttcgccctggcagaatagaccgaaagatagaattcccctctt

SEQ ID NO: 904 - DNA, 549 bp, Hordeum vulgare
agctttgattagtacttcgaaggaaggcgtcaacagatcgtagtacaacaaactattcaattatccaaccattcaggcgaagaaaaggttacaaacaaatttgcgcctatcctccaaaccagggaatatatcccacgataccaaatatattatcactacacaatgttgttctggtagtgaagaccggtgcacaattcatcacatgtaaagcccctccggcacaccttccttcttcttgaacatgaccttctcctttgccttcttgaagtcggcgtgtgtcaccttcatcctgcgctctctcaaagcaagcaagccagattcggtgcatattgctttgatgtcagcaccagaaaactcatccttagtcatgacgaactcttccaggttcacatcatctgacaatgtcatctttgccgtgtgtatctggaagatgcgccgcctagtcttaatgtctggaagagggaattctatctttcggtctattctgccagggcgaagcaaggctggatcaagactttcaatgcgatttgtagctagaataactttaac

SEQ ID NO: 905 - DNA, 518 bp, Hordeum vulgare
gctgggctcactgccgtgatggggccccttcagatactcaagctctacgccatcccctactggatttttgttatgtggctggactttgtcacctacctgcaccaccacggccacaacgacaagcttccctggtatcgcggaaaggcatggagctatctgcgcgggggcctgacaacgcttgacagggactacgggtggctcaacaacatccaccacgacatcgggactcacgtgatccaccatcttttcccgcaaatcccgcattaccatctagtggaggcgaccgaggcagcgaagccagtgctagggaagtactacagggagccggacaagtccggcccgttcccgttccacctgtttggcgcgctggcgcggagcatgaagagtgaccactacgtcagcgacaccggagacataatctactaccaaactgacccaaaactcgccgccggtgcacacacatccgattaacaacatcaagcatactctttgagcggaggctgctcgctataacctgg

SEQ ID NO: 906 - DNA, 542 bp, Hordeum vulgare
tctggagttaagcctgagatcttacagcaatagtatatgcatatggaccagctgacaaaaatactgctctataagtgtataacagtgatgtagtatcaaacaaagaatgccccttaatcaggcaagtttgtccaatctttcaagatctgcgtggctctggtccaaagaatcacttgtttcttacaaacacataatctattctaccatggcttcaagcctattgtacaaccaaaaacccaatatgccaggctagcatccgtgccgtccacctgcttgaattgccggatactgaggaacttggcaaggcgaggcggcagagggctaatcggccaggttatagcgagcagcctccgctcaaagagtatgcttgatgttgttaatcggatgtgtgtgcaccggcggcgagttttgggtcagtttggtagtagattatgtctccggtgtcgctgacgtagtggtcactcttcatgctccgcgccagcgcgccaaacaggtggaacgggaacgggccggacttgtccggctccctgtagtacttccct

SEQ ID NO: 907 - DNA, 518 bp, Hordeum vulgare
gctttgcaaggatttgatctgaatctctctccatagaaacccctgaggaagataagcgagctgagtcacacatctcagctgaacccgtgtcaactcctactgggaggcacgcaactcttgataggaggcgtgccttgaaccggcgtattcgtattcttctatttagacctaggactgcaactaatccttggcagaatagcattcagcatgacagaagcacaccaggagcagaacaaaatcaacggaacgcctgcacttctacagatgtgagcccatcctgttccagggctgatttcatgcagagccagcagagtagctcacaatttgttcagtctgcaagtaatcttaatcaatgcactgatgagggtggaagcaatttccgagaagtagcaaatgccaaggaccagctgattcctattgtcaagaagagcatcaagcacatttgtgcccggtccccattggatcaatcttctttcacgaacgtagcacggcgagcgacacacaccatcttagcgttg

SEQ ID NO: 908 - DNA, 535 bp, Hordeum vulgare
accatatcattgatgagttagattcatagaagatactgtaagacaagagatcatagtgccccccttctcaggaagatactggaagacctgacattggccaataggggttggtgacaactcaattaagaagttagttccaagagaaagtgcatggtttagaaatgactgtatttcaagctatccaacattcattaacacgttcgtatccgtataatctttccaactgtctataattgaaagaatgacaccaatagagagagagagagagagaaatgccagcttaaaaagaccacctacatcaggaaaacatactggcgatgtgactgacaacatcaccgacgaatgagttgaagcatgacgagcagatagttctcatgagaaacgctggctctcggccgtcacaggcatggcaacaatggctaggaaaaggaaaaggtgttgcaacaaccctatccttgttgtgcgcaatcccggacaacgctaagatggtgtgtgtcgctcgccgtgctacgttcgtgaaagaagattgatccaa

SEQ ID NO: 909 - DNA, 519 bp, Hordeum vulgare
ggtcctccgcgccgtcaactccgcctacccgctcgtggtggccgtgctccccgacgtccccgaggagcaccgccagaagctgctccagcaaggctgcgtcgtccgggagatcgtgcccgtctacccgccggagagccagacccagttcgccatggcctactacgtcatcaactactccaagctccgcatctgggagttcgtggagtacgagaggatggtgtacctggacgcggacatccaggtgtacggcaacatcgaccacctcttcgacctcgacaagggcagcttctacgccgtcatggactgcttctgcgagaagacgtggagccacaccccgcagtacaagatcggctactgccagcagtgcccggaccgggtggagtggccggagcgcgagctgggcgtgcccccgccgccgctctacttcaacgccggcatgttcgtgcacgagcccagcctcgccaccgccaaggcactcctcgacaggctcgtcgtcaccgaccctacccccttcgccga

SEQ ID NO: 910 - DNA, 527 bp, Hordeum vulgare
tattaggatgcaggacgtttacagcaatacacgtatcgtgacgtaacaggtagatctatacatggtgtttacaaattacaaactctctaaaaaacacggactagtttcatctacaataccaaaaaccttgtagatccatcttgatccatatagttactttgacactatatatatatacagttcttcaacgaaatccgaaatcccctagctgatactgtataatcgtatactactacttaatgaagacacgccctcgttgtgcgccgcgacccggccgggctagcgccggcccgcaggcagagcctacgcggccgagggtgcccggaagtacttcacgccgccggcctcagcaaaggccgtgtgaaatttgtcggtggtctcgtcgccggccgtgtactccaggctctcgtcgttgtagatatcccaccatttcttcacaagcatcttgatgtcctccctgtccatgttcgcctcctcgccggtgaacctccatggcttcgaacccgcggcgcagtagtgcacgacct

SEQ ID NO: 911 - DNA, 517 bp, Hordeum vulgare
ctgctgaaacctgcttatcatcgtctccttcttcctcctcttcgcggaggagagatcgaccggatgactggctgcaacggcaacggcaacggcatcggcaactcgctcgcctcggccatggggcagcagactgtcactgagaagaagttcggaggaatcgcaccaaagaagcctctgatttcaaaggaccatgagcgcgcctacttcgattccgcggactgggtcctcggcaagcaagctgcaagcaacaacgcgcaggctgcagcaatcgagtccttgaagccaaagctaaagaggacgccccatcaccagctcccccctcgcaagccggcctgcgcgtccggctgatcgatcgcgatgcgacaagggatcaccggagaagccgaagcggacgcttgggctgaggaagctggtgatctagctggttgcttatgtgttaggagtcgattgaatcagggttcgagatctgcagttagacccttttggttgtcgcagcctaaaatttgtcacagtaggg

SEQ ID NO: 912 - DNA, 542 bp, Hordeum vulgare
ttttgtttatctcgacgatatcgggagcgtcgaagctcctcgatttgaaaaaagggagaaaaatactgaactgaaaaccaaacatcttaaactgaagccataacaatgtaggagcatatgctactagccctactgtgacaaattttaggctgcgacaaccaaaagggtctaactgcagatctcgaaccctgattcaatcgactcctaacacataagcaaccagctagatcaccagcttcctcagcccaagcgtccgcttcggcttctccggtgatcccttgtcgcatcgcgatcgatcagccggacgcgcaggccggcttgcgaggggggagctggtgatggggcgtcctctttagctttggcttcaaggactcgattgctgcagcctgcgcgttgttgcttgcagcttgcttgccgaggacccagtccgcggaatcgaagtaggcgcgctcatggtcctttgaaatcagaggcttctttggtgcgattcctccgaacttcttctcagtgacagtctgctgccccatggccgaggcgagcga

SEQ ID NO: 913 - DNA, 1270 bp, Hordeum vulgare
  UNSURE (281),(348),(371),(372),(377),(382),(405),(442),(455),(491),(494),(572),(583),(621),(653),(654),(677),(712),(715),(737),(757),(777),(786),(787),(814),(817),(819),(831),(837),(851),(883),(900),(910),(911),(951),(952),(967),(970),(992),(1004)..(1007),(1010),(1012),(1014),(1016),(1018),(1020)..(1022),(1035),(1036),(1038),(1040),(1041),(1154),(1179): n stands for any base
tggggggcgccgggtcttgcaggcaattttctgtcacgagggagagatttagcagggagcttacgcaagggtaagtagcatatgctctgttctgggaccaccagagggtacgtaagaaactgggtatattcgctcggactgatggcacgctccattaaagactggcacccaagtgcgacgctcacggccttccagacagttttcgcgagcgcattacatggtgctcgctccgtcgacctccctaacgactcccaccgtccgtcgctacttggtcagccggnccgtcggctgtcgggtcgcggtagcacgctgtgatctgcggcgaagacaagcggataatagtttgcnggacattgaggatcatgttagcnnacagnatgcncacaactacgatagcaccggcgngagctataactgaactatggaaccaggacatggcagnaccctactagccngagctgaataagaggaagcaatctccggagaggaanatncgctccggagggagatcggatgtcccggaggccggctggctcgtactagctagctgggaagaagggttatccggaggncgctagaccgngacatagaggagggggaagcaaaaccgctagcccgaanagacgaaagccgaacacgaccaggggaacatnncaaaaccgggctcaccagacggnagatgagtcccggcgttttagtgtacttggtcagnctnattaatgaatatcactgctatnattggcaccgcctatggctnccgaccttcgcaagccttcnaaacctgtnnaaccaaattgggctcgcacacacactnaantncccttgatagcnattttntgcgaaggcatagnccttctggtcaatctctgaacactctagaagnaccctaactaacacgtntgcgcaaccnntcatcctctaaccatagggagaaaatacaaaaaggctctnnggcgcgcgggagcgnacnacacgcccagatagaccccgtnagctagaagacnnnnctnanantntntnnnttcttcgcgtctnncnannttatcttcttatatcatactgcgttgccttgactgtgagtatacgtcgtgttggtggagcctcacgggatgcagccgggcctgcttagtgtctgcgtttacccaacggagagngtctaccgacactatatcaacaccnttacacctactgtatcagaccgcacttaatcagttcttacaatatataacactatgagccgatctgctgcgctgcgacgctgttgtcttta

SEQ ID NO: 914 - DNA, 547 bp, Hordeum vulgare
  UNSURE (88): n stands for any base
attacaatcgtaaaatattaaaagaactaagcaaaacttgtacatttttgggtttgtaacaaacctctagtttttcttatttcacatnagctcctcaactatctagccacggacattctcgtcaaaatttccttaaacatattgtcacatgggacactaggaaaaaacaatcattacaacaaaaagttactcctgatcttgcaaagaatggcctagctgcaaacttcgttccgtattcagtcttgccccaaagaccttgcgcaatctgaatactttgtttgaattgcttgctagcttgtttctgtctcattctggaaagctaacttgtatatttcattgtatgtgtcaacaaagtgaacgtcaagaccctctttcacgtttggagcaagctcatcaaaatcccttttgtttgctgctggaaatatgatcatctttatcgagctccgccgggcagcaatagccttctcttttaccccgccgattgggaggattcttccagtcaatgttacttcaccagtcattgctaagtccttcctggcatgttttc

SEQ ID NO: 915 - DNA, 518 bp, Hordeum vulgare
catgcatcatgctcagtggaatgcgcatttcggacatcctctgccgacaaacgttcggaggagtttcaggaagaaaactccgaagtttgtgcagccattaacctgtgaagtctgcaagatccagtgcgacaccatggatgttctcttgatccataaaactggtcagaagcacaagaagaatctgcagaagttacaagacgcgatcacacctcaaccagcaaagcctccgaacagcggtgttgcagcaagcacagcacctcctacagcacctcctgctgctgccgccactgctgctgacagtgtggtgccggctgtacagccaaagaagaacaagagctccaacgcgtccccagcagacttggaggtgaagaagaggcgggtgatcgaggccggagcggctcatggcgaaatgaagatctgcacagcatgcaacgtcgttgtcaacagccagaaggtctacgagttccacctggccgggcataagcacaaggctaatgtactgaagctggagaagaagc

SEQ ID NO: 916 - DNA, 486 bp, Hordeum vulgare
accaaaataataacaatcttcgccccagtatgcgctgctaatccgcagcaagtaaaagtctgaagcaatttcctggcgtttctacagcacaacaaggggggaacactagaactgcaacaaagactaaagctagcctaccaaacaacggaataagacatgggtttgtgaatgctggtttctgttgatcctctggaaataaagacggggagaacgacgagagccgagcaactcctcatcatctcaggcaacatgctgaagctgcacttgctgctgctgctgctgctgctgctgctgaagctgcacttgctgctgctgctgctgctgctgctgaagctgcacttgctgctgctgctgctgcttcttctccagcttcagtacattagccttgtgcttatgcccggccaggtggaactcgtagaccttctggctgttgacaacgacgttgcatgctgtgcagatcttcatttcgccatgagccgctccggc

SEQ ID NO: 917 - DNA, 518 bp, Hordeum vulgare
cggccggccgatgccgccgcagcccacggtgaagatctactgccgcgccaaccccaactacgccatgtccgtgcgcaacggcaaggtggtgctcgcgccggccaaccccaaggacgactaccagcactggatcaaggacatgaggtggagcaccagcatcaaggacgaggagggctaccccgccttcgccatcgtgaacaaggccactggccaggccatcaagcactccctcggccagtcccaccctgtgcgtctggtgccgtacaacccggacttcctggacgagtcggtgctgtggacggagagcagggacgtgggcaacggcttcaggtgcgtgagcatggtgaacaacatctacctcaacttcgacgccctcaacggcgacaagtaccacggcggcgtccgcgacggcaccgaggtcgtgctctggaagtggtgcgagggcgacaaccagcgctggaagatccagccctactactgagcagggcagcgcacgccgtgcatggatcgatgcatgc

SEQ ID NO: 918 - DNA, 552 bp, Hordeum vulgare
  UNSURE (30): n stands for any base
ggctacaaaggtcctttattagtacgtaancttgtgattacacatacaagcacaacggctccgttattctgcggcgtagggagcgactagcgagagacgcatgcatgttgttcatccgggacagcccacatcgtttcttcagtagatacgtacgtacacatgagcgtggatatgccgatgcatgtccacgcgtacgtgcgcgagccatgcatgcatcgatccatgcacggcgtgcgctgccctgctcagtagtagggctggatcttccagcgctggttgtcgccctcgcaccacttccagagcacgacctcggtgccgtcgcggacgccgccgtggtacttgtcgccgttgagggcgtcgaagttgaggtagatgttgttcaccatgctcacgcacctgaagccgttgcccacgtccctgctctccgtccacagcaccgactcgtccaggaagtccgggttgtacggcaccagacgcacagggtgggactggccgagggagtgcttgatggcctggccagtggccttgttcacgatggcgaaggcggggtag

SEQ ID NO: 919 - DNA, 1084 bp, Hordeum vulgare
  UNSURE (458),(459),(464),(466)..(469),(494),(496),(497),(502),(509),(537),(539),(540),(547),(560),(562),(568),(575),(588),(593),(602),(606),(612),(613),(616),(619),(625),(631),(637),(639),(640),(667),(675),(687),(691),(722),(723),(727),(744),(776),(812),(816),(893),(896),(944),(1080),(1084): n stands for any base
gaggaattcggtacgaggttttattgaggattgggtaaggattgggtttctggttagtaagaaggtgtatactgagtgttgttatatgttttttgagaatagtgtattttcatggagaaggaggatgttattgattttaatttatattatatttgatataatatgattttaataggttgtgtttataaaaaattacatattttttccgtaattatgtttaaattatatttaaattttttttttatttttttcattaatccattttattttatttatcctactttatttacataattattaaccaccatatttaaatttttttttttaatattcaccctattttttttatcttctatattatttttttatttctatatttacttttttattatttattatttttcatttttttttttttatattttttaatatttaaaactattttttttaataatatnnccccnannnnccaatagataaaaaggttaaaaccncnncgggntcttgancggaattcaattttcggtttctacgttngnntctaatngacctttttcgantngagttnggggttncctttaagccttnccgtncaacttttngccnaggttnnacnacnactaanctattngggttngnnccccgctttctttcacccctttttttngcccatangtttctttgagncccntagggcccgtgttccacggttaccctttggnngcgnggcaccccccttttggnttatggttatagcaccaagggtttgggttggnttctttttcacccattagtggcaatacttatccccncacnccgggattttttttattggtttgttggggccccttttgggaggattttctttcccaatccctttcctccctatttgnggngaaaaggtttttttttatcgagggagttttttttttttggcttcctcnttgagggttatttaccaaatatttataatttcctctttcgaaagaggtggcgtcaccggggggtctatctaatatattaaaagtttttttttttaaaaggaacgaaaaagcggcgaacccttatgtttttatttcnctcn

SEQ ID NO: 920 - DNA, 551 bp, Hordeum vulgare
  UNSURE (457),(465): n stands for any base
gtagaaataagattatggggaaaaccctgattgatttgattcatttgtatgtttatgggatgatactgtacaacagatcaacattgattgactgtcaacactaccacaaaactctccttgtcagcaggcactgcaggatctgtatcacgaccacgatcagcgacgtgcactcagcaagttcctcctgaatcagctccagttggacagctctccaacgtcttctgcacatgaaaaacaaatggccccatcttggaaaaacatgtcgcataccacacatctaatgtgatgcaataggcgactgctatgacaaaatgacaacaggaatgatggaccttcgacaacaaatttagttcccaatcctgttccaaacatcctcttcccaggcccttcctagtgctgccaccgtgctatatgtacaacggtaagcaactctactgaatgccccaaaggtaccaancctgtcanttggaggatataagactattttctcatgacacttcattgtgactcttcactcttgaagtattcactattcagatccaggagccctt

SEQ ID NO: 921 - DNA, 446 bp, Hordeum vulgare
ctccctccctctccctttccccgctctcgcgtccgcgctcgctcgctcgctcgctagccgcctccgtcggtccaccgggccaccgcaccgcgggggcatggcggatcagctcaccgacgaccagatcgccgagttcaaggaggccttcagcctcttcgacaaggacggagatggttgcatcaccaccaaggagctgggaacagtcatgcgctcgctggggcagaacccaacggaggctgagctccaggacatgatcaatgaagtcgacgctgatggcaacggcaccattgacttcccagagttcctcaacctgatggcccgcaagatgaaggacactgactcagaggaggagctcaaggaggccttcagggtgttcgacaaggaccaaaacggcttcatctctgctgctgagctccgccatgtcatgacgaatctcggcgagaagc

SEQ ID NO: 922 - DNA, 534 bp, Hordeum vulgare
ttgatactagatagaagagcgaagcagaagttgatgagaaaatatactacagacgggcccaacagcaatcaggatacaccagggaggacacaagttcacataaaacacaagaggtctggaaacacactggagagcatagcaggaattgcgtcgtgcgatccgttttagcagctacagctaggtaggatgcttaactggaaatcgatcaaataagagtttcgtcttaaactaatatgcaatgcacaattctcctcctgtcttcggagcacggttcggcgctcatttggccatcatgaccttgacgaactcctcgtagttgatctggccatcaccgtcgacgtcagcttcacggatcatctcgtccacctcctcgtcggtgagcttctcgccgagattcgtcatgacatggcggagctcagcagcagagatgaagccgttttggtccttgtcgaacaccctgaaggcctccttgagctcctcctctgagtcagtgtccttcatcttgcgggccatcaggttgaggaactctgggaa

SEQ ID NO: 923 - DNA, 106 bp, Hordeum vulgare
ttttttttttttttttttttttttttttttgttttttttttttttttttttttttttttttttttttttttttttttttttttttttttttttttttttttttttt

SEQ ID NO: 924 - DNA, 348 bp, Hordeum vulgare
acctacaacgagaagccgacacttgtgccgatcgcagaggccatcaggatggaagctgcctaatcggaggcccatggctgccattgcctccggccgcgacccagccgtttcctctgggatccgagaatggctcgctcatcccctctggaagatagtaatcggagaccgggccggatccggccatttctgtacagattttcctctttttgtgtgtcgtattgaattcgagaggcagaatcccaggctaaggttttagtttttgtaaacctgccgaagctcttgtgtgatcgtgttgctgcaactagtcgttgctcaacatgataatccttactttaatgacaaattggg

SEQ ID NO: 925 - DNA, 385 bp, Hordeum vulgare
accctaaaatctctatctctcagcacaaccaacagcgatccccggcggcggcgagagatcaaggctcgcggccatggcgcgcgagcagctggaggtgctgtcggcgctggacacggccaagacgcagtggtaccacttcacggcgatcggcatcgccggcatgggcttcttcaccgacgcgtatgatctcttctgcatctcgctcgtcaccaagctgctcggccgcatctactactaccgcgagggtgccgacgcccccggctcgctgccgcccaacgtcgccgccgccgtcaacggcgtcgccttctgcggcacgctctcgggccagctcttcttcggctggctcggcgaccgcatgggccgcaagcgcgtctacggcatgacc

SEQ ID NO: 926 - DNA, 358 bp, Hordeum vulgare
ttttttttttttttttaatcaaaagtcgacttccttcggattaactctccagacagagtgattcaaaacagcaacatgtggctgctatgctacgtttggaaagaaactaaaacatgcagacaatccaacaaagcttgaagccgacagtaaattaaagtaccgcatacaaagagcaactcgcctggacacggccatattggtgaaaccaaatggcggcgacgaggttattcctactgctatccactgccaaatcattccttgaatggggttaggtcgatcttgagcggtttctttcctttgctgactcgagcgatcgcaatcaattcttccaacagctcctccaaattgcgcaatggcc

SEQ ID NO: 927 - DNA, 446 bp, Hordeum vulgare
agactgctgctttagcggtgcctaagaccaatgaccattcggagagagccttctacaaggagctggttaaagtcattgaagcttcagacgtgattctcgaggttcttgatgcaagggacccgctgggcactcgttgcgttgacatggagaagatggtcaggaaggccgatccgactaaacggattgtgctacttctgaacaagatagatcttgtccccaaggagtcggtggagaagtggctttcatatctaagggaggaattaccaaccgttgcattcaagtgcaacactcaagagcagaggaccaagctgggatggaaatcatcaaagcttgataaaacaagcaatatcccacaaagcagtgattgtcttggtgctgagaatctgattaaactgctaaaaaactattccaggagtcatgagctcaagttggcaattactgtgggt

SEQ ID NO: 928 - DNA, 549 bp, Hordeum vulgare
caagcatataccatttgttgcgtctgtcctcattaaacctaacggcgtacaaaatctcctgccaattgttggcaccccacatcacagttgtaacaacctactaattcgcactcccaacctgcagtttttacctcacgcatcatcaactcgtcatgggctcgcactccgcagcaggggcatctttcttgtcgtcttcacccttgggttcttcgccttcaccttcgcctttgctgacatcgccatcgccatcttcatcgtccgcaggggaggcatccttcatctggtaatccaccttgaagtcatagtccgcgtccatgtcattcagcacgctgaacttgttccctttgcgccgcttcttctccgctttcttcttacgggggtcgaggatgccctcggcagtgtacagcttgtcgtgctgtgtgccaccaccggccgctgccttgcttccttcacggtcgttcacgtcggacatcgattcgtccttcacaggtgcactctgcgctgggggatcctcaagcatcgcttcatcaatctctggtggggcattag

SEQ ID NO: 929 - DNA, 457 bp, Hordeum vulgare
  UNSURE (429): n stands for any base
tgcgtgcgagtcgacgggttttgaaacctgggatgcgcaaggaagctgacgagcgggaggccctcacgggccgcaccgctggccgaccctgatcttctgtgaagggttcgagttggagcacgcctgtcgggacccgaaagatggtgaactatgcctgagcggggcgaagccagaggaaactctggtggaggctcgaagcgatactgacgtgcaaatcgttcgtctgacttgggtataggggcgaaagactaatcgaaccatctagtagctggttccctccgaagtttccctcaggatagctggagcccattacgagttctatcaggtaaagccaatgattagaggcattggggacgcaacgtcctcgacctattctcaaactttaaataggtcaacacccgcctcggctttgacgccctcaacggcgancaggaccacggcggcgtgcacgacggca

SEQ ID NO: 930 - DNA, 393 bp, Hordeum vulgare
tttttttttttttttttttagcacagtacaggtcccagtaccaagaaaacacagtcgagttacatcaaagttcagaccttagaatcatggtccctccccactctctccaacaccctcttcttcctcgcagcaacgccgactcaatcgcaaggcaacacacgcaaacaccattgccacacatcgcacacggttttatttggacacagcaacattattcgctagcagcagcaggaggactacgacgacgacgacggacggacggacacgacgactacgacgactcgggggggcttgtccccggactgatccatggcgatgtgtcgatggcaatgcagcagatctcctggtacagcatctaccaggggaggatcttccagcgctggttgtcgccct

SEQ ID NO: 931 - DNA, 516 bp, Hordeum vulgare
cagggacgaggaagggtaccctgcgttcgcgattgtgaacaaggtcaccggcgaatgcatcaagcactccaccggccagggccaccccgtgaagctggtgccgtacaacccggcgtaccaggacgagtcggtgctgtggacggagagccgcgacgtgggcaagggcttccgctgcgtgcgcatggtgaacaacatctacctcaacttcgacgccttccacggcgacaaggcccacggcggcgtccacgacggcaccgaggtcgtgctctggaagtggtgcgagggcgacaaccagcgctggaagatcctcccctggtagatgctgtaccaggagatctgctgcattgccatcgacacatcgccatggatcagtccggggacaagcccccccgagtcgtcgtagtcgtcgtgtccgtccgtccgtcgtcgtcgtcgtagtcctcctgctgctgctagcgaataatgttgctgtgtccaaataaaaccgtgtgcgatgtgtggcaatggtgtttgcgt

SEQ ID NO: 932 - DNA, 550 bp, Hordeum vulgare
ggtggagaaaatgacatgcagggtacagagtagcacagtaccaggtcccagtaccaagaaaacacagtcgagttacatcaaagttcagaccttagaatcatggtccctccccactctctccaacaccctcttcttcctcgcagcaacgccgactcaatcgcaaggcaacacacgcaaacaccattgccacacatcgcacacggttttatttggacacagcaacattattcgctagcagcagcaggaggactacgacgacgacgacggacggacggacacgacgactacgacgactcgggggggcttgtccccggactgatccatggcgatgtgtcgatggcaatgcagcagatctcctggtacagcatctaccaggggaggatcttccagcgctggttgtcgccctcgcaccacttccagagcacgacctcggtgccgtcgtggacgccgccgtgggccttgtcgccgtggaaggcgtcgaagttgaggtagatgttgttcaccatgcgcacgcagcggaagcccttgcccacgtcgcggctctccgtcc

SEQ ID NO: 933 - DNA, 409 bp, Hordeum vulgare
gaagctgcttcgggcatccatcccttccttccttccttccccccatctcttccttgtccttgccttcccttcacttggcttgcccgcaccgcatgcgccagccgccaccgatcgtgcgtcggttgctctctcttctgcgacatattccaccaaaaggagtctggttggagggactgttcgttttgtggcaagcatctccattgcggttgtgttgcttcgaagaattcctttgatctactcgatagcggaggagttcaatgcatgaattgcatgaaaaatccaggagttcaatctgtgactgtttcatgtcaagtggctccaaagctttttttatctcctcaaaataaccagagactctttggtaaaagcgatgaattgttgccaggtagaccgttggagtcaccgtccc

SEQ ID NO: 934 - DNA, 431 bp, Hordeum vulgare
tttttttttttttttttttttgccaccaagctgcctttcataccaagcacggaggtcacaacgtagtacaaacgaggttgcacagccctgtacacgtatgttacaccaacacgacgaaatcctatcattttgatcttcacatcaaaacgcaccagctgttccttggggaaaaagggggtaagccgatcatacacacacacacacgtaaacaagttacacaccactaacacaggcccacggtcaacaagctcaggtcaggtagcagcgatgtcactggcactggcagcgttgcactggttctcactggctgcctcgtcgacaaccatgttatccatgggctcccgctcctgctccaccggcacggcacgcccctcgtcggagggccgctcttcgctctctaccagagcgggttgagatggggcggccgtggc

SEQ ID NO: 935 - DNA, 493 bp, Hordeum vulgare
gctagcctggcctactaccgcgagagctacggctcgtacgggatggcgacgccggggtacgcgcccccggtgccgtacggcatgtcgcaggtgaacgtcgacggcaactgcggcggtcggccgatgccgccgcagcctacggtgaagatctactgccgcgccaaccccaactacgccatgtccgtgcgcaacggcaaggtggtgctcgcgccggccaaccccaaggacgactaccagcactggatcaaggacatgaggtggagcaccagcatcaaggacgaggagggctaccccgccttcgccatcgtgaacaaggccactggccaggccatcaagcactccctcggccagtcccaccctgtgcgtctggtgccgtacaacccggacttcctggacgagtcggtgctgtggacggagagcagggacgtgggcaacggcttcaggtgcgtgcgcatggtgaacaacatctacctcaacttcgacgccctcaacg

SEQ ID NO: 936 - DNA, 559 bp, Hordeum vulgare
gggtcctttattaggtacggtaacttgtgattacacatacaagcacaacggctccgttattctgcggcgtagggagcgactagcgagagacgcatgcatgttgttcatccgggacagcccacatcgtttcttcagtagatacgtacgtacacatgagcgtggatatgccgatgcatgtccacgcgtacgtgcacgagccatgcatgcatgcatccatgcacggcgcgcgctggcaggctcagtagtagggctggatcttccagcgctggttgtcgccctcgcaccacttccagagcacgacctcggtgccgtcgcggacgccgccgtggtacttatcgccgttgagggcgtcgaagttgaggtagatgttgttcaccatgcgcacgcacctgaagccgttgcccacgtccctgctctccgtccacagcaccgactcgtccaggaagtccgggttgtacggcaccagacgcacagggtgggactggccgagggagtgcttgatggcctggccagtggccttgttcacgatggcgaaggcggggtagccctcctcgtcctt

SEQ ID NO: 937 - DNA, 541 bp, Hordeum vulgare
  UNSURE (4): n stands for any base
gggnctgcaggcaattcggcacgagggcaggaaaatccgaagagatattgcaagcggttagggatcttcttcgtgaaaagagttcatttaagaaccagccggattgggttacagttcttgatggaacccaggaaggtgcatatgaatgggttaccattaattatctgttgggaaaactgggaaagacgtatgcagacacagttggtgtggttgaccttggcggtggatctgtccaaatggcgtatgctatcccagagaaggatgctgaaaaggctcctaaaccggcagatggtgaagaatcatacatgaaaaagcttttccttaaagggacaacatatcatctttatgtccacagttatttgcgctatggattgctggctgctagagcagagatcttaaaagctggcaatgccaatggttacagcaactgtgtattggctggacatcaggggcaatataagtatggtggaaatatatttgaagcatcggctgcaccttctggcagtagtttctcggaatgcagggctgatgttgtgaaagc

SEQ ID NO: 938 - DNA, 525 bp, Hordeum vulgare
gcccatctcaagtggatgtcagaaagaatggaatgctctcgtttgactctcatcatcatcagtacaaaactaataatgcgccttcaatggcgtctggctgcagtacaattgatgccgtaatccttgtgtccttgcgtatgaacctatactgtatggggaggggaggctggatgaactgaccgggtgacaaaatggcaacttcaggggatgcacagacaagaaccggctacccctaaattcaaaacttctcctacggtggtcacgcccacgctcccacgttgatgcttccgttgtagctacactggtgctgcctatgatgaagatgcaacctcgatggcgcttccgagcggccatgctgcttcaacgaacgcgtcactgtaaggaaccttctttaccaatgtcatctcctgttggggatcaacaccaaatccatccacaagcagggtgtactggtaaacaagatccatgcaaatgtatggaacgttatccttctggacagcagggtagctagattgggcgtcgttc

SEQ ID NO: 939 - DNA, 519 bp, Hordeum vulgare
gggccaagctgtccagcgctatgtcggtgctgggcaccaccagcggcggcgtggaggcgtcttcggaggctggtggtcggggtccaggtgggaggaggaagagatcgggcacggtgtccgggccgcaccgccggagcacctccaccagaaggtcgaagagccctttcatcaacatggtcactgctaggacgctcaacgatggcaagacatggaggaagtacggccaaaaatgtattcatgcctgtactaacccgaggagctactacaggtgctctcataagccagaccaaggctgccaggccacgaggcaggtccaggagtccgactccagcccgtccgagtacctcatcagctactacggccagcacacctgtaaggacccctccacgttccgatcactcatcatccaaggcgccgccgacgctgcccctcctgaagacttgccaaacctcatcagcttcacgtcgatcaatggcgccgcagctgcgagcacgagctcttctccaaatcatctcgtga

SEQ ID NO: 940 - DNA, 532 bp, Hordeum vulgare
atcattagtactagtatatgtttacacatgacatccaatacacacacatattagtaccttctatccacatgctccaatatacatgcatacacaatataccttcacaataaaatattactagtactaccccatgcatgcaaattgcaagcgcgtgttaatgggtcaggaatcgaagccgaacaggtcgtcgtcgcaaacattattgccaaatgatcccccgaacgagcctgacatgaacccgaggctgctcggcgaggaagggaagctgtccatccctgcgccagcatccgtgtcgacgccggcgatccccacgaccggccagtactccgccggcgctgatcctacggtcaacggtgaagtcctccggccaataacgtcgacgagctgcccgccggcgtactgcgtgaactccccgtggaaagacggcgacggcgagctgctggacacaccctcctgcaccggcggcgaggagctgtagttggagaagcgggagaaaagcatcgaatgaagatcagccgcatctctcacgaga

SEQ ID NO: 941 - DNA, 517 bp, Hordeum vulgare
ctcctcttcgccaccgggaccgggatcagcccgatccgctcgctcatcgagttcggcttcgcggccaagcagagagccgacgtgaggctctactatggcgccagaaatcttgaaacaatggcgtatcaggagagatttgcagagtgggagtcatctgggctcaagattgtgccggtattgtcacggccaggtgatggctggaaaggtgaaaaggggtatgttcagcgcgcgttcttggaagccaagaacatcgccaatcctacttccactggggctgtgctatgcgggcaaagccaaatgatcgaggaggtcacctcggcccttacagctgatggtgtatcacaggataaaatcttgaagaacttctagaatgaatctcctgaatgtaactcatgcttctttggttgggcggtactgtgccttgctgtttgtattagaatatctgtaatttgattcatcgatacttctcaacacaagatacggtagatataaaaaaaaaaaaaaaaaaaaaaaaaaa

SEQ ID NO: 942 - DNA, 482 bp, Hordeum vulgare
cgtatcttgtgttgagaagtatcgatgaattaaattacagatattctaatacaaacagcaaggcacagtaccgcccaaccaaagaagcatgagttacattcaggagattcattctagaagttcttcaagattttatcctgtgatacaccatcagctgtaagggccgaggtgacctcctcgatcatttggctttgcccgcatagcacagccccagtggaagtaggattggcgatgttcttggcttccaagaacgcgcgctgaacataccccttttcacctttccagccatcacctggccgtgacaataccggcacaatcttgagcccagatgactcccactctgcaaatctctcctgatacgccattgtttcaagatttctggcgccatagtagagcctcacgtcggctctctgcttggccgcgaagccgaactcgatgagcgagcggatcgggctgatcccggtcccggtggcgaagaggag

SEQ ID NO: 943 - DNA, 504 bp, Hordeum vulgare
ccgggctgcaggtggctacgggacataaaactggacacgctgaagaagattgccgtggggcttcgaagttggcatgagcacaatcttgccctatcactacttgagcgaggaggaccaaaggcgatctcagttgtagttgaaaccttgctacaatgattttgccttgtgaatttttttgcccccaatctaacttgtaggagccgtttcagtctcaagcctgaattccggctggtgagccatcaggccagcattcatttgtgtagtagtgtcaggtcatctcgtatggcctctttgctggatgattgactgcagtatgtaagtttggtaggccggctatggaggctttggatctttgggatatcattgtggtataggatccctgttcagcaacactgtactgttttaggttttgacggggtttacaaagcgcatctgactgttttcccgttcttatatgttatctccttataatattgttatttacgacgttaaaaaaaaaaaaaa

SEQ ID NO: 944 - DNA, 475 bp, Hordeum vulgare
gtcgtaaatacaatattataagggagataacatataagaacgggaaaacagtcagatgcgctttgtaaaccccgtcaaaacctaaaacagtacagtgttgctgaacagggatcctataccacaatgatatcccaaagatccaaagcctccatagccggcctaccaaacttacatactgcagtcaatcatccagcaaagaggccatacgagatgacctgacactactacacaaatgaatgctggcctgatggctcaccagccggaattcaggcttgagactgaaacggctcctacaagttagattgggggcaaaaaaattcacaaggcaaaatcattgtagcaaggtttcaactacaactgagatcgcctttggtcctcctcgctcaagtagtgatagggcaagattgtgctcatgccaacttcgaagccccacggcaatcttcttcagcgtgtccagttttatgtcccgtagcca

SEQ ID NO: 945 - DNA, 887 bp, Hordeum vulgare
  UNSURE (1),(552)..(569),(571),(572),(574),(588),(806): n stands for any base
ngttccccgggtctgcggtaaatcgaccctgaggaatattcttggctgtctggataaggccaccagcgggacctatcgtgtactcggtcaggatgttgccacgctggacgccgatgcgctggcgcaactgcgccgcgagcatttcggctctattttacagcgttaccattcgctttcgcatttaaccgacgagcagtaacgttgacgtacccggcgcctatgctggtcttgagcggaaacagcgactgcttcacgcccaggagttgctgcaacgggtggggctggaagaccggacagagtcttatccggcacagctttcgcttgggcaggaacagcgcgtcagcgtcgggcgggcattgatgaacggtggtcaggcaattcttgccgatgaaccaaccggcgcactggacagccattctggcgaataggtgatggcgatcctgcatcagctgcgcgatcgtgggcatactgcgattatgggcacccacgatccgcaggttgctgctcaggccgacggggggcccggaacccaattcgcctattggagtattnnnnnnnnnnnnnnnnnngnngnggccctggtgggtncggctgcctattctgttagagatctgtggaagcatgagactctatcggcgaacgtggtaggaacttttggagcccaagtcgatatgcacgactgcaagatgtacattttcacacccgctgtcggtttttctacaagtcggtgatagaaaaaggtcaaagccacgccacgcactatatcagcatgcctggaaacaaactttggtcaatcatccaacttncaggtcacatggtatatatatgtatcagcctgttttcgtcaaatactcgatcatcatatatccagcatgatgcaaaattta

SEQ ID NO: 946 - DNA, 557 bp, Hordeum vulgare
  UNSURE (29),(30),(54): n stands for any base
gagtaattttgcattcatgctggatatanntgattgatcgagtatttttgacgnaaaaccaggctgatacatatatataccatgtgacctggaagttggatgattgaccaaagtttgtttccaggcatgctgatatagtgcgtggcgtggctttgacctttttctatcaccgacttgtagaaaaaccgacagcgggtgtgaaaatgtacatcttgcagtcgtgcatatcgacttgggctccaaaagttcctaccacgttcgccgatagagtctcatgcttccacagatctctaacagaataggcagacgaaccatcaaggcctacagcaggcaatgtcatcgtgatattaacagtctctgaacaacgattccataaagcaacggccaaacggttgccagagagggggccagcccacacctcacggcatccaccttttccttgacccaaaattcttcttccttggactccgagaggatcttggtttacttgaattacttctttgttgctcaatatttcaattgtttgtgaagtcatatttctgacatcacaaccaatt

SEQ ID NO: 947 - DNA, 517 bp, Hordeum vulgare
atgaaaagcctaatctttgtgttcttgttactggagcacttggtggaaggtttgatcatgaggctgcaaatatcaatgtgctctatgtgttctcagacatgcggattgtccttctgtcagatgattgcttgatccaacttcttcccaaaacgcatcaccatgagatctatattgagtcgtctgtagaaggaccacactgtgggatttttcctattggagcaccctctacaagcactacaaccactggcctcaagtggaacctgagtgatgcagagatgagatttgggagcatgataagcacgtccaacatcgtggattcggataaagtaaccgtgcagtctgatgcagatcttctgtggacaatttctcttcgaaatctgacctaaacagcatccacttaattggaatcgtctgctgtgtttcctttttgtaaaatcttcgttgatcttgtgtgttgtcagctcagctcttgtacagtgcagctgtgttcatgctcataagttgttctgtatctgat

SEQ ID NO: 948 - DNA, 550 bp, Hordeum vulgare
gaatccttatgatatctcgtgggtctcatctatctgacacagaggtttcaagtttcaaccacaagccacaagatatcctttatttatcagatacagaacaacttatgagcatgaacacagctgcactgtacaagagctgagctgacaacacacaagatcaacgaagattttacaaaaaggaaacacagcagacgattccaattaagtggatgctgtttaggtcagatttcgaagagaaattgtccacagaagatctgcatcagactgcacggttactttatccgaatccacgatgttggacgtgcttatcatgctcccaaatctcatctctgcatcactcaggttccacttgaggccagtggttgtagtgcttgtagagggtgctccaataggaaaaatcccacagtgtggtccttctacagacgactcaatatagatctcatggtgatgcgttttgggaagaagttggatcaagcaatcatctgacagaaggacaatccgcatgtctgagaacacatagagcacattgatatttgcagcctcatgatca

SEQ ID NO: 949 - DNA, 519 bp, Hordeum vulgare
gcgtcatcgacagcatcaaaacccagctggagagtatatgcaagcagaccgtctcttgcgccgacatcctcaccgtcgccgcccgggactccgtcgtcgcccttggagggccgtcgtggactgtcccgctggggagacgggactccaccaccgcaagcgcggcgctggcaaacagcgacctccctggccctggctccagccggtcgcagctcgaggccgcgttcctcaagaagaacctcaacacggtcgacatggtcgcgctctctggcgcgcacaccatcggcaaggcccgctgctccaccttccggactcggatctacggcggcgacaccaacatcaacgccgccttcgcgacgtcgctcaaggccaactgcccacagacaaccggctccggcgacggcaacctagcgaacctcgacacgaccacgcccaacgggttcgacaacgcctactacaccaacctcctgtcccaaaaggggctcctgcactcggaccaggtgctcttcaacaacgacacca

SEQ ID NO: 950 - DNA, 552 bp, Hordeum vulgare
tgtaagctaggcttgatggtaatttccccttgccttttgcatgggaaattgataattcgaccgttacatgtgtagatgcacgcatgctttgctggtgcacgtacttaaatacacgtttcaagtgctggtagatactgatttgtattgaccactgttcttgggccttattcattgacatgtgatgctggagagctgccggattgtagctcgtgcgtcaatcacgagttcaccttggagcagctgagcctgatctggccctgcgtcccggtgagcggcgcgatgtttcccatcttgatcatggccgtcgtgaaggcgctgctgaaggccgccgcgctggacgcgaagttccttaccgtgttgtcggtggtgtcgttgttgaagagcacctggtccgagtgcaggagccccttttgggacaggaggttggtgtagtaggcgttgtcgaacccgttgggcgtggtcgtgtcgaggttcgctaggttgccgtcgccggagccggttgtctgtgggcagttggccttgagcgacgtcgcgaaggcggcgttgatgttg

SEQ ID NO: 951 - DNA, 390 bp, Hordeum vulgare
attgcataagtgtctcgatcgacaccgtcaacaattaagtgacgttgcatttgagctagctagccatgacctcttcgtccctatcagtcgtgttgctcttgtgcctggtcgtggcggcgtcggcgcagctgtcgccgacgttctaccaaacgacgtgcccgaacgctctgtccaccatcaaggccggcgtgacggccgccgtgaacaaggagaaccgcatgggcgcgtcgctgctccggctgcacttccacgactgcttcgtccaaggttgtgacgcgtctgttctgctgtctggcatggaacaaaacgcggcgccgaacgtcatgtccctgcgaggcttcgaagtcatagacagcatcaaggcgaagctcgagaccatgtgcaagcaga

SEQ ID NO: 952 - DNA, 382 bp, Hordeum vulgare
tttttttttttttgttcgttgatgatagttcctattgcaccactgggcctttatggctttgcacattgacatacatatgacacatgcttaaggtccaagaaagcgctataatggccgttgatcgccttgttaatcccacgtatattaccatttttgccgattaattcaccttcgagcagctgatcctgacctggccctgcgaaccggtcaacgggctaaggttccccatcttcaccatggccaaggcgaaggcgctgctgaacgccgctggattacttgcgaagttgttgacgttgttgtcggtgccgccgccggtgcccgtgaaaagaacctggtcggagtgtaggagtcccttctgagacttgaggttgctgtagtaggc

SEQ ID NO: 953 - DNA, 518 bp, Hordeum vulgare
cttacttcccgactgcttcgttcaaggctgtgacgcgtctgttctgctgtctggcatggaacaaaacgcggctccgaacaacgggtcgctgaggggattcgaagtcatcgacagcatcaaggcgcagctcgagggtatatgcaagcagaccgtctcctgcgccgacatcctcactgtcgcctcccgtgactccgtcgtcgccctcggaggaccgtcatggacagtccctctcgggagaagagattccatagatgcaaacgaggcggcggcgaacctggacctcccaggctttacatctagccggtcagaacttgagattgctttcaagaacaaggggctcgacacggtcgacatggtagccctctcgggcgcgcacaccatcggccaggcgcagtgcgggaccttcaaggacaggatctacaacgaggctaacatcgacaccaccttcgccacaactctccgggccaactgcccccggtccggcggcgacggcagcctggcgaacctcgacacgacga

SEQ ID NO: 954 - DNA, 553 bp, Hordeum vulgare
  UNSURE (18): n stands for any base
cctgttcgtttgcctggngcaaggttttgacaacggttacatgcttaattgccatcaaaagctagatatttttacctttaccaaacgcccaaccatgcttagcaaggctagtttagttcttgccttagatccaaacataccctatattggccacaggttcagctggggccttattcattcacgtacttgtcgtgcttgcgagccctgccgactagtaggtagtagctcgtccgtcgatcacgagttcaccctggagcagctgatcctgatctggccctgcgtccccgtcttgggcgcgatgttgcccatcttgatcatggccgtcgtgaaggcgctgctgaacgccgccgggttggacgcaaagttccggacggtgttgtcggtggtgtcgttgttgaacagcacctggtccgagtgcaggagccccttctgggacatgaggttggtgtagtaggcgttgtcgaacgtgttggccgtcgtcgtgtcgaggttcgccaggctgccgtcgccgccggaccgggggcagttggcccggagagttgtggcgaaggtg

SEQ ID NO: 955 - DNA, 524 bp, Hordeum vulgare
ggaactccccgcagcgcaaccccggcgatccgctccggctccttcccggcgcttcaggaaaaatggccgagcatctcttcgaggacatcttccacgtgaccaggatcgaccctgacggcaagaagttcgacagagttaatcgcattgaagctagaagtgagcagttggacatgtacatgcaattagatatcgccactgatgtctacccaatgcatatgggtgacaagttcaccatggttttagctccgacattgaatctggatgggactccagacactggctactatacacaggctggtaggaaaacacttgctgacaagtatgactatgtcatgcacggaaagctttacaagatttcagaggacggtggcagtaaggataaaacagctcctaaagtggagatctatgcatcttttggtggcctcctgatgttgctcaaaggtgatgcttcaagtgctgctaacctcgagctggatcaaaggctgttcctcctcatccgaaaggtgtaagcatgtcatctacca

SEQ ID NO: 956 - DNA, 545 bp, Hordeum vulgare
taattattaccgaatacacatccacgcagcatcgtaatgtacgcgaacatcggcaacatacattagtcacacgcataatgcgctccgggggaacaaggataagcggctggtgctactgagaagccgttgtaccaatccagagtcatattaccgccaaaagagtacacaagggggtaggacgattagcacccaaacgatcacaggttccgtatagccctgagtggaactacaagcgctggttatctggtagatgacatgcttacacctttcggatgaggaggaacagcctttgatccagctcgaggttagcagcacttgaagcatcacctttgagcaacatcaggaggccaccaaaagatgcatagatctccactttaggagctgttttatccttactgccaccgtcctctgaaatcttgtaaagctttccgtgcatgacatagtcatacttgtcagcaagtgttttcctaccagcctgtgtatagtagccagtgtctggagtcccatccagattcaatgtcggagctaaaaccatggtgaacttg

SEQ ID NO: 957 - DNA, 550 bp, Hordeum vulgare
gtctcccgggcctgcagaaattcggcacgaggcggaaggtaagggaggaggaggagaaggagagcggcggcgaagatggtgtcgctgaagctgcagaagcgcctggcctcgagcgtcctcaagtgcggcaagggcaaggtctggctcgaccccaatgaggtcaacgagatctccatggccaactcacggcaaaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgtgtgctgaggcgtcttctgcgcaagtaccgtgaggcaaagaagatcgacaagcacatgtaccatgacatgtacctgaaggtcaagggtaacatgttcaagaacaagagggtcctcatggagagtatccacaagtccaaggctgagaaggcaagagagaagaccctatctgaccagt

SEQ ID NO: 958 - DNA, 556 bp, Hordeum vulgare
  UNSURE (23),(24): n stands for any base
ggttcaaaagcataatataatannccgtgaacccaaatgttttaacaaactctgcttaagcatctctgaaacatccagcagaacaaacacgatatgatatttaaggtatctgacaagttgacacaaacacgatattgcacaggaaacagttctgaacttctgatgttccaaaattaggctaacccttgatgataccagaaagctaaagcttcaagtcagaccttcacttcttggccttctttggtgccgctgctgccggagctggagctgcagccgctggtgccggtgcatgatctctggggccctgggccaatctctcctccctcctggcaatcttcctctccctgcttgccttgctcttggcacgcttggcctcaaactggtcagatagggtcttctctcttgccttctcagccttggacttgtggatactctccatgaggaccctcttgttcttgaacatgttacccttgaccttcaggtacatgtcatggtacatgtgcttgtcgatcttctttgcctcacggtacttgcgcagaagacgcctcagcacacg

SEQ ID NO: 959 - DNA, 517 bp, Hordeum vulgare
ggaggttgatggtgaatttaccagacgcaaccaataggaaaaaaattattagtgtaatactagccaaagaagatttggccgaagatgtagatctagaagcagtggccagcttgactgaggggtattcaggcagtgatctgaagaatctgtgtattaccgctgcacatcgtcccataagggaaatccttgacaaagagaagaaggagagactcttagcagaagcagaaaacaaaccattgcctcctaagtattctagcagtgatgtccgtcctctaaatatgagtgatctcaaacaggcacacgagcaggtatgtgcaagtatatcatctgattcgacaaatatgaacgagcttgttcagtggaacgagctttacggtgaaggcggatctagaaagaagacacctctaagctacttcatgtagtttatgtgtagtctgtacatagaacagaaacattatagtgaagcggactgagaagatagacaatgaatagctctgttggtttcttcattcatagg

SEQ ID NO: 960 - DNA, 548 bp, Hordeum vulgare
ggttgaaaaaatggtttattttacttaagcccatgcactgtatacaagacctaaatggtttcgcactggctggaacatcaattaagtgaactgtattctgatgctgagtctacatacaggtttgaccgttcaaggaccaaccagatcctatgctattgctatctgtcgaaactccgaactggcattacagaacaattgactcaaaaaattgcctatgaatgaagaaaccaacagagctattcattgtctatcttctcagtccgcttcactataatgtttctgttctatgtacagactacacataaactacatgaagtagcttagaggtgtcttctttctagatccgccttcaccgtaaagctcgttccactgaacaagctcgttcatatttgtcgaatcagatgatatacttgcacatacctgctcgtgtgcctgtttgagatcactcatatttagaggacggacatcactgctagaatacttaggaggcaatggtttgttttctgcttctgctaagagtctctccttcttctctttgtcaaggattt

SEQ ID NO: 961 - DNA, 414 bp, Hordeum vulgare
gcttgatttcactagcatgaaggaagaggacctttacgagattgatattcccctgagttttgtatcctctgttgggactagggtgcatgggctagcctgttggtttgatgtgctgttcaacgggagcactgtgcaaagatggcttaccactgcccccggctcccctacgactcactggtaccagttgcgatgtgtacttgcacagccattatatgtcatggctggccaagaaataaccggccgcctgcatttggtggcccacagtgcgcaaagctacacaatatacttaacaatgtcagccaaaatgtggggtgtgggtgcggagccaggcggcattctgcagacatccactgccaagcttgaactgaaggagccttactacagattgtctcaaccacaagcttatatgccaca

SEQ ID NO: 962 - DNA, 555 bp, Hordeum vulgare
tatcattctatacatacttacactcccacacacaacaataatttgtagaatagaactccagggcgcaacaatcgatctgaatatacataagaacatacaaccttcttccctgttagatgccttctaatttcgactttgtagtccgaccagatgcactattattgttgtatgacatcaaatagcggggtaggggcgagcacgtttagctgcagcgctgcacaattcggacatgatgatctctgaccgcaactagacgcgatgttagccaattggcagctacgcgtggctgcatccagcagaagcatattgttgtacagacctgagctccttgcacgaagcaaagcatgcaggttccagacctatcgagtgaaggctgcagagtccctctcctgttctacagtgatgcccgggctgagcccatcttgcatctgctgcccagatccttgcgcctgcaaagatgacaacggtagctgctgttggtcttgtggcatataagcttgtggttgagacaatctgtagtaaggctccttcagttcaagcttggcagtggatgtc

SEQ ID NO: 963 - DNA, 896 bp, Hordeum vulgare
  UNSURE (789),(801),(863): n stands for any base
cccgggctgcaggaattcggcacgaggtgtcgctttcccaggccctcctgcccgccccggctcgccgagctagctagctccggggccgtagctccagtacgtggtcgcggcttctaccctcccctgctgctgctgcctcttcgactagccgccgcagccgccgccgcgagaattcagtggtgggcgggtgcccccaatggacgaggagatcggcgccgccgcgcggcagggccagtggaaatatcacaaagctctctccctactagcgtttcagagctttggtgtggtgtatggagacctgagtacgtcgcctctctatgtattcaaaagcgcactgtctggactggatgattacagtgatgaggcgactgtctttggattgttttcactgatattttggaccttgacactcattcctttgctcaagtacgtcataattgtcttggctgctgacgataatggcgagggtgggacatttgctttgtattcactactctgcaggcatgcaaagatgagtctgcttccaaaccaacaagctgcagatgaagagctgtcaacatactatcagcctggggttgatcgtactgctatgtcatctccattcaaaaggtttctagagaagcacaagaagctgcggacatgtttgcttctttttgttctgtttggagcatgcatggtgataggtgatggcgtccttacacccaccatctctgttttggctgccttgtcaggattacaagacaaggacacaggtggattaggaaacggttgggtagtactcattgcatngtgtgtgcttgntggcctctttgcgctacacacccgagtactcatagggtggcatttgtgtttgcccccattgntgtaccttggctcttgagcattggtatcattgg

SEQ ID NO: 964 - DNA, 552 bp, Hordeum vulgare
tatcatggaactggaaagtctaaaacgtggtgtatttacatgttcgccgaagccccggaaatcagaacggtggcagcttagcctgttcggccggccaccgaacatctttacatcgcctgaaagctcggcgacactaacaggcatccaaaagaactgacgaaaaattacactaaacgtagtagatcatgccgacctcgatgaggctgatgtggggtatgtgcagcgtcaccgatgggcccctgcagttcttgcgaaggaacgagtaggcgtagtcgatggcgaacgacttcaagaagttggagttcttcctcgccttcacgtaggagtggccaatgatgtacgccacgccggcctccttcgcctccaagaggtccgacagctcgtcacgcacctgcgggttgacctgctcctcctcggcgatctggaaacggacccttcggcggctcaggctgcccgactcctgctcgtagatggactgcaggctctggagggtctccgacttgctgctcctggtcagggaggtgccttcgttggagtctctcatgaccagcc

SEQ ID NO: 965 - DNA, 550 bp, Hordeum vulgare
  UNSURE (20): n stands for any base
gtacccccgggtctgcaggnaattcggcacgagggagttgaaggtggtgcttccatgacagggacatcgcccctgatggcaaaacactcgcggaaacaaatgctaacttggatgagatagttgagctggcaaagcaactccagagtgagaccaatataaagccattatggggaactgcacaacttttcatgcatccacgttacatgcacggagctgctactagcccagaggtcaaggtgtatgcttatgctgctgctcaagtgaagaaagctttggaggttactcactacctaggcggtgagaactacgtattctggggtggaagagagggttaccaaactcttctcaataccgatatgaagagggaacttgaacatttggctaactttcttcaagctgctgttaaccacaagaagaagatcggctttaacggaacattgttgatagagcctaagccacaagaaccaacaaagcatcagtatgactgggatgttgcaactacattctctttcctacagaagtttggtcttacaggggaattcaagataaa

SEQ ID NO: 966 - DNA, 528 bp, Hordeum vulgare
  UNSURE (17): n stands for any base
caaattccgtgttgagnaacgagtttaattttgatataaggttacattattttcagctccacgcagtttgtttacagggttcactgcatggaggcctaactatagaacatcgcctgtagcgacgaggacggctgggcgttccaaggtcgcgctcttgcttttttattcctagaaccgtgggccgccatctacagagcggattggaacagcatctcagccaattcctgtttgcccgatggaacggttggctcgccccactccaagaccttcttttctagcgtttcaaagtcgcccttcccagcctcgatcatggcaccaatctcagtgtcaaagctctggtagcgtttgcgtacaagctcgtccagggaaccatcctcaatcagcttggcaacattgcggaggccgcgggccatggtgtccatcccagagatatgggcaataaacaggtcctcaacatcagtactctccctccgcaatttggcatcaaagttgaagccaccaggcgcaagtccatcattcttaactaca

SEQ ID NO: 967 - DNA, 552 bp, Hordeum vulgare
gtacccccgggtctgcaggcaattcggcacgaggcagaagctgtcgggcgggctcgagccgctggacgcgcgcatcaaggagctgacctcgtcgcagggagagctgctggccaggatccagaagctcaaacaggtatcgtatgtgggccgtcggatagccctgatagcatgcatcgaagggctcatgtgatgtgagaagtttgattttgaccttggctcgaagcctgcgttttcaggaggtgcagaattggcgctccaatgtcgaggcgcaggtcaagacctgccacaacgtgagtagcactcctctatttctttttagtttacttcgcatattaggttggttttaagtcaataggttttaaaattttggccaggtttatagaaaaatatatcaacgtttacgatacaaaatcgaaaacactagattcaaaacgggatatgctttcgtgttaaacttagttggtattgtacatgctcatgatttcattgtgctgacggttaataagttacctatataggagcttgtggaggtgaaggagggacttgcttctg

SEQ ID NO: 968 - DNA, 562 bp, Hordeum vulgare
  UNSURE (28): n stands for any base
tttgttcactgactttcactgttataantggtttcactttcttacagggtcttgaaacctctgcactccagtttgctgataccgacatagtggtagtatgtggcaagcaagcgcgatgtgcaagccagttcatatacatatctacccctcctgacctaatgtgctagtactatgtatttgcctaattttctgggtggtccaaatgactaagttgagcatccacctgcacaagttctgtttgaatcagggatcgcaaatttttcatgctttcaccgcagtttgttgttccgtcttttcatcatcagtcttgagtacttggtcttcttgtgtctgccctgtttgctccgttttcgagcccgccttctcttcctggagggcagacctgatctctttgatgtccttgaagcaacaaataacacaatgtgagcttgaaatgtttcaaggaaacacagagagccagacggcagtaaaaaggtggacagaaagaagacacacggatctcaggtgctgcacttcagaagcaagtccctccttcacctccacaagctcctatataggtaac

SEQ ID NO: 969 - DNA, 518 bp, Hordeum vulgare
atgccaaagccggagcccaaacctatgcctaagcctgaacccatgccaaagccagagcccaagccggaacccaagccggagccgatgccaaagccagagcctaagccagaacccaagcccgagccgatgcctaaaccagaaccgaaacctgagcccaaacctgagcctatgcctaaaccagaaccgaaaccggagcccaaacctgagcccatgccaaaacctgaaccaaagccagagcccaaacccgaaccgatgaagccagagcctaaaccgatgccgaaaccggaaccaaagccagagcccaagcccgagccgatgccaaaacccgaaccaaagccagagcccaagcccgagccgatgccgaaacccgaaccgaagcctgagcccaagccttaccccatgcccaaacctgagcctaagcctgaacccaagccagagccgatgccaaaacctgagcctaagcctgagcccaaaccagagccgatgccaaaacccgaaccaaagccagagcccaaacc

SEQ ID NO: 970 - DNA, 554 bp, Hordeum vulgare
gacattattgtacttaactgtaatgaataagatcatgtgtacatacacgaaagaacaaccgagtcatgtgcacagatgaacgcataccagcacgcaaatgataattacaaagtagtaataatcatcatgggtgcatggaacaagagaaactaaaaagggatgatggaatacaaggaatgcaaaaaagatgcatcatcactatctcgctagccggatactatgccacttattctggaaatagcacatcgtggctccggacggggtcgatctcctcctccttcggctgtcatatgtgagcatcacatcaattgtccgtcatcggcggcttgcccttcggaggcggctccggcttgggttcgggttcaggcttgggctctggcttaggcatgggttgaggcttgggctctggttttggcattgggtaaggcttgggctctggctttggcatcggctcgggcttaggctccggctttggcatcggctctggcttgggttcaggttttggcatcggctcgggtttgggctctggcttcggttcgggttttggcatcggc

SEQ ID NO: 971 - DNA, 553 bp, Hordeum vulgare
gtccccccgggcctgcaggcaattcggcacgagggagctccaatccaatctcaccttctttcttcttcctacccatttccagccgtcgccgccgccgccgaggtcgatggagagatggaggcgggtcagcgtgctggccatggcgctcctgctgctctccgcttgtcatggagcagagttctctgtcaagaatcacgatcagagtcttatttatgaccatactcttgctaagaccattgtggaatatgcttcagctgtgtatatgacagatctaacagctttgtatacatggacatgttcaagatgcaatgacttgactcaagacttcgagatgaggtctctaattgttgatgtggagaactgtttgcaggcatttgtcggtgtagctcacaatctaaattccataatagttgcaatcagagggactcaagagaacaggtgctaaccaaattgcatgtgcttctagtattctcaattaagccgtgtgcagaattggatcaaggacttgatatggaagcagcttgatctaagctatccaaacatgccaaacgca

SEQ ID NO: 972 - DNA, 549 bp, Hordeum vulgare
ggcaatgttatcaatttattctgcttttttccagactggagacatctgcatagatatctgcatgggtactgtattttacaagatgtgaacacagagtatctttcgtgcatccggcaagagtttacggtctagaacctataattcgtgtctacatttctacatattcacaggctatgaaagaacaatgtacaacccaatctgaatgaaattccccaactgaaaccccccatcttcaagagaaagaaaaggcgtcgtcttctgttacaaatatagtgttaacagtaatgcagtatgctatctggaactgctccagtctgtctgcacactattctcgacaatggagacgtcggcatcatgctttgtcatgatgatgttgctggcaagatccttccgtaatcgctcgacgctttgggctgtgatgattctgcaggtgctccagtcatctgattccatatctactcccaggtatgtgaagtggtcctgaatactcaggctcaatatggagaggcacctgcagcagtttggatcttcgccgctggcatcacaaat

SEQ ID NO: 973 - DNA, 515 bp, Hordeum vulgare
  UNSURE (476): n stands for any base
agtaatgagcttgacctctcgaacatcagggaactgtgtgatcaagtcctggctctttctgagtacagagcccagctctatgactatctaaaaagtaggatgaataccattgctcctaacttgactgcacttgttggtgaacttgttggcgctcgccttattgcacatggtggtagtttgatgaatctggccaagcaacctggcagcacgattcagattctgggggcagagaaggcgttgttcagagctctgaagacaaagcatgctacaccgaagtatggtctcatctatcatgcttcattaattggacaggcggctcctaagcacaagggaaagatctctcgttcacttgctgctaagtctgcacttgccataagatatgatgcccttgctgacggtgatgataactccatgggtcttgaaagcaggatcaagcttgaaacacggcttcgggttcttgagggtaaagatcttgngaggtctgctggttccacaaaaggaaagcccaagattga

SEQ ID NO: 974 - DNA, 541 bp, Hordeum vulgare
attattactactaaacagaatgaacacagcagatgttatagatgagagcacagcactgggcctcttaaagtgactgctcaccacttgcaagttttgaattgtagggttcgtcgctgctagtcctaatgtggcattccattctacacgaatggcaagtcccaaaactttcagacgatcatagtacagcaatacaccacaaattcccgccatatctccgtgctgctcactcgtcagcgtgcttcttctttttcttcttcttggcagacacgtcagtctccatgggggtgtcctcggcgtctgatttcttcttctttttcttcttctcgccgtccgcatcagctgcaggggtctcctcggcttccttgctcttcttcttctttttcttctcgctagcatcagcatcagctgcgggagtctcctcggtgtccttggatttcttcttcttcttcttggacttctctttctcctgctcaccatccttttcagctgcctccgcggtaggttcttcctcttggtgcttcctcttctttgaagccacctc

SEQ ID NO: 975 - DNA, 350 bp, Hordeum vulgare
cgccgcctccggcgggacgcccaccggccgcttcaccaacggcaggaccatcgccgacatcataggggagatgctgggccaggcggactactcgccgccgttcctggcgccgaacacgacgggcggcgcgctgctcaacggcgtgaactacgcgtccggcggcgccgggatactgaacgggacgggcagggtgttcgtgaaccggatcggcatggacgtgcaggtggactacttcaacatcacgcggcggcagctggacggcctgctgggcgaggacaaggcgagggagttcatccacaagaaggccatcttctccatcaccgtcgggtccaacgactttctcaacaact

SEQ ID NO: 976 - DNA, 383 bp, Hordeum vulgare
ttttttttttttttttccctcaagaaaagatgttgtcttggcttgtactacaacggacgaagatagggaacgcagcaacacgatcaatatttctaacccgtcgtgcatatgcgcgatcgtgcacatagttcatacatcaaatatgtccccagattatacatgcccaaacttcacgaaccgcgcgcaaccaaaaagggaaagatgtcaccggcgatcgaatctctctgtctagagcttgaagagcttcctgaggttcatgggcgatatgtacttgctgtcgccgtcgacgatgtacttggcgagcagcacgttggccttctcgctggggtgatacgggtcccagaagacgtggttctcccggtcgtcgcacatgctggacgtcg

SEQ ID NO: 977 - DNA, 468 bp, Hordeum vulgare
gaacttactggaagtggtccctggaacattggaagatgattttgaacttatccataccccaggccacaccgaaggatcggtctgcttgttgtacaaaccgctaaaggcactattcactggcgaccatgtcgcaaaatcagaatattcagacgaactgaatctctttcggatgtacagcaagcaatcagtgaatttgcaactggatagcatgaggaagttaatggacctagattttgagtggtatttacctgggcatggctatcgaatccggtatgaagacgtacatgccaaaaatgcagctattgagtctctcctagctaactacaaaaactagggagcatcttgtgacaacgtactttccaaataaggattccagaataaagggaccaggttgatatggagtcctagtatccagcgaaataatgatcgatgctactgcttttacatttctccaaacattatgctaat

SEQ ID NO: 978 - DNA, 552 bp, Hordeum vulgare
aggtcgatgtccaaaaaataaataaagtaacactggtctcccataagcatgatatttggtctcaaaaaactactactccgatccaaaataagtaccatggttttagttcaaatttgaactaaaaccatgacacttattttggatccgagggagtacattatattttcttttgcaggatgccccaataatgtccgtaacttgatataagcatgcccaacccttatacatcttggagagagatatcaagtactagtacttgatataagcattagcataatgtttggagaaatgtaaaagcagtagcatcgatcattatttcgctggatactaggactccatatcaacctggtccctttattctggaatccttatttgggaagtacgttgtcacaagatgctccctagtttttgtagttagctaggagagactcaatagctgcatttttggcatgtacgtcttcataccggattcgatagccatgcccaggtaaataccactcaaaatctaggtccattaacttcctcatgctatccagttgcaaattcactgat

SEQ ID NO: 979 - DNA, 525 bp, Hordeum vulgare
cggcacgaggggcgggcggccgaggcgggagcgggctccttcgtctgagctctccttcgccggagctctccttcggcgggtctcatcctcctcttcgggctgctcgaagccagtgaggtgagtatggacgccgacgcggaagctgtggagcctcatggacacgaggaagcgtgggttcgtgtcggaagggtagtgataaacatgctggattggttttgttttttctcctggccgatctttgggggcctctacttcgcccatatctgggactctgactcagtctgtatcggcctggggggcatgacccagtggcttgtggtggcaataccaattgtctcctttgtgatcttcatggtcaccttcatgtccatggtggatggcggcggacgggcacggatgaggttactacatgccttcgcggtgatcgtcggtctctcatggctgtacatctgctactgagagtagttatcctgtcttgctctcgtggctgtacatctgctactgagagtagttatcctctaatat

SEQ ID NO: 980 - DNA, 521 bp, Hordeum vulgare
gtccttccgggcctgcaggaaattcggcacgaggcaagaactgaagatgaactgcccctcctcctcctcctcctgctgcggcgtctctcctccggtcctcgccagccctcggggggaattcgctgctggttgctccacaagaacaacccagaaggcgcatttcctcggttcaaggcaatcctctcagctgatctacagcccaacatcatcgcggttgtcgaggagagctgtaatcgccttggccggaaagcagtcttgggatatcggcaggttcgccaagactctatttttcttcaacgggcctccgaatcctctcaagattgtggagtccataatgagcagcatcacagcctctgctcccaccgaggcgccgaagaaagcagagacttctgatgtggtgcttgtcactggagccaccggcggtgtcggacggagagtcgtcgatgtcctgcggaagaagggggtgcctgtccgagtattggttagaaatgcagagaaggcgaggacaatgttggggccag

SEQ ID NO: 981 - DNA, 376 bp, Hordeum vulgare
ttgaaggcagctggtgcttcatggattcagtttgacgagcccaccctcgtgaaggatcttgaatcccaccaattggccgcattctctgcagcttacacagaacttgagtcgacactttctggactgaacgttcttgttgagacctacttcgctgatgatcccgcagaatcatacaagactctgacatcattgagcagcgtgactgcttatggttttgacctcgaacgtggaaccaagactcttgagcttgtcaagagtggtttccctgctggaaagtacctttttgctggtgttgtagatggacgcaacatttgggctgatgaccttgctgcatctcttgccactcttcagtctcttgaggctattgttgggaagg

SEQ ID NO: 982 - DNA, 518 bp, Hordeum vulgare
ctttgctgctgcatgcagtcctgcagatgcatcacttgttgtttcgggaggtaaagatgacagagggtttctttggaggattggggcagcacaggatgttcaggagctgactggacatggagacacggtgtgcactgtggctttcagttcagatgggaatttggtggcttgtggtagtatggatggacagataaatgtatggaatacagctacacggacgcttcagggaacccttgagggttcatctggatcgggctttgagtggctgaaatggcatccacggggtcacttgataattgcaggatcagaagactgtaatatatggatgtggaatgctgaccacaatgcctttctgaatacatttgctggtcacagtagcacggtgacatgtggtgattttacccctgatggtactgagcaattttctctagtgttatttatattatgcataacgttgttaagccggctctgaataaggtataatatataccaccccagtctggactttattgtgtcct

SEQ ID NO: 983 - DNA, 393 bp, Hordeum vulgare
gtgcgccaagttctgtctcccgtcacataaccagcaaccgccgagcgccacgcctagcagaccaaccccacgccgccgccgcattcacccacgcgcgcacagaagactccagtcttctcctctcctctcctctccccccgtagccatggcggtggtggacaaggcggccgccgggggcggcgaggcgcagcagcgggagccggagccggcggccgaggcgtcgacgttcgcggagctgggcatctgccgcgagctggtggaggcctgcgacgccatggggtggaagcagcccaccaagatccaggcgggggccatcccccacgccctccaagggagggacgtgattgggctggggcagacggggtccgggaagacgggcgctttcgcgctgcc

SEQ ID NO: 984 - DNA, 415 bp, Hordeum vulgare
ttttttttttttttttaagagacgagttcgatgtaaatgtgaaatattcatgtactccctccgatccatattaattgtagcccatttagtacaaggcagtagcatacacgtgaaaccttgtgtcaaacagagaaatagctattgctcaaagtgtgctgaccttctaacaaagatagcatggatagctcgtacacgaaggaactaacatggctggtgcgtcggaccaactgcgggcaaaatttcgatgaatacctttcgcaaggcggagcggtatatacggaatctactggtcatgaggcgggagcttccacctatctggaccccgagtgctatcatcgccctgatgatttcttgaaagacctcgatttctgtcggtgacctcttggagcctcctcttcttcatcatcttcatcct

SEQ ID NO: 985 - DNA, 520 bp, Hordeum vulgare
gggttcagggtcggtgtcatggagcccaagtcgggtcccacatcaccgaggccaccggaatcccttgcgagtccaacgactatatccaggaactgcttcgtgcggtgcggctgcattttgatcaattcattgaacaactcaagccatctgacctggagaaggcccagcttggtctggggcatagctatagcagggccaaggtgaagttcaatgtgaatcgtgtggataatatggtgattcaagccatctttctgttggatacacttgataaggatgttaattccttctccatgagagtgagggagtggtatggatggcattttcctgagctggtgaagattgtgaatgacaactacctctatgctaagcttgccaagtttgtggtaaacaaatctgacttgtcagagaaggacattccagctttagcggatctaattggagatgaagacaaggcaaaggaaattgttgaggcagcaaaggcatctatgggccaggatctttcacctgttgatttgatcaa

SEQ ID NO: 986 - DNA, 547 bp, Hordeum vulgare
gtttccctggtgccgtcttgggtcacagactcggcatcgcggttcttctttttcttcttcttgggggtctcgtcgtcgccgttggcttgcatctcctcgtcctgcggctcctcaagcttgtgcttcttcttcttcttcttctcggttcccgtttcagcctcggccgcagcactgtcaacgtccatcgcgtcaccgttagcctcagctttggacttcttctttttgcttttcttcacggatgcatcaccattctctttgccgtcatcatcctctgtgttcgtcaagccgtcaatagcagctttcatcacatcaaggttcttgcggggtgcaacacccttgtcgtaaaagtctagtctctcctcaacctgttcacgcagcttctcaccaaaaatggagctgctcatatctgaatagcagtcaatacgtgaagcaatggaacatttgtttgccaggtatcgagccattcttcccttgttcttagttgatgcacgcccaataaaagatgagtggaatatgaggccatacttcggtgtgtttccacgtgttt

SEQ ID NO: 987 - DNA, 216 bp, Hordeum vulgare
tgagcacatcctgccgagaaacaactaccctaataaccaacaagtggacacgaggtccagattattcaaagtaaaacgccggccatggcaacggtgacatcctccttgcaattaaaaggggggagagctgctatacgagcacggcttactgagccttgtcgagctcgtcgcggatctgcttggcggcctcaaccatgttggtgagggcgggcttga

SEQ ID NO: 988 - DNA, 542 bp, Hordeum vulgare
aacgttaggcaaataaagtgcttgtacacgaccgactaccctcaacttaggagggtcttgtgactcttgtaccacttgcaccattgaccacatgtcaaggacaagtacagtaccaaccaaagttttcagtgccccatgatggctgcaagcctgtaagtataattcctgaccatacaagctgagcaaacccccacttttgactggccagaatgaccaaccaaatcaaccatgttgttgctgctatgatttttctcacttgaacatagagatgtcgaagacacgggcagatttatccgtcgagaccgagactatggagttgccgtcagcagagacggccagcgactgcacgacgtccctgtgcccgctgaaggtgcgggccaagtcaccggagaggctgtcccagatgcgcaccatgccgtcgatgcatcctgacgccacatacctcgacgagcccagccacgccaggcatgtcacaccttcatcatgctcgcaagtagaccgaattgcttggcgagcaaggtcccagataatgagagttctat

SEQ ID NO: 989 - DNA, 520 bp, Hordeum vulgare
ctcgttcgtggagcagcaggatttgaaatattttccaggagatcgagaggcgagggcgtgtgcgccggcgcagtgctttgtccccttccccccctcgtcccaatccagaaagcagcgtccgccagacaaagaagcagtccagtcgggtggagcgaagcaacgggaaactccgcccatcgccacggcacggcaccgcagagagcgagagcggccgccggctactccacacgacgcaggtaagaagagaagagatggtgcacaaggagctgcagcaggcatggtggttcgacagccacaacctcgcgaggacgtccccatggctcggcagcaccctttcagaactggatgacaagaccaagcaaatgctcaagctgatcgaccaagatgcggactccttcgctcagcgcgctgaaatgtactacaagaagcgccccgtcctggtggacatgctcggcgagctgtaccgcacgcaccgctcgctggccgagcagtatgacctgctgaagcatggcagcggcac

SEQ ID NO: 990 - DNA, 523 bp, Hordeum vulgare
  UNSURE (1): n stands for any base
nttctactagtacttactaagtacagataaagcatggctatagcagcaacatagttaaaaatcctctctactggctaagcccgaacaaggatagaaccaaacgggggacaaaagaaccccatcctatatgcacatgaggagctataagaaattctcatgggtctggatgtcaaagatggagagatcgcatcatgccacttcctccctctcttcatcatgttggatgattctgccgcaccaaaactcgctcacagagcgaccatgggacccgtgtgtttgcggtgtccggtgaacagctttgccgagaacagatccttggtcagcttcctgaaatcgaaaccgcggggctgggcctccgcggcggggtggtgcttggggttggggctcttgaggagctcgcgcagggtgcagttctcctgcttcaccatgtcgatggacgacgcgagctgcctgatgacctccctcttctcctcgtcctttgcggcgagctccgccgcgtgagccgccttgttctcctcgatcg

SEQ ID NO: 991 - DNA, 518 bp, Hordeum vulgare
ggggaagatgggtgtgtagttgcgctcacagcatcatctgattcttctcgttccgagacaagcagtggaaacagatattcacccaagccaagtagtggagatggagcttcacccctatcagacattgacagtgcttctgttccaacatatctagctggtaatcttcaaaatgcatcatctgcaataggaattgaagttgggaggagaagtgatgagaagatgtcaaagtgggaaaggttgcaggcgttagataaatggatctggacttctttctattcttcccttactgctgttaagtgtggcaagagatcatttaaggaatcactcgttcattgtgaaagctgtcatgatctgtattggagagatgaaagacattgcagaatatgccactctacttttgaggttggttttgaccttgaagaaagatatgctatacatgtggcaacatgcagggagcctgaggatttgtacgatgtgccaaatcataaagttcttccttcgcagctacaggcactcaa

SEQ ID NO: 992 - DNA, 543 bp, Hordeum vulgare
ttctttcatgaaaataggtattatgctatccagtcggtgcctcgctgaccacttcaagtacaaaaaggaaattacaacgccggagcaatgattattaacaaagaatttctaagtgtttacattattgtacacacaccatcgaccatccgacggagatgccgtggcttctgtagagttcaagatcataacctcaaagctgaaggcatcaggatgaaggcaaaaaaagggcatcatgctcgtctcgcctcgagaaaaagcgcgggcatcaatcaaaagattggaactgatgcaaaaataaaagagtagtggcagctggagcaccgcacaaaataatccatctagtcccttcctagctatctcaagcatgtctctatggaccctttgcctaatcctctgccagaatcagcttgtgccaaatgaggtgcaatgagggcatccaatttgacaacccagagtgcaactgcagacgtcgtttgtggcatcgtttggaagtatacaataatgtcatccagatacgaactaaagcttactgctgatgaactt

SEQ ID NO: 993 - DNA, 534 bp, Hordeum vulgare
ggaattcggcacgagggccttcctcctcctccccaaccactccgctcttccgccgcgcatcgcaccggggggtcacctgagatcacatacacaatggtgaaggctgtagctgtgcttaccggcagcgagggtgtcaagggcaccatcttcttcacccaggagggagatggcccaaccaccgtgacgggaagtgtcaccggactcaaggaagggcttcacggcttccatgtgcacgctcttggtgacaccaccaacggctgcatgtcaactggaccgcacttcaaccccgctggtcatgtgcatggggcacccgaagatgaaatccgccatgctggtgacctcggaaatgtgacagctggagcggatggtgttgctaacatcaatgttactgactgccatatcccccttgctggaccacattcaatcattggccgtgctgttgtcgtccatggtgatgctgatgatcttggcaagggtggacatgagcttagcaagagcactggaaacgctggggcgcgcgttgcttgcgggatc

SEQ ID NO: 994 - DNA, 549 bp, Hordeum vulgare
  UNSURE (12),(25): n stands for any base
gatgaatctagnatagctctacaanataaataatgaaacctgaaatctctctcgttcgctgaacatgcccagagctggtaacggcattaagaacaacagcacatccacaagcacttgacagaactgaactgttccagtcacgcaactcaaaaagccaaatgacagtgatatgaaagttcacataggaatcgacacaaatgatgcacactaaaaagcgatcatagatggtgtgcttatttaaaatagatagcaattgcaagtcggtgtccttcaagtgccaagatctgtacggcgttcatcggcctgcgaagacggcatcttagccctggagcccgatgatcccgcaagcaacgcgcgccccagcgtttccagtgctcttgctaagctcatgtccacccttgccaagatcatcagcatcaccatggacgacaacagcacggccaatgattgaatgtggtccagcaagggggatatggcagtcagtaacattgatgttagcaacaccatccgctccagctgtcacatttccgaggtcaccagcatggcgga

SEQ ID NO: 995 - DNA, 522 bp, Hordeum vulgare
  UNSURE (49),(50): n stands for any base
cctcctcctccccaaccactccgctcttccgccgcgcatcgcaccgggnngggtcacctgagatcacatacacaatggtgaaggctgtagctgtgcttaccggcagcgagggtgtcaagggcaccatcttcttcacccaggagggagatggcccgaccactgtgacgggaagtgtcacgggactcaaggaagggctccacggcttccatgtgcacgctcttggtgacaccaccaacggctgcatgtcaactggaccgcacttcaaccccgctggtcatgtgcatggggcacccgaagatgaaatccgccatgctggtgacctcggaaatgtgacagctggagcggatggtgttgctaacatcaatgttactgactgccatatcccccttgctggaccacattcaatcattggccgtgctgttgtcgtccatggtgatgctgatgatcttggcaagggtggacatgagcttagcaagagcactggaaacgctggggcgcgtgttgcttgcgggatcatcgggc

SEQ ID NO: 996 - DNA, 557 bp, Hordeum vulgare
agagctggtaacggcattaagaacacagcacatcccaagcacttgacagaactgttccagtcacgcaactcaaaaagccaaatgacagtgatatgaaagttcagagtagcagcacataggaatcgacacaaatgatgcacactaaaaagcgatcatagatggtgtgcttatttaaaatagatagcaattgcaagtcggtgtccttcaagtgccaagatctgtacggcgttcaacggcctgcgaagacggcatcttagccctggagcccgatgatcccgcaagcaacacgcgccccagcgtttccagtgctcttgctaagctcatgtccacccttgccaagatcatcagcatcaccatggacgacaacagcacggccaatgattgaatgtggtccagcaagggggatatggcagtcagtaacattgatgttagcaacaccatccgctccagctgtcacatttccgaggtcaccagcatggcggatttcatcttcgggtgccccatgcacatgaccagcggggttgaagtgcggtccagttgacatgcagccgttggtg

SEQ ID NO: 997 - DNA, 551 bp, Hordeum vulgare
  UNSURE (12),(20): n stands for any base
gtctacccgggnctgcaggnaattcgtcacgaggggacgacgtcaaggtgttcgcggcagtgcccgtgaagcccagcgcggagttcccaaacgctgcccgctggtacgacgccgttgccgcggctgtttctccgaggttccctggccaggcctctggggtgagtgcatcatcggctcctgctgcagctgctcctgctgcttccaaggatgaagatgatgatgatgacatggatctgttcggcgatgagaccgaggaggacaagaaagcagcagctgagcgtgaggctgccaagcctgcaaagaagaaagaaagtggcaaatcctctgtcctcatggacatcaagccatgggacgatgagactgacatgaagaagttggaggaggctgtccgcggtgttcaaatggagggtctcacctggggtgcatctaagctcatgcctgtgggttatggcatcaagaagctccagatcatgctgacgatcattgatgacctcgtgtctgtcgacactctcattgaggaagtgctctgcgaggcgcccatcaacgagtac

SEQ ID NO: 998 - DNA, 550 bp, Hordeum vulgare
gtttcatctgaatatcctttacagttagaaaagactgagtttactccccatgatagatgtttcgccattacaaactgctcagcaattcaactatttaaaggtaacagacattcaagaccagggcttgactcaaaaacaaaaccagtagcatttctgtaagaggggtaactaaatgggacgacagagacagaccaatcccagtaccaagaatccagcagcaacaggtgagcggacaaagattctagatcttgttgaaggcaacgatgtcacacgactggacgtactcgttgatgggcgcctcgcagagcacttcctcaatgagagtgtcgacagacacgaggtcatcaatgatcgtcagcatgatctggagcttcttgatgccataacccacaggcatgagcttagatgcaccccaggtgagaccctccatttgaacaccgcggacagcctcctccaacttcttcatgtcagtctcatcgtcccatggcttgatgtccatgaggacagaggatttgccactttctttcttctttgcaggcttggcagcctc

SEQ ID NO: 999 - DNA, 552 bp, Hordeum vulgare
gtacccccgggtctgcaggcaattcggcacgaggctcgagccctccgccacagtaccaccccacccagcaacactccgtcccccccctatccgagtgaaggtcaaacggaccagccagccctccccaccaccctcttctccgcccggccgctccgatcgccgcctcctgaatcccaaggattctgctctataggtttggtcatggcctcagctgcctatcttgacgacattgatgctgaagttattgaccctccaaagattgagatgttagacgccgcagaactcgttggtgatcttatcgagcattcaccgaaaccaaatgtcatagtttctagcaatgtgcgtgagctattggaatgccctgtgtgtttggttgccatgtatcctccaattcatcagtgctccaatggccataccatttgttctggatgcaagccaagggttcataatcgctgcccaacttgcaggagtgaattgggtaacataagatgccttgctctggagaaggttgccgcctctctagaggttccgtgcaagttccagaactttgga

SEQ ID NO: 1000 - DNA, 555 bp, Hordeum vulgare
gagttctcattctataccccagcatcacaaattagaaatttgcgggtctggcacagatacgagtctttacactagaggggggctacatcatttacagtccacgagccaccagcaaggcaacaggatgtcaccaaaacggctcttgttcagagcagaacaggagatttgccttcagctctaccacatcagtaccacctcaatccgcatcacaaccgtccatggaaacatctcagaactaataacagctaagacggtctacacaccattgcccctagtcctaaatcctaatcgactcctcgcggcggttcactcacgcgttacttcggatcgtcgccagaacacaccgccttttttagcatcagccacagctcattgttccttccagatcctcccggtgacccgcagcttgagctccttcctgtcgccaccggagaagcacagggccatgttgcgctggatgatgagcccgtcgtagctgtcccgcactttcctgtggctatccctgatgctccgagggatgccctgccaggtcatcttacggttgatgcctccgac

SEQ ID NO: 1001 - DNA, 518 bp, Hordeum vulgare
ggcgcgcggtgggagcccatgggggcccgggagtactacgactaccggcgggccatctacggcgaaatcacgcacaaggccatcctcgtcgacgccgccggcaccctcctcgcccccaccgagcccatggcccaggtgtacagaacaataggcgaaaagtatggggtgaagtactcggaggatgagatcttgatgaggtaccggcaggcatattcgcagccatggggcaaatcgcggcttaggtatgtcgatgacgggaggcccttttggcaacatatagttagttcttctacaggctgctcagatttacagtacttcgaggaactttatcattactatacaactgagaaggcctggcagctcattgatcccgatgctaaatacgtttttgaagcattaagaagggctggtgtgagaacagctgttgtatccaactttgacacccgcctccggccacttttacaggcactgaattgtgatcactggtttgatgcggttgctgtatctgctgaggttgc

SEQ ID NO: 1002 - DNA, 548 bp, Hordeum vulgare
tccagggtaaatcgagttcgcttaattactacattgttgctacatatagacttataggaaattaaggcctgtcacaaagagacactgccatcagttctcgcttccatggaaaatatgtacagcggccggacagccacacacacacacctgagcaaagaagggccggcactatgtacagaggaggcagactaagcgccacctcccagcctttttattgaagctcaggggggctcggcgagcatactcgacgggaagaagggaacggaagcaatccatgacgaccgccagaggcacggtagagcccgcttacgagcaagcgtagcgcttcacatattgttgcccatacccacgctaaccccgatcctttctgcgacttccttgaaggagtgaacatcactgccccaaagccaggcatcgcagcctgcgtccctagctccccacagatcgttccgacggtcgtccccaatatgcacagcctcttcaggcttcacatccaacaactcgcaggccttcaggaatattgttgggtttggcttttctgctgcaac

SEQ ID NO: 1003 - DNA, 487 bp, Hordeum vulgare
gccacggctccatccgcaaggtcgcgccctccggttatactactacaattgctggagcatactcagcagggactggtcacagggatgaacctgcgcagaatgccaccttttccgcagactttgagcttatttatgtcccccaaatttgtgcactgttggttgctgacagaggaaatcgattgattagacaaatcaagctaaagccagaagattgtgcacatgagaaccagaaaggcttgggaaccacatctacctcaatcattgcaatattggctgcgctctttggttcaattattgggttcttagtcaggcatttctaccctttccatgcaggaagtctccatcaaccgctttttcatcaggatacagaggcaatacaggagaacccagaggaaggccgcactgatcagcttctccgacaccagaaacgcaattgctaactccatgctttgtaccctcctgctgaaactagttagagctggtgttg

SEQ ID NO: 1004 - DNA, 558 bp, Hordeum vulgare
ccgtagtatgttacccgtaacacaggtaccattaatacatatatgtatatataccatagttccatgccactgccacaggacatacgagcacggtttccatacgtgcaaatactaacacagttgttatttagacatttaggcaggcaaacactagacactaacacaactaatattcacttacagcgagctcagaaaaccttgctacctccatggaacctcctgcttactccagaatggttaacagctgggttgcaatacttgtcttgacctgaaaagtccgataagttggccttgatcatactatctattttcttagaactgccttgtgggttatcaagaagcgccaacaagtccctgtcaagcgacgcctctttatcctcctcctgagcattggcactaccatcaaaggcggagccattaccttcatccatagcgctgtcactatcatcgaagccgacgaaatcccccaaaagctcggtagaaggcagttcttcgttatcaagaccaatggcaggagtagtagcagcagccatgtctagatcaagaagaggaggagaa

SEQ ID NO: 1005 - DNA, 519 bp, Hordeum vulgare
ggcagcggcagcaatggcagcagcagccgctctccagtgctgccctctactgagctcaccgctggcatcatccgtctcaccgccttcctccgtaagaacaccggcagttagcaggacaggggaggccaggaggaggaggaggctgcagcgatgccgctgttcccagtctgccgaggggcgatcaccgggtagctcgccgccgcagctggagcgcctcttctccaatgtcaacaaggcaaccatgaagcacgagccagggagtatcactggttccatcttccttgtggccgggacaacggtcggggcaggtatccttgcgatccccgccgtcacacaagaagctggattcttggcctcagcagtcacatgcattttctgctgggcatatatggttataacagggctgttagttgctgaagtaaacgtcaatacaatgtgtgagctaggatctggaggtgtctccctggtttcgatggctaagcgcactctagggacagttggagtaagaacagcctgctt

SEQ ID NO: 1006 - DNA, 551 bp, Hordeum vulgare
tggatcgttagttattaactgcgctcatgtgaatatgtacaacacaactcaacttgactgaacatcttgatgaaaccacgaaggggttaagaaaagctagaaatactggattagtttattttgggtgtgttaatacattggaccaaaatctgcagaagcatcagtagttgaactttgcacgttgtaattgtcaatgtagtccttgcagctgcattatgtccttgaaaatctccgaaaatattacaagcaaggcaccccccataacaaatgagagggttaattttcctcctgggactataggggatataggagcttccaagtcatttgagtatctctctgaccaagacatagctgcagggaaaactccaaagagtactagaactccataagttcctgcaaagtccaatgccttgaaaaatatctctggatctagcagtgacagaacaagcggagggaacaaagttacaaggtatgtcagaggtttgttctgtccacttggtagtttaagcaagtccgcgatgaagtctgagagtcctagaacaaatccaatg

SEQ ID NO: 1007 - DNA, 439 bp, Hordeum vulgare
ctacaccaagtcagtcataaacccaagtgcggactcgccttcctcctcctccccaaccactccgctcttccgccgcgcatcgcaccggggggtcacctgagatcacatacacaatggtgaaggctgtagctgtgcttaccggcagcgagggtgtcaagggcaccatcttcttcacccaggagggagatggcccgaccactgtgacgggaagtgtcacgggactcaaggaagggctccacggcttccatgtgcacgctcttggtgacaccaccaacggctgcatgtcaactggaccgcacttcaaccccgctggtcatgtgcatggggcacccgaagatgaaatccgccatgctggtgacctcggaaatgtgacagctggagcggatggtgttgctaacatcaatgttactgactgccatatcccccttgctggaccaca

SEQ ID NO: 1008 - DNA, 552 bp, Hordeum vulgare
gactgttcacgtccgcaactcaaaaagccaatgacagtgatatgaaagttcagagtagcagcacataggaatcgacacaaatgatgcacactaaaaagcgatcatagatggtgtgcttatttaaaatagatagcaattgcaagtcggtgtccttcaagtgccaagatctgtacggcgttcaacggcctgcgaagacggcatcttagccctggagcccgatgatcccgcaagcaacacgcgccccagcgtttccagtgctcttgctaagctcatgtccacccttgccaagatcatcagcatcaccatggacgacaacagcacggccaatgattgaatgtggtccagcaagggggatatggcagtcagtaacattgatgttagcaacaccatccgctccagctgtcacatttccgaggtcaccagcatggcggatttcatcttcgggtgccccatgcacatgaccagcggggttgaagtgcggtccagttgacatgcagccgttggtggtgtcaccaagagcgtgcacatggaagccgtggagcccttccttga

SEQ ID NO: 1009 - DNA, 394 bp, Hordeum vulgare
ctggctcgcctcgccaagtcacacttcgctcttcacacacagccaagatccgcagagatgatccgagcgatgctggtcgtcgtcagtggggagagccgccgggcagcggtggctggcgctggcttcgtcggccactgcggctactccacggcctcgagctcccagaggttggctggcaaggtggccgtgatcaccggcggggccagcggcatcggcaaggcgacggcggccgagttcgtcaggaacggcgccaaggtcgtcctcgccgacgtccaggacgacctgggccacgccgcggcggccgagcttggcccgaacgcggcatgctacgcgcgctgcgacgtgaccgacgaggcgcaggtcgccgcggcggtggacctcgccgttgcccgcc

SEQ ID NO: 1010 - DNA, 372 bp, Hordeum vulgare
ttttttttttttttttttcccgatgcattaacaatgacgcattataatttttattgatagcgaaatttttatgcagccgttgtagatgctcttgctttcgaaaaacgcaatgctcaagctcgcttcgttttacagctcgagctcgatggttctggtgcaatacaacgccaattaatttatttcaagtgcttgcgtcgttttacagcgccggcgccggcggcatgttgggcgccttccccacggtgaaaccgccgtcgacgacgaggttgtgcccgttgacgtacttggcctcgtcggacgccaggtagagcgccgccctcgcgatatcgtcaggctccagcacggcgccctccatctcgttgatgtccccct

SEQ ID NO: 1011 - DNA, 519 bp, Hordeum vulgare
  UNSURE (8): n stands for any base
accgcggncatctacgccgcacgggcgaacctgaaacccgtcgtcttcgaaggtaccaagtcggcggtgttcccggaggccagctgatgaccaccaccgaggtggagaatttccctgggttccccgacggcataaccgggcctgatctcatggacaaaatgcggaagcaagcggagcggtggggtgcagagcttcaccaagaggatgtcgagtttgtggatgtgaagagcagaccgtttgttattcgtagcagcgaccgagaggtgaaatgtcatagtgtaatcattgcaactggagctactgcgaagcgacttcgattacctcgtgaagaagaattttggagcagaggtatcagcgcatgtgcaatatgtgatggagcatcacctctgtacaagggtcaagttcttgcggtcgttggaggtggagatacagctaccgaggaagcgatatatttgacaaaatatgcgtgccatgttcatttacttgttcgaagggaccaactacgagcatccaaagcta

SEQ ID NO: 1012 - DNA, 550 bp, Hordeum vulgare
atttggtaagatgggcgttccattttacgctggtcttctcaattaaacatgtcactaaagacggagggcaccatgtggaggatagacatgaaacgccggtcaatggcaggggtcaacaagatgttatattgtacaacaaagaatatattttggattaataagggcgatcggttaatttcctatggcatgactgcaccaggctcatctgagaatttgaccaaaaattgcccaccagcgtggcttctaaatatagtcaatatatgtgtaaatggaggccattacacttcaaaaccctgggacaaacaatgagctcagatcatttgttcgactcaatgaattcccggtattccttcttcatcttcacaccagagaaagtcctgatcatttctttgtttttaaagaactgaacacaaggtgttcccatgatgcctgcagcttctgctatttcagggtcctcttcaatgtcaatttcaacaaaatgaacgtattcgtcatactcatctataaccttgttcaaaattggttttaatgttctgcagggaccacatgt

SEQ ID NO: 1013 - DNA, 480 bp, Hordeum vulgare
ccgacataatatttgagttgtgaagagagtttcctgctcacaaggtgattcttgcagcccgatcaccagtttttagggcacaactctttggtcccatgaaggataaaaacatgaagtgcataaagattgaagacatggaggctccagtattcaaggccttgctccattttatgtactgggatgaattgcccaatatagaagagcttactggtctaaatacgacttgggtttccactttgatggctcagcatttgcttgcagctgctgaccggtatgcattggagagactaaagctgctttctgaactcaagctatgtgaagacgttgcgataaacacagttgcaaatactttggcgctggctgaacagcaccattgccaccagctaaaaactgtttgcttgaaatttgtgggcctcgccggagaatttgaaagctgtcatgcaaaccgaaggattcgattatttgcagcaaagctgcccc

SEQ ID NO: 1014 - DNA, 553 bp, Hordeum vulgare
  UNSURE (39),(40): n stands for any base
ggaagtttaacatacaccattcaattaaatagatattcnnttgattacatcatttaattcaatacaatacacatcatgcagacgactaggaataacaaggctgacctagcacaaaccaactgtgaacacatcctgcgcttttatttctgcttgatcaagccttgtaccggtcagtcgaccttcgccgcgccacctgtgcgcaattatgaccacaggctgcaaagtaacagagcttcgcagcaattcaattgtaagccagtcagttgaatatatatcagcaccaacgcgctccagactagcaccacggcctagcatcacggctaaggatgaggatgaagatcagaatcacaagacaaacaccgatacacattacagcatgccgcatgcatgccgttatacggacactttacagcgaaacggcatgaaactccttctaggcttgacccagggaccagttaaagccttggtttcacacgtcttccatttgcatcgccaccatccaggacttcgtttgaatataagcaggggggcacagcgtggtctcctaccttcg

SEQ ID NO: 1015 - DNA, 874 bp, Hordeum vulgare
  UNSURE (18),(552),(575),(580),(582),(584),(586),(590)..(874): n stands for any base
gtcccccgggctgcaggnaattcggcacgaggtctcgtcagtagtaatatcaaaacttctcagtgagcaatggcaaagagtctcgccgtcgcgctcctgctactggtggtgctcgcgtcatgcgacgggcgggagctgaaagagaaggttgcagcgacacacggtgccggtgccagcggtggcgtcggcgactccaaggctttggacttgcctctgctggggggaaccggtaccggaacaagcaccattaccggcccgctggtggtgatccctgggatccctgctatcggcccatgatcatctctacctcatgtgctggcgctacaagaagctaaagctcgccttgtccctttagattctataggtagcaccgccaggaagaaaaaggccgacgtttcgctcatgtccatgttcggtactgagcgtctgtatcaactgtcatctgtatttatttccagttcccgtctcgtatttttcgttccttgtgcgctacatgtatcaacaatgacataataaatacgtacttactaaaaaaaaaaaaaaaaaactcgngggggggcccggtccccaattcnccctntngngngatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1016 - DNA, 548 bp, Hordeum vulgare
caacagctaagccctttaattatattcttctgttcctatcctatctgtacatacatccgtctacacagcagcttaatacaacaccatcatcaatccacgtggcacaggggggagggggggtacaaagcaagcactagtagctactactgcagtagtcataaccatcaagcaacaaccttcttttcatcttattacctcttacacaaagactgttggctgacttctcttccatcccggtcggtcgcaagccatcgtcatcctcctccagccacctcaaacagtcgtcgtccacgcacacagacaccagcgagagattggcggtggcttagccatcagtcatctcctaggtttgaattgatgcaagaataataatgcttgttttgcgcctcaggctttcgggatcgaccgggaagagactccgtgcaagagctttatgaacccgaggaagctaagcttcccgtcggcgtgcctgatccagtcctggaggacgacgtggaggggcaccgacgggccaaggccaagttccgacgcaagttcttcgatcacga

SEQ ID NO: 1017 - DNA, 521 bp, Hordeum vulgare
accgccaggtccacctccatcgagaccaccgtcgagaggatcatcttcgacttccggttcctggctcttctcgccgtcgccggatcgctggcgggctccctcctctgcttcctcaacggatgtgtgtacataaaagaggcctattgtgtctactggacgagctgcgccaaaggtgtccatacagggcagatggtcctcaaggtcgtcgaggccattgatgtgtatcttgctggcaccgtcatgctgatcttcgggatgggtctctacgggctgttcatcagcaacgcgtccaacgatctgccttccggatccgaccgggctctgcaaggatcgtcgctgttcgggatgttcgctctgaaggagaggccgaagtggatgaagatcacgtccctggacgagctcaagaccaaggttgggcacgtcatcgtgatgatcctgctggtgaagatgttcgagcggagcaagatggtgaagatcaccacggggctggacctgctcagctactcggtctgcatcttcct

SEQ ID NO: 1018 - DNA, 549 bp, Hordeum vulgare
ttgagagattttgtgctatatgaatgttttgaataagttcttccttagttcctacactgttatagtacagaggttcgccgtgctcgtctctgcgatgaaccggtcgaccaccgcgcatcgatcccttctgctctcagcacatcagggtcgatcgatgcatcggtcagataccaacctacatgaacaccacgaggccatggcgtctgatgaccggctggcacggtttagctacaagtggggcatcaccgactcctcgtgctcgggccggtggaggttatgcaggatgtagagggaggccgaggagaggaagatgcagaccgagtagctgagcaggtccagccccgtggtgatcttcaccatcttgctccgctcgaacatcttcaccagcaggatcatcacgatgacgtgcccaaccttggtcttgagctcgtccagggacgtgatcttcatccacttcggcctctccttcagagcgaacatcccgaacagcgacgatccttgcagagcccggtcggatccggaaggcagatcgttggacgcgttgctgat

SEQ ID NO: 1019 - DNA, 485 bp, Hordeum vulgare
cggggcagagggaggaacaagaggaagtggacggtggacgaggacgaggagctggtgagggccctccgcgaggtgtccgccgaccccaggttcagggccgacggtggggccttcaagaactgctacacgcaggggatagaggccctcctcgcgcggcggctgcccggccgcgccatcagggccagcccccacgtcgactcccggctcaaggtcctcaagcgcaagttctgcgccctcaaggacatgctcgcctcgccgggcttctcctgggacgcctccaggaatgtcctccgctgcgacaagcaccgctacgacgactactgcaaagtcagccgccatgttttagctagtgttgttggcaaatgtgtctttcttgatgatgtactaccatgaatggacgttggcttgtttggtctctgcaggataatcctagggcaagggggatgtacggcgttccgtttccgcatttcgacgcgttcgacgcg

SEQ ID NO: 1020 - DNA, 540 bp, Hordeum vulgare
ggcatagcatcgctaacacagtgcattagaacacttagggacgctaggtatataaccatttacacatgtcctactcccaaaatctcaactaccattgctgcaactagactgaatcagaacttctagagcttcactcctcccatgtcgctttaagctaaaaatggagagattgcccaccttaagaaggggactgaattagaacttctagagcttcattcctcccatgtcgcttgaagctaaaaatggagagattgcccgccattaagcatcttgagtatgtactccctcctgtagatttctgggagtgccaagaacatgcccatttggtccggttccttggcgaaaacactcgcggcgttgaccacttcgcttcctgtaaacccaagcttttgcatttcagcaatggctcttactctgacatcctgttggggcacctcaggcgatgacctttcttgcagatcagtatgaggctcaataactgcttcagttgcgctgccattctgggtgatgcttcgaaactgatcatgtgcatccttgaac

SEQ ID NO: 1021 - DNA, 553 bp, Hordeum vulgare
  UNSURE (20),(65): n stands for any base
gtcctcccgggcctgcaggnaattcggcacgaggcttagcctcaccgtgttcagcttcccaccanacaagggcaatgtcggcactgcagcatacctgaatgtcttcagttccatctattctgtcctccgggatctcaagaaggatggctacaatgtcgagggtcttccagagacacctgaagaactcattgaggaggttattcatgataaggaggcccagttcaacagccccaacctcaatgttgtttaccgcatgaatgtgcgggagtaccaagcactcaccccctacgccaacatgctggaggagaactggggcaagccacctgggcatctcaactctgatggtgagaacctccttgtctatgggaagcagtatggcaacatcttcatcggagtgcagcccacttttggctatgaaggtgatccaatgcggcttctcttctcaaagtctgccagtcctcaccacgggtttgcagcatactatacttttgttgagaagatcttcaaggcagatgccgttctgcacttcggcacgcacgggtcccttgaattc

SEQ ID NO: 1022 - DNA, 551 bp, Hordeum vulgare
actatgcttcctttttacattacaacgaaccaccctctttgttaaaggtctgtattgcatgttacaacttatataaattacaaattatacaagtttcaactcaacgaggcagaagaattccttcttggtcaagtgctggaactggttgatcagtgaaatgagttcaccggtcaattccttcgatcttgtcttcaacctccgagtagagctccctgagcctttccaagttatcctctgatgtctcccagtagcctctgccatttgcttctaggaaggtttgaagcagcttcctgaacgaattgggattagtgtccatcagcctcttcctcatctcttcatcttcgatgaatgtggtatttgcttcctcgtaaacccagttgtccacctgcccggatgttgcactccatccaacagtatttgtcagccgcttctcgatctctctaactccctcatagccactcttcatcatcccctcataccacctagggttcagtagctttgtccttgcatcaagacgcaccgtctccgacaatgtacgcacctgtgcattt

SEQ ID NO: 1023 - DNA, 518 bp, Hordeum vulgare
acagcaagggcatgtacgacttcttctggacgcacgcgctcatctccgacgagacggccgacggcatcagcaagaactgcaacttcacggcctacggcgccggcgtggcgtcgaacgcgctctgcgacgccgcctcggacgaggtcggcgagagcctcgcggacatcgacatctacaacatctacgcgcccaactgccagtcggagaagctcgtcacgccgcccatcgccccctcgatcgacaactttgatccgtgcacggactactacgtggaggcgtacctcaaccggccggacgtgcagaaggcgctgcacgccaacgtcacccgcctcgaccacccctggtcagcctgcagtgacgtcttgacacgctgggtcgacagcgccaaaactgtgctgcctattatccaggagctgatgaagaacagcatccgggtctgggtttacagtggagacactgatgggagagtgcccgtcacttgcagtagactctctgtcaaccagctccagctccctgtg

SEQ ID NO: 1024 - DNA, 543 bp, Hordeum vulgare
  UNSURE (49): n stands for any base
gtccttttggcatagatgttcatacttaacaaattacaccatacacttntcctatctatatgaaagcatttgctgacctgcagttacatggtctgcggagtgcatgggttgatgatgggtttctgtatctaactttacttgattttgcttgtttcttgtactgaatcaaatgatacaacctgtgaaacctgctggtgtactatcttttagtgtaaaaccttcttttcttttgctaatcctgttcgcattctttgcagtcagggagcgctttgcctgcgaggaaattctggacaagcacaagcgctcgccgcggctggtagctggggacctcatggcctgctcctctaacagttaccaagctgaggtcgcccttgtactgcacaatgtatccacccacctctccggcacccttggtgctgctgaaccatggcctccattttgccgccacagggagctggagctggttgacagagagtctactggaagtgacgggcactctcccatcagtgtctccactgtaaacccagacccggatgctgttct

SEQ ID NO: 1025 - DNA, 523 bp, Hordeum vulgare
  UNSURE (2),(12): n stands for any base
gnctaacgcggnaattcatcacaggatggtggtgactttgaagccaacgacggcaatcttactcagcagccactgcttctcatctgccatctcaatcggtggcagctacacctctcgtctcgctctcccagcctctccccgaccccgctttccccatgtccaagcatcacctgtcacaaaagctactacatcctacaacgatgaacacgaagcaacagatagaaacaaccatgtggcctccggcgctgccgctgctccgaagacgctgtccaggtacgagccctctatttggggcgactacttcctcgactacgagccaaaaccactgcagaggtctgaaaaatggatgagtgcaagagctgataaattgaaggaggacgtcgacatgttgtttaagagttgcagctgcactatggaaagaataatcttattggacagtgtccaacgtctcggaatagatcatcacttcaagaaacaagttgatatcgcgttaaatcagatttttgaggatgaattcagtagc

SEQ ID NO: 1026 - DNA, 543 bp, Hordeum vulgare
gaattttaataaatgataattaataaaacaaacatcgcaacatgaagacacacaagtgtatctcatatggataccatgtttatttatagggacaaagatgatgcacaagctctcactgataatttatgatgcacaattgcatctctactaaaggtaaactgtcacacaacatagtagagcctacatgggaatgggttccacaaaaaggctgtcaacggtgtccttaagatgcatgctaaatgtatatgcgtctttctctggatagaataatggcatgctattagcaaagttaataatccgttgcaacactgggagatgtgtgtggtgatcaaatggagcttgatttagagttttccattcatcttctagtagagaaaggatcttgtaaatggcaacctcacttgtgaccctatgctcaaccatgtaacactctatagagcttgccatatctcccttggccttcccacctttaaatgcggccatgtcatccattagacgtgctatcttcccgcaagctatagcaacttttgggtaactagctgc

SEQ ID NO: 1027 - DNA, 517 bp, Hordeum vulgare
gcgatatcgtcgcgagtgggagtctagcaggcggccatggcacagtcgatgctcatgtccggcgtcaacggcgtggcctccggcaggagcctgctgcaggcggccaggccgtcgtcggcgtccacgcccttctcgcggctcgcgctctcctcctcctcggcggcctactacaagcacatgccgtccctctccgtccggaccatggccctgttcggcaagtccaagaccaaggccgcgccggccaagaaggtcgttgcgcccaagcccaagacggaggacggcatcttcggcacgtccggcgggatcggtttcaccaaggagaacgagctcttcgtcggccgtgttgccatgattggcttcgccgcgtcgatcttgggagaggccatcaccggcaagggtatcctgtcccagctgaaccttgagaccggcatcccgatctacgaggcggagcccctcctcctcttcttcatcctctttaccctcctcggcgccatcggcgcgctcggagaccgcggca

SEQ ID NO: 1028 - DNA, 481 bp, Hordeum vulgare
gggctgtggagagcgatgatggtgagaaagggggcaagaagaataaggtggacaagctagagaaggaacttgcagcgtgttggttgaacgatgaagatgacacggatttgaggctggcaaggtttgagcggctattggatcgcagaccagagctccttagcagtgtcctgttgagacagaatccacataatgtggaggagtggcacaggagggtgaaactttttgacaaggatcccgcgaggcaagtagcgacatatgtcgaggctgtgaaaactgtggacccaatgaaggcagttgggaaacctcatactctatgggtggcatttgcaaagatgtatgagaaacataaccgcttagatagtgctgaagatatctttaaaaaggccacacaagtgaactataaagcagtggaccacttggctactatttggtgtgaatgggctgagatggagctccgcaaccaacattttgacaaggcaat

SEQ ID NO: 1029 - DNA, 1371 bp, Hordeum vulgare
  UNSURE (11)..(17),(19)..(32),(125),(127),(128),(131),(133)..(135),(197)(198),(799),(1371): n stands for any base
ccccccccccnnnnnnntnnnnnnnnnnnnnntttgtgtagaagtgtggcctcttgggcttccggaattgggtaaagccccaaaaattaaggtatggtttggggaaaaaacctccaaaagaatcngnntgngnnngctgctactttttttgtgggggggggtgttcactacagaaaaataccggttttgtcgggagnnggtaagtagtgttgtcgttaggatgtatttatgtttttttcgcagtgtggagtgttatcgttatttatcgaatagagaggggagtgggaagggggttgtgagagtagcggttgtacgggggagaaatgtgtcggaagtattgtgatattagttttgagattagttttgttattgttatcgtgtataattgttttttttgtggtgtgggtgtgggtttggtgtttgttattttgttgttgtggtggcgggtgttcggggtgtgttgtttgagtaatggtggtttggtgggggtgttttgtgtaggatgatttactgatagttattttgtgtttgtttgtggaaagttttttggtgtttgttgcgtgcgttgtgggttatgatgatttgggtataaatattgggagtagtggggtgttgaggtgggttgtatccgtcggttgtgttgtgtcgttatctgtgtatggttagaggattattcgtttagcgtgtttggatgttgttttttacgttcaatattttgttgcgttgttagttattttcgctgttttcttttaggtgaatcattgctgtgggtgggtaaggcgtggtcatgtggtcgggngataattgagttttgtcggttttgtgttttttttagttgggtttgttcgttagatgttatttgtgttttgtgtttgattgtttttgccggtatttatagtgttctagtgcgtgctgtttgttgttttcgattatgtgtgtgtccatgtttttttcttatttgtttatagtagagttgttgatgtaggtattgttcatttgtgttgtttgtgcttgcggtgtttcatgagcatattgtcatcgtagcatgttttggtgtttggccagagcgagagtattggtatgttttgtgggtgtacgtgattgcgatttggcggtttatcttttctcggttgcgacggcggtagatatatacgttttgatgtcggatgtttttggaataggagtgggtttggtttagtttagtgcgagtttgtacaaggttgcgtttttgttgtttattcggagtttatgagtgcgctgttttaattatcctgagttccgtctatgtgtgttgtattgcgtcgtgacgtatgtttgctcgtttttacagccgatgtatgtctaatattgtgtacgtgtgatgtgttaatn

SEQ ID NO: 1030 - DNA, 544 bp, Hordeum vulgare
  UNSURE (12): n stands for any base
tacgcccctggngcctaaaaatgcaaagcgaaagactctcagcagtcatcatgcgtctaaattgtgctaacaaacatgatgctatcattgcacagttcggcatggttccctaaatcagaaaatacacattctcgcatcaccacctccctctagaagcacttacagatagatataaactaggggatagaaagagctcgcggtcaaaccgacgatgctccctgccctccagacaacgtcacttcggtaacgcagcaccgggaattcacaacattcgcaggtcgttttgtagaaggctcaaactttgtcggatgcgtcgagagatgtgctctctgtactcttgacggcggccagcttctcagccaatctttgctccagtgccctttgacccctttccctcctcctgtttgcctcactagaatctgaaccaggcaatgatgaggtttccagtgtctgacccctgtctgccctatcagatctcccacaaagaagcctatggaatattgaggctatcggatccaaaactgctctcagaaatgcagggaag

SEQ ID NO: 1031 - DNA, 518 bp, Hordeum vulgare
gagcattgcatctcagtattcaacaatgctgtcaaccaccttggagaagagattttggcagcagcatacagaagtcctaatcagtggccagctcttgagattgatcttctggagagatcgagcagcgagaggatgttcacagaaatgttcttacctagtgttggatggtcattgccgtcaagaatccagccgctggttgaagccgtaaagagtttacagcttccagagttcagtgacggcttgtcttggctaaaacaaggatcttacatgggcaggcagattctagatcagaagctatatctcgaggagtgcttgacgagatatctgacccaatcggctcagttgttaaatggggctcaggcggttgctgaggcaaagattatggtgcagaaaggtgttgatcttgagctccgtgactcgaatcactatcttgtgccgaactgggttaccatcttccggcggatctacaactggaggttagcgaggctttctaccggagatttctcagaagcttatgt

SEQ ID NO: 1032 - DNA, 484 bp, Hordeum vulgare
gcaaaacaacaaaacgcctatgctggttatctgcgctatatatgcctacaacacaatgacatactcatcaataacctcacaaaataatgtttttcactccacgatatccaatgttacaagttacacaccaagcgtcgggacctttcagaggctcggcagctcagaagtatataaagagccgctcatcgatcttggattgcagcttggcgcactgctgctctagcttggcaagctcatcgtcccatgcaggtggaaccaaacgtcttggatccagccttctcggtacaaagtgctggttgtcatcggtagctccatgcaccaggtttacctcaccattgatgtgagccggtgcttgaggaggttcgtcgcatactggggttggcagcggtgctggcgtaggtctcggcggtggaggactgtcagaatcaaggtcacaactggcctcaatgatctcgtctagcgagagcccagatagcacagcagg

SEQ ID NO: 1033 - DNA, 542 bp, Hordeum vulgare
  UNSURE (4): n stands for any base
gggnctgcaggcaattcggcacgaggagccacagcgctccgctccccccccgaaaaaaagagaacagcaacgggaagaataatcttcccccgtccgcgtgcgatcgacgcggagccgccgcccacctctgccccgaccccatggccttcatgcgcacctcctccaatgcatcctctggcatgggagttgctcctgatatcagggagacattcctggagcttcagatgaagaaggcatttcgctatgttatcttcaagatagaagaaaagcaaaagcaggttgttgtggagaagacaggggctacaactgagagttatgatgatttcctggcttgtctcccagagaacgactgcagatatgcgctttatgattttgactttgttactggggagaatgtgcagaaaagcaagattttcttcattgcctggtcccctgacacatcccgcatccgagccaagatgctgtactccacctccaaggaccgcatcaagcaagagctcgacgggttccactacgagatccaggcaactgacccgaccgag

SEQ ID NO: 1034 - DNA, 496 bp, Hordeum vulgare
gtctctagagcctgggtggagtacttgtcccagacaaagttcatcagggcggacagagataagctgaggaccttgtttggattcttgggagagtgcctgaagctgattgtggcagacaatgagttgggagccttgaagactgcccttgagggaagctatgttgagcctggccctggtggtgatcccatccgtaacccgaaggttctcccaacagggaagaacatccatgctctcgacccgcagtctatcccgactgcagcagccatgaagagtgccaagattgttgtggaacgtctgctggagcggcaaaaggctgacaatggtggcaagtatcctgagacaattgcacttgtcttgtggggcaccgacaacatcaagacctacggcgagtcactggcccaggtgatgtggatgctcggtgtggagccggttactgatggccttggccgtgtcaaccgtgtggagcctgtcagcattgaggagcttgggcgcccta

SEQ ID NO: 1035 - DNA, 516 bp, Hordeum vulgare
actagtttctcttccccgatgggcggtgccgacggcgacacggcacgacggaatcgaaaagtcacagcctgaaagctgcctctcgggacaaggatgcctgctccttcgggctctcgtttttagtcttgtttttttcccgatcgctccgtgccgtccaaccagatatggatgccaggtgcccgattccctcaaacacttcagaaccagcatctttatactccagctttgtacacgaaagatcttcgctaggtttgtttaaagtttaaattcagaacctgcatatttttgcataataattacaaccttgttcatcgtctgaggagatttcagcttgcagatcagctggctgagctggggagctggacgagacggctgacagaccaagactcagatgccttttttgtttctaaaaaatcaagatttgtatatttcctcttgccgtggaaaggcgaacgggaggagggatttctttttacaagatgtgctctgcgatttttttgtagggctgtgtttaaa

SEQ ID NO: 1036 - DNA, 549 bp, Hordeum vulgare
ggcgaaggcatgctttttagctgaccactagtatgatttttttgttgcaaaagaagaagacctaaagtttgttgcaactgagccaagaatgagtgaagccaacggataagcggcacgcaagcaaggagcgccgtcagagcactcgcgacgcaaacaggtggccgtcgacatctctcccatttcctttaagccgagccacgaaatatccaccacgcatcaatcatcatctttaaacacagccctacaaaaaaatcgcagagcacatcttgtaaaaagaaatccctcctcccgttcgcctttccacggcaagaggaaatatacaaatcttgattttttagaaacaaaaaaggcatctgagtcttggtctgtcagccgtctcgtccagctccccagctcagccagctgatctgcaagctgaaatctcctcagacgatgaacaaggttgtaattattatgcaaaaatatgcaggttctgaatttaaactttaaacaaacctagcgaagatctttcgtgtacaaagctggagtataaagatgctggttctgaag

SEQ ID NO: 1037 - DNA, 517 bp, Hordeum vulgare
ggcgcccaatccccaccacgacgccgtcgtctaccccccgtccatccacagcgccgtcctctccccatccccgtcgtctgctgccactccccagcatacgcatggtttggcgattgttcctcaagggccgtacggtggtgattaccagccttctcagggcgtcgcgagggatgtactggatgaggtggagatccggcatctgctaattgaacatgttggacatcgatgttgttggggaagccggcctgctcgcacatggaaaattacatccattgaggactgcaatgtatatgttggaacattggaaacctttattgaggaaagagacaccatattaaaaaaggaaccctatgatggtggcaaaatagatggaagagacaagggtcctgttcttggtgtgtgggaactagatttgagatccgagtttcctatgctctttgtaccggagaaagaagtaatggtcaagattcctcattcagaagttactgaaaaatgcttagattgcgagggtcgtgga

SEQ ID NO: 1038 - DNA, 545 bp, Hordeum vulgare
cgatttacatgattccacaagcccaaaatgtacatacagaagctttcgtactgtaacactacagataacgtaacacaccagaaatcacaatgcgctctctacaggtacacacaacttttgatagtatgaacattggacaccaaaagaagatggcacgcacatgcactagttccccaaccattcaaagcaacggcaaagaccccagcaaaacttcgaaggatagtcccggatgaaaacatccctgccatagccaacaacgtagaagctaaaagaccgcttacggtgagacattgtgacacgggttacaggcacaaccgagatgatgtgtctctctgaaatgactcttgcggatggtggaattggcagccggctagcaacaatctccgacgagaactggttgagtgggtatgaatcggcaaagaaagcgggagtgcattggtatgcctgtatgttgcatagctgcaccccttgcgctctatggaaaacttcgtcagggaccgaagcagctcctgctgttgcactaacttttctcactgtaagcgtct

SEQ ID NO: 1039 - DNA, 438 bp, Hordeum vulgare
cctctacgctgataagatggctgctcttgaggcacaacttggagaggtaaatggcgagaagatcgattccaaaaatgattggccacatgttactctttggacagcccctggtgttgcaccaaaggaagcaaacaagctgccgcagctgttttcatcaggacaagcgaaacgtgtactgatcgaccctcccatcaccatctcaggagtgctggacttctactgattcctgtcttggttttagaatttgatggtgtggacttgagcatagatagaatcaggagtcatcgggttattgctagaggccaaacagctttgtaaatatgttgagttccatgccacgaaattttcaagggattattaaaggatcttaggagtcatggcaacaactatgtaaatatgttgaggttaggattcatggaggtcgcgataccagtcttt

SEQ ID NO: 1040 - DNA, 533 bp, Hordeum vulgare
tattaattttgattgatgataattcttaggggcacatgtttcacctacccatgtctaaagactggtatcgcgacctccatgaatcctaacctcaacatatttacatatgttgttgccatgactcctaagatcctttaataatcccttgaaaatttcgtggcatggaactcaacatatttacaaagctgtttggcctctagcaataacccgatgactcctgattctatctatgctcaagtccacaccatcaaattctaaaaccaagacaggaatcagtagaagtccagcactcctgagatggtgatgggagggtcgatcagtacacgtttcgcttgtcctgatgaaaacagctgcggcagcttgtttgcttcctttggtgcaacaccaggggctgtccaaagagtaacatgtggccaatcatttttggaatcgatcttctcgccatttacctctccaagttgtgcctcaagagcatccatcttatcagcgtagaggaaggcgttgaacgacacagggacttcctggttctggta

SEQ ID NO: 1041 - DNA, 564 bp, Hordeum vulgare
  UNSURE (14),(30),(34),(44),(50),(62),(63): n stands for any base
gtacccccccgggnccttgcagggaaattncggncaccgagggnaggagnatcctcacaagnncggcggttggggcttgcacacgcgcaacaaagtgaggccggggttgggcgctggctctcccgacacaaaccggatcgaggtaaggcgtggcgtctcgggcacgtcgccgcatgcttcccagcccggacgcaccaccccatccagccgccgcatcaccgcgcccgccgcccaaactgttctcgaccatcgccgggattccacggctgccacaactctcgctggtgatgtgcatcgttcccgcatgacccccctcctcccgcgtgctcctagatggatccttctccatcttcaaacggagcagatccaccacccagctccgacatcgcgtcgcatccccgtgcccccgcattgttccaatgcccatccctcgccttcctctgcccgaggcctcccgtcttgtcttactccctgcagatgtcatttagttcgatatgggtgaggcaaggaggatggggaacagttgcttctgcaggcgaggggctatatcgaacccgaaggcgt

SEQ ID NO: 1042 - DNA, 438 bp, Hordeum vulgare
tattcctataccgctacttgtttgctcaggcaagccggtcatgtatatatccttcagatattcatacgtggcaacagtagtcaccattcaccatgtcactaccttgtagaagtactttctgccagggtgcagccccttcattgcgctgtcgaagatgaaacccagggcggcgccacccaacgccatcgttcgccgctgcttgtttgccctcatgtctgctggcatgtctcctcattccccctcgcgccggccgggcaacccgtacccattcattacgacaccatcgtatgaatcctcgaagtctggccaaggtgtgcctcttgtttttttattttccttcaaaaggggcgaatgaaatgataccaacttgcaacatcacagggagcacacccctgattccctgggatgaacaactgaatgattattctgcatctgcga

SEQ ID NO: 1043 - DNA, 550 bp, Hordeum vulgare
  UNSURE (20): n stands for any base
gtacccccgggcctgcaggnaattcggcacgaggccgtggcacggggcaggccatggaccgcctcggatccccatccagggcggcctccgcgccgaggagcaggtgtcaaggcatcgtacagtcatgagcatatttgataaggagccacggatcaacaaagatgtttttgttgcgcccagtgcatctgtcattggtgatgttgagattggacatggatcatcaatctggtatggctccgttttgagaggtgatgtcaacagtattcgtattggatctggatcaaatatacaggacaactcccttgtacatgttgcaaagactagcattagtgggaaggtccttccgacgatcattggaagcaacgttacagtaggtcatagtgctgttttgcatgcatgcaccattgaggatgaagcttttgttggtatgggtgccactttgcttgatggtgtggttgttgaaaagcacagcatggttggcgctggatctcttgtcaagcagaatacgaggattccttctggggaggtctgggttggtaatcctgccaag

SEQ ID NO: 1044 - DNA, 479 bp, Hordeum vulgare
  UNSURE (2),(3): n stands for any base
gnnactgcttcaacaatgtgcacttcatacggaaggtgtaaaagtgatcccgggctcctcttcattgcaatgtgaaagagagatactgtatacggtcgatcctacaacagcgctcgacccaaaatcttattgggcatgaaaaaacagagaacaagaccaaaacatacgtcaaatgttccaagtcgccatgtaacaaaaaccaaagcatccctacgaggggtttgatctcagcgagcgacggcagctgttttcggtgccttgtctgggaggatgttgtcggggaggatgagctgcggcgggatctcacggactattccgagcatagagtcgtactcctcgtctttgtgagcaaacttcttcctcaacttcttctcgagctcaatctcgtcgaagctcttggaattctcagtggcatgaacttgagctaagttgatgtagttggctgccgattgggcgatgaatgtgatctcctcctctgt

SEQ ID NO: 1045 - DNA, 552 bp, Hordeum vulgare
gtacccccgaggctgcaggcaattcggcacgagggatctccgtgcgcaaggtgcctacatacaaggtgacaccgatgcagctgaagaaggacaagagcaacatcatttggaggcagtttgatgggcatgagcctgagaactactggtacagggtctgcgaggggcgagctgccaaggtcatccagaggccttggtatgctatttggaagtccaagaggctgatgaacattgtaactgagattgcgggcaggatggattgggactacgatggtttgcatgtggtccgagggtggaaggcgatgaacaagaagatgtatcccaacttggatgcggacacatcacccgacgcgatcgtagataaggtcaccaagcttatcaagccgtggcggaacctttacatcgcaaccaacgagccattttactactactttgacaagctcaggtcacactaccatgtgcatttgcttgatgattataaggagctttggtcgaatacgagcgagtggcacaatgagacgacagcgatcaataatgggaagtatgtgccgttcg

SEQ ID NO: 1046 - DNA, 542 bp, Hordeum vulgare
tttgtttagggagttttgagcacagttatacattatacaaaaagaatggagggcacataatttagatgaacatgtaatgcaataaatgacaggcggcatcaagatggtatgcctaatgacaaaccctggatgaagttcgcctgagttccattgcgccagccgcccagcctgtgggagagtatatggacaccaatagttatcacagcatgaactcatgtgtcacaaattgcacgtgttgattccatctttgcaatctctcgtcaggttgttaaacgtttcaacctttgcctttgatctgtagaatacctcagtgtccacaatcaccttcatgtaggcatcgaacggcacatacttcccattattgatcgctgtcgtctcattgtgccactcgctcgtattcgaccaaagctccttataatcatcaagcaaatgcacatggtagtgtgacctgagcttgtcaaagtagtagtaaaatggctcgttggttgcgatgtaaaggttccgccacggcttgataagcttggtgaccttatctacgatcg

SEQ ID NO: 1047 - DNA, 511 bp, Hordeum vulgare
ccgccgccgccgcaaccgctgttagcgagacgaaggatgcagacggtgacaagaaggaagccgcagccgcggaggccaagccggcagccaagccagcagcggccaagccgaagaaggccccgccaaagccactgccggagatgatggaggaagagatcatccctcctttgaagactgcgctggaggccgaggaggacgtgtcccaagtcgtgctgaccttccagaacaacacgttggaaggctccttcgtgaaggaagacataccctactacttctgggccttcttcccacaaggagacctcacaggacccaagggctttgcgatgacttcctactccatggaggtgagcaccatcgagccgttcctgatcgacgagaagagggtcactccacagtacgtggtgttctgggtgtataagaggctggccggccagggggtcctcccggtctggaaggcagaggacctgactcctgcacagtagtaagtagtagtaacacatgcaagatacaa

SEQ ID NO: 1048 - DNA, 554 bp, Hordeum vulgare
gagccttactaattacaattagacatggacatcgtatacacagagtaacttgtgtccgtatgatcaccctgtatgttgtatcttgcatgtgttactactacttactactgtgcaggagtcaggtcctctgccttccagaccgggaggaccccctggccggccagcctcttatacacccagaacaccacgtactgtggagtgaccctcttctcgtcgatcaggaacggctcgatggtgctcacctccatggagtaggaagtcatcgcaaagcccttgggtcctgtgaggtctccttgtgggaagaaggcccagaagtagtagggtatgtcttccttcacgaaggagccttccaacgtgttgttctggaaggtcagcacgacttgggacacgtcctcctcggcctccagcgcagtcttcaaaggagggatgatctcttcctccatcatctccggcagtggctttggcggggccttcttcggcttggccgctgctggcttggctgccggcttggcctccgcggctgcggcttccttcttgtcaccgtctgcatcctt

SEQ ID NO: 1049 - DNA, 518 bp, Hordeum vulgare
aaacatatagaggcccatttgatgtgataaataaggttgtcaggagtgaaggcctccggggcctttaccgaggttttggaattacccttttaactcaatcaccagcttctgccctttggtggagttcatatggtggtgctcaacatgctatctggaggtgtgccagctttacataataatttccctttcctttgtgtctaatgtttgtactcgtacatcttatttatattcctgcaatccctatttaggagcttgggctacgggattgatacacaaaagaaaccttcccattcagaacttattgctgtgcaagcaacagctggaacaattgctggagcttgctcatcgattatcactacaccaatagataccatcaagacccggcttcaggtaatggacaactacgggagtggaaggccatccgtcatgaagactaccaggctgctcctgcgagaggatggctggagaggtttataccgagggtttggaccacgctttcttaacatgtctctttgggg

SEQ ID NO: 1050 - DNA, 553 bp, Hordeum vulgare
aatctcaagctttagtagtactatgttaacttagatgggaagacacaaaactctctttccgaatttttttgctcaacagctacaaggtggtccagtacccagatcaagcctctgactctcatcctgaaacgagcacccttcagaacttacaaggaattttttgctcgacaactacaaggtgctccagtacccagatcgatcctctggctctcatccggaaacgatcacccttcagcacttggaagtatttacatgccggtagttccgtacggaaacatgttaggctttataaggggatttgcatcgagaatttaaagatcggtgttacatctcaatccctgtaccaaaaagaaattaactagatggccaaaacggaaatgaggaccagctaggtagagcagaagccaaaaggctcattgttctggtttcacagaaagtctctttatcagctcgtacgtgacaatcattgatgtaccccaaagagacatgttaagaaagcgtggtccaaaccctcggtataaacctctccagccatcctctcgcaggagcagcc

SEQ ID NO: 1051 - DNA, 518 bp, Hordeum vulgare
ggcacacagtgtgccaacattgtggaacactttggattcacccatcttagtgctggagatcttttgcgcgcggagattaaatctggctctgagaatggaactatgattgagaacatgataaaggagggaaagattgttccatcggaggtgactataaagctcttgcagcaagccatgataaagaatgagaatgataagttcctcatcgacgggtttccaaggaatgaagagaatcgtgctgcgttcgagaatgttacaaaaatttcgcctgcatttgtgctattctttaattgttccgaggaagagatggaaagacgtcttttgggacgcaatgagggtagagttgatgacaacattgagactatcaggaagagattcaaagtttttgttgaatccagtttgcctgtgattgagtactatgacgcaaaagacaaggttaaaaagatcgatgctgcaaaaccaattcctgaggtgtttgaagatgtcaaagccatttttgccccatttgccaaggctgc

SEQ ID NO: 1052 - DNA, 552 bp, Hordeum vulgare
gtgacatgtgataaatctcaattttctgtaatgcagccgcatagctcatgggcacaaggtctgattcgtccttgcagtaaattacacaatggtacaggtacactacatgggatacaccaacaatgggtggtaaataaaaacttctagcaggaacaccccaaaccagatctaatttattgctggcaacaaatcaaattgtctactgataagtctgatctatattaagggtttgtaatcacatatatgtagtcacacttgagcaaaaccttgtatgagatcattccatttatcacctttgtggtcctttatactgttctatgcagccttggcaaatggggcaaaaatggctttgacatcttcaaacacctcaggaattggttttgcagcatcgatctttttaaccttgtcttttgcgtcatagtactcaatcacaggcaaactggattcaacaaaaactttgaatctcttcctgatagtctcaatgttgtcatcaactctaccctcattgcgtcccaaaagacgtctttccatctcttcctcggaacaattaaa

SEQ ID NO: 1053 - DNA, 516 bp, Hordeum vulgare
cgccctcctcgcctccaccggaagagctgctccccacgcaaccgggcggatcccgctaggcgtaggcggggatccagcagccgccatggcggcgagcgacgtgcccatgagccccgagctcgagcagatcgacggcgagatccaggacatcttccgcgccctacaaaatgggttccagaagattgacaagatcaaggactccaacaggcagtccaagcagctggaagaactcactgggaagatgagggagtgcaagcgcttaatcaaagaatttgatcgtgtactcaaggatgaggagaaaaggaatacctccgaggtcaacaaacagctaaatgacaagaagcaatttatgatcaaggagttgaattcatacgtcaccttgaggaagacgtaccaaagtagccttggtaataagaggattgaactatttgatgctggtaatgaccaggtagctgaagataacgttcaaatggcatcagaaatgtcaaatcaacaactgattgattctggagtgag

SEQ ID NO: 1054 - DNA, 534 bp, Hordeum vulgare
  UNSURE (10),(16): n stands for any base
cattactctnactggntaccactaacgcatgtacacaaccaagaaggccaggcaatttaaacaccacacgaccgaagtgctactaacaatccgaagctaaaagcaatcaaagaaaattacatacggggataatgtacaagcaagcaccaatggaacagttgacatcgtgtgttttggcttccgcgagagagacctgtactgcacgagacttccatttccgaatgttcagagcattcggaaagcatctatggaaagcagtttccggttctgcgcaggaggtgcaggaggtgccagtcccgggatgtctggtatgcttttgttatgcgggttgacgatcttgacaacaatgatggcaatcacaccacaaactatcaagaatagaaatgccatgatgcatttgtcagttgcaacctgacgaccaatctctttcaccatttgactagccttcttcaatgagaagtgaacagaatctagctcattgccaattctcttcatttggtcagtttgctgtgttagagttgtagcagtttgagc

SEQ ID NO: 1055 - DNA, 555 bp, Hordeum vulgare
gtacccccgggcctgcaggaaattcggcacgaggcgcagcgccgaaatttttgctcgccccttcccccaacaatcccaccaccaccactgctcccaggaggaaccaatccgcctccgattctcccgtcgccaccgcccccccgagaagggtaaatgggatcagaagggccttcaatcgtgactgtccatgttaccggatttaagaagtttcatggagttgctgagaacccgacagagaaacttgtgaccaatattaaatccttcattgaaaagagagggttgccaaaaaatcttgtacttggaagctgtgaaattctcgaaacagccgggcagggggcgcttggaacactatataaagttttagaatctgccattgcagatagagagaacgggtcatcagctcaggggcaaattatttgggtccactttggggtcaacagtggcgcatcacggtttgctcttgagaatcaagctgtgaatgaagccaccttccgctgcccagatgagcttgggtggaagcctcagagagtccctattgttccatctgacggaagc

SEQ ID NO: 1056 - DNA, 559 bp, Hordeum vulgare
ttccgacgattctgatcaattttatttggaacccaggttttcatgcaagttaaggacatgtaactgatggcatgcaagccggcatttcacacacacacactctagagcatcgttttttttcctttttctctccccttaaatacacccttctttggagcaagatctgaccaataggcgccaatcaccacacaatttttattcagtctgcgtccaactttacatcttccaggtcaagccgctgaccttttaagttgtcctttcctagttcaggctagcgagagcttcgacgagggaagcgacgaaatggatctggacctcctcgtcgactgtcgagaagaggggcacatgcacaaacagagacttgatgccgtgctgctccgcgaaccggagagagtggtagtacacatagttgcacacgaaccgcccggcgtcatccgaaggcatcacatcgtagcctgtctttcggagtgacttggttaactctttcactggcagtgtagtctctcttgtccgtgagatgcttccgtcagatggaacaatagggactctctgaggcttc

SEQ ID NO: 1057 - DNA, 147 bp, Hordeum vulgare
  UNSURE (19),(26): n stands for any base
aaatcgatgaaacacatgngtatgangtcacgaggaactagtaccgctagtttgcgggagcacgaagagttcacaaaggtgaaaaatatagcgaagattgaacttgggaaatacgagatagacacttggtatttctctcctttccca

SEQ ID NO: 1058 - DNA, 551 bp, Hordeum vulgare
gtacagggaaatagttattaaaccggaaagcttggcaaagagtgcagagagacacaacaatttgatgttacacaaggctactacagtcacagttcgggagaaaagagactactacagcgcgtcacggtacgagggacgaggacggcaaggagttcctactgaaatatacaagactcgattggtcagcttatctaattcgacatggcatggccccatggcagatgtgcttagcttagccttgctctttgtacggtgtccagatcagcttgctcacgtcgacgtccaagcccccccgccccgcagccttgaggtggcggtcgaggacctttgggtccgcacagatgacgtgctgccctttccggtactggatcaggtccaggctctgcagtgtgctcaagatgtcgtccgcttttattgccgtcatgtcgctcagctccttaatagatatgttgctcttatgcttcttcaaaatttccagaagtactctagtccaatagcctctataactgagcagaccaagatccgagagaggacgctccggtgttcccact

SEQ ID NO: 1059 - DNA, 518 bp, Hordeum vulgare
gccttatttatgtaggctgcttatccggtttgggattcaattgaagcacattataaagaaagaaagagtaatagggctgcagttcagtagttgtatgtataagtaatggaggttccagtaagtagctatggttgtcggctttgctgactgctaccatgtctattagtcacgtcgatggacgaagccatgttcctaatgataagagtatctatcaaagtgggattctattgggatttcctccattcttgttgctctttttttctacgatgtagaaaaatcatgtgcattagtgcatacctcatctgcaggagccgggatgatcatcggggcagagattctagaaggcgaagtcgcagtcggagtggagatagatatggacgtgacaggtacagagagagggatcatcatcgtcgtagcaggagtcgtagtgctagtcctgatgattacaagaggcgtggcagagacagtcctagtcgtagcaggagccgcagctacagtcctgttgatgacaggaaggg

SEQ ID NO: 1060 - DNA, 556 bp, Hordeum vulgare
tgccagtaaatattttaattagacaccaggtcctacatacaaacgagcaacaatcactcgtcaatgagcaaagtagcccatagtacaatcaagagtcgctgacttggcaagcaataactaattgggtggtgcaaattctttcccgagttttcaattgtgtacgaaacgagtattactactacaaagctatcatacattacacttctgatgaaaacataaatcatggaacgtaggatttttcatagggccgccatcaccacatgatcataagtcgagcattcacatgatcacatctacagggcagcattcgcatgattgcatctacagggcagcaggccttggagctggcataattcagtctgcaattgaaaacacctaccacaccttctattgcacaaggatgttaagagttgtaaagttaaaaaaaaaatgcataagagtccaaatatgaagaagtcctacaaactggttacaagctaagatgctaccacatgattactgtaaactcagaacatcaactgccaaacatgctgacctctataaaccatacaaaacc

SEQ ID NO: 1061 - DNA, 463 bp, Hordeum vulgare
gaaaaaacctcctcctccgctgtaccctagagctgccgcctcgccgtagcttagcgtcaccgccgacgcctcaacccccaaccctcaaccggccaacccctccgtctctcgctcgcgggcgccgccgccatcgccgttccctcccaagctcgtcgcctccctgctgtccgaaccccttccccaaccttggccgttggtctctgaggttgtatcaaagaaatggaagaggtggagaattccagcaagcgtaaagcacctgagctgagctcggaggacaattcctctgctgttgttctgcacgagcaggagccgctgcctggctcgactgccaagcgtcagaatctcgcccggtcgtgcatccatgaggtcgctgtccccaacggctacgatttgtccaaggatgaggccgtacatgggaccctttcaaccctgcgtttaatggggagatggccaagacataccc

SEQ ID NO: 1062 - DNA, 413 bp, Hordeum vulgare
ttttttttttttttttttagtacgttgtaaaaacaacttacaaaaatgttgatgtataacagattgcttctaatcttctgatgaaaccagttgcggcctaagggtttactaaagtagaaggttacatcctatgctgtggcagacgatggctacatctccatgtcatgtcaaagacaaattacaaaacagctacatttgctctgctaacttgtttcaaaaaacatttgctctgctaacatataccccgtatggtacaacagcgggagctccactgatcacaggtacaatgagttggcaaacatgatgccccggcgcaagctctcgctcgccgctccaaacttcttctcaaggttaacctccccaacggcttcagcggcagcttttagctgatttagaaattcatccagcctcct

SEQ ID NO: 1063 - DNA, 895 bp, Hordeum vulgare
  UNSURE (12),(820): n stands for any base
ggactcccgggnctgcaggaattcggcacgagggttttttttttttttttttaagggtttcgaccataatttttgctgttaagcttataaaaggactttgacaaaatttttactttttttttaaagaggcccaacgggttgcccggttgacaaaaattttccggtttacaaattcatttcccagtttttttaataacccgggaaaaaatagtggtaaaaactacaaactaacctttacccaacacgggattaatttttacccagagtcgggattttttaaaaccgcctttgttccctgggtttcaactttgccacggaaccccggttttgcctgccgtaaaggcccactccgtcggggtttgaaatcgctttgttgccctcatcagcagacccttaggggacaaagccaaagcccctcaacctgccgttgtcccggtcatagatgaccttagcataaagcccctttccttgttcgttgaacaggttctaaagcgttgagttgtcaaccccccaggataggttcccgacgtaaagcttgttggctgaataaaagttgccgccaccaccaccgccgccaatggccctgggggttctgggggcaaattcatttttggggggggggggcccggagttaaccctcaaaggtcttccttggaaggtataccctttgaattgctcaacgggggaagcaacttcctaaactgaaccctttgtgacgaatccaaatccacgtttccgtccggtcattttatggtatacaacctggaccatttagacagacccggcctgtttaaaaagcccggaaagcttgccgcttgtnagggtgaagggggagggtgccgacaaaaacctgagggtcctggagtcctcggcctcgggagaaagagagagaaaa

SEQ ID NO: 1064 - DNA, 532 bp, Hordeum vulgare
  UNSURE (8): n stands for any base
tcctatgnctgctaagcatatagaatgactttgacaaaatttctactttttctatcaagaggcgcaacgagttgcacggctgacaaaaatcttccggtatacaaattcacttcccagtctctctcatcaaccgcgagaaaatagtagtagaaactacaaactaacacttacgcaacacgtgattaatctctaaccagagtcaggatatcttaaaaccgcctttgctccctcggcttcgactctgccacggtaacccggatctgcctgccgtcaaggtccactccgtcgaggtttgagatcgcattgttgacctcatcagcagagccataggtgacgaagccaaagcccctcgacctgccgctgtcccggtcatagatgaccttagcatcaagcacctttccttgttcgctgaacaggttctcaagcgttgagttgtcaacaccccaggataggttcccgacgtagagcttgttggctgaatcaaagctgccgccaccaccaccgccgcccatggccctcggtgttctgggtg

SEQ ID NO: 1065 - DNA, 520 bp, Hordeum vulgare
ggagaaatcagagcaggcaatggaatctacgttaatcacgatattatgccccctcctcccctctccctccaagtccagggccccctcttcatcccccctcgccggagctcgccgcatcgcctccgtttccttctcttccggcagcgtatgtggcgtcttgcgtccccgcggcggcgttacctcgtcggtcaccgccgcagcggcggcattcggcgaggcgacagggcccgagtctgaggccatcttgctcagtgttcagggcatgatgtgcgacgggtgcgctgccagcgtcaagcggattctcgagagtcagcccgaggttacttctgctacagttgattataaggaagcaagggctgtcgtgtggacaactcctgaggtcaaggtggcagaagattggcagaagcaatgtggagagaaacttgcaagtcatcttggtacttgtggatttgagtctcgtccacaagggcaaagtgaagcctgagtcttactgatgccacagatgagctatgagcccatc

SEQ ID NO: 1066 - DNA, 558 bp, Hordeum vulgare
aaaggcacattttcattaaaaacacttagagagtaacaaataatatgatgccatctgctaagcaactcaaaaattcacttgtaacatctacatgacgttacacacttcattctaggttcagctggacataaaatgaaatcagcatttcgtcaaactccttggcttatagtagtgacccttgcaatttgtttgatggaatgttccagttgaagttcacgagcaaggcaagctacattgcttaaacactatagataaggaacacgaacataataatctgcagttccacaactatagagacaactttcacagagacgcacacaaatctggagcatcacgtgcccttcactggttaacatgatgggctcatagctcatctgtggcatcagtaagactcaggcttcactttgcccttgtggacgagactcaaatccacaagtaccaagatgacttgcaagtttctctccacattgcttctgccaatcttctgccaccttgacctcaggagttgtccacacgacagcccttgcttccttataatcaactgtagcagaagtaacc

SEQ ID NO: 1067 - DNA, 391 bp, Hordeum vulgare
  UNSURE (381): n stands for any base
gaaccacacctgaatctcgacctcctcctcccagcgaccaaatctgccgccgcgccacctaccggaatcgatccccgcgattgcgcgatgaacaccgacatcaccgcgtcagtgaagccggagtacccggtggtggatcggaacccggccttcaccaaggtcgtcggcaacttctccgcgctcgactacatgcgcctctccaccatctccgccgtctccgtcaccgtcggctacctctccgggatcaagccggggatccgcgggccgtcaatggtgacggggggcctcattggggtcctgggagggttcatgtacgcctaccagaactccgccggacgcctgatgggattcttccccaacgaatccgaggtcgcgcgctancagtacaagc

SEQ ID NO: 1068 - DNA, 66 bp, Hordeum vulgare
tttttttttttttttttttttttttttttttatttttttttttttttttttttttttttttttttt

SEQ ID NO: 1069 - DNA, 519 bp, Hordeum vulgare
gggtgcagtttgccaagtatggcccaaatgctgagaggattcagaaagggagaatcatggaaacggtcccgaagccaggggtcgttccagaagccgcagtccaagacgggggagccgggatgatcatcggggcagagattctagaaggcgaagtcgcagtcggagtggagatagatatggacgtgacaggtacagagagagggatcatcatcgtcgtagcaggagtcgtagtgctagtcctgatgattacaagaggcgtggcagagacagaagtcctagtcgtagcaggagccgcagctacagtcctgttgatgacaggaagggtggcagagacagtttgtcgcccgcacgcagaagcactagtcgctctcctcgcaagacaccacctcctcgcgaggggtctccggctaggcgcaatgatgaccagtctcctgttaggcgcagtgatgagcggtctcctgttaggcgcaatgatgagcggtctcctgttaggcgcaatgatgagcggtctccaggctc

SEQ ID NO: 1070 - DNA, 542 bp, Hordeum vulgare
gcaaattacactttatagtaagtgcccacactggaaaggaaatagtaatacttagtgctaatagacaagattgaatgggaaggtgaagtagtacacatagttctaacaagtatccagacatccacaaagcagcatctgtagcttgaagtagtcactgatatcaagcaccacaacatttttaatttgtaactgcagattgttcatgataaagcaactgagcagcctccgatacgagcagctctgttccattgatcctcagttgtttgacattcagctcatgttgaagggctacgagagcctggagaccgctcatcattgcgcctaacaggagaccgctcatcattgcgcctaacaggagaccgctcatcactgcgcctaacaggagactggtcatcattgcgcctagccggagacccctcgcgaggaggtggtgtcttgcgaggagagcgactagtgcttctgcgtgcgggcgacaaactgtctctgccacccttcctgtcatcaacaggactgtagctgcggctcctgctacgactaggact

SEQ ID NO: 1071 - DNA, 516 bp, Hordeum vulgare
catccgtgctgtccgcaattctggacagattgtcacatggattactgaccccatgcacggaaacaccatcaaggccccatgtggtctgaagactcgtccattcgactccattatgaacgaggtgcgtgcattcttcgatgtgcatgaccaagaaggaagccacccaggaggcatccaccttgaaatgactggacagaacgtaaccgagtgcatcggtggatcgcggaccgtgaccttcgatgacctgggtgaccgctaccacactcactgcgacccaaggctgaatgcgtcacagtctctggagctcgctttcattatcgccgagagactcaggaagaggaggatgaagtcaggactcaccaacaacctgccactgcccccattggctttctaagaaggaagcatcagggaggaggggttagatagttggcatttgcaagcggtatccaaatgcgcattccattgagtttgtatggtgggctgctctttgcacaagctgtatgcttatgaggtatt

SEQ ID NO: 1072 - DNA, 547 bp, Hordeum vulgare
cagtaactatattatctttatttgctccgatacaaaggctcaaacagatcaaacactcaaaaataaaaacaaagaaacaaaacatagtgcaacaccacgagtacgctatcccctgctgtcctcgacaagtaccaatacctcataagcatacagcttgtgcaaagagcagcccaccatacaaactcaatggaatgcgcatttggataccgcttgcaaatgccaactatctaacccctcctccctgatgcttccttcttagaaagccaatgggggcagtggcaggttgttggtgagtcctgacttcatcctcctcttcctgagtctctcggcgataatgaaagcgagctccagagactgtgacgcattcagccttgggtcgcagtgagtgtggtagcggtcacccaggtcatcgaaggtcacggtccgcgatccaccgatgcactcggttacgttctgtccagtcatttcaaggtggatgcctcctgggtggcttccttcttggtcatgcacatcgaagaatgcacgcacctcgttcataatggagtcg

SEQ ID NO: 1073 - DNA, 547 bp, Hordeum vulgare
gtacccccgggactgcagggaattcggcacgaggcaagagccagctcaccatcttctatggtgggaaggtgatcgtgttcaacgatttcccagccgacaaggcaaagggcctaatgcagttggctggcaagggcatccctgttgttcagaacgtctctgcgaccacacctgtcgcagacagccccaaggtccagccggccgtgctggccccagcaagtagtttgcctagtgatcccgttgatgctcataagtctgctcgtccgaatgcttctgatctgccaattgctagaaaggcgtcacttcaccgattccttgagaagagaaaggatcgtctgcatgcaaaggcaccataccaagcttctccttcagatgcaacaccagtcaagaaggagtttgagaaccagccatggcttggactagggccgaatgccgccctgaagccaaaccaataaggcggcatgaacagaagcctcatgcccttaccagagctttccagaaatatctgaaatgttctttgcccttagagtatcaaagtcatgaatatttt

SEQ ID NO: 1074 - DNA, 554 bp, Hordeum vulgare
  UNSURE (13),(63): n stands for any base
tgaattatacggngtccgagaaccgaaccgtgtaaaccattaagcctagcgacacaaacatangtttgaatcaattacaaccacttacttttacaaatcaaagataaagaaacccaatgacaataccgaatgatcagagttacatgtaagatacagatatgtttctttgcactaacttttgttccttagcatggccaactcaatatcaccatgtgttaacatgccaaaacttctctcaggcttcgggcaccggtcatcatcatttgctacttacttctctttacatcggaactatggaggcgaataacatagaaccataataacctaaacaaaacgctagaacatgatatgggataaaatattcatgactttgatactctaagggcaaagaacatttcagatatttctggaaagctctggtaagggcatgaggcttctgttcatgccgccttattggtttggcttcagggcggcattcggccctagtccaagccatggctggttctcaaactccttcttgactggtgttgcatctgaaggagaagcttggtatg

SEQ ID NO: 1075 - DNA, 516 bp, Hordeum vulgare
gaaaataccaggcaagttccctgagacagttgtggcaacgggttacttggctgacatgacagagatctcgattgaactgaaggtccagcatataaaggacatgcctcttgataacgttttcgcaccacagcagatcgctcttctcacagcaaaggcatggctttctgcagacaaacaactggagagaaaggtgataaaattaagcatagagaatagtgttctttcagagtacacaagcatggttgtacttcaaaccaatttggacgcagcacaaaaagtcaagcagaaaccgaaaggacacaaaggtgccaatgagccattacgattccagcttcatggtctaaaacttggattcggtgacaaagcagccaccaaggaaaacctcctcacaggttttggcgaggagaaaccactggagacgttgaagatattcaagaaggctggagggtgctgcagccgcgttgcggactgcctctgctgcatgtgctgcatcaaggcgtgcaacaggatgaacga

SEQ ID NO: 1076 - DNA, 550 bp, Hordeum vulgare
gaagtctctacactctgctctctcctttttgtacacataaaagcgcatccgaacatttgggctagtccaaacttacactaactatccaaagttgtatcatgatggacaagttgtacaaccaaagacgcctgatcattctttgatcaagcattcaagctacacagtatgacacccacaggcttccgcccactctagtagtatgtacacacccggggctctcactacgattcagaccctccacagcacacctcggcacagcactcgtagcagccaaggcacgagagcgcggcgcagacctgcgccatcatgatggcgcactggtcgttcatcctgttgcacgccttgatgcagcacatgcagcagaggcagtccgcaacgcggctgcagcaccctccagccttcttgaatatcttcaacgtctccagtggtttctcctcgccaaaacctgtgaggaggttttccttggtggctgctttgtcaccgaatccaagttttagaccatgaagctggaatcgtaatggctcattggcacctttgtgtcctttcggtt

SEQ ID NO: 1077 - DNA, 518 bp, Hordeum vulgare
cagccgcgtgcggcgtgcccgcatcggtactcccttcaacttcttcccccttccatctttgccggcgaacggaaggaacccaccccaatccccacgccggacgcttccccccacgacgatcgcctccaaaccctcctgcccccgccgatccggcgcgcccagaggtctttctgtgtcattgcttattacctatatgagtgctgtatctacatgattccatggagaccccaaatgatttgatgtcgtactcatccctctccaaaatcaatagctaccacagccaggcgggtcctatgtccgatctagctccaggaaacacatacccagtgcatgactatctctatgagccatctctggaaccagactttccatctgaatatggtgcaagagaagatccgttccctacagctcaagctagttcaactatcaatctgaagaccgttctaggtggtcttgctgcgattgtttcgcgtccaagcaagattggggatgatgcatcacggcagcaaagtttcagc

SEQ ID NO: 1078 - DNA, 543 bp, Hordeum vulgare
gcccttcaagtgctaaaagggtgaaatgttttaacagcacaacattgcaagaattaagccacgacggcggataacatactgatatcctgacaatatttacatgcgtggacacatacttgcagtgaacccacccaataaaagctgtacattttttttctgggatattttctcccaggtagggttcctaccatattttagagatatatatgtacaccactgaatgctgagactaccatggctagaactagcaaaccatttttgagaatagatcatccagagctgagtacaagggttgcgcagctctgggcttctccaccctcccaaacaggatatcggtcgtggtcaagtaggcgtccccatagaagcgcagattggtgtccgatctggttgtcaccacatttccttccagagagaccccaacaaatgcacctttgctgcagctgtaagtgtagcatatcccagaacctttttcacttgctcgaacatctgcttcaagggctctgccaatcgggcctgctgccgcactcaatcctgccccaagag

SEQ ID NO: 1079 - DNA, 80 bp, Hordeum vulgare
gcaagaccgagggcatcgccggcgacgtctggcagcactctgaaaaccgggcctagcattacggatgctgcaatggggag

SEQ ID NO: 1080 - DNA, 543 bp, Hordeum vulgare
gatttaagattggctctgatatttacaacacaccttggaccagaaaagtatccacactactgatacatgaatgcactgcttatttaagccataaatttaaaccaaaatacacaaatggtctatagacatcgacatgggtcatggcaacagatgcatgcgacagggaagtgatgtctaggcgcccccgcgagcagcctcctggagacacttcacagcgctgtcgtagttgatgaagcccatgaaccagaagtcatggttatcaacagaaactacctggatgtacctctctgcaggattctgttgactagcggtaggggtgactgatctcagatgaggtacaggtacaactatcttgtaaatggcggactcggtcttattatcctcagtgacatatgccacggggctgtcactacaaaaagcaagcttggcggtcgagacgtacaagacgcccattatcgggccatgagaggtcgagaggtagcatgcgtaggccttcttgagcttctcgtcaggcaagcactcaaacgtctgctgaaatatctt

SEQ ID NO: 1081 - DNA, 552 bp, Hordeum vulgare
  UNSURE (20): n stands for any base
gtccttccgggcctgcaggnaattcggcacgaggggggtattgagcctgatgttgtgatgtacactgctttgatcgatagcctgtgtagacacgggaaggtgaaaaaagcagcacgggtgatggacatgatgacggagcgggggttggagccaaacgtggtgacctacaatgtgctgatcaattccatgtgcaaggaagggtctgtgagggaggcactcgatttgcggaagaatatgtcggagaagggcgtgcaaccagatgttgtgacatacaacacactcatcacagggctatctagtgtgctcgagatggatgaggcgatggcgttgttagaggagatgatgcaaggtgaaactagagttaggcctgatttgatgacattcaactcggttatacatggactttgtaagattggttggatgcggcaagcactccaggtccgggccatgatggctgagaatggatgcaggtgtaacttggtgacatttaatctgctgattggtgggctccttagagtccacaaggtaaagaaggccatggaactgatggat

SEQ ID NO: 1082 - DNA, 530 bp, Hordeum vulgare
  UNSURE (10): n stands for any base
cgacatatanttagattttaaatatgaaggcaagatacacgcaagcacctgaattgggatcagaacttagcaaagagcaggggattcaggtttggtgcaatgtttttgtagcatattcattacatcatggggcgagatgacgtcgccttttgatatttctgtatcaaaaccaggcaaactctgcaataacttttgcccttcaatgcttgccccaagagaagtgacaatagttgaaataattttaggatcaagtgctacacccttggctgtcatttcacgagttaactcaagaaccttctcggtgtcgcctttagctccataaccttggatcagtgaatcaaatacagcaacgtcaggcacaaagccacttgctgtcatctgtttaagcacacgctccgccgctgctaggtctccagattttgcaaacatgttgattgggatagaatatgtcacagcatcaggaatcagcccctcatcaatcatatctttaagaaactcttccgcaattttcttctcccctgatttgaaag

SEQ ID NO: 1083 - DNA, 538 bp, Hordeum vulgare
gggctgcagaattcgcacgaggctagttgctccacctcgacttgcaccaatgttgcaaggtggtacaatcacattgatgcgctcctgaagctgagtggagttactgcccctggtcaaggtgtgaaggttctgtcatcaattgtccctgaaacctcaactactgatgttgctgaggctcctgcagctgatgatgacgatgacagcgatgttgacctttttggagaggaaaccgaagaggagaagaaggcagctgaagagcgtgctgccaaagcgaaggcatctaccaagaagaaagaatctggcaagtcatcagttttgcttgatgttaagccatgggatgatgagactgacatggtcaagctagaggaagctgtccgaagcatcaagatggagggccttctgtggggtgcttccaagctcatgccagttggatatggcatcaagaagctccagattatgatgaccatcattgatgaccttgtctctgttgacactctgattgaagaccatctgtgcgtcgaaccagcgaacgagtaca

SEQ ID NO: 1084 - DNA, 550 bp, Hordeum vulgare
gttaggaatcaacccattgttctcatttatacgatgcaaacaacactcagtagtaatactacgacaaaactcaacctaaggtccaaaaacctacagggcagaatatgttatgctgctttagctacgacaccatcatggcaacgggaaactgtagacatattgtttgtgctgctgcattgtccaccgaccgcaatcacgaacctcgggaagatttagattttgttgaaggcaacaatgtcacagctctgaatgtactcgttcgctggttcgacgcacagatggtcttcaatcagagtgtcaacagagacaaggtcatcaatgatggtcatcataatctggagcttcttgatgccatatccaactggcatgagcttggaagcaccccacagaaggccctccatcttgatgcttcggacagcttcctctagcttgaccatgtcagtctcatcatcccatggcttaacatcaagcaaaactgatgacttgccagattctttcttcttggtagatgccttcgctttggcagcacgctcttcagctgccttcttct

SEQ ID NO: 1085 - DNA, 518 bp, Hordeum vulgare
gcaacttcgaagagaaggacggggtgaagctgccgagttacaggggcgacaacgtcaacggcgacgccttcgacctcaagagccgcacgcctgaccccgataggatgatccgggcgtacgctcagtcagtggcgacccttaacttgctccgcgcgttcgccaccggaggctacgcagctatgcagcgggtcatccagtggaacctggatttcatggatcacaatgagcagggagacaggtaccgtgagttggcacatagggtggacgaagctcttggcttcatgacagcagctggactaggaatggaccatccgataatgacgactactgacttctggacatcccacgagtgtctcctcttgccatatgagcaggctcttacccgtgaggactccacaagtggccttttctacgactgctcggcccatatggtgtgggttggtgagcgtactcgtcaactcgatggggctcatgttgaattcctccgtggcattgccaaccctcttggcattaaggtg

SEQ ID NO: 1086 - DNA, 535 bp, Hordeum vulgare
ttatttgctccgatacaaaggctcaaacagatcaaacactcaaaaataaaaacaaagaaacaaaacatagtgcaacaccacgagtacgctatcccctgctgtcctcgacaagtaccaatacctcataagcatacagcttgtgcaaagagcagcccaccatacaaactcaatggaatgcgcatttggataccgcttgcaaatgccaactatctaacccctcctccctgatgcttccttcttagaaagccaatgggggcagtggcaggttgttggtgagtcctgacttcatcctcctcttcctgagtctctcggcgataatgaaagcgagctccagagactgtgacgcattcagccttgggtcgcagtgagtgtggtagcggtcacccaggtcatcgaaggtcacggtccgcgatccaccgatgcactcggttacgttctgtccagtcatttcaaggtggatgcctcctgggtggcttccttcttggtcatgcacatcgaagaatgcacgcacctcgttcataatggagtcgaatgg

SEQ ID NO: 1087 - DNA, 552 bp, Hordeum vulgare
gtccccccgggcctgcagggaattcggcacgaggcgccgtgaggtcgtggattggctcgagtccttccttccggcgaagactctcacctcaaatttttcaaaatttggacctcgtatgggcaatgatgttggattagatggatacagcgaaactgatagctatgtgtgtcacaatctgggtacagcttgcagtacagacattatgtggtctggtccattctggacttgtagcaagcagcttcagcactatcaagccttttgtcgtaatggaaccacaatatctatccactcttttgcacttgtcatgtctgaggaggaaaaccgttaccttgcatacttggaggatatgtatgaagataagaagggactcaagaaggttaaagtgcgatggtttcatcaaaaccaggaatttgcttgtgccatacctcctcctgctcctcatccttgtgaagttttcatcacctcttattctcaagtaatcagtgttgagtgtgtcgatgatattgctactgttttaacccgagagcattatgaaaagtgtggggacacttt

SEQ ID NO: 1088 - DNA, 552 bp, Hordeum vulgare
gaatgaatactgcattgaactgctaaaatcattgcaatgcaagaccaaacaacaaacattcttctgatgtggcaaaaggaaactaggacaccgattctgttctcaacagacgcataaactttttttcgactgaggattaacttgaagcaaaagtcacttggaacactatacaatatgactgctaacggtaatatttagtctccaatccatgtatctggtgacagatatgagacaactaggaggagccaagtacagaaactaggaaaattaagcgtatgagacgtgatgtcaccaccctctgctatcggagacctagtaaaccccctccaccggggttgcattaccatatctatagctatgtacatgaagtccaacgaggctgaagttcccaaacttcagggcttgctgacatctaagtctacgcctacttccccgtcgcagtcttgttcatcatcgtcgtccctaggccacttccctaatacagtttgcttctcatcctctacaggaggagaggccttatcggttaacctgcatacttcatcgttgcagcgc

SEQ ID NO: 1089 - DNA, 407 bp, Hordeum vulgare
  UNSURE (33): n stands for any base
tcctcccgcggcgaaaccctagctagcgaccgngcgctcggcggcgggagccatggcggacgacgattacaatgaagttgacatggggtatgaggatgagcctccagaagctgatattgaggaaggggttgaagaagatcctgagaacaatgaggatgcccctgatgatgtggtagggggtgaaggtgaagaaaaggaacaggaaaagactgcccgtccacgcaatacaacaaaatatatgaccaaatatgagcgggcacgcatccttggcacacgtgctttgcagataagcatgaatgctccagttatggttgagcttgagggtgaaactgatcctcttgagattgccattaaagaactgagagcacgcaagatccccttcacgattaggcggtacttacctgatg

SEQ ID NO: 1090 - DNA, 543 bp, Hordeum vulgare
agaggtagattgggtattcactcacaacttgtacctgcatgccagcaatagtccaagcaaactgatgcaaccacgcgactgaattatagtagcacaacagtgggcagccatagtccacacatgttacagtaacataacattgtcacagcaattcagtgctaaacattgcatattatagctactagggcaaggtttagttgcagcaacagtctgccagctctactccccgccaacttgacgcttccacgagtcctccacaatgagctcgtcgactccccagtcctcatagcttccatcaggtaagtaccgcctaatcgtgaaggggatcttgcgtgctctcagttctttaatggcaatctcaagaggatcagtttcaccctcaagctcaaccataactggagcattcatgcttatctgcaaagcacgtgtgccaaggatgcgtgcccgctcatatttggtcatatattttgttgtattgcgtggacgggcagtcttttcctgttccttttcttcaccttcaccccctaccacatcatcaggggc

SEQ ID NO: 1091 - DNA, 549 bp, Hordeum vulgare
gtcccccgggctgcaggggaggccatggcattccccgggacgcgggaacgttccgggtgctgataaaaaatctctgtaagattcgcaggactgaggatgcaattaaactgttcggacaaatgggcgagtggggatgctcgccagatgctgacacatatcttgtacttatcaagagcttgtatcaggctgcccggatttctgaaggggacgagatgatgatttggatgcgatccgcagggtttggagataaacttgataggaaggcgtattatgggttcatcaaggttttatgtgggattgaaagggttgagcatgctgtcaaggtgttccgtctgatgaaaggatatgggcatgcacctggaacgaaatcgtatagcctgctgatcgagaagctggctaggcataatttaggggatcgttcaaatgcgctgttcagggaggcattagcgcgtggagttactgtgacaccaggagtctataagattgacaaggtatgtgaaagagaagaaggagaagaaggtgaagaaaaggctgactttaccggagaag

SEQ ID NO: 1092 - DNA, 546 bp, Hordeum vulgare
ggaaatcgttaaggatgtaactagtacaatagttgcctcataagaagacagaagcaacttctcacgatgtggtaactagcaagcaaaacacgcattatttctgctgcaacatttgcagggaacatcaacatagattcggcagtacatcaacaaaaaagagtgagctcatatcaagccctcggatcggaaaggtaatgttgtctgttagccgctcgcaatggcgggcgcagctcacaggcaccaattttctgctcttctaaactgtgggcgggcttcgtctgatgctttcccttccaacgatcatccgctccaactcaaccccaagtatgctcaagacttcatttgccgcttaggcttcttgacaaagctcattttgagcttgtacagccgcttgctctttagtatcttcttctccggtaaagtcagccttttcttcaccttcttctccttcttctctttcacataccttgtcaatcttatagactcctggtgtcacagtaactccacgcgctaatgcctccctgaacagcgcatttgaacgatccc

SEQ ID NO: 1093 - DNA, 517 bp, Hordeum vulgare
cggagatggggcgcgggccggtgcagctgcggcggatcgagaacaagataaaccggcaggtgaccttctccaagcggcgcagcgggctgcttaagaaggcgcacgagatctccgtgctctgcgacgccgaggtcgcgctcatcgtcttctccaccaagggcaagctatacgagtactccagccaggacagtagcatggatgtgattcttgaacgttaccaacgttactcatttgaagaaagagctgtactggatccaagtactggaggccaggcaaattggggagacgaatatggaagtttgaagataaaactcgatgcactccacaagagtcaaaggcaactcttaggtgaacaattggacccactcaccacaaaagaacttcaacagttggaacaacagcttgatagttctttgaagcacataaggtcaagaaagaatcaacttctctttgagtcaatatctgagcttcaaaagaaggagaaatcattaaaagatcagaatggcgtcctgcagaa

SEQ ID NO: 1094 - DNA, 554 bp, Hordeum vulgare
  UNSURE (21): n stands for any base
gcaagtacatgtgccctactncttttaataacaatataaagagaaggcagcgcccttttgcatttttacaacggatggaatacaaaaaccgtgtcaacgtgtaaaaccataccgcaaatccattaaagcttacacacgaaagtccaaccacaagatcgtgctcatcgatcagcgaaaaaaaaggaactgaaacgtggaaacaagacactgctccctatagtgcaggaaaagctcaagacaggaagaccccattcaccctgtagcaaagacacatggtcttattggtggctacaccggaagccattgccggagatggactgcacaccggcagctagcttccatagtgggcgcgtgtcaggcgccattgtcgccttcaggtggagtcgtatgaggctgtcgccagccttcatctgttgccgatggtgcggagcatccacggtggcagattgctgttgtttgcttgtgctggggacggctgaggttctggatcccctcctcctctagattgatatggcccaatatttggaggtgccatggaatcttgggccgtcggt

SEQ ID NO: 1095 - DNA, 518 bp, Hordeum vulgare
ggcatctcggcggagcgggtgcttgagctcgagtacataaaagcggtggcgccgaggaagcaggagccaccgttgccgcacgatgactgggttagcgcggttgatgggtcgaacccaagcttcatattaacaggttgctacgatggtcttgcaagagtatggaaagatgccgctgtatgtactcaagttttggagggacacagtggtgcaattacttctgccagcttcatcaataaaggagttgaaactgatggcagtttgcatgtcgtgactggctcaaaggataggtcattgcgcctgttcaagtttgatacttcagtcaccatgggctcctcgaagcgaattggagcttacaaagttcttcctggtcatacatcatctgttcaaagtattgctgttgacccttccagaaatatgatatgttctgcttcctgggataccactattaagctatgggcaatcgaaggatctgaagaagatggtgacaccgtttctgtgaaaaagagaaggatgaactc

SEQ ID NO: 1096 - DNA, 548 bp, Hordeum vulgare
gctaaacaattatctcggaatatgaatacagcattgttataatgtgttggctttttagagtttcgacaagggagcacaaaacaaaacttgattgcaaaaatctggtgacccctaacatggatctacttatgcgcaagcactggcatatattggatgcgacaacttcatttgacatcttgatctgacaatagggataggatgcttccaaccataattggcatggtttggtttttagggctgtcttgtcaaccaatataatctggattgaacagctgttagcttgatagcacaagaacaacatatgggagggaatcttcatcacgctatctcaacaccagatgagatgcacagcttggaatcagctccaccacttatcacgctgtcccctttccaccaatcggtgcataaaaccttatcgttgtgggagtccacagaagccagaggccaagctgttcttagatcccacaacatcactttcccatcaaacgaggatgatatcaaatgaaaccaggaactaggatgccatttgcaggcggagatccagcttg

SEQ ID NO: 1097 - DNA, 73 bp, Hordeum vulgare
tttttttttttttttttttttttttttttgttttttttttttttttttttttttttttttttttttttttttt

SEQ ID NO: 1098 - DNA, 360 bp, Hordeum vulgare
acatcaaaaacacatcgcacgagctagtacaaccatagacatccatcaaaatggcttcaagaaacgccgcagtattcctcgtcgggctgctcctctcgtgcgtcgccatgagcagcggggcaagaatcctggaggaggaggcgactacgtccaaaggcgaggagcacctgccggatctgccaacgctgcccaaggtcgagctaccgccattcccggaggtgcatctgccacctaagccagagctgcccaaggtggagctgccgacgttcccggaggtgcacctgccacccaagccagagctgccaacgttcccggaggtgcatcttccagccaagccggaactgcccaaggtggagctgc

SEQ ID NO: 1099 - DNA, 1493 bp, Hordeum vulgare
  UNSURE (19),(37),(40),(41),(49),(51),(57),(64),(66),(78),(105),(109),(144),(151),(169),(177),(182),(216),(255),(263),(267),(269),(320),(335),(342),(345),(347),(355),(358),(368),(416),(434),(449),(457),(488),(523),(598),(605),(611),(629),(658),(677),(692),(694),(739),(746),(752),(754),(759),(784),(853),(931),(945),(1134),(1155),(1169),(1219),(1241),(1257),(1305),(1315),(1389),(1412),(1414),(1442),(1459),(1485): n stands for any base
tggttgtaggcagtgaggnacacacaaacctatgagntcnncagtacancncgagangagatcnantgcagtagacgntcgtgagcgacattcctagcccatgcncgantaggtcttactttctggtgcgtgacgcagaccatnatacatngagagaagtcacccccancggccgantgcancgacctacatctagtatgaagacgtctactcttngtctcgatgcattgctgcttacttgtgtacgacgagacncatgcgcngtcngnctgactgtagtgctgtgtgctgctagtactctgtgtagtcaatcaataggnagctaagactcgagnaccagcncantnctgactancgncagatgacantgatagcccttcatcatgaactgtcgcgatctcgcattcagctatgcnagcgcccttgtcaccganactcatccgtcagcngcataggncagatacacatctagagggtcacatgagatngacgatgctcgataacaggatcgcaaatcgtcacnatacgctgaacgacaagtcatatataggttgcagatgacagcacactagcgacagcgtgatctgtacgatgcaantcattcnacgacngcgctctctagtcgtctncactgtctctatatagtagcaggacggtnctatcgcgaagtgagtacnatcttagacgtagtnantcagaatacgatgcgtgagagtgtacacgcactcggtcttagctnagccgcntctccntngcagntggcttctcactacacattagcggnatatgacagagtcactaggcagcatgagttgatggctcctttgcgacgctcgatcatccacagggtctnatgcatctgttattgtgagagatgcacacacgtgcctcagacactcgcatgtctatcctatccaagagagacggagcnctagtactagggantcacatcagataatcagaatatactgtcgagtactctattctctagcgtgtgagtcgaactgatacatctatgaatctcttagttacgtgcattgattctcggtgctctcgatatacgatcctgcatcgtactctgttgcactactggaagttctcttcatatatgtgagagtcgtgagtagctagttntggagtatgtagcggcggtanggcatcgcgtccgntcgagcacgccagtcacacaagcacagcgctgtggcgtacgcggcggtcncctcgtcgtctatgacactgantcatcgcaatcgaccnttctcgatattcatacgtctccgtcgacacgtgacgcgcgactacatntgacgtatcngaggtctgaatacgtacagcagacgtgagtgtattatcagcgcgtactacagtgctactcactatcgtatcgtntacttacgcgtcatatatgactngncgctatgatgtcttgtgtcacgcgtgcncgctactctctcagcgntgcgtgacgatgaccgcgcgtggaangccggcat

SEQ ID NO: 1100 - DNA, 387 bp, Hordeum vulgare
ttttttttttttttttgtcagaagttgcaaggagtacagcttgcagcattatgcccgttagaaaaagattgcggcgacaaagagaagagcatcgctctggctcttgtaatgtagagcgtcggtgtccatcgtaatgtacaagaatctgtaatgacacgccacacggacggtgaagagaaacgcttcctttggccctctgatctgatgcttacaaggtgtacaacatactgctgccactaactctttcctcccaaggtagacagagaataaacagtgacggcatcatcagatgttgcatctgtcgtacccggagaaccacgagttgaggtcggtgctcttggtgacctccagtgatccgtgctggtgtaaggcgtccacctcccccgg

SEQ ID NO: 1101 - DNA, 551 bp, Hordeum vulgare
cccgggcctgcagggaattcggcacgagggcctcaacaaactgctaatccaagcaaacgagatcaagcctggcaaaccagtgcagaccaatccaaaaatctgtccacaaatgcaaaggagccatcttggcaaaggaacagcttcaaagcaaatgagatgaaaatcggagaagctcctacagaagatgaagcatatggaacctcccatgcagaatctcagttccacgaagatgagccttgtggaaggaagtggtttgagctgctcaaagcacagaaatcagccaacgcaccatcgtcgagaggccaaggatgtcagccaagagaagcaaacaacgacgcatcagccttatgtggagtagtgacagataatggatactgcaaactggaaccggtgacaggaagggaaagatgcgaggagcacagaggaattgaggtcactggtgcgtcatcggcaccatgttccggaaggtcggtattgccatctgtctgtggagctcgggcatccgatggttcaccttgcaagaatcagccaatcgcaaggaggaagagatg

SEQ ID NO: 1102 - DNA, 536 bp, Hordeum vulgare
ctacgtatctatagcctctccaaaatctaatcgacaatttgtgttacacttgtcttttcatatatcatcaacaaatgatgtttacaacatgaacaacagaatcaacaccctgtaaaatggaataataagtgatcccaaaatctgtatctgaaatgctattacaacacacgacacgatcggtgaacaatgttcttatttgactgatggcgcggaggcgcagcacgctctttgacctttgtgcaacgcacatctcttcctccttgcgattggctgattcttgcaaggtgaaccatcggatgcccgagctccacagacagatggcaataccgacctttcggaacatggtgccgatgacgcaccagtgacctcaattcctctgtgctcctcgcatctttcccttcctgtcaccggttccagtttgcagtatccattatctgtcactactccacataaggctgatgcgtcgttgtttgcttctcttggctgacatccttggcctctcgacgatggtgcgttggctgatttctgtgctttga

SEQ ID NO: 1103 - DNA, 541 bp, Hordeum vulgare
  UNSURE (4): n stands for any base
gggnctgcaggcaattcggtacgaggataaattccccctcccccatcccccctccgggaaaccaaaccctagcgctcctcaatcgcacatagcaccccggaaatccgcccagctctagccagatttggctttgcgcggaccaattcgccacccaataaatccgggggtgtgtccccttgggcatggtcgcttgatcgcgtccggcccatgggaatgtcgggggccgccagtggcggtgccggatgcggacgcggcgagtacatgagtatcccggaggatgtggacgcgatcaaggaggcggtaaaggaggagggggagtgcccaaggctgctgcgatgccgcgcgatccggtggtgggcgaaggtcgccgtactcgggatcttcctcgccggcgccaccgcggccgccgtcgttttcttgggcccactcgtcatcaagaaggtggttgtgccgattattgactggcaatcaagaacattcagccgaccagttattcttctaatatgttttggtgcaatcgcttttttcccaagtgtcttga

SEQ ID NO: 1104 - DNA, 553 bp, Hordeum vulgare
tggtggtcgtatttttcttaataaacaaaacaaagataatttcaccttaagagcttgaaatatacattgcaaaggccctggttcaatacattgattgacgttcttaaatttggcagttctctgtctacttgaaacaaaaccaaaagcggttgcaggttgttgacgcttgaaaccagattagtagtccctgtctgtagtttacacctggaggggacctagcatcaaagatttgattcggagatctcaacatagctcatcctcagcctgcaatttttggagcgcctttttcgcataaatagttattgcagcagtggaaactgcagcaaccgtaaagccaattccattgtagatgatctgatccactgataagaaagacccttggctcgttgccacagccaagctttgaacgagcttcccactatagattgcaaggagggtttcatgtatggttcccgccattgaaccagctatatatggacaatattggacatttgtagccacggaagcgtagttaaaaactatatatggaaacggggaaatcctaagtaaagca

SEQ ID NO: 1105 - DNA, 553 bp, Hordeum vulgare
  UNSURE (36),(39),(44): n stands for any base
gtacccccgggacttgcaggaattcggcacgagggnagnaaggncatgaaggcgacgaaccatttgagttcaagacggatgaggaacaggtcatcgaagggctcgatacgacggtggtcaccatgaagaaaggagaggtcgcgttagctagaataccacctgaacatgcgttcggatccactgagacgaagcttgatcttgctgtggttcctcctaactccaccgtcttctatgaagtggagcttgtttccttcgagaaggagaaagaatcttgggacttgaagagcaatgctgagaagatcgaagcagcttctaagaagaaagatgaaggaaatgtatggtttaagatgggcaagtatgccaaggcttccaagagatacgagaaggctgcgaagtacattgagtacgacagctccttcagcgaggatgagaagaagcaaaccaaggcagtgaagatcagcatcaagctcaacaacgcagcgtgcaaactgaaactcaaggattacaaagaagcagagaagctctgcaccaaggttttggagctggagagcac

SEQ ID NO: 1106 - DNA, 557 bp, Hordeum vulgare
catattctttttatttactacggacagttttggtacataaggaacgcagcccatcacagacgagtatacgctacagaacagaggacaaaaccaccaaactacggcaccacaagcaggagcagcagaataggaagacaaccacggtacagcgctgatagaaactacgacgctgatggcgaatccggacccgacccggccatactaggacgctgcagcgccgtcacgcggtgctgtcgatggccataggctgtgcgtcctgctgcttcccggcggcattctccgtcttcctccatttggcgaacatgttgccgtagaacttggcgtccctcttgttgtactccctcagcttgtccttcaacgccttgtacgcaaccttgacctccctgttgtctggatcgatctccagagccttcttgatatctagctctgccagctccagatccacgagttgggtgtacgcctgcgccctcctgtacagagccttgacgttcgtgctctccagctccaaaaccttggtgcagagcttctctgcttctttgtaatccttgagtttcagt

SEQ ID NO: 1107 - DNA, 514 bp, Hordeum vulgare
gagagagaaagagcagcgagaagaagactgtctgggagatgcaccaagaaaaaatgaaggaaaagcggaaagctaggaagaggtcgtcgaaggatgatgatgatgatgacgatagcaacgaagatggtgctgatgaagatgaagatttctttgaggatgaaaagtctgatgaagacgttaagccaatgaagaagcagaaggttaaagccaaagataaagaaaaagggaaaggaaaggacaagcttccagaggaacatttcgaaccagaagcaactaaagaagagttggagctcctggttgctgatcaggatgcaggcaatggtgcaaagggctataacataaaacgcaagagtaaaaagggcaagaagggcaaggattctgtcgaggacaaacatcctcatattgaccttaccaatgacaagaggtttgatcccatgttcacgtctcatctgtttgcgctggatcctactgatccccagtacaagaggagtgccgacttcaagcgaaagcaaac

SEQ ID NO: 1108 - DNA, 505 bp, Hordeum vulgare
  UNSURE (503): n stands for any base
acattactatagttggataccgtaacagccagtaaaacacaagcccttgcaaacatgcctgttccacatgaacgactgagaaaaccttcagggtatttaactagcctaatagaatttttagtccaacaggatcattgtgctatcgacgtccaaaaatggcatatcatcaaaccttcaacctattctgaaggctactgaggcatttttcatcaggaaagctatatcaggccaaagacgatcatcttctctaccgttcactcgtgctgcttcctttcttgaacgctgtgaggttccttttgagggacttaacagcagatagcatttgtagcttctccgtagacgccccgtcatgttgcttggtcttcctagtcgatgcatcatcagctggcaatgtactccccggagatgactcctccacaggtggttcactatccaatgtgcctgcatgcacacccttcttcccagtttgctttcgcttgaagtcggcactcctcttgtactgngg

SEQ ID NO: 1109 - DNA, 549 bp, Hordeum vulgare
gtacccccgggcctgcaggaaattcggcacgagggaaaccctaagaacacccctgcttctgcttctgcttctccggcccttgtcctcagccgcgcgccgcgcatctcgattccgcccgcgcccgctcctgattggtgctccgcgtgcgccgtgtcctgacccctgaccgactcccgctgcgcggctgcttgcgcggcgccgctggttccttcttgctgcgattctcgtccgtttcgtgattccggtttcctgctgcccggccggcctcgccatggggaagagtaagaagagcaaggtccgcggcgccggaggggacgaccttctggacagcagcgacgccgacagcgtgggatcgtcgtccaccgcgctctcagatctctccatctcgtacgccaccgagaacgtcaactcgcacgagtttgttctcgacaagtacatcgacgctctctacgagaagagggggtctacaagagaggcagcgttggcttcgttggttgatgctttcgaaagttttatgcttgatggtcttgttgagaacaaatatgccac

SEQ ID NO: 1110 - DNA, 561 bp, Hordeum vulgare
ccaacaggtggatcttttcggcccagtagtagtattttctcaagtacaacaatgcctcataatcataattagacaacaagtcaaggaaggagcaagctctaaggacattctgcctgtggttgtttacacagatataaataaataaattccagctcaaacggagtaaactgccgggtcgatgaggttttgttttgtttcctttctcgttactcttcaaacaaagcagcgttcttcctctcctgtgccaaacgacgatccttgttcagcttcagagctcttcctttctcttctccagatctaaagattttcttgtcattcgatgacagcgtttcagccttgtcagccttgatgttgaagatatcttgaagaagtccattgtcctgcacatgcttcaggaagcctctcccgaggaaacgcttgaagaagttcaactgaatcaattcagaccatgatgcaacccttagaacatcacgttttccagcaatcttcagtgattcttcagggcactcaccatacttgacaaaatccaaaatccgttgaaacagatctctttggtcagaa

SEQ ID NO: 1111 - DNA, 517 bp, Hordeum vulgare
gtgataggcttaatcgtattcgtccaagttggacacattgaatcgagcatgtggagtaagtttggacaatggtaatctatctagaaaggatgctggtggcaagtcctttgagcgagaattcccacaccttagttctgaggacaacaatggaaaacatgatgtagtcagagttccatctcctggaattggctccccaattcagagcataccattggttaatgcgcctgatggctggaactcggtgctagcagaagtccctggatttagtgagccaagcaatacccaggtctcttctacttcatcacgtgctggttccagtcagcagcttgaagtgtcaaactgcgggactgcattaagcatggctgaaacagtaatgcagaccccattaaaaatttccaccacacctcagctattgattgatgctcagaagattgaagaaagaactatgaggcagtgtattctaagacctctgacgccttcatcaaacaaaaattctgtatctactttgtcggatagg

SEQ ID NO: 1112 - DNA, 540 bp, Hordeum vulgare
gctattcttttcctttctttctgaaacaggataagccatgagaagtactgtatacaaaagaagacaacctatattctttctgagcacctctgtgtgcctccaacaccatacatgcttttatcattcggtattccttctgggaaaatgaagaaaaacctcaaccctcttttcagcagggaaaaacatctgcctaagcatgacaacccccacagagctgaagttaactagaacatctcgatttgttaagctagacacaaccgtcccatggcagatgaggtagttacggaaactcgtcacaaaatacagcttgattcccacaagttctcagcgccgtgacgaactttggttgatgagccctatcatcagcccctgcattcctcaagcttctgctgcagcctcacgttgtgccttaaacaatcagctatctcttcctgtttcagaggcgggactacttcatcttccttccagccaagagatttcaagaaagccatttcttctggactaggttcatcttcagtaggatatggttcctcttcccca

SEQ ID NO: 1113 - DNA, 520 bp, Hordeum vulgare
caacttattattacatcttcttgccaactcccacttaattacttggccggacgatgagtcacgccgccgcaccgtccacctgctgccggtgccgcctactggactccttgatcgtcagcagctcgtcgcagatgatccacgggaagctccagaaccgcctctttcccggctggtggtggtccgggtgataggccatgtggtaccacgccgaggccttcctcgccgcctccgccttcgggcggctcgtgaaccagccccgtacaggagcctgttccggatgttgcccgtcagtatctcgtcctcatgctccgtgccgtagtagctcatcagggtgctcagcttctccgcgtacagatcgtagcactcctccgcggataccaggaactcctcaaagccagggacctctaggtcaggatcgaacgcggggatcggttgagccgaggacgagggggcaggagcgctctgcatacggctcgcagccgctcggtacagcttgccgagaggtccgttggagatgtac

SEQ ID NO: 1114 - DNA, 462 bp, Hordeum vulgare
ggctttaaatgtagtttcctcgacagcaattgtatttttctcacctgacatgtttataactgtaatcttacgaaaacatctgatgaactgcaggaaattcagaagtactttgtggattacatgataaatgactcgctcggtgcaatctcaactgctcacttggtccatgcggatcgtcacccaatgaaagcccggagccctgagtgcctccagctagctgctttgcattcaatggcggctgactttgccaaatcaggagctccagctgaaatgccccggtcactgagaccaaaggagtaccccgacttcatggaacggtgggacaaaccaacgtacatcttcaacggacctttcggcaagctgtaccgagcggctgcgagccgtatgcagagcgctcctgcccccttgtactcggctcaaccgatccccgcgttcgatcctgacctagaggtccctggcttt

SEQ ID NO: 1115 - DNA, 929 bp, Hordeum vulgare
  UNSURE (1)..(4),(14),(21),(22),(24),(25),(27),(28),(32),(33),(52),(67)..(70),(73)..(75),(102)..(106),(108)..(123),(134),(135),(148),(161)..(183),(185),(188)..(190),(193),(194),(196)..(198),(241),(242): n stands for any base
nnnnggtaagggancgagganncnnanntgtnnccctcagtgggcctagggnttttgtgacccaaannnnaannntttgggggggggggccccaaaaaaccnnnnncnnnnnnnnnnnnnnnnttttttttttnnggggggggggccncccaaaaaaaaannnnnnnnnnnnnnnnnnnnnnnanatnnnaannannnaaaaaaaaaaaataaaaaaaaaaaaaaaatggggggggggganntttttttttttttagaaaaagaaaaaataaaaaaaaggggggggggggtaataagcccccccccgataggggggggggggggggtttttggggtgggggggggggggaaaaaaaaaaagggggggggggggggggggttgtgggggggtggagggggggggggggggggggggggggggggggaggggggaaggggggtgtggggggtggggggggaagttggggattggggggggggtggggggggggggatggggggggggggggggggggggggggggggggggggggggggggggggggggggggggagtgcggaggggggtggggggggtggggggggggaagcgggggggggggggggggggggggggggggggggggggggagggggggggggggggggggggaggggggggggggggggggggggggggggggggggagggggggggggggggggggggggggggggggagggggggggggggggggtggggggggggggggggggggggggggggtgggatgtggggggtggggggagggaggggggtgggagggtggtgggggggtgggggagggggggagaggtggggggggtgtggggcgcggactgggggtgcgggtgtggggagaggggggcgggggagggttgggtggcggggcggtggagtggcgtggggc

SEQ ID NO: 1116 - DNA, 548 bp, Hordeum vulgare
tgacagagctgctgcttttttgcacagtattgattacacgtgtgtgaaataaatatgtacacgatgcagttctcttcaatttgtggcatcccaattaaaccaacattctagctacagtctatttacgccctaggcaagagatggcttgaagtacatgcacatcggcgggtcaatcctcatgatagacagtattgcagaagggacgctccagatgccatcaccacagatcaaacccgaagcaaccgcacctgaaaagtcctccgactccttccggttaatcttctcccaaacaaacaggatgaccgtcccgacaaacatgtcaatcgcaaaatacgctccaatgtagaagggaacagccatggccatcgggagtgggatgaatttggacacactgtctggagtgacatccctcaggagattgatcgctatggctgcaaagaagaagaaagagcagattgctaggcagtgttgcggcagtgccgagaatccttcgacacccaaaattgacatctcacggaagatgacagcatatggagctttgaacatgc

SEQ ID NO: 1117 - DNA, 518 bp, Hordeum vulgare
atcactgatcaccagcacagccgcgcgcatccaccgttgctagcaaggtcgaccaagcagcacagagatggctgctgccttctcctccaccgtcggggctccggcttctacgccgaccaacttcctcgggaagaagctcaagaagcaggtgacctcggccgtgaactaccatggcaagagctccaaggccaacaggttcacagtcatggcagcggagaacatcgacgagaagaggaacaccgacaagtggaagggtcttgcgtacgatatctccgacgaccagcaggacatcaccagagggaagggcatcgtggactcgctcttccaggcgcccacgggcgacggcacccacgaggccgtcctcagctcctacgagtacgtcagccagggcctgcggaagtacgacttcgacaacaccatgggaggcttctacatcgctcctgctttcatggacaagcttgttgtccatctctccaaaaacttcatgaccctgcccaacatcaagatcccactcatct

SEQ ID NO: 1118 - DNA, 517 bp, Hordeum vulgare
gccgggccgcgtggtgtcccgagacgggtctcgctggcggcgggggcttcctattattcttcgcccttcggctgctctatcttgttctagctcacgggtgggagctggtagggagttcacgagagaatatggcgaggttttgctgcttcggcgctggctgctccgagctgacagggcatgcatcggcctcctctggtaaagggaaaggctgtcagggccaagtcaaggttagctacgggtttagccttgtaagaggaaagacaaaccatccgatggaggattttcatgtcgcagagcttgctgaagtgaaaggaaacgagcttggtctttttgctatttatgatggtcatttaggtgacactgttcctgcatacctacagaaaaatttgtttcctaatattttgaacgaggaagagttttggacacatccagacagagcaatcacaaaggcttatgaaaagacagaccaggctattctgtcacatactccagatctgggacaaggtggctccactgc

SEQ ID NO: 1119 - DNA, 525 bp, Hordeum vulgare
taatttacgggaaaactttgatccgtgtttgcccatcatgacatatattacatggagcgatacctcagtatgaactatacatctcaataacgtagcagcagcaagaattgttacatctccctggaggtcctaagctgctgttgctagcagtgctatttaaatcctcgttgccaatcatagatatacattggagaaaagctatgccaaaatcaaagaccccatgaagatcttgagatgagaaatgcaggtacataccctctaaagttatcacctatccttgtcctgtatcaagttgccgaccatcttggcaaggggcacggtgcccttggccatgatctccagcttggacgtggttgaggcgtgcgcgaacagcgagagcccgaacatgaggagctcaggcaggaacagcctcgacgagaggaagccgtgccagtagtgcggctcgaggtcgaagaatgcgttgaagaagcgtcgtgtaccttggaggtcgagcttgagcaggacgtccatgccgaagcagaagaa

SEQ ID NO: 1120 - DNA, 552 bp, Hordeum vulgare
gtttattctttaataattcataacactttatataggattccaccagacctttatactggcaatgaatttgtcatatggaaactggagatcaaaaataaaattctacgagatggggctatgagctgatggatcgtcatgttgtacaacagcactgctctaactttctttgacgtagtataacgtattactatgcttgcaagaatgtggtccgactccaacttgtgcagccatctactgtaattcgcctactggcgcctcgttcagccataggtaatgaatgaactcatacagctttgcactcacactcaccttgtaaggtgtcggatttagccgcctgatgtgatccggccgcagtttttcgagctgttgcatacagcggcttctgatcttctccagcgggggcagctctgctctaggtttatctgaactcccaggccagtaacaatgtagcagctcctcaacatgctgggggacaacataagccctcttggattcaaggaacgggtgacgacaaagaattcgctctcctgcctttggtgatggttcactttc

SEQ ID NO: 1121 - DNA, 494 bp, Hordeum vulgare
gtcgtcatcagggaagaacaccgagggcgagtactcgggcctcgagcacgaggtcgtcccgggggtcgtcgagagcctcaaggtgatcacgaagttttgctctgagaggattgccaaatatgccttcgagtatgcttaccttaactaccggaagaaagtcacagcagtgcataaagcaaacatcatgaaacttgctgatggtttgttcttggagtcttgccgtgagattgccgctaaatatccaagtattgagtataacgaaatcattgttgacaactgctgcatgcaacttgtttcaaggcctgagcaatttgatgttatggttacgcctaacctttacggcaatttggttgccaacacagctgcaggtcttgttggaggaacaggtgtcatgccaggaggtaatgtgggtcaggatcatgccatcttcgagcaaggtgcttctgcaggaaatgtgggaaacgacaatcttgtagagcagcagaaagcaaacc

SEQ ID NO: 1122 - DNA, 551 bp, Hordeum vulgare
ttaaggtagcacggctattctctctgcaattaaatttaaggtagccagctattctctctgcaacacaaggtggtttgccttgctacaaagtctcgtgagaataataattctcgtggattcctcaattatttctgaaacagaattgacgatctaacactgtacgaaaaaaataacactcagaagttgggacttttaaaccagtcctccaaaagaatcgatccttcagcggtgcatcaggtatctaatccagattagcgatcactgcatcagtaacttcctgggtggtgctggtgccgcctagatcctttgttctgtactggccttctgcaacgacgcgcttcaccgcagtttccagacggtcagcgaatgacgggaactgcaaatgcctcaacatcatcgcggacgacaggagcagggcgacagggtttgctttctgctgctctacaagattgtcgtttcccacatttcctgcagaagcaccttgctcgaagatggcatgatcctgacccacattacctcctggcatgacacctgttcctccaacaagacct

SEQ ID NO: 1123 - DNA, 929 bp, Hordeum vulgare
  UNSURE (707),(799),(800),(807),(808): n stands for any base
gcctccccgggactgcaggaattcttgccgagggagagagagagagagagagagagagagagaggaaacgtatattttgcacttccacaacgaaaaagcgcgcacacatcagagaaagtatccaatcctgctggaggtgcaagcaacatcactttcagagaggatcctgtgacgaacaccgcaaaaaaaattcacaaccagaagttccaagagctgacaggctatcacatctttaacgaggatgctcctcctgtctcagctgacaagtctgtgagctcagcagagcttaaagagatgagcggcaatgacatattctccgatagaaaggcgtcttcgagagactacctgggatgtgtgcgaaagccccctggtggagagagcagcattgctctcatctaattatggtagactgctctagtgggcactggctagtacgtccttctcattagaggcgctcttctcggccttgcggggtctagatgatgattcgagatctgaatttatgttggatatcttacccctaatatagtgtagagtcagcaggatctgactcggtttatatcatgtacgcttgcgcgtgatcacattctttgttgtgcggcacttatgtattaatctctctgtcctgagaacctgcagcataagcttttatggactcactagttgatcgcccgtggagaaaattaatatcatttcttctctccccngcagcctagccttaggtcactggacaagtgaacgacccttccgggggggggcgccccccactacctgcgtctatgatgcaaaaaaagagggnnagaaaanngggaattccattagagtggtgtgaaattttggcccattgttgaaactattagtggctccacagggtgattcgttgattgattctgtaacacatttgtgggtcgaccggttggctaaagata

SEQ ID NO: 1124 - DNA, 538 bp, Hordeum vulgare
aaatgatattaatttctcccacgggcaatcaactagtgagtccataaaagcttattgcgcaggttctcagtacagagagattaatacataagtaccacaaaacaaaggatgagatcacgcacaagcgtacatgatatgaaccgagtcagatcctgctgactctacactatattagggctaagatatccaacataatttcagatctcgaatcatcatctagaccccggaaggccgagaagagcacctgaaatgaggaggacgtactagccagtcccgactagagcagtctaccataattagatgagtgcaatgctgctctcgccaccagggggcttccggacaccgccgaggtagtctcgcgaagacgcctttccatcggagaatatgtcattgccgctcatctccttaagctttgctgagctcagagacttgtcagctgagccaggaggagcatcctcgttaaagatgttattgcctgtcagctcttggaacttctggttgtgaattttctttgctgtcttcgttacaggatcctcac

SEQ ID NO: 1125 - DNA, 539 bp, Hordeum vulgare
  UNSURE (16): n stands for any base
gtcccccggctgcagnattcggcacgggcccagccggtttcttctaggagagctacgtagaggcttgagcgagatggggttgagggacaagaagaggaaccagaggcgcgtgctctcccggcgctccgccggtccccgcaccggcgagggcaaggatttcctgccgctggaggggaaggagcagaggatccgggagaagcagctcgaggagccggagaacacggccactgtcctgtacatcggccacatcccccacggcttctacgaggaccagatgcaaggtttcttccagcagttcggggctgttaagagggtcaggattgcccggaaccgcaagacaggaaagtccaagcattatggattcattgagtttgagaaccccgaggtggccaagattgtagctgatgagatgaataactacctcctgtttgagcacactctgcaaattgcgcctgtcccactggagaaagttcatgccaaactatggaaaggtgtgaggaagggatttgtaccagttgaccgggtagcaattgaacgga

SEQ ID NO: 1126 - DNA, 559 bp, Hordeum vulgare
agcaataaagatcgttcattcttcacccacaacttcatggctccttcaccaacatgcatcagtcattttttaaactaatacataagacacgatgagaaaaagaagtaccaaatcacaatctcatcctcaataaaatagaccggccatgataactcagcagttccatcactcccactggataaaagatccatctgctttctctatagctaattctcatcaaactttatcttcttagcggaaggctgaacgctcccgataagggctggacactcgtaatcgataccagcagccttgattcttttccgacacttctcatcccgctttacaattccttcaagcatccttttgtgctcttctactgttttatccttgctaagcctcttccgttcaattgctacccggtcaactggtacaaatcccttcctcacacctttccatagtttggcatgaactttctccagtgggacaggcgcaatttgcagagtgtgctcaaacaggaggtagttattcatctcatcagctacaatcttggccacctcggggttctcaaactcaatga

SEQ ID NO: 1127 - DNA, 518 bp, Hordeum vulgare
cgaagatgattttgagagtggcgatgaacaagacctttatgttggagatggaggtgctggtggtggagtagcacttgctggtacatggtggggcaaggaagctttggctttggccgaggaggtttcggcatcattcgatggcgacttgaaaatttatgctttcaaggcgactgcaaatttggaaatcagagttcgcatcgagaagatgtccactaggtatggttctccaactattgatgatattgaagcatacacaattgtataccgtgcaaagttggatgatgcagagtcagcaggcaggataccgaagaacgtatccttagaggtgtcgtcccctggcgtggagagagtcatccgcgtcccagacgaccttgaacgcttcaaagaacggtcaatgtatgtcagatacgttataacaagcgaggatgcagccacatcccaggaaggcgacggcgtgttcaggctcatttcctatgacgtggacctgtgtgaatgcacctggggcatagccgatgtga

SEQ ID NO: 1128 - DNA, 550 bp, Hordeum vulgare
tctatgggaaataaaaattaatgggatcagtaggtaaatcatgtagggaatcctgccatacaactacgtaagaggcaaacaagagggcaagatttcaggacagggacagttgaggtgttatctgttaagtagaagaataaccatctcaccactggatatgaacaaatggtgcaacaatctagctaccgcgcatacactggactatcagtggtagttcagcaaaattggacaaggttctctaaaagatacgtacctcagatggacacaaatgatttagtcaaagaagatgctcaacattcagagtacaccctgaccaacttcagtgactcgaacggcgtctgcagacgccattctctttgcttcttgctcagaggcctgcccttgccggtctgctgccggttaatcttcacatcggctatgccccaggtgcattcacacaggtccacgtcataggaaatgagcctgaacacgccgtcgccttcctgggatgtggctgcatcctcgcttgttataacgtatctgacatacattgaccgttctttgaagcgtt

SEQ ID NO: 1129 - DNA, 518 bp, Hordeum vulgare
cccaaccgctcgccccgcggcggagccctgcaacaacctcttcgtctcaggtttgaataagcgcacgacatctgacggactgagggaagccttctcgaaattcggtcaggttaccgatgcaagagtcatcactgatagaatatctggatactctagagggtttggctttgtgaaatatgcaaccgtagaagaagctgctgagggcataaaaggcatggatggaaagttcttcgatggttgggtgatatttgcggagtacgccaagcagagagaagcccagcagccgccgcaatcagcgggtacacagtcatctggctaccaataccctagctagttagttctctcgatcagaaatggcttgttctcaatttatatgctaccaattggaagttgatttccaaaaaattgtcgaggaagggataaaatctagtgttggtcgcttgaactattccggtacggttatggaattgatcatagtttcacttgtatacgtctgtgtaactgtaacatttgccact

SEQ ID NO: 1130 - DNA, 550 bp, Hordeum vulgare
tctgtacgaagttaaatatagctagtggcaaatgttacagttacacagacgtatacaagtgaaactatgatcaattccataaccgtaccggaatagttcaagcgaccaacactagattttatcccttcctcgacaattttttggaaatcaacttccaattggtagcatataaattgagaacaagccatttctgatcgagagaactaactagctagggtattggtagccagatgactgtgtacccgctgattgcggcggctgctgggcttctctctgcttggcgtactccgcaaatatcacccaaccatcgaagaactttccatccatgccttttatgccctcagcagcttcttctacggttgcatatttcacaaagccaaaccctctagagtatccagatattctatcagtgatgactcttgcatcggtaacctgaccgaatttcgagaaggcttccctcagtccgtcagatgtcgtgcgcttattcaaacctgagacgaagaggttgttgcagggctccgccgcggggcgagcggttgggcctcgtgcc

SEQ ID NO: 1131 - DNA, 549 bp, Hordeum vulgare
gtcccccgggctgaggaattcggacgaggcttccgaggcggtttgtctagcgaagcaagcaagcaggttcatccgaggcagcagcaatggcggtggagcccgagatctgcgtgctctccaatggcaggatcacggcgaacatcgcaaactggggcgccaccatcacctccctcctcgtccccgacgcgcaaggggatctcgcggatgtcgttcttgggttcgacaccctggagccgtacttgaaaggcatggcaccttattttggttgcatagttggccgagttgcaaataggatcaaggatgggaagtttgatctgaacggagtagagtattcgttacctatcaacaatgggccgaacagccttcatggtggattgaaggggtttgacaaggttgtgtgggatgttgtagagcgtaaagatggcgagtacccatcaataaccttccagtatgagagcaaagatggcgaagaaggttaccctggcgatgtaaccatccgagcaacgtattctcttcctgaggctaccactctaagacttgacatggaag

SEQ ID NO: 1132 - DNA, 550 bp, Hordeum vulgare
ttagcccctttgaacttttttctgaatgagataagtcctcagttctgatcatacacctttttttatttttccttggtactcaacttgactcctttcttctggtcgttttattccattctacaactactgcagttgcagccattaagctgctggcattatctctaatcatgctgagaattcaaacaacatggtgtgcttatacttcgcaccaggctgcaccaccacagacgggaaattggtctggttgatggcattggggaacccctgggtttccaagcatactcctgcatgcttcccgtaaacagctccgcctttgcccgtgatgccattcacatagttggcggtatagaactgcatgccaggcgcatcggtccagaggtccagagtccgtgagctcgacgagtcctttagctttgctgcgtgcttcaggccattcttctcatcacccgagtccaacacatagttatgatcgtatcctccaggaacatcgttgatgcgatctccaatcctgtgctccgtggtgaaatcgaaaggtgtgtcctggacggac

SEQ ID NO: 1133 - DNA, 519 bp, Hordeum vulgare
cgggtaggacatatcccacctctcacctttacttctacgaggtctggaatgtgaagcaaataatggagaaagaagtcttgagtgaaaatcctaccattatttccatggtgaaagagatggagaagaagtggatcaaatattttgaggagtcattcttagcaagttgtgtgccagtaatttttgatccaaggtacaaatatgaatatgttgacttccgattgactgcaagatttggtgatgacgccgagaaatagcttaccctagtacacagtgcgatgaagatcctattttccatatatgcatctgaacttgaaaacacttgtgataaaggtgatgagcttgcagaggaggatgtcgagggcactctggatgattgggataagcatttgaggtagaaaagatctcacaactcgaatgagctgcaacgatatcttgaagaagagttgtttcctcgtcgacagaacttgaagtggtgagaaatccactccccaaagtatccagtgcttgtgactatagcgc

SEQ ID NO: 1134 - DNA, 545 bp, Hordeum vulgare
cataaaatgtgattggacaatctggacgattacaagctggcgtgtggggtcaggctgcaggtgggactaatagcgtgagtcccaccacatcccacttaattccacacgttttggtgggttatagccaacaatcgactaaaatttaagtgggttaagtgggatcaagtgggttcccactttttaaatgtatacaacatgtacgactattatccactttttgaatcatgcttatctgaagctacaaccaggatcgtacatgggcattatcaccctgaaagtgtaatttaatcataactacgaccaggttggcgacaatgcgggaagcaacacgatgattatatgaagtgtaatttaatcataactactacctggatcgtacatgggcattatcttgaacattcaaaatgattcaagattatctactaggatagcaaaatcttcaatgatgattatctgaagctacacttccctgaaacttcatatatgttgaaagaagccatggatcattctgatgctgacagttgactgctccagaactctaggtg

SEQ ID NO: 1135 - DNA, 126 bp, Hordeum vulgare
tcacactcccccgccgtctccgcataccacaactagtaatggctccaccgcctgctctggctcctcgtccctttcttgctcgctcgatgcaacggcaggaattgacgacgtggtaagggtccgtgc

SEQ ID NO: 1136 - DNA, 313 bp, Hordeum vulgare
tttttttttttttttttttatggaacggctttgaatgattatacttttatttcacagagatgagcaatttacagaggagagtgccagtgcgtatgtgtgtgtgtgatgtgtcaggagcgacacatcacggagtgcttgaatacactggacactggagagattcactcgttcgttcactgtaacaaaatatggagtgaacatatgtgttagcttcccatacggacagcacaatcaagaactggtgccggacacaaggtcacaggctccaaatgccatggaacatgttcctgagcttgctcccgccgagcttctt

SEQ ID NO: 1137 - DNA, 525 bp, Hordeum vulgare
cgcacgagggaacttccgcacatcggaaggccagtgttacactgctgcctgcgccgccgctcaccgtgcctccgccgatggagatggtcgctgcccccgtctcccccgctccccgcacagtcgaggacatctttaaggacttctccaaccgccgcagcacactcgtccgcgctctcaccgtcgatgtggaagacttctacaggtactgcgacccagagaaggagaatttgtgtctgtacggacaccccaacggcagttgggaggtcgcgctgccggcggaggaggtgcccccggagatgccggagccggcgctggggatcaacttcgccagggatgggatgcaccgccgtgactggctctccctcgttgccgtccactcagactcgtggctgctctccgttgccttcttctttggcgcgcgtctcaatgcaaacgagaggaagcgcttatttactatgatcaatgaccaaccaactgtgcttgaatcattatctgagcggaagcatgggagggataataaatctg

SEQ ID NO: 1138 - DNA, 541 bp, Hordeum vulgare
actcataaacagatcataattgaacgttagaaaaccacatcttgttgtctttccaacatctagccagcagtcgtataacgaggagcattacatctgccgcaaaccttacctagactagactagagaagtattgtttcatcggtcagttggggagcagctccgtggttttattgcctgcttttcttggagctgcaatcagggcacttgtagtgcttaatgtgctccgctttggccggagttatcctcacgcacttgccatggaaccaccgctcacaaatatcacacccaatccagaactcacttgcattgtagcgaccaccgcaggttccacaaagggtttcactgtgttcatcatcatccttgtaggcgtcatcaacaacagctggccttgagttctttgtctgcatgtcattattcgttcgctttcccgagtgtcttgatttgccactgttgtcaacaccagatttattatccctcccatgcttccgctcagataatgattcaagcacagttggttggtcattgatcatagtaaataagc

SEQ ID NO: 1139 - DNA, 486 bp, Hordeum vulgare
gtttccgcggaatcctggactccaaaatccgagccgctcctcctcgttttggcccccactgcaatgcgctgcatgccccagccgatccctctatttaaaccagggcctcctcgccttctctctgactccatcccagccccttctgccacagcgcagtgcgagcggcagcagacctttgtttggtacttccacctcagcttttgtccggccggtcctcttccgccggccggccctgcgtcgcctagctaggccatataaggagaactgaaggaggcctccaaggcattcggaggcgtccagcttgagcatcagcagcaggtgaccgaccagaaatgtcgctgcaagtcgaggacccgcggagcgcagagacgcccgcgccgctcaagcgccacgactcgctgttcggcgacgcggagaaggtctccgactcaaagcaccatggctctcaggtgagctggatgcggacgctgagcttggctttccaga

SEQ ID NO: 1140 - DNA, 464 bp, Hordeum vulgare
ccttgcttatgcctgggaggatacattcaaacttgagttgcaatatggaccttacatttaacacatttagatgtacatacagagaaagtggaaaatgcattaaaaccttgcaaccaaaagaaagaacacccctccctccccaacctgcctgcacctgacctgcatgtctccttattgaatcgacaatggcactttgccctcccaaatcaacgccatgcaccagaaccatcacatcacatgcatgcttggggtgaacatgaactcgatcgatcgatcgatatcgatgactatatctcgtatgtgatcccgactttgagcagctgatctttgggaatggccagcaccttgtgcccctccgtcaagttcttcctcaagaacgtgtagacatggttcaccacgatcttcttcaagatggaggacttggcctccgccgtcacattggcctcccccatcagatacaccat

SEQ ID NO: 1141 - DNA, 480 bp, Hordeum vulgare
gtgaccacgagtagagccagccaaacagtggtctgcgtactatgctcgtcgacaggcctgctccggccaactttggcgcatccgagcgtgtcctacggctccgctgcgtccacgcgctcctctccggactcttctcatcctccatcgttctcctcgcgccacggcgggtgccgtcgcggtattgctccgcccgtgacctccatcgtgttctccctgtcttggccgtttcttcgctgtagtgtcgcgtcgagctgcccttcatcaggtcgacgccgtaaacatccacgaccagctcactgcgagctccataatccggcgaagggcgccacggcagtcgtggttatcgcctcgcctcggccggctataaaagccacggccgagcccgtccctgagcacttcacgaccaccggcagctctcacttcttccttgaatcctccccagcttcttaatcgaactccaagaccttcagcttctcccca

SEQ ID NO: 1142 - DNA, 543 bp, Hordeum vulgare
  UNSURE (534): n stands for any base
ggaagtgcgagcaagggggttcgtcaccatctcatacatcacactactattcatacggacataagcattttaatttaaatatgcaagaacaacatagatcaaagctttagggcatatatcagatgctcggcttgcctggggtcgaagaatactccgggaagaagtgcgaagggtccacggaaaggatcaccgggaactattctctctcgaagaaggctgatagaagggaaagggcaacatggtcattttcagaatgtaaacacataataaaaatgatactaacatgaagtgctcgatgagacgaagacgcgggcgttggtttcactagaatcagagtcccgagcaaaaagatacgagtgtttgtctgccagggacctttttataaaagaaatattcacaaccggatccctaacagcgcagctggtcgtgcattcggggacaatacgccttccagagacgaaagcctattttgaattttacgcttccacttatccacgctggcaggtgcctctctcaccgacatgtggggtcggngcccaccta

SEQ ID NO: 1143 - DNA, 552 bp, Hordeum vulgare
gtacccccgggcctgcaggcaattcggcacgaggctcgtctctgacttcggccgcttgcgtggtgatcaggcctctctcgtcaaggatgtcatcctgccttactcccaccgcatcaaccccttcaagggcgatgtcaatgttgacagcaggcctgcattgctgtttttcatgggcaaccggtaccgaaaggagggcgggaagatccgtgatacactttttcaagttcttgaaaatgagggagatgtaatcataaaacatggagcccaatcaagggtgagtcggcgtatggctacgcaaggaatgcactcatctaagttctgcctgcatcctgctggagatactccctcggcgtgcagattgtttgatgcacttgtcagtttatgcgttcctgttatagttagcgatcacattgagttaccattcgaagatgttatagactacagtaatatatcaatttttgttgacacaagcaaggccatacagcctggattcttaacttcaatgcttcggaaagtcagttcagagcggattctggagtatcaaagagaaat

SEQ ID NO: 1144 - DNA, 544 bp, Hordeum vulgare
  UNSURE (23): n stands for any base
aggaagcccttgctgtcctatantatgtatatagcgctgcaacatccaaaattcaggcaatataggcacaaaagtttccttgaggccgcaaaaaccatcttagctggcagtagatatctcgctcggtgttgaacagatgcacgagcaatcagtttcattagtgcctctttcaactaggcgtttgttccggttaatcaacagcttgatcagtggtgctttcatggaaacttggcgccatatttgattcactggcccattcggatcttcatactcaaagtaatgttttaccctttgtatttctctttgatactccagaatccgctctgaactgactttccgaagcattgaagttaagaatccaggctgtatggccttgcttgtgtcaacaaaaattgatatattactgtagtctataacatcttcgaatggtaactcaatgtgatcgctaactataacaggaacgcataaactgacaagtgcatcaaacaatctgcacgccgagggagtatctccagcaggatgcaggcagaacttagatgagtgc

SEQ ID NO: 1145 - DNA, 542 bp, Hordeum vulgare
ggctgcaggacattcggcaccgaggagcctattactattagtatatactgctagctacctagctaggtagagcggcggcggggcagcactagccagctacggcgagcggttgctgccgctgccgctgccctattctaatctcaagcctctgccgcagttgccgccatcaatcatcatagccggcaccgtcggcggagaattaaaggggccgtgttagtggggagggggagggggagaggatcgattccattcggttctctttttttcttcttcttcagaagattgaattcaaaggaggaaggcattaataacaaacccaaaaggaagtcccggctgcctttctgatggatgtcaccaagcagcagcagcaacagcacgacgaggaagccctctccgactcttctcctctcgcttcttcttcctgggcgtcaacctcttcctccccttgcttgcctggttcaggggacagggcgccgctgctgccctgcaagatggccgacgatgaaaagggtgacaggctcgatgtttctgaggataccgcg

SEQ ID NO: 1146 - DNA, 560 bp, Hordeum vulgare
  UNSURE (122),(123),(138),(139): n stands for any base
gttttaatgcttaaatattttaataagtaatataaagcgtctttcttgaaggaaaaaaacagaggctataactttgaaaagaaaaccatgagcttataactcctgcccgacaaccctctcgnngtagacctgcactgnngtctgacccccacacacacccagccccaaggctcggtaacttaacgcacacctaaggccgaaacagcttggggcagtcggagccttttccttcagctgaggctttccttgctgcgcctcgcccatgtccaatccaatgtagcggtgctgacaaaagcttacacaaatagtagatatttcagactttcaggcaatgtttaggtagccacacatacaggaatacttcgttgactgatgctattttatctcaatgatgagcgtgtcaaacactctactgacctaacccatactataatatatgaaaatctagagctgacttgaaattggcctcacatatcagcaaataagtggtaagtactggaatcaagcatgataagcctgagcgcagcgactgcggccgtgaccgacaacaagctgaaccc

SEQ ID NO: 1147 - DNA, 516 bp, Hordeum vulgare
ggtacttggtctaggcacttgtctcctgagattggccagttcaccacagcacaggatgtttggaagagatgttttgttgatgcatgttcagttgtgcacatggcacgcttctgcattccggatagccaaacttggaacatgataccattatctctcctctttgactcaacgacggatgaatctgatactcgagatgggaataaaattcttctccgatatgcttgctgtggcagcttgtgcaaatatataatggtagcatctgggagagcctcggtgtttttcagtcgagcacgggtgaacactcaaatcaaggcttgggatcatgctgttgggatgatttgtgtgcaggaagctggcggtcagatcagcgactggagtggggaaccgttggatcttgcagctgacctaacagggcgcagaattctgtacccttcaggcggtgttcttgtgacaaacggcgctctgcacgacaagctcgtcgaactcatctctgcaaactacaaatagttgatgcaa

SEQ ID NO: 1148 - DNA, 550 bp, Hordeum vulgare
gtcaggcagctgtgctatttgattatgtaaatgttctggacaggctgtggtttatctctctgaatgcgagacctgatacagagcacacggcaaaacgttacagacgaaacaaaatcatgctcctgttcgaagatgcccaacattgcatcaactatttgtagtttgcagagatgagttcgacgagcttgtcgtgcagagcgccgtttgtcacaagaacaccgcctgaagggtacagaattctgcgccctgttaggtcagctgcaagatccaacggttccccactccagtcgctgatctgaccgccagcttcctgcacacaaatcatcccaacagcatgatcccaagccttgatttgagtgttcacccgtgctcgactgaaaaacaccgaggctctcccagatgctaccattatatatttgcacaagctgccacagcaagcatatcggagaagaattttattcccatctcgagtatcagattcatccgtcgttgagtcaaagaggagagataatggtatcatgttccaagtttggctatccggaatgcagaa

SEQ ID NO: 1149 - DNA, 539 bp, Hordeum vulgare
ggctgcaggaattcgtacgagggccgaatccgcccgtctctgtcgcgtcgctccgccctctccgcctgccgtccacgcgacgtcccccgcagccaatacccggcgctcgcttcccctctccttctttttttcccccgaatatactcgttggaaacatagtcttccccggcggccccgacgctcttcgggacgggtccttgcgcaggtccgaacgggcggcgattaccacgccgcggctgctggtgatacttcatagttttgccaacgtcaagtaatggttaaaatgattggtaatgagccatcaagtgaattagaatgggatgagccattaggaagagtgccaatcttttcctatggctctgggcatatgctaaatgatatcacatcatcttgttggtttacgtatttgttggtattcttgacggacgtcggtcttagtccaagtgatgctgctattgtcatgctttccggtcagttggcggatggcttcacaacaatctttgttggtgagctgattgatcgttttggacatttcaaac

SEQ ID NO: 1150 - DNA, 553 bp, Hordeum vulgare
  UNSURE (15),(33): n stands for any base
gtcattagcccatgnggcgtggattaaactttntaaatgaatatacatacaagctttgcattgttctgaacaatgtgactaggatcaatttacacagttaagtatgaccattggcaggttatatgacttctgtgctacttctggtttatactcaacgccttgttgagtaaccttctctgttggtccctaaacttctcccagactacacagtacataagtggattggtcgtgtctgaatttgtttcccacgtgccatatacgaatatacggttgttagcaccttcacagaatatatgcaggactggtgatcagatttctatggtgcaaggtgtgctaccagcaagagttaggaaagaagaggctccactagaggtctccgtcgagcttcagggaggtccatggtatgagctactatggctgaaagcagcgagaagacagctggaactagccccagaccgagcctcgtaacggagtagccatatgccaattcttggttctcactgatcttggtggttccttgataggactcaaggatatacaacgcgatgccaca

SEQ ID NO: 1151 - DNA, 549 bp, Hordeum vulgare
gtcccccgggctgcggttccttggaggtcatgcctgctggacagtttgaaccgctatataggagccccctaagtattcaggatggagaactgccagtccttccaatgtctgtatacggctctgttgccatgtcacatagtgaggattcagatgagtactcgtcaccaagccagttcttcttctatctatatgataagagaaattctggtttaggaggaatatcttttgaggaaggacaattttccgttttcgggtatgccacagacggaagagatgtcctttcacagattaaggctggagataaaattcgctccgccaagctggtacaaggcagggaacgccttgtactgcccgcggcagcttcggcgccagcaccagcagatccagcaccagcttcaacagatccaacgccagctccggcagagagctgatacaatcaaccagaagctccgcaaaccggtagcattctttcattgatcaggagacaaccattttgtataccgagatcatgtaaagacaaaaaatatattgtgtgtatatatatagaga

SEQ ID NO: 1152 - DNA, 533 bp, Hordeum vulgare
tctatatatatacacacaatatattttttgtctttacatgatctcggtatacaaaatggttgtctcctgatcaatgaaagaatgctaccggtttgcggagcttctggttgattgtatcagctctctgccggagctggcgttggatctgttgaagctggtgctggatctgctggtgctggcgccgaagctgccgcgggcagtacaaggcgttccctgccttgtaccagcttggcggagcgaattttatctccagccttaatctgtgaaaggacatctcttccgtctgtggcatacccgaaaacggaaaattgtccttcctcaaaagatattcctcctaaaccagaatttctcttatcatatagatagaagaagaactggcttggtgacgagtactcatctgaatcctcactatgtgacatggcaacagagccgtatacagacattggaaggactggcagttctccatcctgaatacttagggggctcctatatagcggttcaaactgtccagcaggcatgacctccaatggaac

SEQ ID NO: 1153 - DNA, 377 bp, Hordeum vulgare
tgagagtcttgccacatcagagggtgctgatagttcaacagttgacgcgacacatgtgctgcctgaggaatcagaaagggaggtgatgtgcgaggatgatggaaagaaaaaaattgagcttgatgattgggaagatgcagcagacatgtctactccaaagctgcaaagttcgggctctgggaaccaggctagtgcagtgcaacagccagattctgatatggctgaagctaatggtcgaaagaaatattctcgtgattttctgctaacttttgcacatcagtattctagtcttcctgttggcatccggatggatactgtcactagtactctattcaaagatttggcaggaaaatcctatgttattgatcgggaacctc

SEQ ID NO: 1154 - DNA, 377 bp, Hordeum vulgare
ttttttttttttttttggagaaaaatccaacatagctcacaagtaggagaacatcacaaaatagcacacgttttgtattgctattacattggctatagatgacataacagcatgctacagacaatatttggctttgtgcattatttgcatgggtgtaacaggagaagggatcagacccttttgctgccatctatcagcatcagagccactgcggggtacttgaggagcattggattgcggtcccacaagtacaccacgtggattcctcaaaacaccatgagtacctccttggccgccgcggtaattcgttgctgggccgtttgtcatgtccatgtggggatcacggacaggactgaaaggaacacctgattttgacc

SEQ ID NO: 1155 - DNA, 487 bp, Hordeum vulgare
gtgaagtcggcactctccccctccgtccccttctcctaggtgaactagtctacaatccggtctttatcaacatgtctgagagccaggaaactgataggaacattgaaatctggaagattaaaaagctaatcaaggcactggagtctgctagaggcaatggcacaagcatgatctcccttattatgcctccacgggatcaggtttctcgagtggcgaagatgttaggtgacgagtatggtactgcttcaaatatcaagagtagagtcaatcgtcaatcagttttgggtgccatcacctcagctcagcagaggctgaagctttataacagagttcctcccaatggtttggttctctatactggaactattgttactgatgatggaaaggaaaagaaagttactattgatttcgagccattcaagcctataaatgtctcactgtatctttgtgataacaagttccacaccgaggctttaaatgagctatt

SEQ ID NO: 1156 - DNA, 542 bp, Hordeum vulgare
aaggaggaatatttgtaggaaaaaatgtcttcgttgcaaaaactgcgggagtaagatactactgctactatatattacacaatatttatacgacttccttcaccacattgaatattaaaagtagacactagaattagaaccctagagacatcataatagacatacgacagtacacaccgactgaatagaagcacaattgttgagacaactaaacataacgagcttttagtccggttatcgtctcagacaaggtacttccatgatgacggtatctcaataacctcgtcttgaaatccttcagcatagtttgaggctggcccatgcccctcaatttctggatagctgcctttggagtgttcttgcgtaagtaggtcatcaaaaccgagctgtggcgtccttccatgggccagcacaatcatttgattagctgattgctaatcagagtcttcatacaaaccttcatcgtctgaaacctcgtcgaaagaccggatgtctagctgatagcgcagcagaccaccaatgccaccaaatcctctacaaaa

SEQ ID NO: 1157 - DNA, 450 bp, Hordeum vulgare
agatcccgcctcctctccacgcccttggccgccaccgccggccgccgcgcgctccgtggttgctcctcctccctccgtgctgcctgctttgattggacaggtgaacttggttatcatgggcctcgaggtagcaggtggcggggaagctgcagttaaggggaagttctggggtatagttgtttgttttttcttgggaaatggaagcttatttgcctggaacagtatgcttactatcgaggattactatgtctctctgttcccggattaccatccaacaagagttcttacactagtataccagcctttcgcctttggactcacctgcttctttgcatactatgaagcaacgatgaataccaggaagagaaatcttgccggttttgcacttttcttccttagctctttcgcgttaatattgctggacgttggtaccaaaggacatggtggaat

SEQ ID NO: 1158 - DNA, 418 bp, Hordeum vulgare
tttttttttttttttttttatctaaaaggacttatatttagaaacggagggagtacaccgcagtacatcgcaggtcgcagccaagttatttacaaacatgaggctaacatttcaaatctcttttgagaaagaacacaaataaccacttggaatacaccactgtactgtactactgtagcatccttgtttcggcaaccacctatctatctatggagcgcgaaagaccgccaacgttagcgcgcctcccacactgacaccgaacgaatcgcgcagaccgaaccagggagagagctcgactaccagcccttgcctatcaaccacatccaatcaagcacgacgccggagaatatgccggcgaggaggcacaccacgagcacgtttcccagagcgttctgctccggccccttgtacccatttg

SEQ ID NO: 1159 - DNA, 334 bp, Hordeum vulgare
cggcccatcttcgttccgtcgcggggatcgtgaggtgccaactatctactactttctcctcttattactttatatagatttatagatcttcgaattatagaatcattgatcgtgtgtccagatttactaagtacggtttggtcgtgattaggtaggtggttatggtttcgcttttttagcacggctagatcaagatccattatttgcaaatcatactacgaattcgatctatatcatgaattctaagttcttttaaatttcacgaattagggtttctaatgtttcgtcgacgcctttcagatctcatgggttatctcttctttttggtggagca

SEQ ID NO: 1160 - DNA, 555 bp, Hordeum vulgare
  UNSURE (32): n stands for any base
tttattaaatttgtttatacaaaccctgttancaaatggaagcatacaacaaatcaaatattcagatcaagccccttcggaccagccatgcctccaagattcatccaattcaaattaacctgcttactaaaattaaatttgttagaacaaaatccatccaattcttgttagaagaatgtaagcataaaaatgagaaatccaaaggaatgtacaattttttatgacaacaaattaaatctgaagacagcatatattaagctatgaaaaatatttatgataatgaatcctctaatcttacaaagaaaaatggaagtgaagcaggcaatcagctaactgaaaggtgcagcaccttcacctcacaaaatatatcaacattttacaatttaattcttcaataagctttctgtacgtatcaacatgaacacaagagcgaaaatggcatttcccaaccataagctgtctgtaacttctttatatatgataagctgtctgcaacttcattagatatgacgagctgaatagtaatcctcaaacgctaatcaaactgttcaccaa

SEQ ID NO: 1161 - DNA, 552 bp, Hordeum vulgare
gtccccccgggcctggcaggaattcggcacgaggaaagaattgatctaaatgttccggtgtacacttagctaacagagacatctgggggaatgagcttggttttgaggcgttgggctacaaaaaagactgctgggtcaacaaaaaatggccgcgactctaaccccaagtatctgggtgttaagaaatttggtggagagaaagtggaaccaggaaacatcatcgtacgacaaagaggaacccgcttccatcctgggaactatgttggcatggggaaggatcacactatcttctctctgaaggaaggccatgtacggtttgagcggaataagctgactggcaggaaatggattcatgttgaacctgtagctgggcacactctccaccctgtttacgccgatggttcagccactgcagctgacatggagctactgtagtgttgatctgtgcgtgggtcgcagtaacaaattgctgatagcttcctgggcatggctctgctgttttgctccgacatggataccttcgtaattgaatttgttccagcaaaaatgttt

SEQ ID NO: 1162 - DNA, 549 bp, Hordeum vulgare
tgcgacttggaatgacaaacagaggttcactgtcggtttcagggaaaagcagcaggaaacgaacaaaaaaatacacaagtgaaccttcactctctcgtgcaaaatgtatacttaaaatgcatcagaaacacactgaagttgcttattgcgataatcctaacccagaaacatttttgctggaacaaattcaattacgaaggtatccatgtcggagcaaaacagcagagccatgcccaggaagctatcagcaatttgttactgcgacccacgcacagatcaacactacagtagctccatgtcagctgcagtggctgaaccatcggcgtaaacagggtggagagtgtgcccagctacaggttcaacatgaatccatttcctgccagtcagcttattccgctcaaaccgtacatggccttccttcagagagaagatagtgtgatccttccccatgccaacatagttcccaggatggaagcgggttcctctttgtcgtacgatgatgtttcctggttccactttctctccaccaaatttcttaacacccagata

SEQ ID NO: 1163 - DNA, 403 bp, Hordeum vulgare
agctcatcactcccgcactcaacacttccgccaccttgggctcctcctccatagctactagcaaagctgagctagtagaaggtagcagccagccagccagccacagggctaagatggcgtcgcccgcctccttcctcccgctgcttttgctcttgctcgcggcggcggcgcattgcttgccgctgccccagcggtgcccgcaggccgaccggcaggcgctgctccgggtgaagcaggcgctgggcaacccggcgacgctgaagacgtggtcgccggcgtcggcggactgctgcacgtgggaccacctccggtgcgacgaggccgggcgcgtgaacaacgtcttcatcgacggggccgacgacgtgcacggccagatcccgtccgctttggccgggctgacggc

SEQ ID NO: 1164 - DNA, 387 bp, Hordeum vulgare
tttttttttttttttttaattcccaaaattcccgagtagtacaaaccaaccaacatttggacgcctctcaaaaagtcatgtaaaagtaagccaagcataattaccatttaacacttgatacatgatccatcccgattcccgaacacgggcacacacacactctctcggggaagcgcacctccagacggtacacacacacacagcacgcacacatctctatcgtttggtcgtacacaaagctagcagctctcaaggaccgcgcttgtcaggcattaccacagtaccagcgcggtactccactccactagtatactaagccccaaagcaccgtccttcgtagctcgtacacacgcacgtacgcgcacgagaacgccaacactgacagac

SEQ ID NO: 1165 - DNA, 227 bp, Hordeum vulgare
acctcccaagcatcgccgccactctccgcctctcgctcatccgcgtgcagcatctctctagctcccccctagagagatctcacagcagagtcagcagcagcaagcaaggtcacatcccagcaccaccaggagccaacccgcgtcgccaatggccggtctcaggatgaagctcgtcgccgtcgccgccatggccgccgcgctcgtcgcctcagcggccgccgccgagg

SEQ ID NO: 1166 - DNA, 291 bp, Hordeum vulgare
cacatgtggcctttttttttttttttttggggtaagcacctgatcaccaacacaaagaatggaacgccggcgcacgtacgtacgtactaggacacctcccacaccaccgcggcccatacatacacacacgcacgcgcccacacctcacacccacaacacgacggaacgaacacagcgcacagcgagacgacgtcgacgagcaaaccaagccggagagacgaagaagaagggccatctcatctcatctcatcacgcgccgccgcggcgacggatctagcaaaagaggtagcc

SEQ ID NO: 1167 - DNA, 516 bp, Hordeum vulgare
gtggcaccggcagcaagcagtctattcatctcagatctgaagttcatcccctctcccggtgttctgttcccagcttggatccttcatcgaggacgaggaccgttcctctccaagttgtgattgatcgcatcggcagcttcttacatcatcagcgattaatggccaccggaggcgtaaccctggagagcctaccgaacgagctaccattagacttcttgaacaaaatcacaaggaacttctccgatgagctactacttggtcagggcgcattcgggtcagtttataaggtagtactatgattttgccacaactttctctgtcaattaagaggttgacacgggaaagtgccaaggtagattagttttatgtgacgttaaacaggggatcctggacgatggtggggtggttgctgtgaagaaactcgcggaaaattcccctgtaccacgtgacacaatattcgtgaatgaggttcagaatattatggtgcttgaacatgaaaatatcgtcaagttggtt

SEQ ID NO: 1168 - DNA, 553 bp, Hordeum vulgare
gagaagtaactaaattatttgcaactgcatgatatcaatgggtcatgttccacaatacacttttcattaatacttttcttatttatgaaatgccatcatggattgctttattgaatgcaaatatttggtttcatcatccactttcatagcattgatcttattttactttatgttggacatctctcactaaaaagtgggaagttctgtgctcatatggaatgggagacctgaaatttgatgacacatgttagcataagtcgaaatataaagattctacgttaatatggtgtacgtaagaatgtgtgaaatatgaaaacgagaagtaacagatttactaaaatgccaaatatgaaaatgagaagtatgaactttactaaactatttgatgaatttaaataataaaaggtgaatgtataatatcttaaaacgtgaatcattcttgaaatattaaatacaaacatgaatgtaagtggggcatttcatatcgatctagttgtacctaggcaccactgttaatctatccaattatgtaaattttttgtcttaaatgctc

SEQ ID NO: 1169 - DNA, 523 bp, Hordeum vulgare
ctaagacaaaagctaaaggaagcatcgaacaccatacaagagttgcttctggagaaatcaaaggatggcaggaaaggtcaaaaggtgtgagaaactcaccatgttgctacggcctccctaacccgggagactccagtttcatgttttcacgccctggggcatggcatagcagttgcttttgctctagcttgtgtacggccaatggccctctatgtttagccccgccccacctttgtttagagttgagagtggtagttgaatcatctcgtccagggtaagcttgcagcgctttgtgtatagccatgaatgagatgaccaataagttgattcaatgtaaggtagaatgaccactcgtgtgtccatgtctacccgtctcacctttgtttagagctgagtgctacctgcatcatctcgtccagggcaagcttcgaggcttcgagcgtttggtttatggccatgagttctatctaaagtagaatgacaacttagctatgaaagtctgcatcgaattgataccagtttt

SEQ ID NO: 1170 - DNA, 537 bp, Hordeum vulgare
cactgtataagatagaaatgaaaccgactatttgtatgtaagcatatcaaacacactgaaaaggagctaaaagctgatggaaatgtggccgctcgttctctcatctggagcatgtacaagtcgaagcaaagggagcccacgcctcattacaccagacacttgcgtaattctaatatgaaaacaagggacaaaaaactaacacgagcagatggtacccaacactacctattccttgaatttaggctgaactactgcctcgacctcttgggaaaactggtatcaattcgatgcagactttcatagctaagttgtcattctactttagatagaactcatggccataaaccaaacgctcgaagcctcgaagcttgccctggacgagatgatgcaggtagcactcagctctaaacaaaggtgagacgggtagacatggacacacgagtggtcattctaccttacattgaatcaacttattggtcatctcattcatggctatacacaaagcgctgcaagcttaccctggacgagatgattcaa

SEQ ID NO: 1171 - DNA, 518 bp, Hordeum vulgare
ccaactccgacgcgaccgcgaaaccctagtcccccggcaaccttcgctggacccggggagccgctccggcgccatggcatccccggaaggatcaaactgggtcttcgactgccccctcatggacgaccttgctgccgccgacttcgccgcggtacccgcaggaggcttctactggaacccgccgatgccgccgcagatgcacactctggcgcaggccgtctccgccaccccggctcccaatccctgtgctgaaatcaatagctctgtttcggtggactgggaccatgccaaaggacaaccgaaaaataaacgtcctagatcagaaactggtgctcaacctagctccaaagcatgcagggagaaagttagaagggacaagctaaatgagaggttcttggaattgggtgctgtcttggacccggggaaaacacctaaaatcgacaaatgtgctatattaaatgatgctatccgtgcggtaactgaattgcgtagtgaagcagagaagttgaaggattcaa

SEQ ID NO: 1172 - DNA, 554 bp, Hordeum vulgare
gcgccatcgcatttccttcgcagacggcatttatttactaacaatatacagcagtgccacaagataatcaaatgtccccaggtgatacaacgacgatgcttcagttcggttcttagtttaactacatagtaacactgacaactaaaatatactttaacggaaggctgtttagccatccttccccatgagatagatgaggcaaatgattttcgctggcttatgcaacaggagggcatgacttagggtcatccgaggtatcaacatctgaaggcggcatgaactgccacatgggaaatcctgggtagctcattacaggcatcataagcttatgccctgccgcttggccttgggcggcagcgaatgcagtagctgggatgacagaagggtgtggtacgagtctctgacgggcattcatgaacttaatctgctgctccaggctctctttttccgccttcagcttttgcttctcatctcgcagctcattcttctcagccttcagctctctaatcttctcttggagagactcatttgaatccttcaacttctctgcttca

SEQ ID NO: 1173 - DNA, 216 bp, Hordeum vulgare
caaaggaccccattcgctccggacttaaacctaatcttgagaggcctgaggggaatcctaatggagaagctgttcttaacccgattgataagaaactgaagatgagagcaaggagggtgcttgcaaagcttgctgagaaaagaaaatcagctgcagaatttgcacgcgcagaaagaagcttggatgggattgatatgacatgcaagattgtagatt

SEQ ID NO: 1174 - DNA, 433 bp, Hordeum vulgare
  UNSURE (13): n stands for any base
taatacaatttgntcaggggtgtatataagaaatatgaacctctacaagtgttttctgtgggcaaatacaaaactttttacagttagcaggaatatagatatataaagtgccagctggtaattgccagatcctcagtcttgatgaaggttggctccacatacgtagttattaacctcgtaacaaatcaattatacaaatctaatgaaaaagaatatgcctgttcacaataaacatatccatgctttgacgaaaaagttactggtcatgggttttctcatcggtatctcccgatttgtaccttactcatgctgctctccagcctctgtatgcttgccgcaacacgtcctacatttggctttgaatctatgtcatcctcatcaacactgtcagtgttagtctgtaacttggcaccactcttggcgagacctgtgt

SEQ ID NO: 1175 - DNA, 533 bp, Hordeum vulgare
  UNSURE (39): n stands for any base
ggacttcgtacgaggcttctcctcagatcgggcacgtgngccgagccaaccgcacccgcctccctcccaaaccctaacaaacgtttctcctcgcctcgaagcttccggaagcgtcgggcatggaatcctccgcctccggcgacggcgcctctgccacgaaggctgctgcttctgcggaagcagcggtggcgtcgtcctcgtcgggcccctccacctctgcctccgccttcttcgccgatggcgccggtggggccagcgccacccactacctcgccaaacgcgtgctcaatggcagcgccgtgcagcacgtcgcccgtggccacttccgttcggagcacctttgggagatcgtcctctgcaagggaacttcacttgaattagttgtggttggtgaggatggtgttttacagtcgatctgcgagcaaagtacatttgggattgtaaaagatgttggtgtcttggactggcgctttaaacacttcggtatctggcctgagattgaagggaaagaaattctggttctactctctgat

SEQ ID NO: 1176 - DNA, 553 bp, Hordeum vulgare
cttctattctggatgtctaatgttaccaattctgacgatgtcattttgccaaattttatgtacaaagaagtcggtactttacaacatctatagtattataaatatggagatgcaggtcacagcagaggattgactgctacactcgaacatcacctcagcaccagatgtgtactacctcagtccgggtttacacaccggtggaccagatctgaagtaccaaggcacttgtcgatttgtcagcagattggaaaacagtatgccagcgctatgagtgaaccaagttggttgcagaaaacctcagtttagcgcatagtggacccgctccaacattcgcatgacctggaaaactgagatagacctgtgcggtacctttactgaagaaccatcatcaataacagtttgctgttgctcactggtgagctctaagaattgcacgagcatgtcaccatccagaattgaaggcactcccgacgggataccacgtcgacgaaactctgcatggtcatttcccaagattggagcagtcaatgggtgaagtgaaagtctttcttgg

SEQ ID NO: 1177 - DNA, 517 bp, Hordeum vulgare
  UNSURE (63): n stands for any base
gcgaacctagggttcttctgctccgcccctaatcgcggcaattccttccgccctcctttccgnatattggcttttcttggatcgcatggcgactagcgacgaactcgcccaagtcgacatctccacggaggagaaggacaagctggtggccgaggtgatgcgctacgcgctcttcaagacgcaccagaactccggctgccccatcaagcgggaggagctcacgcagatcatcaccaagaactaccgccagcgagcgctccctgcgctcgttatcaaggaagctggggacaggcttgccgcgaccttcggctatgagatgagggagctccagaggacccgcgccacgtccacccgttctggacgcccctcctcccagcagcccagtaatctggatgcaaagagctacgtcctggtaagtaagctggaccctgaggtgtacagcaagtatgtcgaggataaggagcgtgcccatgtgtctgggtttgcttttgttgtcataagcattgttcatgtcgct

SEQ ID NO: 1178 - DNA, 550 bp, Hordeum vulgare
cagcgcatacttatatggtttcctgaagcttaggcaagcaaacctgaataacaaagcctcgtagaattataaggactcgttgttaagataatgcagccccggttaacgaagtacagtacatattactatactagctgatcagccaccgcaacactaggttcccgcaacaaaagctcatgtctttcgtttttctttttccaaatccagaaagtcaggtcttaggcatctgcagactaccccctccctctcccatacagccctcagatgaagcctccaccaaatctctacaatggttttccaccccaactcaagttcgtcgttgtactgatgagtttagactgaacagcaaagcctgatggttgctgcatcatatccacttcattctgctgtagctgtacttatgcccacaacctgtgaaatgtattctttaagcttggaactgatggattcatccaatgccctctctgcaagctcataaaccatggaatggccttctggaccagcaatcttctccttcagcaagtacctttgttgcactagtagttcaagc

SEQ ID NO: 1179 - DNA, 471 bp, Hordeum vulgare
gcccacctggaaccgcattttgcaggatattttactacttcatggtcttggcattaactttgttcttgttccgggaacacatgtccaaattgacaaactattgtcagaaagaggaaggaaggctaagtatgttggtcagtaccgagttaccgattctgattcactagaagctgcaatggaggcagctggcagaataaggttaacaatagaagcaaaactctctcctggccctccaatgttaaacctccgtagacatggtgttattggtcattggcatggtcttgtggataatgttgcgagtggcaatttccttggtgctaagagaagaggggtagttcatggtgttgattacggatttactggtgaagttaagaaaatagatgtttcacgggtaaaagaaaggcttgatagtgatagcattgttgttgtgagcaatatgggatactcgagttcaggagaagttctaaattg

SEQ ID NO: 1180 - DNA, 519 bp, Hordeum vulgare
ggttagaatttcctctggtatttgttctctgttgtggcacaaattgccttctttacatccatgtaagtaaaagaaaattttaaagccgctatcacgaactgcagttatatttctatctgaaattatataactaacataatattaaaaccttgatatgaccagtgcagatatctcgtctgactttcaccaaattctttggaagtcctgtcatctgccagcaaaattgttgacagggacaccagcatgctttgactggagctgctttatataatatttcgatccacgtgacaggttgatgcgttttcttctttgctcaggaatagattcaatcgaacactctgagaagccacgtcgcacaaaccaatcggctgtccgtgtagtaagcaagaacagtttgccaagaccaagggataatgcctccttctcaatgtaatcaagcaacttatcccccagacctcttcctcggcattcttcagatacagcaatcgcagcaacttcaccagatttgtcctcgggaaa

SEQ ID NO: 1181 - DNA, 517 bp, Hordeum vulgare
gcgcatggacgcgtccagccgcccgcagcttgcttcgtccgtgcgaccacaggatcgaagctcccgcagccacgcaagcggccgcgctctgctccgagcaagccatgcctcgccctctagcactagcgtcggcgagtagagccatcgaaccccatcagcgcgacctctatggagaccactgccagggaaggacctcatcatcctcctcctcctctcttccttcctccccttcttctccctctctcgctaacctccccttctctctcttctatcctgcaggcgctatggatgcccaaggggagctccacccgcgacggcccgggcgtccttcaacgcgccaccgaccagatccggcttggttcccgctcacccaccccgtgccgcctcctctgcgcaccaccatacaccttcgccactccgccgggctgcgtttaccccacagccattgatggcctcctgcacctccagctcgacgcgtcgccttgatgcttggtcggatccataccggggagcttcg

SEQ ID NO: 1182 - DNA, 544 bp, Hordeum vulgare
tggatatgaagtattggacaatgaaaattacagcgagtaaaaaatgattttgccggattgcagcttagtgcaacaacccacgtgtggaatcggcccaagtggccatgtgctcgattgaaaaaaagccagacgcagaaaaaccattgatccctccttggattcgaccccaagaactcatggatcggatgtagttggttctactctgcgctactgcgtgtgcttgtgcaaaaatgagggcgctgcttatattaaactaacacaacggtcaagactttctcaccatgaattcgtgactaacatagccatgacggaaggcaacaacaacagttgctgttgacagagggctggcgagggcagttggggatggacagatccgaagctccccggtatggatccgaccaagcatcaaggcgacgcgtcgagctggaggtgcaggaggccatcaatggctgtggggtaaacgcagcccggcggagtggcgaaggtgtatggtggtgcgcagaggaggcggcacggggtgggtgagcgggaaccaagccggatc

SEQ ID NO: 1183 - DNA, 547 bp, Hordeum vulgare
gtcccccggctgcagcaattcgcacggggctgtatcaactttagtcagcgccatgcctgcccaaccatatatatttcggaactatcagtatccacccggcactctggaggtatcaccaggaatggcagaaagtccatctactggtgcagttggaacggttgtttctggtgcaccagttgggattaaacgtggagcttttatggggagctgcaagcatcacgtatgggaagccataagagcatcatctgcagctccatattatctggatgatttttctgatgatgtaaatcgctggcaagatggagctattgtagcaaacaatcccacgatctttgcaataagagaagcacaacttttgtggcctgatacgagaatagattgcctagtttcaattgggtgtggctcagttccaactaagagccggagaggtggatggcgttacttggacaccgggcaagttttaatagaaagtgcatgctcagtggagagagtggaagaaacgttggatacactgatacctatgcttcctgagatgcaatatttccgc

SEQ ID NO: 1184 - DNA, 559 bp, Hordeum vulgare
  UNSURE (15),(27),(35),(42): n stands for any base
ttccacacttccttncatttgcttttnctaatagncctccancagtacatgctctatttactacagttttacaacggcattcgccaaaaaattcaattggggaacattcacttacctccgcctgcacaatgaacacgagtataaactctataaccccttcctcgtaaaaagaattctataaccccatatgaatccacacgatccttatttttttcctagtattatcagtttcatatttttgtatgggttgtgaatatcactaactacgaaacattcggtagatggcagctgtacttcaacctaggatgtgcgcggagtgcttgttgaagagcagtgtccactgtgactccctcacggaacaacttgtcatacaagaggcacataaattgagccaagtactcctcctcatcaatatccttgttgccttcaccgtttctctcagcatcgctgtcttcccagtcacttatagggctaacaggttcgggttccgactcatcagcttcatcatccccaatgacaaacttcccattctcgaggcttccactgacatccataccat

SEQ ID NO: 1185 - DNA, 280 bp, Hordeum vulgare
ttaatcgcagatggtttcttgtgcgccagtagtggcttagcgcattagcggcggaggttggtacgatcaggtaggccggaggtgaggtgccacatgttgagtggacaaacggcggttagtggcagcagcagcagcagcagcatccgcggcgtcgagcagcagcaccatcgtcggccgatcgaggagggagaggaggaggagccagagttcagggacatccacgcgctgagcccaccgcgcgcgctgagcctgttccgccggagccggccgggcagcaggg

SEQ ID NO: 1186 - DNA, 361 bp, Hordeum vulgare
ttttttttttttttgaaacagtaatttactgcatatcttgttcatattgacacacacacacacacacaataccgtcgattggaaggagaaacagaaacaaaatacaggcagctctcgcacttggactcggcaggcagagcacacccttgcattcttatgctatgtaccccatgtcaaacacgagaaatgaagaagaaagaaagagggaagggaacgatgacacaccatacatgtggatacaacacgaaaacgagagttccacacagcagagcagcgagcacaggaggagtcctgcggagcgaagcggtgaaggatccggcgacggcgagtaagaggcgaaataatggcggcagggcatggc

SEQ ID NO: 1187 - DNA, 552 bp, Hordeum vulgare
gtacccccgggcctgcaggaaattcggcacgaggcaatcgtttaaattttagtgacttctatacatttatcctggagcgtggagaagaagttatatctgcagcaactgtcaggattcatggaactgatttagcagaaatgccattcataggcacgaggggcatgtatcggggccaagggatgtgccatcgactgctcaatgcaattgaatcggccctttgctctctcaatgttcgaagactagtaatacctgccatacccgaaatgcagaagacctggactacagtttttggttttaagcctgttggccctatgaagaagcaaaaaacgaagtcttttaatctcttgattatccatggtactggtcttctggagaagtgcttgctgccaacagctctagtgaatcgacaaaccacttctgggacagttaacgccgttgaatttgacaagacagcttctcaaacgtttggggaagcaagtggatcccttacacctgttcatgtttctcaagaatttgctgtgggtggttatcctgaaaccaaggatcatgtca

SEQ ID NO: 1188 - DNA, 532 bp, Hordeum vulgare
tgacagaatacgagccgatgctgcgagcgcctagcgattgcaccgtcgattgatctgtatttccatggtgattgtatagatgtgtacaagggtaaagcaaaggtctataccctgaaacatgcctcctattgaggaggtgagcataggattataggagatgacaagctcacagatattgtaatgtacacaacaacaaaatgactgacccagttggggtgtaactctgatacgactaggtgcctaataaagaaaaactaacaaagcttcgtcatttgatacagacaccaagacgccaccaaactcctgaatcatcaacaatccatggcagtgagagacaggcctggctacttgggtataaagctgttgccactcccctccattacaccagatgatgtatagtctagctcactttattttctgacaactaatgaacgcaacaactgattgctaaattgttaaaaatgaacatagtcaaacacttttaaggaacatattcatcctcagtaaaatttgcatacaagcgatgaaaaca

SEQ ID NO: 1189 - DNA, 534 bp, Hordeum vulgare
ggcaattcggcacgaggcgcaggtctccgggcggccatcgggctctcggagcacggcttcaacaccgcctgcatcaccaagctcttccccacgcggtcgcataccgtcgcagcgcagggaggcataaatgctgctctaggaaacatgagcgaagatgactggaggtggcatatgtatgatacagtcaagggaagtgactggcttggtgatcaagattctatccaatatatgtgcagagaagcaccaaaagctgttatagaacttgaaaattatggattgccattttcaagaactgaagatggaaagatataccaacgtgcctttggaggccagagtttagattttgggaaaggcggacaggcctaccgatgtgcatgtgctgctgacaggacaggacatgctatgctccacacgttatatggtcaagccatgaagcataacactcagttttttgtagaatattttgcactagaccttctcatggacaatgaaggtaactgccagggagtcattgccttaaacatggaggatggc

SEQ ID NO: 1190 - DNA, 548 bp, Hordeum vulgare
  UNSURE (53): n stands for any base
ggcctagtattttctttatttctatgaatacacaggagacaggatacacaggngaaaacaggatgaaattcagctgaaactctcagctagagaatacccaccacatgctttattaacaaccttaattaaatcaccgagctgagacgcatcaatcagtatacgcgtgctttcggtgggaacgactcgatttcatcatccaatgtgttcatatggactggcctgtatgccaaccgtaccttctcattctcccagtaccccagtgagtgcttcatccaatgctcatcgtctcttgtcgtgaaatcttcacgagcatgagctcctctgctttccttccgagcctctgctgaatacatagttatgcatgcatttatcaacaggttttccagctctatggtttctatcaagtctgagttccatatgaggcttcggtcactgatcttcacgtcatgataactttcccatgctttgctgatcagttgacaaccttcttcaagtgtttcttgtgtacggaaaactgcagcgttattttgcataatacgttgtgtgtt

SEQ ID NO: 1191 - DNA, 477 bp, Hordeum vulgare
caggtttggtaaagtatatctggcggaacttcctgatggagagattttagaagttttgaagatcgacattgataactcaagagtaccagttgatgtctttctagaactagttgtgaacatttcagaactaagtcatcctaatatacttgggcttgtgggatattgtgcggagtttgagcagcggctacttgtctacgagcattgtagtaagatgaccttacatgatgaactccattatgttgatgaacccagcaacgcattgtcatggaacgcccgtctccaagttgccgtggaagcagcaaaggcattacaatatcttcatgatggccgtcaaccaccgcttgtacatcaaaattttgaaccatctgttgttctccttaatagcactttggcagttcaaatttctgagtgtggacttgcatcgctgtctcaggtgtctggcagtttgcgtgccctattccattatgaagcccccga

SEQ ID NO: 1192 - DNA, 529 bp, Hordeum vulgare
acaagcatgaatcgaccagagacgcattgttggctagtctaagggcctatcaaggacaaacagcttctacaggaaaatgaaatgcagacctctgcacatcaccaaccgataaattcaccagttgaattcaaccaacctactactgcatcattgccgatcaaagacaactttgcaagtaagcaaatataactcgagccatgaatctggccagaagctctcctaatggcacgctcatcaggctcctaattgaattttctgtgacaggcttcgacattcttcctcatctcaggaaggcacttacatggaagcctttgccgcgtcgctgaccatacgagttagggcttggacaacttcggacattggtggcctgaattctggctcaggctgaatacagctgccaatgacatcagcaaaacgcgacaaagccttttcagaacattgtcctctaatcaaaggatctaccatctttgatatggcatcaatatcataaagctgagtagaggcccatcgcaccagatgttgctcagaa

SEQ ID NO: 1193 - DNA, 532 bp, Hordeum vulgare
gtctccgggctgcagaattcttacgagggaaggaagaatgccgagagatggattctcatgttggtagtggtaaagttatcacagcaccacttatcactgaggatggaagacctattaaagatcctttggttttacttgaggctacttcaaaccaaaacacctcagacggtgcttcaactagcagcaacaatggaattgaagtagacgattctgcagagcgtattactgacaagcaaattattgagtggaagcttacattacatcaaattggacttgacgtgctacgtactgaccgcaccatggtattttacgagaacaaggaaaatctttcaaagttatgggatattctagccgtgtatgcatggattgacaaagatgttggttactgtcaaggaatgagtgatttatgctcaccgatgattgtgctactcaatgatgaggcagatgcgttttggtgctttgagaaattgatgcgtagattgcgaggaaatttcagatgcacagatcaatcagtcggggttgctaaccaact

SEQ ID NO: 1194 - DNA, 548 bp, Hordeum vulgare
gtgtaaggcgtcaaattttcttggaacgagttctgtccttctgtggctacaatattctcgccggtgaacctcaacatgcatgacatttcaacttgaattgaaattattatttttgcaaggtacccacagcaccatgtctgcacaagcatatgaacttatgtgggatacagagaacgtgatatcattacatacagaggttgcatctatcctgtatccggggccatcttccgatgatgaccacccgtgaggaccttcactcgccgtttctgtgccaaatatggccgtgtatgtgtagattcaaatggtaaagaacacctcagtggaaggatatgttccgatgcatttttaggttttctttgcctgtacctttttgaggtatttcttgtgaagtttcagagctccagcacaggctttcttcgcatctaagttcccgtttacatcattcaatatcctaataagatcatccagtcctctagcttcttgtaacagtttttctctcttttccttgagcacacttgcaaccatgaaaactgaaatgggaactgggc

SEQ ID NO: 1195 - DNA, 496 bp, Hordeum vulgare
gcgatgggccgccccgtccacgctctctcgccggcgactggttttcgcttcatgtcccagggtggcacggggggcccagtggtttattctgatgatgatgaggccaaacaccgtgaggtcataaagcgcatgactgcagaatttgacaagaatataaaggagatacacgagaatctggatgctatggaagaagctgagaggcttcgcaatgaagactatgcaaaataccgcaagaagctcaataaaattgagacggcgtgcgacgttgctcttattgtgctggtgccaacaactgtcctgcttcttatgtctctgtagttttatttcttctagttcgataagcaaccttattatctactgggttaaggaaccctatcatggtttgtgtatgtagtatatgctaggcttgaatggttgcagtgacccaggttctgaggtaacaagtatctatgtgtctgagttggtttgacattattattaatcctaatggacgtat

SEQ ID NO: 1196 - DNA, 504 bp, Hordeum vulgare
  UNSURE (13): n stands for any base
gcataaatacgtnccattagggattaataataatgtcaaaccaactcagacacatagatacttgttacctcagaacctgggtcactgcaaccattcaagcctagcatatactacatacacaaaccatgatagggttccttaacccagtagataataaggttgcttatcgaactagaagaaataaaactacagagacataagaagcaggacagttgttggcaccagcacaataagagcaacgtcgcacgccgtctcaattttattgagcttcttgcggtattttgcatagtcttcattgcgaagcctctcagcttcttccatagcatccagattctcgtgtatctcctttatattcttgtcaaattctgcagtcatgcgctttatgacctcacggtgtttggcctcatcatcatcagaataaaccactgggccccccgtgccaccctgggacatgaagcgaaaaccagtcgccggcgagagagcgtggacggggcggcccatcgc

SEQ ID NO: 1197 - DNA, 496 bp, Hordeum vulgare
  UNSURE (486): n stands for any base
gtctgctgcgctatcagctagacatccggtctttcgacgaggtttcagacgatgaaggtttgtatgaagactctgattagcaatcagctaatcaaatgattgtgctggcccatggaaggacgccacagctcggttttgatgatctacttacgcaagaacactccaaaggcagctatccagaaattgaggggcatgggccagcctcaaactatgccgaaggatttcaagacgaggttattgagataccgtcatcatggaagtaccgtgtctgagacgataaccggactaaaagctcgttatgtttagttgtctcaacaatcgtgcttctattcagtcgttgtgtactgtcgtatgtctattatgatgtctctagggttctaattctagtgtctacttttaatattcaatgtggtgaaggaagtcgtataaatattgtgtaatatatagtagcagtagtatcttactcccgcagtttttgcaacgaanaaaaaaaaaa

SEQ ID NO: 1198 - DNA, 462 bp, Hordeum vulgare
tgcgggagtagatctctgctctattatacaaatattatacgacttccttcacacattgaatattaaaagtagacactagaattagaaccctagagacatcataatagacatacgacagtacacaacgactgaatagaagcacgattgttgagacaactaaacataacgagcttttagtccggttatcgtctcagacacggtacttccatgatgacggtatctcaataacctcgtcttgaaatccttcggcatagtttgaggctggcccatgcccctcaatttctggatagctgcctttggagtgttcttgcgtaagtagatcatcaaaaccgagctgtggcgtccttccatgggccagcacaatcatttgattagctgattgctaatcagagtcttcatacaaaccttcatcgtctgaaacctcgtcgaaagaccggatgtctagctgatagcgcagcagac

SEQ ID NO: 1199 - DNA, 532 bp, Hordeum vulgare
tcggcacgggctcgccaacgccgcgcctccattctcccactccttccattccacacagccacgctcgccgcctcgcaggagctcgcggctcgtagtcgcctcgtcatcccgctgctccccgccgtaggactgtgggctggcgaggcgtggcgtgcagtggagatccatcccagccgtgagattggcctctcttcttgctttctgggtgaggattttcggcatccatgtgcatcctcatctattagcttgaaaaagcatatctgtgaatactaagacacaagttgtcttgaaatttttggtctggctaaagccaattttatatccgccaacttttgcaatgaattatcttgaaatcaagaacggagaagaatatctgatggatcctattgaaatcaaggataatgaagggagtcctgtagagatgcttgttgagcagccacattttctagagcccatatgtccagatgaagtcaatgaagatacacgagtataccctcgtgtgggggatgaataccaggtggaagttccaaat

SEQ ID NO: 1200 - DNA, 555 bp, Hordeum vulgare
  UNSURE (10),(11): n stands for any base
gttatactanntggttcttatatgggcacaccattacgcaattttctagaaattcccataatacaggcaaaaagaaaggtaaagagtacaagtataactcagcagaaaaatctccacaaataaaaccaagtaaaagcttcatgagatggcttcctaacaacgagggcatgattcttgcactcgccgctttcttcctcttttcttcacttctggtatcaaaaggaatggcagcaaacatccatcacatgttagttcaggatcatatgtttttgacaagaatcaagcccaaacatccggaaatgcacagaactatagctgaaattcacaattatctgtataagctttctccattcgtttcccaacccaaaacagaaatttgacagattggcatctgtgatcttttgctttctgaccacaagatcatgaaattctcttaaccagcaacaaatccattctgtgaaggttgaataattcactgcaattgctgcgcatgtagctcattactcgttttcatgccatctacagaatgccagacaatctcacgagttcctttat

SEQ ID NO: 1201 - DNA, 518 bp, Hordeum vulgare
gggcggccgcgcgggccgctgtggcggagcaaaaagctgattgggaaggaggccctgtttgctatccaggggctgaagcggttcaagggagatgaggagaagctgcgggagttcatcaagaggcacgtggcgcggctgctcaaggcggacaagctcgccgtgctcggcgagctggagcgccaggaggaggtcgacctttctgtcaagatgttcaggatcatacaaaaggaggactggtataagccagatgtttacatgtacaaggacttgataatttctctagccaagtgtaagaagatggatgaggcaatggatatctggggaaacatgaaagaggagaacctgtttcccgactcacagacttatgctgaagtcataagagggttcttgagatatggttccccatcagatgcaatgaacatttacgaggacatgaaaagatcacctgatccaccagaggagttgcctttcagggtattattgaagggtcttttacctcatccactattaaggaacag

SEQ ID NO: 1202 - DNA, 552 bp, Hordeum vulgare
cgggaaaagatgcatttcatgttcataaaagttggtttctaaagcagttagggaaggaacagcatgaaaagtgagcagtgtactatttctaacaacctaatacacaagtggacccaacaactgaatgttactacccgctgcctcacaagatcctggattacggaacaagcggtggcagttgttgaagtgaataaattgcttcatatattaagagattgcccgaacaatgtactttgtgtaaccatagagatagtaagaatctttttgtttctccatgaagcattaccatccataacttctctgcatatcctctgacaaattctgaattcttgtgatgcaggtaatcaaataacccaagcaattggctgatctgattaaatcgtaagctcagcaggctcatgtggacataaacacttcaaccttagtgcattccaaatatatcatctggagggtcataaatatgcctctctgggaatagctcttcaaaatcttgcttcactctgttccttaatagtggatgaggtaaaagacccttcaataataccctgaaag

SEQ ID NO: 1203 - DNA, 10 bp, Hordeum vulgare
  UNSURE (1)..(10): n stands for any base
nnnnnnnnnn

SEQ ID NO: 1204 - DNA, 522 bp, Hordeum vulgare
  UNSURE (5): n stands for any base
cttanaaaagtgtacacataacacaaatgagataacaaagacaaacggccgggaggcatagatgaatctagcaatgtcgtcaacgaggacgggtcattattatatggacaagaacaaatataaccaatcacaacctataactgacctttttttactttacaaaagaacaaaatcgaggcctacacccccaccaacttgcgagtagaactcgcaccggcttcccatcaacattggccaatgtaagcaaaacaaagccacgcagctcttgaacgaactaagcatctcagctggcaggcaagttcaatctttcatgctttggtttgcagctgaagtaggcgtcagcaaatttgtcggagtggcaggccttgggtcaccactaaggacagaccactcgttacctgttacgaatgcggtggcaagatctgtaggaaccacggtgctggatttgacagcaaagaaatgcttaccaccacctggttctacattagttgcgaaatctttggttcctgaatcggttgattt

SEQ ID NO: 1205 - DNA, 550 bp, Hordeum vulgare
gaggaattcggcacgagggcgcaatggcggcgtgttccttcgcgctccgcctggggccgcgcttcgcggcgccaacggtggcgagtgcgacgaggggaggaggaggaggaggtggccgccctaccggcagccgagcgctggtgtcaaagaagccaaacaaggaccaccgtttgtggatcagaaaagattcggctgggtcagggaagaaggctctttgtcttgttaatactgtttcaaaactaccgaatgaaaaagaagctgtttatggtgcattggataggtggactgcttttgagcctgaatttcctattatagcagcagcaaaagctttggaaatgttgaaaaaacgaagaaaatggctacagattatccaggtaaccaagtggctgatgagtaaaggtcaggtgctgacatggacaacctacgatacactgctgttggctctttctatggatggaagagtagacgaggctgagtcaatttggaatactatcttacaaacttatacacgctcagtgcccaagaagttgttctctcggatgatccagat

SEQ ID NO: 1206 - DNA, 550 bp, Hordeum vulgare
cacatggtatcgaagtcggcggcaacctgtttgaaacatacaacttacacatgtttgggcaccaacatcattagcaatgccggttctcacccctgtactatgatactatccatttgtctagagagcattacaactccgacacttccttccatctgacaagctcgcataggacctcggaagaagatagcaatcgcatatgtccagacgaggtgatactcacattgttcgccccaagctattcagacgacgtttactaggccaaaggtcctgccctccgtacccgaacgcgttcgccattgaaatggatgtacttccacttcttcaagtatttttcaaggacaggcttctgcttatcttcctggcctgaagttgcaaacgctcgtccgatccttcttgttgtatcctcatctggacgcacgcccaattcctccatgtcagcatatatctccaaaactttgtccggaagatggcacgtgttgtaaatctggatcatccgagagaacaacttcttgggcactgagcgtgtataagtttgtaagatagtattcca

SEQ ID NO: 1207 - DNA, 518 bp, Hordeum vulgare
cacagcaccgcagctagcaactgaaaccgacgccagctcaagtgtatagggggcagagcagtagcccaaatcttccaatccatctacctagctagctctgtagctccatccttcagctagccaaatctcaggcatggacggaaagaagaagcctgctgctgcgactgggagctccatcgtcgacgacctcttcggccccaagaacggcgccgcctctccttcctccgccggctacttcagcaccgtcttcccaactccatccgcggccacggggaaagatgcgtcacgtcgggcagcagcgaccgctgggaataaatcatcgtcggcagggcatcagcagcaaggaaagcagcatggggggtcacctgagtcaccttacttcggctcttcctccgtccactatggcggccgggacttctacgccggcgccgaatctcagcggcaatatccgcccgccgctgccgcaccggcacccaagcacaaggacgacggcgacacatcggcagccacccggggtg

SEQ ID NO: 1208 - DNA, 542 bp, Hordeum vulgare
ccgcacgactatatattagtgtgagaaggcatattacaacagcatagtagtacacacatgagaggacccatgtcccagctaggtagacaaacacaagctctaacataacaacatatatagcttaattagtaataagctgatgatcgctggaccgaccatcttctccacccagtgaaataacgatgatgaagcatgctattatgaggtagctagctgtacattttatttatatctcatctcacatcagtctctctttcctgccagtgctagtagtagagggaaccttgccaccagtcaccccgggtggctgccgatgtgtcgccgtcgtccttgtgcttgggtgccggtgcggcagcggcgggcggatattgccgctgagattcggcgccggcgtagaagtcccggccgccatagtggacggaggaagagccgaagtaaggtgactcaggtgaccccccatgctgctttccttgctgctgatgccctgccgacgatgatttattcccagcggtcgctgctgcccgacgtgacgcatctttccc

SEQ ID NO: 1209 - DNA, 523 bp, Hordeum vulgare
acgaggggaaatatatcgcggacatgccccagtacctaagcgggaggcagggtggtagaattcttggattgcagtgcaactacaggtacgagcagtatcccttcttcaccgggccttctctgctgcagctcccggcaccatccgtgggggaagctccatctccagcgccggacaacgtgacgccaccaccagtcagaggaggaggcacaaggaatggaacttttagaattttagccattgcactaccgataatcgttgcaatactggctgctgttgtaatttgcttttgtctatggaggaggaagagcaaaccggcggcactaaaggcatcattatcatatccaaaaaatccagaggacatacagagtatcgattcactcattcttgatctatcaactctacgagccgcaacagataattttgatgaaagcaataaacttggtgaaggagggtttggtgtggtttataagggaatccttcctaacaatgaagaaatagcagttaaaagactctcacaaagttc

SEQ ID NO: 1210 - DNA, 549 bp, Hordeum vulgare
tatatgacgttatgctttgctagtaactttctagccccaaaggtccagtagttatactacatatgaagtagggtctttccctgcatcaatataggttattttggcaagaatggtgtacataatgaatacacatcaagctcggacttatctcggctcaagctcagtaatcgaaacttcgtttggtgacataggtgatctgctggtagaatgcgaaactcctggatatggatctgtgtgcatgcctgagtagttcatgccactcttttggatgcaaaatgctggcctagatggagcttggagagacacagtgctgctgcttagcatgacagtcacaactgacatcatcggtctatccgcggggtcttcttgaacacacagaagtccgatgtgcacgcacttcagcatctggtctccaggagaatggctagtcatagatgaatccatgatccctacaattgttcccatcgtccagtgctcccagaccaaacttaagaggtctacagcttgctcggagtcatatgcgacactgtttctttttccagtgacgat

SEQ ID NO: 1211 - DNA, 553 bp, Hordeum vulgare
gtcccccgggctgaggaattcggcagagggatcatcggcacccggttcgaggacgccgacgtcaagtccaccccgttccagccctacgcggaggtgttcggcctccagaggttccgcgagtgcgagctcatccacggccgctgggccatgctcgccaccctcggcgccctcaccgtcgagtggctcactggcgtcacctggcaggacgccggcaaggtggagctggtggacgggtcgtcgtacctgggtcagccgctgccgttcacgatcaccacgctcatctggatcgaggtgctggtgatcgggtacatcgagttccagcgcaacgcggagctggacccggagaggaggctctaccccggaggctcctacttcgacccgctgggactcgcggcggacccggagaagaaggagactctgcagctggcggagatcaagcacgcccgcctcgccatggtcgccttcctcggcttcgccgtgcaggccgccgccaccggcaagggtccgctcaacaactgggccacccacctcagcgacccgctgcacaccacca

SEQ ID NO: 1212 - DNA, 569 bp, Hordeum vulgare
  UNSURE (13),(36),(44),(45): n stands for any base
ttggaggtacaantttgggttactatttttacaaantacccaanngtcccagcagctctcctatgtgatcggaccagcattataatcaacaaaggatctttgcgataccctctcatccatcactcgtcatacaaaaccaaagcacgttcgttacacggacgcgcgttcgtccattttgcagctgagctgacagaaactgctcgaccaccgaccacttaagaggagccgaaggtgtcgaagatggtggtgtgcagcgggtcgctgaggtgggtggcccagttgttgagcggacccttgccggtggcggcggcctgcacggcgaagccgaggaaggcgaccatggcgaggcgggcgtgcttgatctccgccagctgcagagtctccttcttctccgggtccgccgcgagtcccagcgggtcgaagtaggagcctccggggtagagcctcctctccgggtccagctccgcgttgcgctggaactcgatgtacccgatcaccagcacctcgatccagatgagcgtggtgatcgtgaacggcagcggctgacccaggtacgacgacccgtccac

SEQ ID NO: 1213 - DNA, 520 bp, Hordeum vulgare
gagagagtgctccaggagatggtggacaagggattggatgttgatgtggtcacgtatacagtactcattgatgggtactgcaaaagagggaacatggtggaagccttccgagttcacaatgaaatggtggggagaagagtggcaccaaatgtggtgacatacacggctctgtctgatggactgtgcaagcagggggatgtgcgtgctgctaatgagctattgcatgagatgtgcaacaaggggttagagctgaatgtttacacatacaattccctgatcaatggcctgtgcaagtttggcaatctggagcaggccatgaggatcatgacagagatggaagcagcgggacatagaacagatgtttatacatatacaactcttatagatacgctctgcaagtcaggagagtttgacagggctcacaacatgttacaggaaatgttagataaaggaattaagcctagtattgcgacctacaatgttctaatgaatggtttttgcatgtcaggtagggtagaag

SEQ ID NO: 1214 - DNA, 558 bp, Hordeum vulgare
tctgtaagtatataagtataaatatgactttatacaaaacaaattgattcttacaatgcacatatcactatatcttgcccaattaccattgtggcagcacaaggttgaatctagttttgtcctaatgctatcagctaaacaaacatgatttcaagcatctcaaagaaccttctcctcccatattttgttatctcaccaatgtgacaacgatggacaccaaagtcagtgcccagttaagcagggctggatcctatcatcaacactggtgaaggaatcagagtgtgaagacaaagaattacatctgccttctgattttatgggaagaacaaaaggctcaaatgagttcttaatgttatcttcccaagagttatccatgaatgcccacagaggttaatccttccttttcgccttataacggatgcaatcgtgtaagatacttattgtcttggcttctcctatctctttccagaagtttggtccatttttccatgtgtacacattaacatcatggcagcatcagcagaaattgcttaccgattgactgaagcacaatcccct

SEQ ID NO: 1215 - DNA, 503 bp, Hordeum vulgare
cgggttcggcagaccccagcagccaggcacggcatcctccactctatctactgcaattaactaaacacgggtctgtgattgtgagggccagtaagcaccatgtgccgctcttcgtcctctcttagttttggctcgtgccattgctccaaaactactcccttggtcgtcttataatatagcgcacaatatttttttccattcgtcctctcttagttttggctcgtgtcattgctccaaaactactcccttgatcgtcttataatatagcgcacgttatttttttttctcttcgtcctctcttagttttggctcgtgtcattgctccaaaactactcccttggtcgtcttataatgtacggcacattattttttcttgtaaaagtcagttatgtttatggctacatgtggtccgatcaataatcttctgtgacaccaacagtgtctaattttgtttttcagagaatctttgtccaagtgatgtctcgtcgaagataaaagaatag

SEQ ID NO: 1216 - DNA, 549 bp, Hordeum vulgare
gtttgcctagttaattatgaagaaacgaacgaaaatattacaatctgtgagcggcacatataaataacccacacacaccactcccaagagggcgtgaggagacaacatgcatgtgtcatcatcatcactcttttctacgccatccctaaattttgaacagatgactccgacttcatttcacgcgatcgtcagctgaatccacaccatagcggacgtttgtaattgcactagtatctgcgctattcttttatcttcgacgagacatcacttggacaaagattctctgaaaaacaaaattagacactgttggtgtcacagaagattattgatcggaccacatgtagccataaacataactgacttttacaagaaaaaataatgtgccgtacattataagacgaccaagggagtagttttggagcaatgacacgagccaaaactaagagaggacgaagagaaaaaaaaataacgtgcgctatattataagacgatcaagggagtagttttggagcaatgacacgagccaaaactaagagaggacgaatggaa

SEQ ID NO: 1217 - DNA, 529 bp, Hordeum vulgare
aggacagcattgagcagtcccttaagccaactataagctatttgattgaggaagtaggtattgaggagagcgatgtggggaaagtcgtgcagttaagcccccagattctggtgcagcgaattgataatgcgtggaaatctcgatttctttttctctcaaaagaactaggggctcccaaagatagcattgtcaagatggtcacaaagcacccacagctgcttcattacagcattgaggagggcatcttgcctcgaatcaatttccttagaagcattggcatgagaaactctgatattctcaaaatattgacaagtcttactcaggtgctatctttgtcgctggagaaaaatctcaaaccaaagtatctttatttggtcaatgaccttaagaatgaggctcaatccttaacaaagtaccccatgtacttgagcttgtcccttgagcagaggattcgtccccgtcaccgttttcttgtttcactgaagaaggctccaaagggtccatttcctcttagctcctttgtgcttac

SEQ ID NO: 1218 - DNA, 549 bp, Hordeum vulgare
gcaactgctgggtatagtttctgaagtgtgattccatcataaccctgtgagagatagggaggacgtagacacagtactacccctagtactagtacgataaatcattacaaccctgatgaagaagttactgttactatagcctatatgtctgacacaaaaaagttacccaccacagcactaagatggtcaagctgcagtcttgctagacttaatatcttgctcgaaagttgcggttaacagtaagtagaagtcaaggcagctactctttaagcagttaacagaatgttcgatcagacattccggtggatgccgttgtgtcagatgaaccatccatttgtagttgatgatccggagctatcagaaagactctacaagatgcttcacaacgaggcaacagttgaacagcaaagcaacctaggccatttcagtgaggagggacaggctcaaagtctaaatcgtaatccctcaattcaagattagttatctactgccttggtgctaataatttccttcagacttctcagcataacctgtgaacagacactctgt

SEQ ID NO: 1219 - DNA, 540 bp, Hordeum vulgare
  UNSURE (11): n stands for any base
ggcctgcaggnaattcggcacgaggcaattcttcacgcaaacgagaaaggtcaatcgcaaatacacacaacctgccaggcaaagaagacagctttctccagggtttttggaagatgcattagatgaggatgaggagaccgacaaccagtacagctctcggcgaatggcatctcgtggtcgttttgaggatgacttggaggctgaagcactagctgaaaggcgtataattaatgcgaagaagtcgaatatgagcagaggtgttcctcgtaaaccatccttccctccttctcgcccagcgagacgccaggagtactctgagagcgaaagggaggagtcagagtatgaaactgaaggcgaggacattgagcactctccaactggtggaaggggagatgagctggatgaggaggatgaatatgaggaagacccggaagaggatgcgcgtatgtcagatgaaggaatccaggaaccaaagcggaagagagagtcagcagcaggcgggagccaaaggcgcagggaggtggactcgggcgaggattc

SEQ ID NO: 1220 - DNA, 542 bp, Hordeum vulgare
cagacaattctgttaccagacgattctgtgggcagtttcccagaatataattctgaagaattatgaggtgaaaagaactggccctcacacatggcctatccaatagtattcaacagcactcttttggcagcagagacaaatgtaggtttgtgagcttctattttctctcccttcactcgtcttcatcgtcgctttcaaaaacgacggccttccggcgatgaaccatcgcaggttgtttcctcggcggggaatcctcgcccgagtccacctccctgcgcctttggctcccgcctgctgctgactctctcttccgctttggttcctggattccttcatctgacatacgcgcatcctcttccgggtcttcctcatattcatcctcctcatccagctcatctccccttccaccagttggagagtgctcaatgtcctcgccttcagtttcatactctgactcctccctttcgctctcagagtactcctggcgtctcgctgggcgagaaggagggaaggatggtttacgaggaacacctctgctcata

SEQ ID NO: 1221 - DNA, 493 bp, Hordeum vulgare
ccagaaatgcagaggaggcacttgcgaaagctcaggaaaaatatggaaaatcagttgaaatatatcaggatcctgatgttctcgatacttggttctcaagtgctttatggcctttcagcacacttggttggccagatgtgtccagggaggattttaagcatttttatcctgcaacagtccttgaaaccggccatgacattttatttttctgggttgcacggatggttatgatgggaattgagtttacaggatccgtaccattttcttatgtctatctacatggtcttatccgggattctgaggggaggaaaatgtcaaagtcactggggaatgtcattgaccccctagataccatgaacgagtacgggacagatgcattgagatttacactttgcatgggcacggccggccaggacattaatctttctacagaaaggttgacatcaaataaggctttcaccaacaaactctggaatgcaggcaaattcttgtt

SEQ ID NO: 1222 - DNA, 547 bp, Hordeum vulgare
ctgccgaaaaacttgggtctgtaattttttatgagtagttgtcatgtaaaattctaaactctattctcctcttattaaatggatgaggcaaatcttatgcctccgtttcgaaaaaatattatgtactgatctgctgtgctactctgaggtaaccatttgtctctcaagatttgctttactgacaatcaaaattggcattccgataaacgttggctactatgtttatgtggaaaccgttgactgcagaaaagcaagccggttcttggtgagggagatcttctcctctgcctcggatgccttctcacgaactccatgaacaatgttttccggggccttctctacaaagctcggggaactgaggcgggccaacagagtatcatattctgtctgtaacttagagagccgcttagagagccgctcaacttccgctgacacatcaaccatgtcggccaaaggtaggtatgcctccaaaccctcatcagcaacaatgtggacacactgatttgcatcacccggtagtgattcagtcaaatttatgttctgtgcg

SEQ ID NO: 1223 - DNA, 539 bp, Hordeum vulgare
ctgcaggaatgcgggcgaggaggtggagatcctgaagcctacgggctcaagttcgccagggccgcgacggcggcacctacatcgaggccatcttccccggctcctccgccgagcagaccggcaagttcaccgtcggtgacaaggttatcgccaccagtgccgtctttggagaggaaatctggccggcggcagggtacggccagaccatgtactgcatccgtcagagagttggccctctctacatgaagatgcagaagaaatttgggaaatgggatggtgttgctgagctctcggacaaggaggtcatcagggctgaaaggaacacgggaaacgtcagcactaaactcagagagattcagatgcaaaattaccagaagaagatggagcagaagatccaaagagaagatgaccttcgcatggggctaaagctgtacaaggatggaaaatacgaggaggcattagagaagttcgagtcggtgctggggtcaaaaccagagattgatgaagcttccgtagccagctacaatgtcgcgtgctgt

SEQ ID NO: 1224 - DNA, 540 bp, Hordeum vulgare
agtatattacaacttacaagcacgatggtaacatatttcctgtacatggcatttgcttcccaaggaggattgccatttggatgtacaaagtgtatgttcatagaatggttgaagtacaaaggaaggctaaaaacattcctggagatatctccgaagtctcagcaagaacaaactagaactagtgtttcgaactagtggcagagggagggagggagggagagagggggctgcactgtatggtcaagtgtgcaaactgcaagaccaagttagatgtgtgcaatcgatagtaggtcatcacttcttaccgaatccaaatatggatttgatagcattgatggcgttctcattgataaacgattcatcgtacttgtttagcagggtggcgaactcctccgagttcctcaagtttgctaaatccgggtcggtgcgaatcctcttgaagtcttcatagcctgctttcatggcttcttcaagtgcagaaaggccagcttgtatccggtcgagcttcgaataacagcacgcgacattgtagctggctac

SEQ ID NO: 1225 - DNA, 518 bp, Hordeum vulgare
ataatgatgccaatgcaacatgtcaaagaacactagtgctcagtacacactgctacatgtaactgctgactgttgagctaatccttccttaattggttcgaagggtagatcccaaactataagttgcttctatgctcctaggatatcctgattcttgagaaaactgtatattgacggtttgttctatgtgagttgtgagtgtagcctcgaccttctatgtgctagcagctgatggttgcaccttggcaatattctggtgcaaaccatgagccattgaatatggagcagtacgaagtgatctgcaacatctctaatgagttaaggacatacacacctgatgtccaagtggttctgaactggctccttctacgtttgaggcttttgcgaaagttccaaatgttctacgtccgcatacacaaatcttttgcactagtgaatgggttcttggcacaagagaggacttagtgaaggatattattgccgaactacgacctgaccttggtgaagagtggtggaca

SEQ ID NO: 1226 - DNA, 547 bp, Hordeum vulgare
agctcggtgccacgctacatattgtactgctcccaagaatccatataattgtcgttgatttagtacaagtatctacaactactattagcattgacgagtttgatcaaaagtgctgtatttcatcagttggctaatacagtgtataacaagccatgtacaacaacagatgtgctgcaatggaagaaaagaacgacaatgacaggtacccatggctgccctaagaactgcaggtgcggtatacctcaccgcgcatcacgtcgactggcccatgatcatgtgcatagcgatccgggccaagatacgcgccggtcttctccaggagggccaaggcctcctccctgccgtactttgaggagtaaaggttcaagtattcaatgtcctgcatgccactgagaatgcgttcaagcctgagggatgcaactggttccttcgacgaagaaaacacctcaccagggtaaaacagaaccccgtcgcctggaggaaggccgcgtcggaaacagatctctgcacttggaatcatagccttctcgtagcagttggtacccca

SEQ ID NO: 1227 - DNA, 519 bp, Hordeum vulgare
ggatggcgtgcctctccagtctgaagcaggcgtcggcctctctcgccgtggccgcaagacggtgcgcggccgcgcctctcgtggctgcgtcgctcctcctcgccgccgcggctgcgtctcctgtcatgcctgccggcaccccacaagcgtttgcacaatcccaaggcgcggcgctgttccgtaaggcgtgcatcgggtgccacgacacgggagggaacatcctacagccaggtgccacgctctccatgaaggatcttgagagaaatggagttgccacggaggaagatatatacaacatcacttattacgggaagggaaggatgccgggttatggggagaaatgcacgccgagagggcagtgcaccttcggccccaggctgcctgaagaggatatcaagatgcttgcagcatttgtcaaatctcaagcagagaacgggtggccaaaggtcgacggtgatgtcgagtgattcgattacggttgagcacgaggtgttacctccatttcgtgaggaggctgaa

SEQ ID NO: 1228 - DNA, 549 bp, Hordeum vulgare
gtttggaataatttcggctgtgagattaaaattgcatcaacgactctgaacctgtctgacgattggcttctatcagacgtatggtagctagtgtttcccttaagtaaattgatagcgttacaagcatgggccaaacaaaacagcacatggatcgttacaccatcgatcccaacgccacgtgatacctttaccgtttgcgttaccgtccagtaaaccaaacacctctattaacctcatcaacaattatgttttcagcctcctcacgaaatggaggtaacacctcgtgctcaaccgtaatcgaatcactcgacatcaccgtcgacctttggccacccgttctctgcttgagatttgacaaatgctgcaagcatcttgatatcctcttcaggcagcctggggccgaaggtgcactgccctctcggcgtgcatttctccccataacccggcatccttcccttcccgtaataagtgatgttgtatatatcttcctccgtggcaactccatttctctcaagatccttcatggagagcgtggcacctggctgtagg

SEQ ID NO: 1229 - DNA, 500 bp, Hordeum vulgare
tcgaatcggccattaatcgttggctctgctgagctctgcttcccacctctctcgcctcgccgccagctcgcgctcaccagatccagtgcgccgccatcgtctaatcgaaactccaccagccaacgacaacagttccacctcaccagccagcttcatccgactcgcacctccaactcaatccccctcgcatcggtggaccgcaccacccaccttcgtccttcgctcctccccgcagagcagcacggctacgccccagtccactccaccaatgctgtccccgtgcgattctgtggtgttttctcagtcgctaggctcccccatctattgaattagatgcatccccatcgattgattcggccggctggagaacattatttctgaaggaaggcatctccaaagcaaaaggtatgcacacttcatggactgccccacatttggagatttgcaattttagcaacggattgtgtgtgtgtgtgtgtgtgtcttttcgccaaaaaaaa

SEQ ID NO: 1230 - DNA, 546 bp, Hordeum vulgare
  UNSURE (8): n stands for any base
aacactgnaacataaaaacaccatgaattacacaacaacaatccttttttttggcgaaaagacacacacacacacacacacaatccgttgctaaaattgcaaatctccaaatgtggggcagtccatgaagtgtgcataccttttgctttggagatgccttccttcagaaataatgttctccagccggccgaatcaatcgatggggatgcatctaattcaatagatgggggagcctagcgactgagaaaacaccacagaatcgcacggggacagcattggtggagtggactggggcgtagccgtgctgctctgcggggaggagcgaaggacgaaggtgggtggtgcggtccaccgatgcgagggggattgagttggaggtgcgagtcggatgaagctggctggtgaggtggaactgttgtcgttggctggtggagtttcgattagacgatggcggcgcactggatctggtgagcgcgagctggcggcgaggcgagagaggtgggaagcagagctcagcagagccaacgattaatggccgattcgatg

SEQ ID NO: 1231 - DNA, 541 bp, Hordeum vulgare
  UNSURE (4): n stands for any base
gggnctgcaggaaattcggtacgaggaagagaagcacgccggagctccatctcctcggccgtcaaaatggtgaacgttccgaagaccaagaagacctactgcaaaaacaaggagtgcaagaagcacacacttcacaaggtcactcagtacaaaaagggtaaggacagtctgtctgcccagggaaaacgtcgttatgacaggaagcagtcgggatatggtggtcagaccaagcctgtcttccacaagaaggcaaaaaccaccaagaagattgtgctgaagctgcagtgccagagctgcaagcactactcccagcgtgccatcaagagatgcaagcattttgagatcggtggagacaagaagggcaaggggacatctcttttctaaactgcgctcacctatctggagtggtggtggtcaagaactagtactacttgtgttaagggtttgttgttaggagctaaattaatcagaccttgtcatgtatccaaactcctgtgtctggcatttaagtaaggggcgactttttggccaagaaagtttt

SEQ ID NO: 1232 - DNA, 555 bp, Hordeum vulgare
gccaaaaggatcgcaaagctcaaattaccatgtcactcaactgcatggtgtcaaaataagacatgatacggaatgaaagaggattcaaactacaaaactttcttggccaaaaagtcgccccttacttaaatgccagacacaggagtttggatacatgacaaggtctgattaatttagctcctaacaacaaacccttaacacaagtagtactagttcttgaccaccaccactccagataggtgagcgcagtttagaaaagagatgtccccttgcccttcttgtctccaccgatctcaaaatgcttgcatctcttgatggcacgctgggagtagtgcttgcagctctggcactgcagcttcagcacaatcttcttggtggtttttgccttcttgtggaagacaggcttggtctgaccaccatatcccgactgcttcctgtcataacgacgttttccctgggcagacagactgtccttaccctttttgtactgagtgaccttgtgaagtgtgtgcttcttgcactccttgtttttgcagtaggtcttcttggtcttcg

SEQ ID NO: 1233 - DNA, 540 bp, Hordeum vulgare
  UNSURE (12): n stands for any base
ggggctgcaggnaattcggcacgagggcagcacctcatccaccgactccggagaagtcctcccacgaacccatgaatgaatttcccctcctaatatagcccgcgagccaccgaaggcagaagatcatccccgctgtcgccaccatcactggagactgcgtcaccaatgaccctgtccacctctccatccatgacaaccactggatggattgccaagacctcctgagcctatttccgcgccctgcaacccgtgtggagctgccattcgcccgcgaggagcaccagagatccgccacgctcggccgcacccaatcctattaagtagaaatatacttcgcagagtagggtgtggttcagtaagtcgtcaacccctttcatggcacacacatgatacagagaggccacaggtgaagatatcggaggcatctgttcggaatgccacttggtcgggggcatgggtgttccggttggaccgaggaggtagcgcccatgtgtgtgcgtgttataaatatgttgatcccatgccaatcgagattgtggt

SEQ ID NO: 1234 - DNA, 548 bp, Hordeum vulgare
aaggttacttcatagcaaaacgtataataattatgataatccatcacgattcatgattctcatcatgtttcagttaattcctacaaaaactgacacttgacctatcccacactgtagtccttcaccgctgacaaggctttcaaataaatattataatgtgcagagggtgtcctctttaccgacaaataacaaatttctttagtcaacgagagatgccaactaattcctattgtggtctttgagttggaaacgcacctggcccacacacactagtttaacttcccaatgcctggaatcacgcacgacactcgttaagaaaaactctaagttgggagaccacaatctcgattggcatgggatcaacatatttataacacgcacacacatgggcgctacctcctcggtccaaccggaacacccatgcccccgaccaagtggcattccgaacagatgcctccgatatcttcacctgtggcctctctgtatcatgtgtgtgccatgaaaggggttgacgacttactgaaccacaccctactctgcgaagtata

SEQ ID NO: 1235 - DNA, 553 bp, Hordeum vulgare
  UNSURE (20): n stands for any base
gtccccccgggtctgcaggnaattcggcacgaggcttggatgttgatcaagtggagaatctcataaagttttgtcccacgaaagaggaaatggaacttctcaagaactacaccggagacaagcaacatcttgggaaatgtgaactgttcttcctagaactgatgaaagtcccacgaatggagtcaaaattgagagtgttctccttcaagatccagtttggttcacaggttgcagatcttggaaaaagtttgaaaaccatagattcctcatgcaatgagatccgaagttctctcaagttgaaggaaataatgaagaaaatactactacttggaaatacgttgaaccagggaactgctagaggtgctgcagttggcttccggttggatagtctgctaaaacttacagatacccgggcaacaaacaataagatgacattaatgcactacctctgtaaggtgcttgctgcgaaatcaccacagcttttgaacttctatgtggatcttgttagtttagaagctacatcaaagatacaactgaaaatgttagcggaaga

SEQ ID NO: 1236 - DNA, 557 bp, Hordeum vulgare
tcaaaactatgatacacttagctcaaaaaatacgattaactgcactacgagtgcgattacatctcatatttactaccatgccagacacacattctttgctcctaccctttccctactcctatttgtacaattcgcaccttcgtgccttggttgcactctcctaaagctacggctgtacttggcccccggtgttagaaagaacaggtaacatagcacaggtaagaaaaaagaatgaagttagcttcacagttggctctttacatcagccagatgttggcactgaacacctactggccgaaggggggaaaaaatagtcgaccattgccagtgagaccgtggtgggagtacagttggtactgtacaattgcttaaatgtgttctacttcccctggtcactgcatccattcacacgccttctccttttctttgccttcaaagacgcggtgcgaatccatggtccttcgcatgcacccggcagggcatgcatttgccccgcaggcagatcaaaatcacaacactggagttggtcccacagatcatccaccatcttttcctcg

SEQ ID NO: 1237 - DNA, 521 bp, Hordeum vulgare
  UNSURE (6): n stands for any base
gaaaancacacaagccttctatttattcattacagctatgttgcagctttttgatcggtctgggatgctttacggtgagcttgcgagatttgtcttgcgcctgctaggagtgcgaacaaagtcaaagaaaggccgtgttcagggcactgaggcccctgcattagagggacctggccagcagctttttgagacaccaaaagccaacaacaactcatgggacaatgtttggggaaactaagacgccttgcccttatatgtgctgttgaactaatagaaacatacggttagcaaaggaaagattgccaaagcatgtatgtcagcaaccatcaatcagaaagcgaagaagagtacccagtcggagaaattgtctgttgcagttagcgaaagaacacaagggctgctctttctgattttcatggcttaatctgctgtgagcctaatgatggccagtttgctttgctggaggatgcagtgttattgaagtatttttgttgtttgtatgtatgtggagggtaaataat

SEQ ID NO: 1238 - DNA, 554 bp, Hordeum vulgare
agataataatcctcacttttcttggcaagaatcaatgcataatacatctgcttcagttagctggagaaaacatttttgttcaagtctctacttctgtgacacacttactgcgaagattaaatgtttgcacttcattatatcttcaaggccaccttcagttgaaaatcaaactaacaaatagggaacacaatacattttgctccgttcttttcaagataacaggtactattatttaccctccacatacatacaaacaacaaaaatacttcaataacactgcatcctccagcaaagcaaactggccatcattaggctcacagcagattaagccatgaaaatcagaaagagcagcccttgtgttctttcgctaactgcaacagacaatttctccgactgggtactcttcttcgctttctgattgatggttgctgacatacatgctttggcaatctttcctttgctaaccgtatgtttctattagttcaacagcacatataagggcaaggcgtcttagtttccccaaacattgtcccatgagttgttgttggcttttg

SEQ ID NO: 1239 - DNA, 520 bp, Hordeum vulgare
ggggatctcatggtcgtcatggtcagtcggccaaaaggcatatttaaggagtgtggaaagagaatacattcaggactacagctcatccatgaggaactctccaagcttgggatcgtggatggtgtgacagagggagatttggaacactcaacgatgtggacggccgggttgtacttgatgcttttacttcagtttctcgaaaacaatgttgctgtggaactcacgagatcagaatttgttgaagcccaagaggctttagcacaaatgaaaaactggtttactcgtttcccaacgattctccaaggttgtgagagcacaattgaaatgctaagggggcagtacgcacattctgttggctgctttgacgaggctgctttccacttccttgaagcattgaagctgacagagaacaaatcaatgcaatctatgtgccaagtttatgcggcagtctcctacatttgtaagggtgacgcggaatcatcttcagaggcgctagaattgattggtcctgcttacagaa

SEQ ID NO: 1240 - DNA, 551 bp, Hordeum vulgare
tgaaccgttcccttgcagttaataattgtttacagatgaggctacaacggtgtacaattgactaatgataataaacttaattaaaacaacaactgaggggcctatataggataacatgtccagcatgctctctctctatatatatatatggggagcatggcgattcactccgatggacagccagcttgactcacgaaacccgcctccttgtgctgcgccttaccgagcttgaatcgaccagccttttcacggacgatggctggggagtggacagccccactgattctgggatgtcaaggtcatcatttaccggcaggcctgacatatcgttatgcttctggaacaagtcgtgcagcggctcggcttcgatcctcactttctccaccagctcctggtgacaagcacgggaacgagcttcagccagtcttctctgcagttcgatttctttcttacttacatattcggaattctccatttcattttccttctcttccagttctcgatataactctgtaaataccgacaagatccagatttgtgttgggatgtca

SEQ ID NO: 1241 - DNA, 1146 bp, Hordeum vulgare
  UNSURE (1),(2),(12),(32): n stands for any base
nnttttgcatgnctcatggatcccaaatgggnagcccacaatggcgtgacgcggaacgaacgaaacaacgcttggttcacggtcttggtgggccggcgccgagctaaaagcccccgggcccgtgcggagaaccatggtcatccgcccctacggctacgcgagggggcaggccacacagaattatttgcctgtacagttcaaagagactgcacatcatgatcttgctaccctccccaggttttacttatttcgctcatagagctcgggggggggcatgtcctttttttttttttgtacccatcagcatcccctatacgcactcgtagcgggggggttagtccaccacccctctttccactccctctcgttcttcgtacttcttcccattttctcgtttcgttttttatttccacattaaattttttccgctcgctcaccccctccattttttcgtccttttcttcatttctcgtccttactatctataagaccagctcctccgtcccgccaatgatcacccattacatacgccaacttatcctccaatatatcccacattcatcccattcccgcttcgtttttcaccttctctccctttcactttgcctgtttttccttgtccctatttccctccccgtccctcatcatctccctttcatcgtagcatcgttccctttttctcccctgtgttgttcctcccgcgcctgctctaccctttttttcccatcgcaatgtcgacgggcgttagactatgcggtcccggttctccgccttaggccccgcggtttaccccccccatttatttctttcgttttctcaccatttcctccccttttttcactttccctttctctcccccgcatttcttcgtcttcctctttttcgcatatttcactcccgtcacctgccgtctcgccaattcttaatgtatctacgctgttcgctgccccttttttttccttgtttttccttcgcctttccgcttgccattaccatctttttttcacctccccgcttctctagcatccctctcattttgatccgcccgtccagggttaccccttgtccgaatatatactattgcttacccccgcccgttatttttttcttctcatcttttttccgcccgcttctcttcgcttttat

SEQ ID NO: 1242 - DNA, 545 bp, Hordeum vulgare
aaggtactttgttatacattgacactgatgttttgctgaagtgagattacatagcatgacagaattaaaatcttgctgattgtggtattacacggtaaaaaaactttaaattctttcatgggtcagtaaagaccacagagaaactgtgtcgaagagaaaagaatctgtagtaaaaatattctgatttctggttgcacaaacatggcctaatatgacttcgcaaaaatagcaacttcatcagttggattgccggtcatgaaacatttcttcgcaccccccggttgatcaaagggaaagcacctgatggtggcactggtctcttctttcactttcagctcatccgcatcgctatctgaccatggaccttttgcccatttgccctcagcaatgacctccttcagttctccatatgagttgacatcaactatattactatcaccaaatgtgatggccttctgtagaagagatgcctgaatttcctctacacggccttttatatgatccaccaatattgatgtttccatagatattccaaactcctttcc

SEQ ID NO: 1243 - DNA, 517 bp, Hordeum vulgare
gttttctcttctgatcctttgcagggagccagctcgaggccaacaagaaggccatgaacatccaggtgcgccgattaatcccgcctatccaatcaatcgaatcgatctaaccttctctagcgattgggaattatttttccgccgacgagactgttatctgtggaatttgttgaaattacgcctttaacggggacgggatgcgtgccccttcagttcgaacgacgattggtagcttatttcttgataggactctggtcagatggtatttttggcggcgattatcggtatgatttggagttgtacttatttgttaactgcgcctagagaaacgaagggaatcgtgtacttttgactgccctgccaggactatggttagcgtatcgacatactagtatgctggattgcaaattagttgtacaaaattccttcttcgggcatagatctggagtattcacatcgcatatcgtgcgtattaagagacacatgtggtttctatgagatatagcctgacagcttt

SEQ ID NO: 1244 - DNA, 552 bp, Hordeum vulgare
cgactaacgaaaccaatccaagaggattaagatattgtagcacaacaggctgatagtggacgattacatagtaatgggcacacaaccaaagcagctgggacagcagcacaccagagttcagacccaagcttaggtcaacaaccagtcattgcggaacattataatactaggtggattaagacagcttctctctcttttatctctccctctccgtctgatttggcagatatcactgcttgaggtgggggaagcactggacaaggtcgctcttcggatgcttcgcctcggcgtgctccttgcactttgcttcagaggtggtgcagatgaaagtctgcatgcatatcttgcactgcattgagaagcattggtcagatgaccggccaattaccaaataatgtttcttggcagcaatgctgaagattacacgatctctatggacttataacatagagtattcactagactgatatgatgtgcaaggcaaggccactgaactgtttcagctatccaatatggtgcacatcaatctctatggacttataacatagagta

SEQ ID NO: 1245 - DNA, 517 bp, Hordeum vulgare
  UNSURE (18): n stands for any base
ccgcctccacccccccanctctgccgaacccgtgcgagctcgctatgcaagcccgtcaagggcctgggcttcggccgggagcgcatcccgaggaacatcacatgcatggccggcagcatctccgcggaccgcgtcccggacatgagcaagagggagctgatgaacctcctgctgctgggcgccatctcgctccccaccttcggcatgctcgtcccctacggctccttcctcgtcccggccggctccgggagcaacgccggaggggtcgccgccaaggacaagctcggcaacgacatcctcgtcgaggattggctcaagacgcacggccccaacgaccgcacgctcgcccaggggctcaagggtgatcctacctaccttgtggtggagtccgacaagaccctcgccacctacgggatcaacgccgtctgcacgcatcttggctgcgtcgtgccttggaacgccgccgagaacaagttcctctgcccttgccatggatcccagtacaacaaccagggca

SEQ ID NO: 1246 - DNA, 549 bp, Hordeum vulgare
tgaaaggtttctcttctttatagactgtatcatataactggatacaagaaacaggtgcatttatagcaggagtactcttatagcagcgttcttaggactggcaggaggcttaacatatcacacgagtgagctttgctgccggagcttgtgtcgcttatttccaccacgggttctcgccggtcctgaagtcggtctccacccatggcacgaagacgaccttgccgtcgtcgacgtcggcgtgaacgagggccagcgacagaggtgcaggtccacggacaaccttgccctggttgttgtactgggatccatggcaagggcagaggaacttgttctcggcggcgttccaaggcacgacgcagccaagatgcgtgcagacggcgttgatcccgtaggtggcgagggtcttgtcggactccaccacaaggtaggtaggatcacccttgagcccctgggcgagcgtgcggtcgttggggccgtgcgtcttgagccaatcctcgacgaggatgtcgttgccgagcttgtccttggcggcgacccctccggcgttgc

SEQ ID NO: 1247 - DNA, 523 bp, Hordeum vulgare
  UNSURE (4),(12),(13),(25),(26): n stands for any base
gggnctgcaggnnaattcttcacgnnaggaattaccctcctacagataatcacagctcctctgtagcggacaagctacctcatccacaacatctgctgcctcaattccaagatctggttgctgcctctacaaatctcgccaacagcatatggaaaggagttcaaacgagctcggcgtcatgttggaggtggggagaactcgaagcaaatgagtctagacgagcttgttatattgtgccaccacggaaacaacttgatgcaatggtttggacagcttcatgacgaagtaaaagaagagcttatgacagaagaaacatgattggttgggcgtccttgccagcgacctcgcagtctccaacccacccataggtattgcagctccttccaatccagtttactcctttttgataatttccttacttgagccttagagataggcactgaatcggctattgctcggagaatttccttttaacacatactcgagggaaggaggatctttagtattttgaattatcagttaa

SEQ ID NO: 1248 - DNA, 547 bp, Hordeum vulgare
tttgcaaggcatgacacaacgacgaagcttcttatatacatacaacacgtaatatgctagaattttttttgaacagggagtatgagaactaacaaaattatcaatgcacaacaatatctgatggaagaaggccgcctcgcagtcagcaagcaaacattcagggaggaactgcacgggtcgttagtatcatgccatatgcacctaagatagttggcatatactctcacgattgacctcttgatagtccatccattgcaccgttatatcctccttccctcgagtatgtgttgaaagctcagtgctgcagtatacataataacaaagtttgtgcaatgacagtgaaataaatagagctaaccaagatagaccaaatcatggacatggacatgaatatcaaagagacaggaaacctacggatgggttagatagcaagtcgccggcgaggacgcccaggtctggctgacaacacccggccccacgcacagttcggaagcacattctaccacataatcagatggcatgcaagtaccaacagcgaccaaccaaa

SEQ ID NO: 1249 - DNA, 517 bp, Hordeum vulgare
ctcccgagagttgcaaaaacagaagagcttcaatcttcattggagacagtagatataagaagtgatagcactgggagtgaaacgaaggatgattccgaacaacaagttcctacaaatggtgctgcttttaagccaagtgaagattcctctacctggacaactgaatccagtaagtcaggacctatgctatctattgatacaattgagaaaatgatggaagacccagctgtgcagaagatggtttacccctacttgcctgaggagatgaggaatccagagtcattcaagtcgatgcttcagaatccgatgtaccgccagcaactggaggatatgctaaacaacatgggcgcatctcctgatcaatgggataaccgcatggttgatcacttgaagaacttcgaccttagcagtcctgaagtcaggcagcagtttgcgcaagttggcatgactcctgaggaagttgtatcgaaaataatggcgaacccagaagttgctgttgcattccagaatccaaaaa

SEQ ID NO: 1250 - DNA, 558 bp, Hordeum vulgare
  UNSURE (26): n stands for any base
ggttgggcaacttccacccgtcattnggagctcaggttacattccgactaaacaagttgggacaacatagccaacattttcatgcactgtcatggtaacacaatgtatcaaaattgaggtgatatgaactacatcggcaccttcacatcctacagcaaaccatatagtgtcaaagcaccaactacacaattctacagagcggtggcgtaaatatatatctcaaactttgctacttcactactctgacttcaggtatggtcgcaaccaaaccgaaacgctggatcatatgatgtgcattggcaactcaaaaaccttgacagcaaggatacatctttgcgcaaaatgaccgaacacatgaagtttcactgttcctcagccggttaacagatgctactgcagtcgcttaggctggagataacaggccaaggcaaatcaaaaactgcaattccgtgatgcacatccactagccattaatttgggggaagatttgcgatatcttcataaaaacatccatgacctcttggtcattttggtattttacaatattcagagggttct

SEQ ID NO: 1251 - DNA, 519 bp, Hordeum vulgare
ggaattcggcacgagggtggagcagcacatggttcacttcagtgaggacggcaacatatccgttgtgtcgatcctgtaccggctcggcaggcaagacccttttcttatgcagctgcaggataagctatcggagctctatgtggaggcctgcagggccgagaaaggtgctcccatccccgccggagtcgtaagcctgtggccgctgcggagttacgccaacatgtactaccggtacgtcgggtcgctgaccacgccgccgtgcaccgagaacatcatctggaacatcctcggcagggtgagggagatgacgatggagcaggccgccgccctgatcgcgcccctggaggaaggctacaggcgcaacaacaggccgacgcagccgctcaacggccgcaccgtgcagttctatggcaggttctggaagaagaagaggaacgggacgccgtaagcatggtggatgatgatgtctggagacgatgatgattttgcagtgtctcgtctttgctctcggttcgggag

SEQ ID NO: 1252 - DNA, 543 bp, Hordeum vulgare
  UNSURE (6),(8): n stands for any base
acttgntncgtaaagggaaactttgttgattagctaaactttttgtagacaaaagaaggatcgatcacatcaaccctcccggacccatttacagacaccaaagaccttacatttagttaaccaaattcagtgcccagactagacccatatatatatatatatgctaacgacttgcagaaataaacgactactataactttctcccgaaccgagagcaaagacgagacactgcaaaatcatcatcgtctccagacatcatcatccaccatgcttacggcgtcccgttcctcttcttcttccagaacctgccatagaactgcacggtgcggccgttgagcggctgcgtcggcctgttgttgcgcctgtagccttcctccaggggcgcgatcagggcggcggcctgctccatcgtcatctccctcaccctgccgaggatgttccagatgatgttctcggtgcacggcggcgtggtcagcgacccgacgtaccggtagtacatgttggcgtaactccgcagcggccacaggcttacgactccggcgg

SEQ ID NO: 1253 - DNA, 394 bp, Hordeum vulgare
tgcacacttcacaaactttaccggtcatgtggagacaattgagaactgtgtgtgtttgcacgaggaggaccatggaatcctttggaaacaccaagattggagaactggtttagcagaagttaggcgatcaaggaggctcacggtgtcatttatctgcacagttgccaactatgaatatggtttttactggcacttttaccaggatggtaagatagaagctgaagttaaacttactggaattctgagtttgggagctctgatgcctggggaatcaaggaaatatggcacaactattgctcctagtctatatgcacctgttcaccagcatttctttgttgcccgtatggacatggctgttgattgcaaacctaacgaggctcataatcaggtggtt

SEQ ID NO: 1254 - DNA, 170 bp, Hordeum vulgare
tttttttttttttttttttttttttttttataacaaaggcattatgccagtccagacattattagatgctacttgtgcagctcaaaacattcacaatcattcagagcagcaaacacacatattacagaaaataaaacagaccacgagaagataacttttattgccagttt

SEQ ID NO: 1255 - DNA, 488 bp, Hordeum vulgare
cctcgtgccgaattcggcacgaggcagctctgctcgtcctggaccgcgggtcgccaggaagggccttcaggaacgggatttttttacctaggagccaatttgggtttttaatcgcagattggattgggttcagggatgaggggagaggaggggctgcatcacctggcccggttcccatctctctgaacttagatggatgcatctgtgaagtccaagaaggttagctcttgtggaaacaccggtcatagccgctgcggcgaagttcataaacctgtcctgccgtgtcgcatgcgggatcgctgcttaaatagaaataatcccttctcgcttcaggtttggtttgcatttccttttaagtataaaggcaactgtatttggcatggcatttgagtaagcatcagaaactcaaaagcaaagtttgtcagaaatattatacctttattggtgtcaatacttccatagagaagatggtggatgatttgttttat

SEQ ID NO: 1256 - DNA, 556 bp, Hordeum vulgare
aaagcatatctgtatcgcaccccaaaatttcaaaggatatacacacattattatgtttattgactatcacaccagaaccctgaaaaagatccatgtcctaacacccacaaaattttatgcggctggcagcctcttcttgagatcggcacgtctttcatatcgaagttgatgcgctcaccgtccttcgtgcgttcccaaggatgataactatgacagtcacgtcgtcgtggtactttctcctgctcccaacaggtatcctcatcaactgttcagctgttaaagctgcttctttggcagctttatgtacaacttgctcgataagatatttcgcaggatcgccagttggattatcatgcataaattgataaaccaactgaacaacttcatcgttactgaagaaatcaaataagccatcactgccaagcacaacaaacagatcgtcctccgtaaccttgtgactgagtgtgtgtggatttgtatatacgtaaggcggactgcacaaattacgaactcggagaattcccatgagtgcatcattgaactttttctgtttaag

SEQ ID NO: 1257 - DNA, 536 bp, Hordeum vulgare
  UNSURE (3): n stands for any base
ggnctgcagggaattcggcacgaggtgctaatggcagcaggcctcacatgtcaaaagatgtcagatgggaagccatgaggcgcatagcgatccaacaagggagcctaggattgaagaacttcaagcttctcaaacagcttggatgtggagatattggcactgtttatctggctgagttggtgggttcggactgcatgtttgcactgaaggttatggacattgagtacctaataagccgaaagaagatgctgagggctcaaaccgagagggagatactgcaaatgcttgaccacccgttccttcctaccctgtattcttatttcacgacagataatctgtcttgcctagtgatggagtattgtccaggcggtgacctgcatgtcctaaggcagaagcaacctactagatgtttttcagaagccgctgctaggttttatgtcgctgaagttctccttgcattggagtatctgcatatgttgggggttatatatcgtgatctgaagcctgagaacatacttgttcgtgaagatgggcac

SEQ ID NO: 1258 - DNA, 522 bp, Hordeum vulgare
ttctgtatctgatggtattaacaagggaataaagttacaggcacaacacccgaccttactcagttactctacatcccaacattggcaggtgacaactgataactcatcttcaacagaaaaactgcaggggggtggggacagggggaactgtgggactactacttctagctaccacggtatggatattcttcagaacagaaacgtactaccactacaacttctactgctactactgccaccattagaagagctcaaactcgatgtcgtctccgttcatccggaactcgaggcacttgccttccttcttcttccgtgccacggctaccgtaagggttgaggcttcgacgatgcttttcggggtctccggcggtgcagtccaacggatcaaggcccagttcaggccttggaagaagggatgccgcttgatctcggcagctcctttcctcgagcctagccggtgctctggctccttcacaagcaaccctctgatcagatcgcgagcctggtagctcacagctgggc

SEQ ID NO: 1259 - DNA, 542 bp, Hordeum vulgare
  UNSURE (3): n stands for any base
ggnctgcaggcaattcggcacgaggggttgccggcacacagaggtactacgtgcttggaggcaaaggtggtgttgggacaacaagcatggcggcatcgcttgctatgaagtttgccaaccgtggtgaaccgacgctcatagtttctatgcacccagcacactcactgggtgatacatttgaacaagacctgagtggcggtaatatcgtacctgtcaatggagttgactctctttttgctgccgagattggccatgttaatacaaaagaggaatcttctaatggtggatcttttatccgtaatatactggacaagatagggcttggagttcttgctgatccgctgggaaagaataagctgcatgaaatgctgatgaaaactcctggacttggagaagccgttgcaatttctaagctggtacaaattgttgaactgcaagagagcaataaatttaggcgcatagttttggataccccggccactgggcatacacttaaccttttatctgctacaactttaatggaaaagctccttggtatggcc

SEQ ID NO: 1260 - DNA, 551 bp, Hordeum vulgare
gacacaccatatggattgttcaattagagataaacacgcgagggcaataataccaaacatgaaacgctgaagcagatctacagcctgaacagcctcatatcctgctgggcatcatcttttgtccagatttcaccgcatttctggacaacgagtgccgccaccagtactctcgagttataatgaaatactccctctgtcacaaaagataagtactaacaaaattctcatcgcggcctggcatcctagcggctatttccagaccacgtcactgaagaatctgagggcaggggcgcctctaacctccacatcaacaagtggtgcttggattagctctaggccgctaagctcacgatcattgcttatcatattcagggcgcgtgcttcttccttgcgttttgtagaacagaatctgcaatcagatgtagagggcggcaacacttgatttacgataagccttgttgctggcgcaccatccttctttaaagatgcatgaaaccttgatgactcagtaatcgccatcaccgtaggaatcgtcacaatgataaattcag

SEQ ID NO: 1261 - DNA, 551 bp, Hordeum vulgare
  UNSURE (20): n stands for any base
gtacccccgggcctgcaggnaattcggcacgaggcggacgcgccgccgagaaagccgaaactcctcccagcccacgtctatccctgatccgtcccccgcccgcgggattcggatcgtcttcagccatgtcaaaggccagggtctacgccgacgttaacgtcgtacgccccaaggagtactgggattacgaggccctcgccgtccagtggggtgagcaggatgactatgaagttgtgcggaaagttggaagaggcaaatacagtgaagtctttgagggcatcaacgtcaacaataatgagaaatgtgttattaagatcctgaagcctgtgaagaagaagaagatcaaaagagagatcaaaatacttcagaatctctgtggaggtccaaatattgtgaagctgcttgatattgtcagagatcagcattcaaaaacaccaagcttgatctttgaatacatcaataacacagatttcaaagtgttatatccgacattgacagattatgacattcgctactatatctatgagttactgaaggctttggattactgc

SEQ ID NO: 1262 - DNA, 546 bp, Hordeum vulgare
tggatttagaatccaagcacttaacaaagatattctttacaagcagagtcgtacaatattaccgaacacgttacatgaaaagtgtgttgcgaactttcaatcaatcaggtttccatacacaaacaacaagagcaaatcacagttcttttccccctcgacgatagaggcacacaccacacaggctcttacctttcccagctgatccaaccattatcgagttgtaatacgtgacaaagtcgctacaaggatgcggcttcatcacgcgctgctcattcaatgtcagcaacagtcctgctattgctattgcgcgcgagtcctgctgttttcagcggccctcacctgcaggaagtatggatgtgccatagcttcacgtgcagtgagcctgtcctggtgatcatatcgcagaagcttatcaaggaaatctatggcctcaggggataccagatgctggttgtctgcattgataaactttgaccagggttttctgctgtgccttcccacaagggcttcaagctgagggtcaagctcaattctgtacttgttcaa

SEQ ID NO: 1263 - DNA, 399 bp, Hordeum vulgare
ctgttcactactgcagtagagcgagcgaagacttgagcctgaacatcttttgctgctagagagggatttcaccggcacatcagaagaatgcttgtcaccatcagaaacgcacagctagccctggcagatcacccttgtcatttcggcagcctccacgagctgtagctgctaactccatacatatcgagaatgaagttcaactaactgcttgggcgtgatagattgccaatatttgtacaaattaacaacaatcatttgataggattcctcttgattcattctggagatatcttctctatatatgaaacttcatagtatgtgtacataggacagaaatattcaggacaaggatgccaatttgtcacgtgtactgttcttctaaaaaaaaaaaaaaaaaaa

SEQ ID NO: 1264 - DNA, 372 bp, Hordeum vulgare
gtacacgtgacaaattggcatccttgtcctgaatatttctgtcctatgtacacatactatgaagtttcatatatagagaagatatctccagaatgaatcaagaggaatcctatcaaatgattgttgttaatttgtacaaatattggcaatctatcacgcccaagcagttagttgaacttcattctcgatatgtatggagttagcagctacagctcgtggaggctgccgaaatgacaagggtgatctgccagggctagctgtgcgtttctgatggtgacaagcattcttctgatgtgccggtgaaatccctctctagcagcaaaagatgttcaggctcaatgtcttcgctcgctctactgcagtagtgaacag

SEQ ID NO: 1265 - DNA, 518 bp, Hordeum vulgare
tggaaacttgggtcttggtgatcggaatgaccgatttgttcctgaaaaagtatcttcggtggagggagacaagatggtgcttgttgcatgcggatggcgccataccattactgtttcctcctccggtagtttgtacacttacggttggagtaaatatggtcagcttggtcatggcgattttgaagatcatctagttccacataaagtagaagccttaaaggatagctctacatcccagatttcaggtggatggaggcacacaatggcacttacatcagatggaaaactttatggatggggatggaacaagtttgggcaagttggagctggcaataatgctgatcactgttccccagcccaggttaattttcctgaggaacagaaagttgcccaagttgcttgtggatggaggcacactcttgctttcacagaaaagaaaaatgtgtttgcatggggaaggggtactagtggacaactcggtcatggggaaatagttgacaggaacacacctgtgatta

SEQ ID NO: 1266 - DNA, 550 bp, Hordeum vulgare
gggacaaagaacgaatagcttattgatggtaccgtccaaacaaagtgtcggatgaagctaccgaaacattcagaacacaggtacaggttgattctactagccacctctaagaggtgaattatacaccatagcccataggtgccgacacatcatctctcaacgccgggagaaggcggttcctctcctggaaagtactttggcagaacggaatgcacaaaaactggacaccactagatggaaactgatgaacaatgcgcaaggttttttggtggtagtgctagggttaatgaggtacatagatgacgggtcatcgcactaggatcaaacgcgcattctctttacatcattctcgggcacactcgcatccgcaccattgccacgcgcggtggcatcacctggttttgcaaccttctcatcaggaacaagagcatatctttcagagggtgacacccaaattttagctgcaaatggaatagctgctgaagactccagcttcttgcaaccaggaccgtctgggcttagggcatcaataatcacaggtgtgttcctg

SEQ ID NO: 1267 - DNA, 518 bp, Hordeum vulgare
atatgatcctcggtgacacctgcacgcgcggatgcagattttgcaatgtcaagacatcacgaacccctcctccaccagatcctaatgagcctgccaatgttgcgcaagctattgcatcgtggggccttgaatatatagtcatcacaagtgtggaccgggatgatttacctgatcaggggagcggccattttgctgaaacagtacagaggttgaagactttaaagccagatatgcttattgaagcgctcgtacccgatttccgaggagatccaagttgcgtagaaaaggtagcaacttctgggttgcatgtttttgcacacaatattgaaacggtggaagagcttcaaagagatgtgcgagaccaccgtgcaaattttaagcaatcaatggatgttctgaaaatggcgaaggagtatgcccctcctggcactctcacaaagacatcagtcatgctgggttgtggggagactcccgatcaggttatcagcacaatggaaaaggtgagagctgctggtgtt

SEQ ID NO: 1268 - DNA, 552 bp, Hordeum vulgare
aggataaaggggggcagcaagaatttaattctctggaaaagaatagtaatattaccaggatgtaaaaagacaaacatgtttctccaatagaacatattatttgcagcgtagcaatgtcaatgactggagctggaggtgtgtcaactatgaacttgattctgcaacaacgcctgattttgctcggtcatcttcgatcatggctttgatgtagaactcgcctgctttgtaggaggaccgaaccatcggaccagatgcaacataacggaatcccatttcaacaccaagggctcggtagttctcaaaggcttcaggagtaatatactcagacactggcatatgtcgctttgacggcctcatgtactgaccaaatgtaatgacatcaacaccagcagctctcaccttttccattgtgctgataacctgatcgggagtctccccacaacccagcatgactgatgtctttgtgagagtgccaggaggggcatactccttcgccattttcagaacatccattgattgcttaaaatttgcacggtggtctcgcacatctct

SEQ ID NO: 1269 - DNA, 517 bp, Hordeum vulgare
ctccacaatggcgacggctcaccttagcccggcgctcgcggtctcatcgtcgcgccacctaacctgcaaacacggcaagccgcccgtcttcgcgcagccaggcggcacagtggtgctgcggtcttgctcacttcctttgtcctcgagactcgccgcgtcgggtcgaggtgggtggcggctcgcggcggcagtggagcccatgaccgcgcagcaggaaaaggccgaggcctcctcgaggcttgtcctcgtcgtgggcggaactggcggcgtaggtcagttggtggtagcatctttgctgagcagggaaattaagacaagactgctcctaagaaatcctggaaaggcagcgtccttatttggcaagcaggatgagagtgttttgcaggtttatgaaggggacacgagaaatgctgacgatttgaatccagaaatgtttgagggagttacccatgtgatttgtactactgggactacagcatttccatcaaaacgctgggatggggataacactcctgaa

SEQ ID NO: 1270 - DNA, 550 bp, Hordeum vulgare
  UNSURE (18): n stands for any base
gtagcctgggcgcatagngatagtaaggactatgctcgattgtttgcaagtcgtttccaaatcccgcgacaatgacaattgtgcacctattactgaatactgatgactgttactgccctcgtatggaatccactacagcttgagacaaagtgccactagttcgattcagcagctgcaaatagctgcttccatttctcctggtcgctcccaggtccttcgcccttcaccgaactaatctcgtatatttttccttgggtagattcaatatccaaagcttggatacatgcttctgccaccaccaatctgctcgcttctcccacaagcttgtcaccttggcctatctcaactgctcgtctttctccagctgtagccttaacaagtgtgttcaggtcataggaagtgtagggcccatctgttaatctccccggcctgatgatggtgaaaggtatgcctgaattacggacaaagtcctctgccatcttcttgtatttaagcacaccaaataggttcatgatactccatggtatttcattgtattttgtaacaccaa

SEQ ID NO: 1271 - DNA, 552 bp, Hordeum vulgare
  UNSURE (11): n stands for any base
gtacccccggngctgcagggaattcggcacgaggcctcgtgccgaattcggcacgaggggttcctgtgcctgcacgggttccggaccagcggcgagatcatgcggaagcaggtggtggggaagtggcccgccgaggtcacggcgcgcctcgacctcgtcttcgccgacgcgcccttccccgccgagggcaagtccgacgtcgacggcatcttcgacccgccctactacgagtggttccagttcgacaagggattcacagagtacaggaatttcgacaaatgcctggcttacatcgaggagctcatgatcaaagaagggccctttgatgggctgatgggtttctcccagggttcgattctatctggcgcactcccgggcctccaagaacaaggattggccttgactagagttcctaagatcaaatacctcataatcataggcggcgccaagttccgctcgcctgcgatagctgataaggcgtacgccaacatgatcaaaatcccctcgcttcacttccttggggacaatgacttccttaaaccccatggtgaa

SEQ ID NO: 1272 - DNA, 551 bp, Hordeum vulgare
gaagcaaaatggagtgaatatacacattaaagtatgtctatatacatccgtatgtagtccactagtgaaatctctagaaagacttatatttaggaacggaggaagtacacgatagctatcactctgcattcaggaattattattgaataatcacacacttgcaacaacacgaaactaaggaggtcacaactgtatgatttgcctatataaggacttgattatgtattcaggcacggtgctatatcagatgcaaatttctttttcgtcaacatcagcgggtgcttcggccttgggctcggcggatggaagttcagatatctccttttccatcttgtcaaggaaacgggacatgacttccaaactcgtctcatcaacaagccttgggaccgtgtggccctttgggtgacgtatgatgaatggatccacaaatgactctatgagctgttcaccatggggtttaaggaagtcattgtccccaaggaagtgaagcgaggggattttgatcatgttggcgtacgccttatcagctatcgcaggcgagcggaacttgg

SEQ ID NO: 1273 - DNA, 946 bp, Hordeum vulgare
  UNSURE (1)..(3),(22),(946): n stands for any base
nnnttgcatgcccctagacccncagtgtggggccaaaagagcgtgtgttgttaagtcaacacaggagaaagacgagcagtttggtgggccgggtgacaaaaaaaccggagagcgagcaattggtggtggcagaagcatgtatccaactggggtgtgaatctacccaaggaaaatattcgagatagttcggtgaatggcgaatgacccgggatcgaccaggtaaatggaactactatagcagctgctggagggagtatgtcacttttttttttctgtctggattccatacaaggcaagaccgggggggggatatagtcatcttcctcaattcatttacatactatcccttttaccttccacttccctcttatccttttccctttttattcatatatatctttatccttgcccttcctatttactcctttttctccatttcttttcttttatcttttctttttccccccgtttcctttttctatctttcttacttattatttttcctttctttattttctccaattttttacttttaaccctattcttcactctcattatattactccccttccttttttttttttttttttcccatccccatcctccttcgcatttttcctttcattctcctatcttttcccccattctctttccgtttactcctctgtacctttcccctcattttttttttgcttccatctttttttgctttttttctttccactcttgttaaggtcattattgcagctgttaacggattgtctttttctttttcctatcttgcctacctataatttttctttctcttcgtttttcttttttcttttacttacttcctttccttcttttgctttgtgcgtcatcattccccttatcttcttcccttcccttttttttgcccctccctttcccttctcctcctctccatttcccaccatcctcctcn

SEQ ID NO: 1274 - DNA, 480 bp, Hordeum vulgare
atctccgtaaaatatctacttattcacacaaatttgtacttatccaaattcagcccccgagtcactaagcaaaaaaaggacaaacaaacggtatttttagaagcctgggcgcataggatagtcaaggactatgcgcgattgtttgcaagtcgtttccaaatcccgcgacaatgacaattgtgcacctatgtactgaataccgatgactgttactgccctcgtatggaatccactacagcttgagacaaagtgccactagttcgattcagcagctgcaaatagctgcttccatttctcctggtcgctcccgggtccttcgcccttcaccgaactaatctcgtatatttttccttgggtagattcaatatccaaagcttggatacatgcttctgccaccaccaatctgctcgcttctcccacaagcttgtcaccttggcctatctcaactgctcgtctttctccagctgtagccttaacaag

SEQ ID NO: 1275 - DNA, 550 bp, Hordeum vulgare
gtcccccgggcctgcaggcgacacgcgtcacgtgaggagacctaaccgccgccgccgaagaccccgcgtcctcccccttccttccctcgtcgtcgctcgagggtgtggtcgggcaaagcccggtcggcggcggtggtggtggggctgcttctcctcttcgcttggcgcctggtggcgtgggacgccacgtcaaggcgggggagggggtgtggcgactcgcctccgatcgatggcgtagtcgcctagttgtgatggttgcgtgggcggctccgtgtctgtgagtgtggccagggtggcgccggcggccaaggctgggcttgcccggatctagctcttggtgccctttcgagaggctggggctcgacggcggccgcgcctgtggggctcacatgggagctcggctggtggtggatgtggttgtcgctgcacctcatagtcggttctgtggaagtggtggtggatggcgccggatctaacgcgtggatcgtggtggtcggtggcggtgcgtgtcggccggatctggtctcttctggcgggcgacgctggttgg

SEQ ID NO: 1276 - DNA, 440 bp, Hordeum vulgare
acaacattctgatacaaactgatatacacacacacccaaggcatgatacatcggcactgatctacaagagcaaccaggggctcaaccgggaaaatgtcaccgcgaagaaatgaagccgcatacgacgaactgtgggcttcaaggcggcaccttcaggaaggagacgacaccgaagtgccgccatcgcccgatccgaggatcggagtttcctctggagcagcacgacggacgatgagagccgcgacgacaccttcaagaagggaacaagcttcgtcgccgtcggtccgtccgaagatgaaacaggttttcaccccggccaagactcactgccaccgatcgccacaccccgactgccatgccacccacacggccatggccaccaggcagcatcaagccacgggctctgcccaagagcatcgcacaaccacctccgtggcttg

SEQ ID NO: 1277 - DNA, 553 bp, Hordeum vulgare
gtacccccgggcctgcagggaattcggcacgaggccgcaatccgcaagcagaagaggagggatcgcggagtggttatttacagaggtgttgggagaatccaggaggaggaagtagtccggccaagaagggggggatacagagaggaggaggccgagttcgggggagaggagatggagacggacagcccgcggagcccggaggcggagatcgggcaccgggtggaggacctgtgggaggtggcgcagccgcagctgtccccgtcggagaagctcaactcctgcttcgaggacatccccgtcgccgccttcccccgcaaccacccctcgcaggtcatcgagataccttcggatgccagccttgctgatactgttgagacattatccaaaaataaaattttgagtgcacccataagaaacgtcgatgctccagaggatgctacttggatagacaaatacatcggtattgtggaatttgctggtattgcaatgtggttgcttcatcaggtttacatcctccctctcttcagttcaatttcctttttatatagctaga

SEQ ID NO: 1278 - DNA, 544 bp, Hordeum vulgare
  UNSURE (19): n stands for any base
tctcattcaaaggttttgntatacggtaacttgacaagaagacgggggaggagcaaaagataaactacacagcaacttgacaagaagacgggggaggagcaaaagataatgtacattttcttacagagtacagcgttttgtcatacggtactgtttgcgggtaggggaacgacgccgtcgaagaaatccccaaagtaatgccgtggctcgtgcaccagcttggagattatgtccctcagtgtgatcaccccctcggtgtcccccttgtcgtcgaccacgtagatcctgtggatcttggtcgagtccagcttcagtatgatatccttgatcacgtcgtctcttttgcatgtgatcacgtcgtgcagcagcggcgacgcttcgtgttgctcctggagatggtgccggaccgcagtaaggaaatccttggctgagattgtcctgtgaatcgaatgcatccagccagagtcatacaagagggcacttcttatgcagcaattatcagctgacatggtctgcctcgtacacatgactgctcgtacctcgc

SEQ ID NO: 1279 - DNA, 517 bp, Hordeum vulgare
cgggcttcttcgaccgcgaggtgtacgacataatcgagggccgcggcagcggcggcggcggtatccgtgacggtggcagtaatgcggccgcggtgctcgcggaggttggggaggaggagggcaaggagaaggtggtgttcgacagtggtcgcgcatccgtggccggtgacgacgggctgttttcctcctcatcgtcgtccgaggaagaggacgaggaaacgtccacgcctgcgccggtgccggttctgccgacggctccatatccgtctccatctcaggcacccgcggtggtggccgtggccgtgcccgtttctttacccgagaagaagaccgaggcacctacgcaggggagctcagaccaagcagggacatccaaaggcaagcaacaagaagaaattagaattaccgatgagccgccaccaccgcagggtggtcagaagaggcagcgcagcgatgatgccctaggagaaaccactgacctacagggcaagcttattgagattctagatcgtagcgg

SEQ ID NO: 1280 - DNA, 548 bp, Hordeum vulgare
gtgtcaacaaatgttattaaagcttttgtatctccatgaggaaaatggccatctccttcaggtttctgactaaatttcagaaccagtctacaagaaaaatcaaatgacgagatactctaccaatctgtacattcttataaattcatgctatttcccttcttattcgcagtaattatttacgttgctcaagacgtttacagcggcaaactacagcttgtcagcgattctgtagagggcatcagccaccttgccaagcacacccagcaagctgctcacttggtctttcctctgctccctatccagttggcagttgatgttctgtgactccagctgtgctgccaccatccggccgctacgatctagaatctcaataagcttgccctgtaggtcagtggtttctcctagggcatcatcgctgcgctgcctcttctgaccaccctgcggtggtggcggctcatcggtaattctaatttcttcttgttgcttgcctttggatgtccctgcttggtctgagctcccctgcgtaggtgcctcggtcttcttctcgg

SEQ ID NO: 1281 - DNA, 518 bp, Hordeum vulgare
cttcctctgccgcccgcgctatccagtcccacggcgcacatggcaagcacctacctctcaagcttccaggccgccgccgccgccactagcggcggcgcttcaacgaggccgagaccaaggccaaggccaagagtggtgacatgccacaccttcgagccatcgggcaggcgatcagcctgcctcagtctaggcctcggccttgccaccgccgctgtgttccacacgacacccgcccgcgccaccgctgacggcgacgaggagccggagccggccaataacggctggtggctcaccgagttccccctgccggtgcccaagatccgcaacaaggagatcaacaatggcgagacagggacgcgatccttcgtgaagaacggcatctacatggcggacatcgggccgagcttcgcggcgcacgcctaccgggtgcgcagctctgccttcgacctgctggcgctggaggacctgctcggcaaagaggcctccaactatgtcaacaagtacctccgcctcaaggc

SEQ ID NO: 1282 - DNA, 527 bp, Hordeum vulgare
ccaaatgtacatgtacattacatcacgcacaatggtataactgaggctatcctggatggagtttcagttcgtgaaagaactgtttctcctgggtcctggctatgccattcttgtcatgacctcctgcagtatgagctttgtgtcagcatagcaggatcctatgtcggtgtcatccttggtggtgaccgcggcctgcaacttctcgaagctgtcgaagagccggttggcgaggtcaagaagcggtggcttggcgtcggggtctgcggcggtgatgagcttgtcgaagtcgtagtatatgaaggtggccttgaggcggaggtacttgttgacatagttggaggcctctttgccgagcaggtcctccagcgccagcaggtcgaaggcagagctgcgcacccggtaggcgtgcgccgcgaagctcggcccgatgtccgccatgtagatgccgttcttcacgaaggatcgcgtccctgtctcgccattgttgatctccttgttgcggatcttgggcaccggcagggggaact

SEQ ID NO: 1283 - DNA, 483 bp, Hordeum vulgare
  UNSURE (165): n stands for any base
attgccgtcccagacaccgaggctgctgagattggggatatcatggcggagtatgggctcgaaccgcatgagtatggccccgttgtggagggcctccggaggaacccgcaggcctggctcgagttcatgatgaggttcgagctgggattggagaagccggacctnagtgatctctgcagagtgctttaacaatagcactatcttatatcatcggtggattggtccctctcctgccctacatgttcatctccacggtccaggacgccatgctcacatcagttggagtcacgctgctcgctctccttttctttggctacatcaagggtcggtttactgggaaccgcccattccttagcgctgtccagactaccattattggtgctgttgcttctgctgcggcgtacgggatggcgaaggctgtgcaagctagatagtcttatggggtgcactcagtatccaaacttttcactagactgcaatgta

SEQ ID NO: 1284 - DNA, 547 bp, Hordeum vulgare
gtattaatgcttgttaaagaagcaaatacatctgttctgaatacattgcagtctagtgaaaagtttggatactgagtgcaccccataagactatctagcttgcacagccttcgccatcccgtacgccgcagcagaagcaacagcaccaataatggtagtctggacagcgctaaggaatgggcggttcccagtaaaccgacccttgatgtagccaaagaaaaggagagcgagcagcgtgactccaactgatgtgagcatggcgtcctggaccgtggagatgaacatgtagggcaggagagggaccaatccaccgatgatataagatagtgctattgttaaagcactctgcagagctcttctagggtccggcttctccaatcccagctcgaacctcatcatgaactcgagccaggcctgcgggttcctccggaggccctccacaacggggccatactcatgcggttcgagcccatactccgccatgatatccccaatctcagcagcctcggtgtctgggacggcaatgatctcctcctgctctctccct

SEQ ID NO: 1285 - DNA, 255 bp, Hordeum vulgare
gcacggggcatccaaaataccgtacttccgccgtcgcacggcgatgctctcctcgccgctcgccttctctcctcaccgcctaaccccttccgccgcctctgttcgccggagcacatcttccaccatcacgatgcgggaccggggcaagaaccggaagccgacgcagcgggggcgctacctcagcaccgaggccatccaggccgtccagtccctgaagcgcgccaccctctctggagcccccgctgctggcgccgt

SEQ ID NO: 1286 - DNA, 544 bp, Hordeum vulgare
gaagttgcagccctgcaagaagcctttctttaatgtttatacatctcaggtagatattggtagtaactaattactacttgttgcacaaaaattctgctgggtccaagattatggactttcattcatctgttctaacactgcataataaacttcataaatgatttcccttccgacatggccatacaatatcctgttaagaacgaactgctcgagtctcaatcgtctcctcttcctcaaagaagtcccagaggtcaccatagtcactttctgcttccaacctcatcttagcagatagatccatctctcctagggactcaagacccttgaccagcgttatgtatgttgtcctgtcaggttcactgtcccatagcttcataagacggaagcagtccattgttaattgtgtgaactcagcatctagaagggtcttcagaagcagattgaaaccatcggtgtcaggttccaattgttccctcttcagataggaacaggctttgccaacctcggacctcaatcctttgctagcaagcactgtaataagatc

SEQ ID NO: 1287 - DNA, 885 bp, Hordeum vulgare
  UNSURE (661),(773),(777),(780),(782),(784)..(885): n stands for any base
gtcccccgggctgcaggcaattcggcacgaggcccttcagtacagaaagttggatttcgaagaatttgcggcctctgccatcagcgtatatcagatggaagccctggagacctgggaacagcacgctcggcgcgcatacgagctgttcgacaaggagggcaaccggcctatcgtgatcgaagaacttgcgtcggaacttggccttggcccgtcggtgcccctccacgtcgtcctccaggactggatcaggcacgccgacgggaagcttagcttcctcgggttcataaagctcttgcacggagtctcttcccggtcgatcccgaaagcctgaggcgcaaaacaagcattattattcttgcatcaattcaaacctaggagatgactgatggctaagccaccgccaatctctcgctggtgtctgtgtgcgtggacgacgactgtttgaggtggctggaggaggatgacgatggcttgcgaccgaccgggatggaagagaagtcagccaacagtctttgtgtaagaggtaataagatgaaaagaaggttgttgcttgatggttatgactactgcagtagtagctactagtgcttgctttgtaccccccctcccccctgtgccacgtggattgatgatggtgttgtattaagctgctgtgtagacngatgtatgtacagatgaggataggaacagaagaatatgaattgaaagggcttagctgttgttgttaaaaaaaaaaaaaaaaaaactcgggggggggcccgggccccaattcncctntgngntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1288 - DNA, 540 bp, Hordeum vulgare
gtgaatctaatgacacactggaagcgtctgatggattacagtgattgtacagtataaggaaatgaactgaacctattttgactagctcactggaacataatccataggtgcgtgaaataacaaagcaccctggagttacaatcactcggcgactcgaaataatgcaacaggtattgtaacacatgccatgcaattctgtacatcattcatcatggaacgttccattaaccgcagcagctgccaccttgggaagatgaggcaccaccacctccagcttggccaggaactgcatagccaactttgattccatacgactcattagatacatcaaagacaccatcctgaattttcttatatattgctccagcagtcttgacaaagccctcctcgacgttttgtgcagtttttgcagatgcctccatgaagatgagaccattctccttggcgaactgctcaccttcctcgaagctcacagcacgtctatgagataggtcacacttgtttccaactagcatgatcgtcatgttagcatttgcgtgt

SEQ ID NO: 1289 - DNA, 518 bp, Hordeum vulgare
gcctgaagttgctcctgagtgttttgagccagagggcgaagagtgcagttcaggtggaacaaatggaatcttgaatacaagcagttctggagtttggttagatgatacacagaacaagttatgtttgaacgggcttaaagatcattcctctgaggtttcgaggtcatgcctgaatgagggctcaaatacagcttcatctgataatcagatcgaatatcaaaatcggctgagctttcctgtagcatgccattccgacaatggtagtgaagaggattccaaaatcttgaaaacccttggcccttcccaggcactggaggagccaatattggaccagaaacatactcctcgcttgccttccaaagctgcacctctgtcgaatcgggagagacttgtgctaaggaagcaagctctgcaaatgaagaaacggccagtacttgccattgggaggaataatgtcatcaccggagttgcgaaaacaatacggacacacttcaaaaagcatcctcttgctgttgtga

SEQ ID NO: 1290 - DNA, 557 bp, Hordeum vulgare
  UNSURE (57): n stands for any base
ggactacaatgaatacatggttcgtctgtatttccagtttccacggcataggaggantcatcttcccaaaaaacaaagaggatcaactgcgacctgacgaaaaaaagaagtaaacaaagcagaagaccagtggacgcgtctggagaggttgtccagccaggatccagctattgtgattcacctgggtgcaacccacattctaatctaatggcttcaaggagctgcggtgatatcacctccttttctcccacatatgtgctatcttccctggaactagtctgggtggcgtccgctccccaacctctgtacaaaatcactttgtttggttctcgcgacacaagaaccgatcctgttgcctcctctagttctgatatcagctgttgaactggagttccatctgctctgttcttaatattcacaacagcaagaggatgctttttgaagtgtgtccgtattgttttcgcaactccggtgatgacattattcctcccaatggcaagtactggccgtttcttcatttgcagagcttgcttccttagcacaagtctctcccgatt

SEQ ID NO: 1291 - DNA, 985 bp, Hordeum vulgare
  UNSURE (474),(478),(480),(489),(495),(529),(530),(580),(587)..(609),(612),(614),(615),(628)..(630),(640),(642),(671),(672),(759): n stands for any base
gtcccccgggctgcaggaattcggcacgaggcgagaacggcgtggtcaccgactgcggccgcggcgagaacaagggcaagtcgctgctcaacgaccacgtcgtgcgccggctggagaaggtggccgccgtgcgcgacggtgcgtccgccaggaaggccgtgtccgggtccgtccagttcccgctgtgggacgactttcgcgcgaccaagtgcggcctcgtcctcttcgtgcagaactcggcgctgcaggtgctcggcgtccagcacttcgacctgcccgacaacgtctgattccagtggctcgcacgaacttgccgagtgtgcagggggcagtgggtgcgttgtcagctggcatgtacaactattctttatagagtgtgattggcatgttgcgttgttgtgtaagtatgaaattatcggatgggtggtggacgatggggaattcaggaattccacgtatactctgatttctgcncgananaaaaaaaanaaaaanaaaaaaaaaaaaaaaaaaaaaaaaaaaaaaaaannattcggggggggggcggggcgcccccacaccccttttgggagtttcacanccccccnnnnnnnnnnnnnnnnnnnnnnnccncnncccccacccaccnnnacattcaacncnataaataaaccaccactttccaccaccanncattcaaccccctatttcttttcttctttcacctactctcatcccctccatttttcccttctcccccttttttctcccttttatttntttttaaccccttctctttactttctcctcttttttttccctccacccttttttcttcccccatttcgccatctcttttctccttccagatccataattacattccgatacatcttcccattttcccactttacttttttatccttatacctcccacttcttacactcacctgtttattaccctttttattctttcttttccccactttctactcgccctttcctt

SEQ ID NO: 1292 - DNA, 429 bp, Hordeum vulgare
  UNSURE (8): n stands for any base
tacgtggnaattcctggaattccccatcgtccaccacccatccgataatttcatacttacacaacaacgcaacatgccaatcacactctataaagaatagttgtacatgccagctgacaacgcacccactgccccctgcacactcggcaagttcgtgcgagccactggaatcagacgttgtcgggcaggtcgaagtgctggacgccgagcacctgcagcgccgagttctgcacgaagaggacgaggccgcacttggtcgcgcgaaagtcgtcccacagcgggaactggacggacccggacacggccttcctggcggacgcaccgtcgcgcacggcggccaccttctccagccggcgcacgacgtggtcgttgagcagcgacttgcccttgttctcgccgcggccgcagtcggtgaccacgccgttctcg

SEQ ID NO: 1293 - DNA, 45 bp, Hordeum vulgare
agagagagcgagagaactagtctcgagtttttttttttttttttt

SEQ ID NO: 1294 - DNA, 548 bp, Hordeum vulgare
attctgccatacggcgtaacagtgaccgggatgataaataaacgtatacaccaagagcaaatgaactgacactgacaggctgacagacagcttgtcctcaatttgactcccaccagatccttccggaccatacgaacgctgaccttttatttccggcgtatcaataacagaaattggccggccaaaactaaccacgcgcatcgatcaaatcgtactactaacagcagatcatacttttacaacaacaataatatgtcgcacacggggtgcagttcacgctatgccgcggcgcgtgcatagactcgtcacagagcggcggccctggcctcgtggcccttggccgccttcttgtggccgcagttgtcgacggtggcgtagaggcggtagggcgaggcgtcggtggcgagccactgctcgaccgtgaagagctgctgcgcgcagcccatgtggggccccgtggccgtgacctcgacgtagttgcagtaccagccgtggtgcgcgccggcaccgtcggatgtgacgttcgcccagcacggcgcgtgctccat

SEQ ID NO: 1295 - DNA, 857 bp, Hordeum vulgare
  UNSURE (49): n stands for any base
gtacccccgggcctggcgggattcggcacgagggcggcagcgaccttgnctcacctatgcacagcccttgttcagacaactctcgaggcggcggctgcgctcagagtaagcgctgctccagcaatggtggtggccccagtctcagcagtgtgagcagtctatggtccagttccaggagtgtgagtgatgccgaggatgatgacacaggcagcggccctgaggaggaaaacggggtgctggatgattgggaagctgttgctgatgcactttcagtcgatgataacagtcattgccaccagagtttcggtaccacgattcccccaacagctacaagtgactcggtgcctcaagcaaatacatcaaaaagaacagagccgattcgtagcaatgcaagagcttgggcaccagatgatacgttccgtccacagagcttgcccagtatctccaagcaggcaagcttcccggcgaggattggcaactgctggggaatgggtatgagtgcagcacatcagagtatcctctcgatgccattatcttgcccaatatgctatgaggatcttgacccaacagactcaagcttcctcccctgcccttgcgggtttcatctgtgcctcttctgccacaagaggatccttgaggcggatgcacgtttgcccagggtgcaggaagctatacaatgcagggtctgcagcagaaggaggagcaccagcaccagtgcgcctatcccgttcttgtagcatgggtccaagacactaggctgtgtgaaggctatgatagctctatgccgtagttctgctttgcatgttactggtcgatatgctgggtttgttgcgtattggctgcttttggtataaaaa

SEQ ID NO: 1296 - DNA, 542 bp, Hordeum vulgare
  UNSURE (4),(13),(40): n stands for any base
tgtnccacttgtncttagtatagtagtataaagtcctaanaccatcacataataagtaaaaatagcaagagctagacttaagtgaacatgactcaactgctaacagcatatactagtggaaaggaaataacagtcaccttagctattatatatgatctcacaaactgtaacaacaaaaggtcctctccaatctccagcaacatatgcattacacggaatgcatcagtacaaaaaggataccaaggtcctggagactctatatgggcacagcatctattcaaatattcacatttctttataccaaaagcagacaatacgcaacaaaaccagcatatccgacagtaacatgcaaagcagaactacggcatagagctatcatagccttcacacagcctagtgtcttggacccatgctacaagaacgggataggcgcactggtgctggtgctcctccttctgctgcagaccctgcattgtatagcttcctgcaccctgggcaacgtgcatccgcctcaaggatcctcttgtggcagaagaggcaca

SEQ ID NO: 1297 - DNA, 551 bp, Hordeum vulgare
  UNSURE (20): n stands for any base
gtacccccgggcctgcaggnaattcggcacgaggcttcttgaccagcttgggattgacaaagaccgtctacgattccggcagcatctgccaaatgaaatggctcactatgctgctgattgttgggatgcagagatcgaatgctcttatgggtggatcgagtgtgttggaattgctgataggtcagcgtatgacttgcgtgcccactcggataaaagtggtgttccactcgaagctcatgagaaattcgcagaacccagagaagtggagaagttagttataaccccatcaaagaaggagcttggtcttactttcaaagggaaccagaaggcggtgctcgaagcattggaagccatgggtgaaactgaagctctgggtatgaaagcagctttagagtctaaaggggaggttgagtttaaggtctgtacccttgggagggatgttaccgtaaagaggaatatggtttcaattaacatggagaagaaaaaggaacatcaaaggaagttcactccatctgtcatagagccatcatttggcatagggagaattattt

SEQ ID NO: 1298 - DNA, 551 bp, Hordeum vulgare
tgcacacgtctcttccttttaatacacgagatgaacatgtagatacagtacatatcgacaaggaacggatgaaaaccatacgtgaagggaaaacgggactaggattacagggcaacgctccattagcatttctgttaacatgacacgcatccgaaactgcaaaagccaaatatcatttaacccatggaagactcttcgactgtacccttcaggtttctgaagcttcttcctcatcggtggccaaggtggtgtgtgctgggtatctccacatgatgtctgcccaggtgctctgcccatcggtcacttccttcacaaccgaagccacctcgtcgacctcaatacgaatttgatccttgctgtccctgtcacggatagtcacgcttgtagttgagtcgactgtgatcgccaaggggacgccgatttcgtctgtccttgcatacctcttaccgattgtagtgcctgtgatgtcgataatgtgagaaatccctgctgttgtcaaagcttttgaaattttcttggcgacaatatcaaatttctcaaccttgaccagt

SEQ ID NO: 1299 - DNA, 519 bp, Hordeum vulgare
gtagaaagccaaacatttatgacgtgacaattgatgaatcaagcatatcccagttgaccatcgaacagcttacacaaattgaaagaaaactggaatatgcactaagaaatgcaaagaccaggaagttggaagcctattcgatcgccacactacacgagaaggggaaagcaacgcttgaggagagggacttgatggaaatggtctccaggaaggagcaggcaagtggattgatccatcgcaattaatcataacaccgagtttcaccgcggagttgatgtcttgcatgtaaacagaagcaggaggggggaaggtatgtaactaaaagccagcaaagcagcagggaggtggatttgacgctcagcctcggcatcagcattggctgcaacgttggttgctcgcataggcaccaaaggccaattgacctcaacatgccgtgacacagacaatttcagcgggctcatgagttggatagttggagtgacgctgtatatggagcatcaacagtttctccagaatctg

SEQ ID NO: 1300 - DNA, 545 bp, Hordeum vulgare
aaggtacattactgattattagaggaacaaaatatggattcgtttcagtgaagatacatatcatggtactcatggataataacttgaatttggtggagatgtgcacaaatgcactctttgtgaagtcagcttatgctagtacaactgtacaagtgtacaaccgaacccaggatgaacgcattcttaatcgagccctaaacgcaatgggggtgaaaagctgtgcacatgtgcagtaattatgatagctagagatttgacttaagccaactcaaaatattcgcagcagattctggagaaactgttgatgctccatatacagcgtcactccaactatccaactcatgagcccgctgaaattgtctgtgtcacggcatgttgaggtcaattggcctttggtgcctatgcgagcaaccaacgttgcagccaatgctgatgccgaggctgagcgtcaaatccacctccctgctgctttgctggcttttagttacataccttcccccctcctgcttctgtttacatgcaagacatcaactccgcggtgaaac

SEQ ID NO: 1301 - DNA, 953 bp, Hordeum vulgare
  UNSURE (20),(789),(855),(866)..(869),(871),(877),(879),(880): n stands for any base
gtcttcccgggcctgcaggnaattcggcacgaggagagagagagagagagagagagagagagagagagagagagagagagagagagagagagagagagagagagagagtgtgagagagagagagagatagtgagagagagagagtgtgtcatagagagagacacacatatagatatagacacacctacctcttctcacgctcatgcatatcttcatctttaccttttgcgtctcgctcacccttctctttttagtttttctatttctatctctccctctcttttctctgcgttttttctcttgttcctcttcctgccgtgtgtgtttgtgtctgtctctctctctctctctctctctctctctctgtctctcactctctttttttccctctcccgctctctctactctctcttcttttttttatttttagagacccagatatagatacacatatagttacgatacacatactcatatttcccctgctctttttttctgtgagagagacagagctcccgcacactctctctctttgttataaatctctatctttggtcgctttctccccctctctcgcgctctcttctgtgtctatattcgcgctcgttctggtcgcttttgctctcgccctctctcgcgcactctctctctctttgtatctctctctcttgatatatcactctctcttgaggggtatatgtatctgttgttgtctaatcgcgcacgctctctctatatatctctctctctctatctcactccctctatatatatataaaaatctctgtngtgggcccgcccccccaaacaatcttttctgtgtggttcgcccctccccccccctttttttttttntttctctttcnnnncntttggngnngcaaaaaaaaaaaaaagtttgcgtgttgcggcgcccccccctcccctttttttttttttttctattgttatta

SEQ ID NO: 1302 - DNA, 478 bp, Hordeum vulgare
caaacatcactacataaaaccatcatgcaaaacttataactcaaaaacatcacatccaaactacgaggaagttcactccattgggctagcgccaaagccaccagcaccaccgccaccacggccaaagccacctgcgccaccgccgcggccaaatccacctccaccagagctcctgaatgatggctggaagtctgcaggagctccgcctttctcaccaccaaagtcaccaggtgcaccacgaggaccgccacggtaaccatccctgtcgccatatcttggcctgtcaccctcaaaacgaggtggccccctcgggcgatcaccaggtgggccagaaccgagtgggcggccaggaggcctggcagattttttgagcgtggcaggcacaatctcagacggcaggttgaggaagttgcgcaggaactcaatgccatcgttggtgaggtaccaatagtaatgctgccacgagaaggtctccctg

SEQ ID NO: 1303 - DNA, 95 bp, Hordeum vulgare
  UNSURE (10): n stands for any base
aaactttcanaacatgggcgcaggtacatgtttccttagctccattattccttctgagctgtcctgttggtcttacatttcattttttgtctgag

SEQ ID NO: 1304 - DNA, 548 bp, Hordeum vulgare
ttttattcctacgtatgatatacagagtagaaagaagcgccacagtagccccgacttccaaaaaggatgcaacttacgctatagaacatgtgctttagtgtttagtccctctctccaaagccgaaacaggcatcgtgaaagtgagttttcttctagagaaactcactaagaatctcattaaggattgaggcattcttcttcatcaaatctgtgagagcttcaaattagtccaaaggacatctcggaatcgaagatcaagaactaaggacggcgtccgagcaattggaccatgggtgccaatgagcccaaaagttatcctttcatgtccctgcaacatgtacttgttatactgcaatcttcattgtcatgacagcacaccatcagcgtcaatcttggcaagatgccccttaggcgagatccacttcttcgcctagtttgttcctctcctgaaaataacgactgcatctagccccgcagcgtagccaaaaaatagaggccatccagttatttgttgatgaaacacaaggacaacattggtgtttgaaatt

SEQ ID NO: 1305 - DNA, 517 bp, Hordeum vulgare
gggctcaagaaggaattgcagccttgagaaatagtgtggacactctcattgtcatcccaaacgacaagctgttgtctgctgtttctccaaacactcctgtcatggaagcattcaacttggctgatgatattctttggcaaggaattcgtggtatctctgatatcatcacggttcctgggctggtgaatgttgattttgctgatgtgcgagctataatgcaaaatgcagggtcatctttgatgggtatagggactgcaacaggtaagtcaagagcaagagacgctgctcttaatgccattcagtcaccactgctagatattggaattgagagggctacaggcatcgtgtggaatatcactggaggaactgatttgactttgtttgaggtaaatgctgcagctgaagtaatctacgatctcgttgatccaaatgccaacctgatatttggttctgtcatagacccatcactcaatggccaggtcagcataacattgatcgctactggctttaaacgcca

SEQ ID NO: 1306 - DNA, 523 bp, Hordeum vulgare
agctacaccattattggcagtaaccattcaagataaagaacagaaagatcaaacaaaactatgggaaaaaaaactctacggaaaacaactagactctaccgatctggtatcttacaagagggcatctaatctacgaggggcaagtatcatcaggcatatctgagaaagggatcctggggaagagtcaaattcgcaggaagcgagacggtcctctcttccgaaggaactcaggaatctccaccttgcttccacctgtggaagatggatctcgaccgttgtctccttgcatttgctggccaccctttgcggtgcgaccttctgcttcatcctggcgtttaaagccagtagcgatcaatgttatgctgacctggccattgagtgatgggtctatgacagaaccaaatatcaggttggcatttggatcaacgagatcgtagattacttcagctgcagcatttacctcaaacaaagtcaaatcagttcctccagtgatattccacacgatgcctgtagccctctcaat

SEQ ID NO: 1307 - DNA, 519 bp, Hordeum vulgare
gttgtcggcctacatgtgtggaaccaactatcaccagtctaactgtcttgagcagttcaaaaatgcttatgtgaaggagaaaccggcaaatgaagtatccattgcagtggcagcagctagcaagaagccaaaggatgtggagcttgcttgccctatctgccgtggggaagtgaagggctggacagtggttgaaccagctcgtcaatttctcaatcgcaagaagagaacttgcattcatgaagattgcttgttcattgggtcatacaagaaactctgcaagcatgtgaaggccagacacccttcatcaaaacctcgtgaagttgacccggcacgtttggctgagtggaagcagcttgaaagtgcaaaggataggcaggatgcaatcagcatagtcacaggcttgaatccagggtccatgattattggggactatcttattgaccccaatagtggcagcagcgattcttttatgggtaactctgattggagtgacgactctgactcttacacgtttcctgg

SEQ ID NO: 1308 - DNA, 551 bp, Hordeum vulgare
  UNSURE (18): n stands for any base
aatggtctgactaacttntgaaaagaaatgacacagagctgggttgtgattttccaggacaataacaccaatggctaaagcaatcttctgcctaacatacgctgcttctattctactttgataaaaggaaataaaagaaacgtcattcacagatctagcagcgcattcatcatcagagaaaaagaagtggcccaacaagaaaaaaaaacttttaaaacccatcctctatgaccaaaccagaaagaaacatgctaaaggattcatgaatagtggttccgccagaacagctctgatggcaaggtgctgctgtctgcttcctggcagatgaaatgctcccatttctcagctgtcatttgtggatcttgctcgtctcccccttggcatgcgagctgacagagcagaaccaatctgcggccatcgacgccttccactgcttctggagatggttggagtgcgacgctggacattttgccttggtcttgccccatttgtcctgtaagctctgcgaaccactcttcgtaatgatcggatatcaggagcttcagaaaaca

SEQ ID NO: 1309 - DNA, 232 bp, Hordeum vulgare
cttaagatgtgagacagtagctgcaagggacgaaacgatatttgatctgagtgttgacattgagcagaatagttccattacaagctgcctgaaaaatttcagctccactgagactttaaatgctgaggacaaattcttctgtgacaaatgctgcagtttgcaagaagcacagaagagaatgaagatcaagaaggctgggggtatattggtgatccacctaaagcgctttaag

SEQ ID NO: 1310 - DNA, 552 bp, Hordeum vulgare
ccaatgcatttgttacatttccttggtaagaatgtcggtgcaaagtatagtcgagcgtactttatgacttgcgccttatttcatcatcactggagcaaggttccattttccgctgtacactagaaccacaaaaaatctggctttcctcagttcgtactcacaatctctgagattaacaatttaccatggaggtgatgaaatagctgtgtacatacaacagtaagcttgcatgctccaaagaaaaaagaaaagaaaaacaaccgggaaaatcaacctaaactcttcccaccaaggccctcgtaaaacaagatgtatccatgatctgtgttgcctgagtactcatgcgaagaaccgaagaatgtttgcagggtcgactcttcaaccatctccacgttttcatcatcgaagaacagccagtggttgtggcttttaacgaggctaacataatggccatggttggggccgcttccaacatggaccactacagcaaagagagaatactcggtatctacatcatcagatgtactgcccatcttcagctccatggggaat

SEQ ID NO: 1311 - DNA, 518 bp, Hordeum vulgare
  UNSURE (11): n stands for any base
ccctctcaagntatagtagatgcgtctctggttgaaagttcaaaaaatggtgtcacagtaggcatttgtttgacatatgaaaatcagctggccatgaagaaagaggacacacaatggatagctggaagagatgtttggtggcaggatgttgtgcccaatttccctactagatgtgatgtggaatgggttgatgcagaggatccattgtttcttctgtacactagtggcagcacaggaaaaccaaagggtgtattgcatacaacggggggctatatggtatatgccgcaacaacatttaaacatgcatttgatcacaaaccaacagacatatactggtgcactgcagactgtggctggattactggacatagttatgtgacttatggtcctctcctgaatggagccacagttctcgtttatgaaggggctccaaactaccctgatcctggtcggtgttgggacatcgttgacaaatacaaagtgacaatattttatactgcaccaacacttatccgttc

SEQ ID NO: 1312 - DNA, 534 bp, Hordeum vulgare
  UNSURE (12),(24): n stands for any base
tactaatttttnctggtgctgtgnatccaacaatttacatatacatctcacttgacttgcaagctgcaacttctgccaaccccatggtactaaataaatcaagggaatcataagaccatgcgacatataaactgattctctctatttatcaccagaggcaagaaagaaaatgagacgtgctaaaagtataggtgacaacgtgccatctccatcgtcacaggctaactatcgctaagcgatatcagctggtcgaccacaccaggatcagcaagtgtgctcgtgtcaccaagctcatccagctgcctggaggcaattttccgcaatattctccgcatgatcttaccgctccgtgtctttgggagccctggtgcccaatggatcttgtcaggtgctgcaaacgcgccaatctggctgcggaccgccattatgaggctttttcgtagatcatcactgtaaggaacaccatccaccaaagttacaaatgcgtagattccctgacctttaacctcatggtcaattccaacaacagcggcc

SEQ ID NO: 1313 - DNA, 518 bp, Hordeum vulgare
aagagctgggcgtctacctgctgtccttcgaccggcctgggtacggtgagagcgaccctgacccggcaccgtctgagaagagcatcgccctcgacatcgaggagctcgccgacaacctgcagctgggccccaaattccacctcgtcggcttctccatgggcggcgaaatcatgtggagctgcctcaagtacatcccgcacaggctctccggggtggccgttctcggcccggtgggcaactattggtggtccggtttgccgtcgaacgtgtcacgggacgcctggtacgagcagctcccacgggaccaatgggcggtctgggtctcgcgtcatctgccatggctgacctactggtggaacacccagaagctcttcccggcctccagcgtcatcgcctacaaccctgcactcctctcccaggaagacgcgaagctcatgaagaagtttggaatgcgaacctacatgccgatgataaggcagcagggggagcactactgcctgcaccgcgacatgatggtc

SEQ ID NO: 1314 - DNA, 545 bp, Hordeum vulgare
  UNSURE (16): n stands for any base
gtgaagatgcccttcnggcttgttatttattggctcccccgaagagcatggctccaaaacctcctgtggtccaagtcgccggcggatcggcagcatgcccggccgtctgcctcattcacggcccccgggtcacgagtccgttacgaggccagctgccctgcccagcgaccctgacccgggaccggatacaatacatgctcccaatgggagacactgttttctgcacgatctatgcatgtgttccagaccgaaagaaacacttttattcggtgcccgtgacgaggagctaaccacacggcgcggcaagcacctgcacaagaaccatacgcagagaactagagatagatgatggggagtggaaggtcagtgctccccaaccagcagggacttgacgatggcgtcggccatctcctgtgcaatggggaagaggtgcccggactttgggagctcgtggtagaccacccacgggagcctctcgctgatgtacctggacaagatgaccggcacgatgcgatcctccgcgccgtgccacaggtgcaccttgc

SEQ ID NO: 1315 - DNA, 403 bp, Hordeum vulgare
atagccacgcactaggcctctccatctcgtcgagcacttcattaatcgcacccatgtccatgcaacaacaacagcaacaaccgacgagtgccaaccttctcggcgccatgcctgcgtcctctatgatcagcatcgccttcacggccgccgtgggtaccgcggtcttattcgtcgccgtcgctgtggcgaggtacaaccggaagtacagggggctgaggctcccgcccggcccgcccgtgtggcccatcgtcggcaacctcttccaggtcgccttctctgggaagctcttcatccactacatccgcgacctgcggcgtgagtacgggcccatcctgacgctgcggatgggggtgcgcacgctcgtcgtcatcagcagcgccgagctcgtgcacgaggcgctcgt

SEQ ID NO: 1316 - DNA, 432 bp, Hordeum vulgare
tttttttttttttttttttaaaatagaaataagttcttcaattcaaaatcatacaaactcgcgtgctgcatatgttgatgtgctatacttcgcacacataatacaagtctgtataccgtgcacgtagatacacgactacagaaggtatatatatctatagcacactaggacactttttcataatgctggaatcggtaggcatggtactggcacatgtggctttacgtgctgatctaacggcccgagtgattgcgatgcatgcattggacgtacgtaggtacgatcgagagacgtacgagtacgactgccggccacccccgatccacatgcatgcatgcacgtgcatcagagcgacatcttccgaggcttcaccgtggccagcagcggctggttcatcaccaccgtgaactccaccttatccttgaagtccac

SEQ ID NO: 1317 - DNA, 531 bp, Hordeum vulgare
ggcaattcggcacgagggcctcttctctttctacgaggacggacaccaggagtgctgcagggtgaggaaggttcggccattgaggagggccctcaagggcctcaaggcctggatcaccgggcagcggaaggaccagtcccctggcaccagggcgagcatccctgttgttcaggttgatccgtcatttgaagggctggatggtggagctggtagcttgatcaagtggaaccctgtggctaatgtggatggcaaggatatctggaccttcctcaggaccatggatgtccctgtgaacaccctgcatgctcaaggctacgtctccattgggtgcgagccgtgcaccaggcccgtgttgccggggcagcacgagagggaagggaggtggtggtgggaggacgccacggccaaggagtgcggtctccacaagggtaacatcgacaaggaaggtcagacacccaaggtcggcgtcaacggcaacggctcggctgaggccagtgccccagacatcttccagagccaggcaatcgtcaa

SEQ ID NO: 1318 - DNA, 517 bp, Hordeum vulgare
ctgatcggatcctttggacatggcgtcgcccatgctctccacggcctggcgccactccaggggggcatgctggagttctccgggctgaggagctcgtcgtcgctgccgctccggcggaatgccacctccgacgacttcatgtccgccgtctccttcaggacatacgcggtgagcacgagcggcgggtcgcggaaggcgccgacggaggcgaagctcaaggtggcgatcaacgggttcgggcgcatcgggcgcaacttcctgcggtgctggcacgggcgcggcgacagctcgccgctggaggtgatcgccatcaacgacaccggaggcgtgaagcaggcgtcccacctcctcaagtacgactccacgctgggcatcttcgacgcggacgtcaagcccgtgggcgacaacgccatctccgtcgacggcaaggtgatcaaggtcgtgtccgaccgcaacccctccaacctgccgtggggcgagatgggcatcgacctcgtcatcgagggcaccggcgtct

SEQ ID NO: 1319 - DNA, 552 bp, Hordeum vulgare
  UNSURE (20): n stands for any base
gtacccccgggtctgcaggnaattcggcacgagggagagcttcgtgccctccaatcggcggtcggcgcacgctctatctgtttcgcggatcatctatttgtgaagcagtcattggttgacccaacttggtgattcacagcggcgtgctcctctgtgtttcgccgctcgctgtaagaattttgcttctgccggcggatccgatctaacgccacttttgctgttgtggcgtattttgcagacccggctgcagcgatggagaaggaggcgagcagctccagcgacgtgtctgcttctcatgtaggccgtgttaggaatcgtaagcgccctaatgaggtcatgacagacgggaataaagccaatggacagactttgcttgtcagcgaccggaacaagtataagtcgatgcttatccgtacatattctactgtttggatgattggtggctttgcattcctagtttatatgggtcatctttatatctgggccatggtggttgtcattcaaatattcatggcgacagagctttttaacctactcagaaaatccagtgaa

SEQ ID NO: 1320 - DNA, 559 bp, Hordeum vulgare
  UNSURE (28): n stands for any base
gcacctaatttaaattagttagccctantcaaccatagtcatacattcgttctgtacaatggttttccatcacaactcacaagggtacagaggagctccgacgacgatgctgtacacggtgaatctagagctacattcatggcggcgaactcaggtctcaaataaataacatacacagccagcctactgtatcgtattgtgtgcttttcataagcaagcagacagtttatcagctttgcataagttgcctaacatctccccgagttgctcatacaagtttctctgctcctcgtacgtcaggtttcttaagatctgatccaagattgcgtcaacagagaaattgtgcggtgagatgaatgactggtggtatatgtatgcaaaaactgccatgaccatttgacagtccattcggtcagtgattccaccatgcccaggtatactgtcgccaaaatcctttattttaaaagccctcttgaagccacttgcgaaaaatccaccaaatggtgcaattatcgatgcaaacaaaccaagggctaaagcatgccactgcacaggcatt

SEQ ID NO: 1321 - DNA, 548 bp, Hordeum vulgare
gggctgaggaattcggacgaggcctcgtgccgaattcggcacgaggatggcggtcctcatatcttccattgcttccaaagccttggcgctgtacacttcagagatttctcggcatcgaaggagcgcagtttccctcgcatcggctcatcgcccgcgaatccttgccatgaagttctggggcgccaaccataacctgccgatcaggacagcaacacaaatccccgtagctgttccaggccccgaaaatttgccgagaggaaatctccctgtgcccaacatgccttcatggatgaccttggtcgttggtgccgtgcttgttgcgatacctatttacagaaagataagagcactggaagataaggtggagaagacggcagaggtggcggtcgaggtaatcgacacggtggccgaagctgccgagaaagtcgccggcgaggtggccgaggcgtttcccgaaaatgaagggctcaaggaggcagcatccaggatcaagaccgtcgccgatgcgatcgaggaggacgccgagaaagccgaggcactaatccata

SEQ ID NO: 1322 - DNA, 530 bp, Hordeum vulgare
tttattcctgccttgacttgtattccaaggatgatcatgtactcctatatatatgcccatgagactcaagcaatataataactattctaccagtccctctattcccttccaacaaatatatatacgttttccaaaattttgtaacaaaaccaaaactcatgactatgatacaagagccaaatgataatgacaaactcgaggtgttactgggtacttatcatcattgtatatattgttatatacactctgtgcattcgaacgattgacaactagttatatctattcgcaggtaagacatgtttcttatacgttatccgtttctttcctcttgggttctttatctacgactcctcctctttctcccttctccttcatgaccacgtcgatgataggaccgaccacggaatccacctttttcgttatctcatcaaccttatggattagtgcctcggctttctcggcgtcctcctcgatcgcatcggcgacggtcttgatcctggatgctgcctccttgagcccttcattttcgg

SEQ ID NO: 1323 - DNA, 497 bp, Hordeum vulgare
tcctgaaagctgcaacctccccctttcggcgaatttggggtttccgaagcgcgcgaggtgagccaaagtttcgctcatggctcgtactaagcagactgctcgtaagtccactggaggaaaggctccaaggaagcagctagccaccaaggctgcccgcaagtctgctcccacaactggaggagtgaagaagcctcaccgttaccgccctggaactgttgctcttcgtgagatccgcaagtaccagaagagcacggagctgctcataaggaagcttccattccagaggcttgtcagggagattgcccaggacttcaagactgacctccgcttccagagccatgcggtgcttgcccttcaggaggctgcagaggcctacctggtgggtctcttcgaggacaccaacctgtgcgccattcatgccaagcgtgtgaccatcatgcccaaggacattcagctggctaggaggatccgtggcgagagggcttaagctgctttgc

SEQ ID NO: 1324 - DNA, 549 bp, Hordeum vulgare
caatactaatcctcgaacataaatgaaggttcagatagaacccgccatgtggatgcttcaggacgaccaacgaacaaatgatccagctctagaacatagtacgacacagaatatagtactgacatattactacagacgactaatattagtagttcacgacacatgataagtgttcagcagcaaaagcagacacacggagctatgcccaccagagccattcccacaggcaaagcagcttaagccctctcgccacggatcctcctagccagctgaatgtccttgggcatgatggtcacacgcttggcatgaatggcgcacaggttggtgtcctcgaagagacccaccaggtaggcctctgcagcctcctgaagggcaagcaccgcatggctctggaagcggaggtcagtcttgaagtcctgggcaatctccctgacaagcctctggaatggaagcttccttatgagcagctccgtgctcttctggtacttgcggatctcacgaagagcaacagttccagggcggtaacggtgaggcttcttcactcctcca

SEQ ID NO: 1325 - DNA, 412 bp, Hordeum vulgare
caggaaagttggatgatgttcaggtaaaattctcagctttgaccaaagcatgcaacatttctgtcagcaacaaaaaagacgagtctgcagtgccagaagttatcagcagtgcttcagttagaagaaccagcgaaatgcactcaactgaaaggaacagtataacttcggccgaagatctgcaacaaaatgaacaaaagacctctcttcttgagaatgttgttaaagaaaatgttgattcatgtacagcagaaaacgataagcagaattcttcacaaccttctgttcagtatttcttaggtagtgcagcatcgcatgagaaaattaatttgctcaagtcagacataagcagtgctgcttgtgaccagaagaggtctgttcaagatggagttaaagtaaatgatagtttgtcatc

SEQ ID NO: 1326 - DNA, 425 bp, Hordeum vulgare
ttttttttttttttttttggtacgtacatactaaatccgcgtcaaatataatgtgacgggagccgttataaacaaacaataagtttgccgagcaatgatcgatgctaggtaagtagtcaagtggtacagcaatgttctcctacatactagaacattcttcctagcttacgggttactaaagatagagagactgctggtcagcttatacacatcactgactgccaagggcgaaacggaggccagcagaacaacggtaatgacatattgccactacttcatcaaatgcaatggaaggctatcttaagccgcgctgcggaacgggcgccggaaggacttcaggtatgttgaaggacagcttccgtgcaaaaatttctctagggtttaatgttttgttggatagtaagatgttatccaagttttctttc

SEQ ID NO: 1327 - DNA, 352 bp, Hordeum vulgare
acggcactatatagctgtcgctgacctcctggcttctccccattcctcgtccaaccgctttggtctagttcgtctatcggctagcgaaaaccaaagagttcatcagaagaacacaaaggatttctaagaggatcgtgtcgatgacgtcgtgcgccgatttcgatgcgctccgggcgtcggcagcggacgtgcagatcgtcacgtcggacggacagagcatcgcggctcattcctgcgttcttgcctcggcgtcgccggtgctggagcgcatgatcgacagggcgcggcgcgggtggggcgccgattgcacagtccgcgtcctcggcgtctccttcgacgccgtccgcgcctt

SEQ ID NO: 1328 - DNA, 423 bp, Hordeum vulgare
tttttttttttttttgttaatctagctttgtttgcagcacccatgtactgtagagaattatcgaaaaatccagtataaacatcatccgggcatacctatagcctgactatataatacagcttgattcactactttgctaaatttagacctacaagactatgcagtatactaagttgggaacgggcatgcttgattatcttctcatctcaacttggccactctgccgttgtacctcgcccatgactcagccacaacctccggcaccaccttcctctccgccaaggaggacatcaccttcgctctcgtcaccttcttcaccagaagccgccatgtcttgtccgctttctccgtctgcgccttggccttgaaatggctgcagagcggcacacggcaggcctggtctggccggtggcagacggaggc

SEQ ID NO: 1329 - DNA, 516 bp, Hordeum vulgare
tcctgatctcccccgtttcttggctaaatccggcgcgtacgcctccgtaattgcaatctgggggagcagattgcgaacccgcctctcctgaagcccttgatttcctgggtggtcgtggctcgcgcgccagctgctcgacgcaattccgctgcagaatcctctctgccatttggagtcgcgcaggtggtgacggtggtttgtatggcgtgtgcgccaaattatattgccactggccttgccagctatgggttatatacgggggcaagggtactctcaccaagctacaggaacttcccgcagaaatcctcttacaagtttctcaaggtccgtgccctgcagggaaatgacggtggtagaaggctgattgacataatccgaatcatccctgagctgtcaagaaactatttcaaaagcgggtccaggagagctctttttggcggcatcgcgctgctgggtggcttttatgttgcgcagacaatatccctgtcattcggtgccttggccgtgaacgatgtt

SEQ ID NO: 1330 - DNA, 554 bp, Hordeum vulgare
ggaaatttattctgagaatatgaacataaactacacacttgccatgcagccctgcacaatgggctaagctacagagtacagactgcctgcaaatcaaactatgcgctagactggatagccacaagtaccacagcttgaattagctaacaataatatcaaaacaaagctctactcacaactaggatagccagaagtatgccttgacgcaaaccagatatcaaagctgaactcgggctacaaactggacctgcagtatcatcacacctcgttctatgccagcaatgggccaatgttcacatggaaatacaagaccaaaaaaggaatgtatccctgtaacacatcacatggtgttgcgttttttcaccatctttgcctacttactgtgatgaaaatgcatgtgaagcaccagcaggaggtaacgtaaatcagctggcaagcttgaaggcatcaatgaaaaggccatatgtgaagcccatcttgaaattgttgaggagtgcgacggcgaaggtaaccttaggtcggctgtagtagaactttgtgacatactcggtcag

SEQ ID NO: 1331 - DNA, 504 bp, Hordeum vulgare
acgtggcttacagtgttaaacattggaccgcgtatctctaaaacaaaggttgtagacgcacctgagatcctggctgttatcggcaaagtacctcacctctcggaatttctcaattccctctacgattgtcagtacaagtcattttttgtggcattctctggcctgacggagcagatcaagttagaccgatacttgcaaccacatttccgctacttcatgcgtgaagtgcgcactgttgtctattcgcagttccttgagtcatacaagagtgtgacaatggaggcaatggctgccgcatttggtgtgacagttgatttcatagaccaggaattgtcgcgctttattgctgctgggaaacttcactgcaagattgataaggttgctggtgtcctggagacgaaccgacctgatgcacggaatgccttctaccagtcgaccatcaagcagggagacttcctgctgaatcgcatacagaagctgtcgcgagtcattgacctgtaggct

SEQ ID NO: 1332 - DNA, 550 bp, Hordeum vulgare
atggatgaattactcgtggaaacacgctctaaaacaatggtctgcaattcccttgatccatatagttaggttacaagtcaaatcctcagatttttaaaaaaaaactacccctctttccctttgatcgatttgaaacgcaaaatgcaatactgccagtactccgcaggaaccaaagcaaagtcttgtaagggaagcttgggtagggtagggttgtgccaaggagctgctccaaacctcacaaagaaagcctacaggtcaatgactcgcgacagcttctgtatgcgattcagcaggaagtctccctgcttgatggtcgactggtagaaggcattccgtgcatcaggtcggttcgtctccaggacaccagcaaccttatcaatcttgcagtgaagtttcccagcagcaataaagcgcgacaattcctggtctatgaaatcaactgtcacaccaaatgcggcagccattgcctccattgtcacactcttgtatgactcaaggaactgcgaatagacaacagtgcgcacttcacgcatgaagtagcggaaatgtg

SEQ ID NO: 1333 - DNA, 528 bp, Hordeum vulgare
aaggaaggaagacgaagccaggccagccatcctccagttgcttcctcgcgccgagcccgaatcctctcccctcgcgccgtaccagagggctccgccggagatcgaggagacccgaccctagctggagatggccgccgccgtggtgaactacccgctcgtcgcggggctcctcgccttcgcggtcgcgcagtccgccaagttcttcaccacctggtataaagagaagcgttgggatgccaggcaatttatagcttctggagggatgccatcatcacattcagccacagtgacagcacttgcagtgtctgttggaatccaagaaggctttcgtagtgccacatttgcaacttcagtgatacttgcatgtgtggtgatgcacgatgcttttggtgttcggttgcacgctggaaaacaggcagaggtgttgaaccaaattgtctacgagctgcctatagagcatccactggcagagacaaagccattgcgtgaaattcttggacacacagtccctcaggtggtggctggttg

SEQ ID NO: 1334 - DNA, 552 bp, Hordeum vulgare
cgttaagcatttagaaccttcatctctgaagtttacatgactgctagttgtacaacaaacactcaacatgaggaggttctgaccgacggcaaacatctcagatttacagcaccaactgaagctacgacctactatcctacagcgcagatctaaatcagtcaagactttgtagcagcagcatggacaggccacttttacacattacatccaagatgagctttcattttcatgctttacaagatcggcgatacgatattagatgatcaaatattgccgatatttaaatgtaactccccagaactaagagcatgatcacagccgtgaggattccaaggatgcaaccagccaccacctgagggactgtgtgtccaagaatttcacgcaatggctttgtctctgccagtggatgctctataggcagctcgtagacaatttggttcaacacctctgcctgttttccagcgtgcaaccgaacaccaaaagcatcgtgcatcaccacacatgcaagtatcactgaagttgcaaatgtggcactacgaaagccttcttgga

SEQ ID NO: 1335 - DNA, 518 bp, Hordeum vulgare
cctcgtgccgaattcggcacgaggactcctaaaccctagcgcctccgccccttccggcccaaacgcgttagccatggcgccgacagacgccgccgccgccgccgccgcccccacccccgcagtttccctcgacgataccaaggcaaagaatgtcctccgccaggtggagttctacttcagcgacagcaacctcccccgcgacggtttcctgcggaagaccgtcgaggaaaacgaggatggattggtgagcttggctctcatctgctccttcgcgaagatgaggtcgcaccttggcctcgatgccaccgtgaaggaggacggcgtgcctgagacgacagtgcttgcggttgccaaggtcctgcggtgttcctcggccctccgtgtctccgaggacgggaagagagttgggagagctaccgagttgttgaagccagatgagcttatagtgcaaattgactcaaggtcaattgctgtgtcaccacttccttacaacgtaaagctggaagatgttcaatctt

SEQ ID NO: 1336 - DNA, 556 bp, Hordeum vulgare
  UNSURE (31): n stands for any base
gcccgcatataaagggttttcctttcccttncattcccattgtcaacatggctcatcacacattcgacgttcagactttaaagagcacaggtaaaatttaaagcagacacagaaaaaaggccgcctcccaagctgtggaggcagcaagcaggcacgggcgacatatcttgcttttcctcactagggctaaaagatggtataagccgatccaggctatctaaggagacgaatcgagcttttggactttgttagccctttctttgttgtcggagtggcgaccaccccgcttcccaccaccgtggtgccttccgccgccacctctgttgttcttccagtcccttcctcccctgttgcttctattattgctattgtatctcccttggccaccctttatttcactccaataatctttctcagcttgtccagacacaggttccaaggtaacaaggcggcccttcataatcaaaccaccttcatccgcaagagctgcaaatgcacgggccttttccacagccgtcgattcctcaaacctaaggtatcctgaatcatccccctt

SEQ ID NO: 1337 - DNA, 516 bp, Hordeum vulgare
cgcagtccccgctcaccgccgaccggggagcttgtcgcggcgcggcgcggcacggcggagccaagctctactcctcctcccgtacctttctttcctctccctcccgagtcctcccgacctactgacgcggctctgaatctctcatatagcatataccacaggctacagctgacgcctcgatcccgcccccgcccccgcccccgcccccagacgacccgccgtcaccgttcttcctcgccgggacgtcgcgttccggccttatccaccccgtccgcagtctttggccattgggttttgaggtttagctctagttaattcaagaagttggaaacatgagctactgccaagctacaacgtacaagcctcttggtgggctcactttggacagaccattaggtcttgggagaaattgcaaaatacttcctcaacattctgtatggcaacatttttctagatcttgcaagctggaagagaaagtatatccaaggcttgttgttgctgcttgccataagaggc

SEQ ID NO: 1338 - DNA, 541 bp, Hordeum vulgare
agacttatatttaaaaatgaagggactagtacagtacataaagacaacaacaaatggaaaagtaatcttgcaagtctctgcagttaactcaaataggctagacagactgaacaaccatggcccacgcgagagcaaatcacacagagaacaccacaaaacattctttatagataccagtacacttctttgccgcattgattcactggcagtacttgggcctttgcagttctgatccatcagactcagcattcaagctgccagctgctgcagcaccccattgacgagcagagcagacgatcatagcaaatgatgttacatggccttcaaagctgacaagaattaactcctgcccctcctgttctgtagtcaatacagaccagagacagcacggcatcgtatgaatgaatttcagtactctaggcgataatcaccatccgccaggaacaacagctgatcgtttcgtcgcgtcgattttacttagcactggcatatactgctgctacatgattagagacataagtttctgaggtggaaattctaa

SEQ ID NO: 1339 - DNA, 1417 bp, Hordeum vulgare
  UNSURE (21),(826): n stands for any base
ggcgggcggctcggttgttgngcgtctgtgtcccatcggaacacagagtaacctcccgggtgctgacaggccactttaggtcacgcaggggtcgcaaaagttaggccatggactggccgggttccggaggtcgatcaattgtcttgctcgaccgtgcgccattaaaccgctgtacgctcgctatcacatcgcgcacacccgctgaggaggaacgcaatagctgacgtatttctgtatttggcgaaggcatggccatccgcaccctgcggagttcgcctgcacgacgcacgttagtgtgaccggctcgcgagtaaacactgcgcaaagtgtcgacctccgcagcctctctagatgtcgcagcaaagcgagcggactagcgcagctctgcgtgctccgatgcatagtcatcacactcctccagtactagtctcattatcatagcacaccccttctgcttaccgacactgttcaccagtctcacgtcctcgacctcacacccctagagacagggctgctggtaatgtgggtccgtgctggcatctttgggtatgaacagagccatagtaagttcgcatgcaaaaagccaaaatcgacgccgtctctccacgcaatataggcctcgtccaattgttgggacacaagactggtcgtcgttttcaatggtgtgtgtggtcgccactagtcacgagcacgcgcgacactgtagatatcgccccctcaattattgctctcgtgacaccacgcccacagtatatatataagaatccggcttcgtccaccgatatatacgctgtgaataacgtttaccgcaccaccctgtccctgnattcgttgccgaacgccgcacgcgcgtcgttggtgcctcaagtattccaccgcgcttacgcggttacatacgcaaactacatcacataatctcagcgccaccttgtagtgtagtaatcgccactgtgctgcttggtcagttctcgtcggcacgatgactcgtgcgacgtggacatttagcaccgcgcgtgccgagatacgtggattgatattttagagagcatagtcgtgtcgttgttgctgtgtcgcgcattttgtcgcgcgatggggacagtgcgcgcgtgttgttgtaacctacgagtcgaaaagcgcgccacgatggaattgactccgccgtgtaccgatcaatgatttccaccagttccctcgagtctcttgccttctgatgtagcagatatacattgttgtgtatgcatcgtcactatatctaccccgcggcaccacgcataatttctccatcgtattgtgtttgtggagtacacagcagtctggtcgttaatatgttgtgtccagaataggcttgtacgacagagcggcaggaccacgaaattacagtcgcacgcgctccgtgtctgttcctctccccatcccg

SEQ ID NO: 1340 - DNA, 755 bp, Hordeum vulgare
  UNSURE (1),(2),(39),(594)..(598),(605)..(755): n stands for any base
nntctaaaaagacttatatttaaaaatgaagggactagnaaagtacataaagacaacaacaaatggaaaagtaatcttgcaagtctctgcagttaactcaaataggctagacagactgaacaaccatggcccacgcgagagcaaatcacacagagaacaccacaaaacattctttatagatgccagtacacttctttgccgcattgattcactggcagtacttgggcctttgcagttctgatccatcagactcagcattcaagctgccagctgctgcagcaccccattgacgagcagagcagacgatcatagcaaatgatgttacatggccttcaaagctgacaagaattaactcttgcccctcctgttctgtagtcaatacagaccagagacagcacggcatcgtatgaatgaatttcagtactctaggcgagaatcaccatccgccaggaacaacagctgatcgtttcgtcgcgtggattttacttagcactggcatatactgctgctacatgattagagacataagtttctgaggtggaaattcgaaggcaaccgtggaatgctagggtttaagattcctgggcatgtggnnnnnggttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1341 - DNA, 477 bp, Hordeum vulgare
cgggctgaggaattcggtacgaggatcatcccaaggagttgtattggtaaaattcaaagaccgcaaagatggtctcaaatgcgtagagaagatgaacggaagatggtttggtgggaggcagatacacgcgagcgaggatgacggttcgatcaaacacgctctcatccgtgactacgacgctgaggtgtcaaggctggagcgctttggagaagagttggaaggatccacatagcaagtttttcggtcgcccggcagtttagggctgttttgtagctgatagcgtgaaattatacaagaacaaaacctgaaaagggcagctcggtcatctgttcgtccgattattcatactatatgactgcttctgggttagctttaagcagcggagttgttacatcagctaaagtttgtcctaatgtactcccacattacagagattgagcatttttgccatgctaacatgtagtacaaacttgcttt

SEQ ID NO: 1342 - DNA, 445 bp, Hordeum vulgare
ttgtactacatgttagcatggcaaaaatgctcaatctctgtaatgtgggagtacattaggacaaactttagctgatgtaacaactccgctgcttaaagctaacccagaagcagtcatatagtatgaataatcggacgaacagatgaccgagctgcccttttcaggttttgttcttgtataatttcacgctatcagctacaaaacagccctaaactgccgggcgaccgaaaaacttgctatgtggatccttccaactcttctccaaagcgctccagccttgacacctcagcgtcgtagtcacggatgagagcgtgtttgatcgaaccgtcatcctcgctcgcgtgtatctgcctcccaccaaaccatcttccgttcatcttctctacgcatttgagaccatctttgcggtctttgaattttaccaatacaactccttgtggatgat

SEQ ID NO: 1343 - DNA, 550 bp, Hordeum vulgare
gtacccccgggactgcagggaattcggcacgaggcttctaagagccttggtggtaagagcaagagtggcaagaacaggacatccggtgccggctccaaatcaggcagctccagccgtggtgtggacgatagcaacatttggacgtgtgatcagtgtacatatgtaaaccccagatcggccaaggcctgccaggcttgtgaccaccaacaccgatagcagtagtcagtccttgtttaacatctcagctccgtcagatcgagaagaatcctctcaggtcatacacctgtggtacccaacatatgcaaacatagttgctaaggatatttgggctactggagtgaggaggcattagtagagtgctgcatacaaagggacgaggttttcgtgtatctgcattgtttgtccactgactgactgcaccttagcctcgggggcaccatccagttcgttgtgtacataaactatatctgtaactctgttttgtttcgtcgatgtagggtgtactgaggtgtgtgctccaccagagaacaagttcttttctttttgtaat

SEQ ID NO: 1344 - DNA, 551 bp, Hordeum vulgare
gtaatgcattattgaaagattcaacagcattacaaaaagaaaagaacttgttctctggtggagcacacacctcagtacaccctacatcgacgaaacaaaacagagttacagatatagtttatgtacacaacgaactggatggtgcccccgaggctaaggtgcagtcagtcagtggacaaacaatgcagatacacgaaaacctcgtccctttgtatgcagcactctactaatgcctcctcactccagtagcccaaatatccttagcaactatgtttgcatatgttgggtaccacaggtgtatgacctgagaggattcttctcgatctgacggagctgagatgttaaacaaggactgactactgctatcggtgttggtggtcacaagcctggcaggccttggccgatctggggtttacatatgtacactgatcacacgtccaaatgttgctatcgtccacaccacggctggagctgcctgatttggagccggcaccggatgtcctgttcttgccactcttgctcttaccaccaaggctcttagaagcctcgtg

SEQ ID NO: 1345 - DNA, 159 bp, Hordeum vulgare
ccattcggcacgagggggtggagctgcccgacgacgacgacgaggactacctcatcgttcccgatcttggatgagatatctgaactgaatgtatagttcgtatgtgtgatgtattccctccgttccaaagtacttgtcgtgtcttagttcaagtttgtc

SEQ ID NO: 1346 - DNA, 400 bp, Hordeum vulgare
ggtcagtacaaagtatattacactgataaacccatctcgtttgtgaaagtatttccccgattcgccctgcagcttcatatgttccacggcaaccaagcgatcggcacaaaaggattgcagaatccctttgcatacatacacacatacatatcactagtttactcatacttcatccgttccaaaatatttgtcgtgcttttagtacaaatttgaactgaaaccaggtattttggacaaacttgaactaagacacgacaagtactttggaacggagggaatacatcacacatacgaactatacattcagttcagatatctcatccaagatcgggaacgatgaggtagtcctcgtcgtcgtcgtcgggcagctccaccccctcgtgccgaattcggcacgagg

SEQ ID NO: 1347 - DNA, 520 bp, Hordeum vulgare
cggccagtgaatactgcgacgacagcaatcacccggagtggccgtgcacctcggggaaggggtactacgggcgagggccgctgcagctgacgtggaactacaactacggggcggccggggagaagctcgggttcaacgggctggacaacccggagacggtggcgcaggacccggcgttgacgttccaggcggcgttctggttctggatgaccaacgtgcaccaggtcctgccgcaggggttcggcgcgacgaccagggcaatcaacggttacgtggagtgcgacggcaagaagccagacttggtgaacgcgcgggcgggctactacatggactactgcaagcagttcggcgtcgacccggggaacaacctcacttgctaggtctgaattgatcgacgcgcaaaaacctttctagcgatgctcgtactcctctaccgccctgtgtattcggggatctctatacattctccgcatgtaatttggatttctgtattaagatataggtaatataaacatagtaa

SEQ ID NO: 1348 - DNA, 527 bp, Hordeum vulgare
  UNSURE (29): n stands for any base
ttttacttatgtttatatttacctatatncttaatacagtaaatccaaattacattgcggagaatgtatagagatccccgaatacacagggcggtagaggagtacgagcatcgctagaaaggtttttgcgcgtcgatcaattcagacctagcaagtgaggttgttccccgggtcgacgccgaactgcttgcagtagtccatgtagtagcccgcccgcgcgttcaccaagtctggcttcttgccgtcgcactccacgtaaccgttgattgccctggtcgtcgcgccgaacccctgcggcaggacctggtgcacgttggtcatccagaaccagaacgccgcctggaacgtcaacgccgggtcctgcgccaccgtctccgggttgtccagcccgttgaacccgagcttctccccggccgccccgtagttgtagttccacgtcagctgcagcggccctcgcccgtagtaccccttccccgaggtgcacggccactccgggtgattgctgtcgtcgcagtattcactggccg

SEQ ID NO: 1349 - DNA, 517 bp, Hordeum vulgare
agatagctagctagcagagatgagcagcttggccctcttcttgccgagctcctcctcctcctctccgttcctcacaaagcaggcccaccctaccaaggggagggcgcctacggttgtgaggtgcggcagtgggccaaacctgtcagggtcacatgaagaggaggagcagagagagggggtgatggccttggttgggaggaggaatgcactggcctctgcagcagcagcagcagcagcttgtggagtttcggtgcttggttttgcaggtgatggcctggcggcggccaagcagggcccactggcagggaggatccctgggctgtctggccctgatcagaatggttggagaacataccgcaggccggacgaaaagtctggcggacacggcgtcggctggagccccatcatcccctacagcttcaaagttcctgatggctgggaagagacgccggtctcgatcgctgatctcggtggcacggagatcgacctgcgtttcggaaaccctaaggagggccgg

SEQ ID NO: 1350 - DNA, 543 bp, Hordeum vulgare
aaaccttcaatgtatatttatgtgtttaggcctggaagttgttatatgcgccctgaaggtgcttttaggtctgaattcgtactgtaactagaagaggaagcttacatacaatgttcagtttcttcagctagaaaatcattgttacaaatgatgtgtacttagcctccctttacataacggcatccctcatcttctctaataatagaacagattatgtgatgaacgaacccagtggaaccaccctagactacgcggaatgattctgctatttgcttcagatccttgtaatgcctcttccattgtagcccgtttgcagttacgctgaacaggtagagcctattcccagcagccgtagctgtgatgaagatatggggtggttccagctcgaactggtagtaagttcttccggagtactctgctgtggctgtggacaaaaccttcccttccacattctcgccaatgacctccggtccaaaggcgttgatcaccttctccggcgtgccgatcttctcgatcgttgcatcgtcaaggtcatctgcaaac

SEQ ID NO: 1351 - DNA, 227 bp, Hordeum vulgare
ttttttttttttttttttttttttttttttttccgattaaaaaaattgcttatttataagttgggacagattttctccaaacagtacgctcattggggcagacgcagcaaaccacctagagctaatagtttattcagagtagcaatagcctggccggctgcttcacagtaaccaaaacgacaaacggaagtcagaacgaattccacagacggaacagcgacagcaaa

SEQ ID NO: 1352 - DNA, 356 bp, Hordeum vulgare
ggggcgtcctcatctaccagagctttaccgcgaatgaagaggttgctgtctccgccgggtcgcccaggtccgtcttccactgcttcgagggcgagaatgtggagagcggccaccctctggtcaaggaaggcaagcttgccaacctgctcgcatggcgggcggaggaggattctctggaggagggcggggtgctgtgcgagtgataagatgatttttgctgtcgctgttccgtctgtggaattcgttctgacttccgtttgtcgttttggttactgtgaagcagccggccaggctattgctactctgaataaactattagctctaggtggtttgctgcgtctgccacaatgagcgta

SEQ ID NO: 1353 - DNA, 517 bp, Hordeum vulgare
cgctaactcgtcgcacaagaatttcctcccaccccccaccgcctcgccgccgccaccgcagccagataagaaaagaagaagaaaagagagagaaggactcgtcgggagggctcgagatctgtgtcgggagaggggggaattcttgagatcggaaccggaacaagtgggcgcgctcgggaaggggttaccataccaatttttcgcaggaacccttagtgaatgttctaatggagtcaaagggtggcaaaaagtctagcagtagtagttccctgatgtacgaagctcccctcggctacagcattgaagacgttcgaccagctggaggcgcaaagaagttttctgctgcatactcaaactgcgcgaagaagccatcctgatatcgtttttggctttccccttcccgtagtttaggatttttatgcaattttattctgactcttttctcccaccaatctctctggcttgctgcttcacgataatcgaccagttctctagtctctctccctctgttcctctc

SEQ ID NO: 1354 - DNA, 558 bp, Hordeum vulgare
  UNSURE (21),(24),(34),(35): n stands for any base
attaaaatgccttatttatanagnttgtggacanngattttctccaaacagtacgctcattgtggcagacgcagcaaaccacctagagctaatagtttattcagagtagcaatagcctggccggctgcttcacagtaaccaaaacgacaaacggaagtcagaacgaattccacagactgaacagcgacagcaaaaatcatcttatcactcgcacagcaccgcgccctcctccagagaatcctcctccgcccgccatgcgagcaggttggcaagcttgccttccttgaccagagggtggccgctctccacattctcgccctcgaagcagtggaagacggacctgggcgacccggcggagacagcaacctcttcattcgcggtaaagctctggtagatgaggacgcccccgcaggggagctcctgctccacgatgttgttgcagtcgtatgcctcggcgtcgagcttcttgccccaggtggcggcgtggccgcggccaccgaagatggtgaccgccacagagaactctgaagggccgaagcaccggaggaccctcttgac

SEQ ID NO: 1355 - DNA, 543 bp, Hordeum vulgare
  UNSURE (4),(12): n stands for any base
gggnctgcaggnaattcggtacgaggtgatgagcaacttgggtccaaagtcaccatagcagaaaagaatgccaaggcggagttgaacgcttctatcagcaacttgatttcaaaaataaaagtgaggtggcattctgggagaaatagctccggtgagctgaatatcaaagatgctattcaggcagcattacaggcgtctatattggacatattgttgcctgatcccttgacatttagctttagacttgctaaggatgccaagcctgccaatgattctagccattctactgttgagaatgttggtccatttaccggtgagaatgttctgaggtgtaaagatcctatatcagctcataaaatgacccatatggaagttcaaattcggaacaacacaaaggaaattattcagatgaacctcagcatttcatgcaaggatgttgcaggagaaaattgcttcgaagaaaacagtgcaaccgtcctctgggctggtgttcttaacgacatacaattggaggttccaccattgcaggaggtgatgcatcct

SEQ ID NO: 1356 - DNA, 525 bp, Hordeum vulgare
tcaaaagccctaggattgagttgcgtcttatgaataaacacccacactgagaaaattctcaagaatcctccaaaatttctttgaaaatcctgaatcaaaaagcccttccgtgggcagccaaggccatggtgtgcaccatattaatcttggcggatgcttttacactgtacacaaacacaagtgtattacaaaggaagcctccgagtggctcaaataaatcacaagtgtacagggggaataatgctcttgtacatgattttcacagctgcacatgtcatggtgaaatcgctgcctctaaactacaccaaacagcgtttgctactctgtaccaactacatggatatggaatggggatccacggcataggataggttcgtctggtgattctgcctttgcccgagcacgaagaacatctgtggcgtcaattataacagaagaagactgcagcgagtagtctccaggtactaggaagtatacagagaaaggatgcatcacctcctgcaatggtggaacctccaattgtat

SEQ ID NO: 1357 - DNA, 425 bp, Hordeum vulgare
aaacatttctgttcccttctccacctccccgacacacgacctgctccgtcgtcagatctcgagctctccccctccctctccgcaatggagcccgggctgagcatcgagtccgggtcggccatccgggtggcggtgctgccggtgggcgggccgatcccgccgcagtgcctgcgggactacgcggcgctggtggcgcggcacgcgcgcgtcgacctcgcctcgctgcgcccctactactcggagcaccagaagagccccttcgcgcaccagccctgggacacgggctgcctctgcctcaagttcgtgctcggcggctgcgtgccctcgccctgggaggacttccagtcctcgcgcaaggtgctcgccgtcgtcggcatctgccacctcccctcctccccggacctcgccagggtcgccgccgactt

SEQ ID NO: 1358 - DNA, 399 bp, Hordeum vulgare
ttttttttttttttttttttttgaatcaaaaagcccttccgtgggcagccaaggccatggtgtgcaccatattaatcttggcggatgcttttacactgtacacaaacacaagtgtattacaagggaagcctccgagtggctcaaataaatcacaagtgtacagggggaataatgctcttgtacatgattttcacagctgcacatgtcatggtgaaatcgctgcctctaaactacaccaaacagcgtttgctactctgtaccaactacatggatatggaatggggatccacggcataggataggttcgtctggtgactctgcctttgcccgagcacgaagaacatctgtggcgtcaattataacagaagaagactgcagcgagtagtctccaggtactag

SEQ ID NO: 1359 - DNA, 517 bp, Hordeum vulgare
ctcgccccctgatctctcccgaggcgcgagcaggacgacgccggcgggcggctccggcgaccggatactctgcggtcttccctccgccctttccatattgctgtcagagtggaacaaatctgttgctggaaatggcaagtacagcatgtttcgtgattgtaagtaagaacgacatcccaatatatgaagcacaagttggatccgcaccaaagaaagaagatctggcttatcaccatcagttcatcctacatgctgcgttagatgttgttcaggacctagcatggaccacaaatgcaatgttcctgaggtcggttgatagatttaatgaccttgtggtgtctgtttatgtaaccgccggtcatactagattcatgctgctccacgattcacgcagcgaggatggaataaaaagcttttttcaagaggtccatgaactttacatcaagatattcctcaacccgctgtatctgcctggctctcgcatcgcatcgtctcatttcgacaccaaggtgagggc

SEQ ID NO: 1360 - DNA, 518 bp, Hordeum vulgare
ttgacggtttttacatatttgcactgtacatacagcacgatccattttcaaaccggattcaattccaaaaggtggggattcaccggcgcgcgcacgcaaggatccaacgaggagaaaaatgcagtgtgcatacatgattcggcaacatacgtagatgacaagagaacaaccgcggtggattatcttttgccggccctgcttctgctgtacgacgccaagctgctccgcggccgcgcgctacagatacttcctcgcgagagccctcaccttggtgtcgaaatgagacgatgcgatgcgagagccaggcagatacagcgggttgaggaatatcttgatgtaaagttcatggacctcttgaaaaaagctttttattccatcctcgctgcgtgaatcgtggagcagcatgaatctagtatgaccggcggttacataaacagacaccacaaggtcattaaatctatcaaccgacctcaggaacattgcatttgtggtccatgctaggtcctgaacaacatcta

SEQ ID NO: 1361 - DNA, 457 bp, Hordeum vulgare
  UNSURE (426): n stands for any base
agcaacagttcacggggcagaacagaagggagctgggtaaattccggtccattccgccaacctccctcccgtcccgtcccattcgccgctcccactgcacactgcgactgcttgcgcagtggtactagctcgctgctccgccccccgccgccggccaatgctcgccgccgctcccccgtaggaatcccgtatctttgctgatgttgtgatgcttggaggtagtggttctagtgagaagaagacaatgatcaacttgttcgacctgagtacggggatggccagcacgaaggcgctcgctgacagaactcacagagaagattctcctgttcgtagaggccggacagatatcaagagaaccgttgatcctgataaagtttgtatagaggataaactggaggccagtactaggagttctttaagcagcanatcagatgcatcacccatgaagaagctacta

SEQ ID NO: 1362 - DNA, 262 bp, Hordeum vulgare
ttttttttttttttttttttttggtcttgcaaaatactgtatttcctttcctttaacagagagttagaatatactgaaaccacatgctgctgatgacagtacaatatgctactactgtgaaagtaacaaggaaaaactagttgctgcacagttgacatggtttgaccaaaaagggatgtagcacaatctgcagtgtgccactacaagtatatgcagaagcaactactacgtggacttggcttacaagctagtagtagtatga

SEQ ID NO: 1363 - DNA, 183 bp, Hordeum vulgare
  UNSURE (9): n stands for any base
gctgcaagncgatagctcgagggaaggaagatcaaacgaccaagcaaagcaaagcaaccaaccaaccaacgagcgagcgagcgagcgagatcacgggcatgggggagcaggacaccagcggcagcagcatggtggaggcgcgggcgccggccaagaagagcggcagcggccacgccgacccgc

SEQ ID NO: 1364 - DNA, 541 bp, Hordeum vulgare
gataaattaatgcttagatgcacacacaaaaatctcataaaagaacctgaacaacaggatggttcttttctttgcggctaacagcggtgattcccgacagaaataactacaaagctctcatcaaatactctactactggaaaaactagtgctaggaagactacatctcatctatctcaccctctccatcaagacacttagcaatagcagctgcccctaacagtgtactgcagacttatcaatgcacatccaccgtgcgcgcccttgcaaatgaatgaagctgtcatcctttctctgatcaatcatcatcatttcattttttatttgcgggactccaccagtatgtaaactggctttccatcgagcttgtagaaatccttaaacttggggagtccaatgaggcatgcacactcaacaacatcagctgcggcacgttcaagaagttttatagctgcagaaagtgttccaccggttgcaaccagatcatcaaccaccaccacacgctcgccaggttcgacggcgccaacatgcatctccaagca

SEQ ID NO: 1365 - DNA, 517 bp, Hordeum vulgare
cctcgtgccgaattcggcacgagggccatttcagcaacagatggttccaaggggacgtgtctaccggtacccacctggacctcgtacatggctgaggttcaacagatgcctggggttggtgttggaggtatggttcagccatatgatatgggaagcttccctgtgcgagatgctggcgtgtcacctgctcctccaattggaactctcacatctgcccttgcaaatgctactccagagcaacaaagaacgatacttggggaaagcctgtatccacttgttgagaagctggaacaccaacaagctgcaaaggtgacgggtatgcttctggagatggaccagacggaggtgctgcatctgctcgagtctccagaggctctcaagtccaaggttgccgaggcgatggatgttctccgcaacgtggctcagcagcagaaccctaacgcccctaccagccagcttgctgggctgtctctgagcgacggcattatctcttagtttagaagtcagtttgcggtct

SEQ ID NO: 1366 - DNA, 536 bp, Hordeum vulgare
cttaacttatattaatagcaaaactttcggcaagtcataaccgcataagaggcatgtaaccaagctctcaatagtagccaaacacggaaaacaggtgcctgccaatcataggcagagagaccaggcagatggagcctaacaaccagtgcaaaaacgcaactcaccaaagttcaaccatggaggacaaaacaatctatagcatcattgagaccgcaaactgacttctaaactaagagataatgccgtcgctcagagacagcccagcaagctggctggtaggggcgttagggttctgctgctgagccacgttgcggagaacatccatcgcctcggcaaccttggacttgagagcctctggagactcgagcagatgcagcacctccgtctggtccatctccagaagcatacccgtcacctttgcagcttgttggtgttccagcttctcaacaagtggatacaggctttccccaagtatcgttctttgttgctctggagtagcatttgcaagggcagatgtgagagttccaattggagga

SEQ ID NO: 1367 - DNA, 517 bp, Hordeum vulgare
ggcgttccttctgtctcagaggtcggcctggacggggaggtgatgggcgtcgatttctcagggcagcaactacaaactgctgctagccgtcaggaccagcgatggaaggcttgctacaagaacatcaaatggatcgagggcgatgcacttgatttacctttcacggaccgctactttgatgctgttacggttggttatggattgcgcaatgtggtggacaaacccaaagcgatgcgagagattctgagagtcctaaaaccagggtcacgagcatctgttctagatttcaacaagagctcatcatttttcacggcatcgttacagagctgggcgatcgataatgtggtcgttcctctggctagtagctatggacttactgaagagtacaagtacttgaaaagttcgatatcacagtatcttacaggagaggaattggagaagttagccaaagaagcagggttttcctcagccaagcactatgaactaggtggagggctcatgggaaacctagtagcaa

SEQ ID NO: 1368 - DNA, 556 bp, Hordeum vulgare
gccacaactgcattattcggtaatgcagaggaaaataattatttgaattaaaattcagataattcgtacagatcaccgttcatcgctaaaattctagtcagcgagttgctactaggtttcccatgagccctccacctagttcatagtgcttggctgaggaaaaccctgcttctttggctaacttctccaattcctctcctgtaagatactgtgatatcgaacttttcaagtacttgtactcttcagtaagtccatagctactagccagaggaacgaccacattatcgatcgcccagctctgtaacgatgccgtgaaaaatgatgagctcttgttgaaatctagaacagatgctcgtgaccctggttttaggactctcagaatctctcgcatcgctttgggtttgtccaccacattgcgcaatccataaccaaccgtaacagcatcaaagtagcggtccgtgaaaggtaaatcaagtgcatcgccctcgatccatttgatgttcttgtagcaagccttccatcgctggtcctgacggctagcagcagtttgtagttg

SEQ ID NO: 1369 - DNA, 970 bp, Hordeum vulgare
  UNSURE (16),(24),(39),(638),(694),(730),(773),(802),(823),(882),(933),(942),(952),(954),(961),(965),(966),(968): n stands for any base
ccccccctggcccgtncccccggnctgcagggatcccgnacgcagggtgtatgtctgtaccgtcatggcggagcatcaccggtagcggaatgccaggagcctgcaaccccgctggagttggtccgcctcctcgccttgatcatgttgccgtgagcctacccggagggagaattatgatatttggtggctctgtagcaggtcttcattccgcctcacagctttacctcctggatccgaccgaagagaaacctacctggagaatactgaacgttccagggcgccctccaaggtttgcctggggacacagtacctgtgtcatggaaggatcaaaggcaatagttcttggaggacaaaccggagaggagtggacgctgactgaaattcatgaactctctctggcgagctcattagtttgagaccggacagtctccagcaagcttacaggttcctcaaagctatgcaaacggaattggtaagcaaactgggatgttctcatggcaggttagtctcaagtagatgaaagctggctactctcgcaacgcctcagagtcgcctcgtttagtctatatgaagtaggaatgcattctccccgcccgctgccgtttgtttggtctactacaaggtaactaactatcatncataacccctcaatgtgtgttggtctcgtcagatgtttccagcactctgataagangaacaaaaggactggcgatgcttggagtgtcccatncgatccaacaccctgcgatgcgtgcctttgccgatgatgttgnaactgctctgaaattccaccgccaaaatnggtatgttaagcttttgcgtngggatgccctggatggttttccggggcccggccgggactaacttcaattggtcgttggntgcctttggtgaaaaaaaccttttggggttttaccttttggaagtggaacnttggttggncccaaaagtncnggattgnttgnntnac

SEQ ID NO: 1370 - DNA, 552 bp, Hordeum vulgare
  UNSURE (20): n stands for any base
gaaaaccaactgctatgtancacgaaccattacattatcaatcccaaatgcggaggaagcacgacgcatttacagttgtttcttcgcatcagctttgatgggcacaccataaacagacgacataaacagttcagtctatcatcagatcaatccttgccgtaactcacaagactatgtatgtacagacgcgcaggcccgttctgcctgctctactcggggtggtcatatttacacgtggacggaaggtgcctgttaccggaagactactccggacgcacgcttaccaggttggggagggcggccagctgaagcttcttgacctcgcaggccgtcaccttgcacgagtcgagcgacagcgagcgcaggttctgcagcggcctcagatggtggaggcctgcgttcgacacccgagagtacgacaggttcagcgagaccaaagacgtcaggcccgagattatctccaaggtcttgtctgtgaggttgccgttttgggataggttcagcaacgtcagggctttgaggtccttgatgttcttcactccagcgtcggtg

SEQ ID NO: 1371 - DNA, 460 bp, Hordeum vulgare
taaatgatgaggatggtgtgcacaaacgttatgcttctccctcactccgtgagaaggttctgcagccttctcgtacttcatctcatgcaagtgccactcacatgcctggatatggcacttcagctattgttgcaatggacaagagtgcagctatttcttcagatacatcgctgccaacaaaccatcttcgtttatcacagtcaaagacaaccagcagagtttctgatagaagcctagaaagtgtgctaggttcaagcaaagaaaaggtttctgctattgaaagtttgctgaaaggtgccagcatatcagataggcaaaatttctcagttgcacgctcaacaagcttggaccttggggttgatgctccatcatctcgtgatcctcctgttcctcttgcagcaccagcttcaaatcatctatctctgcagaactcagcgttcttggattcactattcctagc

SEQ ID NO: 1372 - DNA, 424 bp, Hordeum vulgare
ttttttttttttttttgaccagacaaaacttggcacacgctctctccattacgttacaactcctttctttgtacattgtcacctagtcgtacaacccaagacaacacacgctcgctaacactctcctctcctctcctctccacaagctaacaaaaaaaaaagacaaggaatacataataatcacacaaagaaccaaactcccgaatacaagggaattgtttgcttatatactatacacaaacctacacaaacaaacgggacccccaaaaaatcccacaccctaccaaacaaaatgtccatataaaacacaatgagaaatgtcacgcctcattggttagcgtcgatcgccgtgccggaccttgcctgcgagatccggttcgcgtagatggtcaccagccgcagctgcgtgctgctcagcccttcc

SEQ ID NO: 1373 - DNA, 518 bp, Hordeum vulgare
cctcgtgccgaattcggcacgaggcggatgcggcgcctgggggatcatcttcacggcgctcttcgccaagcggcagtacgtggaggagatctacggccccggcaggccgtacgggctgttcctgggcggcggcgggcggctgctggcggcgcacatcgtgcagatcctcgtcatcgccgggttcgtcagctgcaccatgggaccgctcttcttcgcgctcaagaagctgggcctgctccgcatctcggccgaggacgagatggccggcatggacctgaccaggcacggcgggttcgcctacgtctaccacgacgacgacgagcacgacaagtcggtgggcggcttcatgctcaggtcggcgcagacccgcgtcgagccggcggcggcggccaacagccaggtctaaccaatcatgcatgccggggcaattcacaagaaatccagtggaaattcgttcgcctttcagttctcgcgcgcgcgtcatgtcgtgatccgatcgatattttccggtgctgttt

SEQ ID NO: 1374 - DNA, 550 bp, Hordeum vulgare
ccaaaaatgacatcattatatcaccaaggaagaaaacccccggccctgcagatcccatccacacaccacacatctctaaacgcacgcatgtacacaaaaaagggaagaaaaatttaacctcgtcctagtgtaattttgcaatcttgtgaaggaaacacaagagcggcaaagcattggcccaaacagcaccggaaaatatcgatcggatcacgacatgacgcgcgcgcgagaactgaaaggcgaacgaatttccactggatttcttgtgaattgccccggcatgcatgattggttagacctggctgttggccgccgccgccggctcgacgcgggtctgcgccgacctgagcatgaagccgcccaccgacttgtcgtgctcgtcgtcgtcgtggtagacgtaggcgaacccgccgtgcctggtcaggtccatgccggccatctcgtcctcggccgagatgcggagcaggcccagcttcttgagcgcgaagaagagcggtcccatggtgcagctgacgaacccggcgatgacgaggatctgcacgatgtgcgc

SEQ ID NO: 1375 - DNA, 518 bp, Hordeum vulgare
agagagaacggcagcccaagcaacaacaacaacaacaacacgtcctcatggaggctgcagtggttcggggacagcggcagccaggcggcgccggagctggggctggagcccgggcagtgcaaggtgttcgtggagtcggacgccgtggggcgcaacctggacctctcggcgctgggctcgttcgaggagctgtacggccgcatgtccgacatgttcggcatggaccgcgctgaagtgaggaaccacgtgctctaccgcagcgccgccggcgaggtgaagcacatcggcgatgaacctttcagcgcgttcgtgaagtcggcccggaggctgatgatcctggcggacgcggggagcgacaacattgggggctaggaagggaggcaagcagcaacatccatcgatcttgagccgaataacctaggtcgccggcgacccctggacctccattagcgagcaataagccggagcaagtaccaccccacgcctacagcccaagtacaagctgtggtttcttcctt

SEQ ID NO: 1376 - DNA, 542 bp, Hordeum vulgare
ggcatggcatggcatggcatggcatggcgacctggatggaagtacgtaggtacgttacattcgatgatgctgatgatgatcatgaaaggtactgctgctaggagtggtatccagagtggtactgctgctgctgctgctgctgctacattgatttgtttgcagctcctgcctacggtacggctacgacgacgagaaaaatgcaaagggaaatgagctaactctcgacaaggaagaaaccacagcttgtacttgggctgtaggcgtggggtggtacttgctccggcttattgctcgctaatggaggtccaggggtcgccggcgacctaggttattcggctcaagatcgatggatgttgctgcttgcctcccttcctagcccccaatgttgtcgctccccgcgtccgccaggatcatcagcctccgggccgacttcacgaacgcgctgaaaggttcatcgccgatgtgcttcacctcgccggcggcgctgcggtagagcacgtggttcctcacttcagcgcggtccatgccgaacatgtcggaca

SEQ ID NO: 1377 - DNA, 518 bp, Hordeum vulgare
acccatcggtgtgtccatggacaacaccaggcttgccattgctgcgattggcaagctcatgtttgcccaattctcagagttggtgaacgacctctacaacaacggtctaccttccaacctttccggtgggcgcaacccgagcttggactatggcttcaagggtgccgagattgccatggcatcgtactgctctgagctccagttcttgggcaaccctgtgaccaaccatgtccagagcgcggagcagcataaccaagatgtcaattctcttggcctcatctcctctaggaagaccgccgaggccattgacatactgaagctcatgtcctcgacattcctggtcgcgctgtgccaggctatcgacctccgccacctcgaagagaatgtcaagaatgctgtcaagagttgtgtgaagacggtggctaggaagacactgagcaccaacagcaatggccatctgcatagcgcacgcttctgcgagaaggaccttcttctcacaatcgaccgagaggcggtgt

SEQ ID NO: 1378 - DNA, 547 bp, Hordeum vulgare
  UNSURE (7),(18): n stands for any base
acccggnaccacttgatnctcaaaaaaagggacacataaatttctcatgaatatttatcacacattgtaccccttttaacctacatcgtagagattctactggctacctaccactaccaaagcatgcaattgcaatttttggcaacaacccggcagctctataagaacaatacaaaacatcgacttttaagaatatccaatggaaaaacagtgttatcacttatcagctaagaacatctgaagccttctgaactttgaagcacattatcatctgttcatgttcttgatccttagcagataggcaggggctcaccgttccaacccttgagacactcaagcagtgcgtcgatgtgcttgcccttgttcatagcaacaaacaccttgtccacttcttcgccgggagacctagtcttctcgccggtcaagtactctgttccaagctccttgcgcacaaaccggtagagtgggtatgatcggcattcagtgatacggttttgttgtgtggcagtaccgttctccacggcactccgagcagcctcgacctcct

SEQ ID NO: 1379 - DNA, 372 bp, Hordeum vulgare
atccctccaaacatataccgcgagatagaaaaaaaagaaaaacaacagatctgcccatgagtgaggaactcaaccgggactacgagatcggggaggaggtagggcgcggccgcttcggcgtggtccgccgctgcgcgtcccgctccaccggcgacctctacgccgtcaagtcggtcgaccgctcgctcctcgccgacgacctggaccgcggcctggccgagctggagcccaagctggcgcagctggccgccgcgggcaaccccggcgtcgtgcaggtgcacgcggtgtacgaggacgaggcgtggacgcacatggtcatggacctgtgcgccgggcccgacctgctcgactgggtccgcctccgccagggcg

SEQ ID NO: 1380 - DNA, 310 bp, Hordeum vulgare
tttttttttttttttctacaagcaagcaggcagggttagtttgtacatgagcagcatcccatcagacacagaaaccgaacaggcaggcgttctcttaaccaaggcagcaaaaaaaagcccagaaaaagaaaagatagctacagccgaacccctggctggctcgtcggcactctggatttatacaatggcaccagaagctccctactaccaccactactactgatacttcgcacactctcgtcgcatatacaaagacgctagacacgttatctctccacgggaacagtcgacgtacgtgggcctgctacgg

SEQ ID NO: 1381 - DNA, 510 bp, Hordeum vulgare
ctcttcaatacgttgatgctttgccttctctggtacattctacggtatctcactgggttctttcaaagtaatctggagaccatcctacatggtgcgaactatcttctacaaggtagttaatcttcaaaggcaaaagcacatatgttgatggctttatggaatcccccctgtaatctatgttttgattagtctcagactgagaaactagaaaggaacggtttatgtgttgttgtgtttgcagccgttttttgtactgtatgtctgcattgtccatggttattgtaatatattgatgtcgctgattctcagttgactgcccggaacttctgtaaatctagccccgtcgatatttgcacatcttaaacctcaaattggagtccaacttttagtcgtttttttttcatttttctcagtggggtcatgaacttagctatacattgtccatatgtctccctctgtatttgggaatgtagctactcccatcagactaaatcagcgtcaattggtatg

SEQ ID NO: 1382 - DNA, 534 bp, Hordeum vulgare
gagagaaattacttaaagtcacatcacatattggttaaaaaaaaacctaatatacataccaattgacgctgatttagtctgatgggagatagctacatttcccaaatacagagggagacatatggacaatgtatagctaagttcatgaccccactgagaaaaatgaaaaaaaaacgactaaaagttggactccaatttgaggtttaagatgtgcaaatatcgacggggctagatttacagaagttccgggcagtcaactgagaatcagcgacatcaatatattacaataaccatggacaatgcagacatacagtacaaaaaacggctgcaaacacaacaacacataaaccgttcctttctagtttctcagtctgagactaatcaaaacatagattacaggggggattccataaagccatcaacatatgtgcttttgcctttgaagattaactaccttgtagaagatagttcgcaccatgtaggatggtctccagattactttgaaagaacccagtgagataccgtagaatgtac

SEQ ID NO: 1383 - DNA, 416 bp, Hordeum vulgare
atcgccatgggaagatcacaatagcaccggacaagccagagagccgatccggagcagctccgctccgaaggcgagatcccgcgcgggccgaaggcgaggccccgatgggatcgtcgccgtccgggctgcccctgctggccgccctcgtcgcggcggcgctgctcgccggcgcggccgcggccgcggcgacggaggaggcatacgtcacgctgctctacggcgacgagttcgtcctcggcgtgcgcgtcctgggcaagtccatccgcgacaccggcacgcggcgcgacatggtcgtgctcgtctccgacggcgtctccgagtactcgcgggggctcctcgaggctgatggttggatcgtgaatcgtataactttactggctaatcctaaccaagtgagaccaacgaggttttggggt

SEQ ID NO: 1384 - DNA, 396 bp, Hordeum vulgare
tttttttttttttttgtacaacgaacaaatgacttaaagtgttttagagacaaaagatttacatctgcaggcctgcaagctggatgtcaactgcacaacgttaaaatctatgtacctttgatttggcatcaatgttacaaaaatggaatatctgtgtcaaaggaaactccaaaatttcctcgtgtaaaaatgtacaacaacatgaactaaatcaataacgtaggtacagagcttactacaaacaccaaaagcaaattcttctagttctcgacccattcctatctttctgacccttgtggaaagctgagatagcaagatgcaccgaagcatacgtcataaaagatgccagcaggacaccaccagcaaccatcaaccctagctttgcaaataatgcag

SEQ ID NO: 1385 - DNA, 447 bp, Hordeum vulgare
gtgagcgtggcgccccctccgccgcccgcgccggcgccggtggaggaggtcgaggtgaggaaggaggtggtggtggtcgaggagaaggccaaggcgaaggcgaaaccgaaggccggggccggcagcggcaagaagcgggcgctgagggtagggagcgaaggggaggaagtgcgcgcgatgcaggaagccttggaaaagctcggtttctactcgggcgaagaggacacggagttctccaccttctccaccggcaccgaacgagccgtcaagacatggcaggcagcgatagggactacggaggacgggttgatgacgtcggagctgctcgagatgctatttacaggacggacccaggaggatctcagaaaggaaggcgtaaacggagcacttgttccacctgtagcagaaactgcaggggttcagcaacctgtggtggaaaaaattgac

SEQ ID NO: 1386 - DNA, 433 bp, Hordeum vulgare
cagctgctatagatgctgaactaaggctgactgttgctcatgagtcatgactcatgagtcctttgctttaactgtgcactgttttaatcccttgacaaacatcacatatggtgtaaccaaggccttcacagtaggggcacttggtgtcttcaccaacccactccaagaactgtggttcgatgttgggctcaccagttccatcgcattctaggcacaggaggcggccttcgcctcggcaggtgatgcactgctttgtcgacgcggcagtagaaccgctgatcggtttatccttcttggtcagcctggacgggtcttcccacctgttttcgccgagaaggtacactctgtgcttgttgtagtcaattttttccaccacaggttgctgaacccctgcagtttctgctacaggtggaacaagtgctccgtttacgcc

SEQ ID NO: 1387 - DNA, 482 bp, Hordeum vulgare
tatggcttagggtgctgagattgccatggcgtcatactgaaacgagcttcagttcctgggcaaccctgtgaccaaccatgtccagagcgcagagcagcacaaccaagatgtcaactctcttggcctcatctcctcaaggaagactgccgaggccattgacatactcaagctcatgtcctcgacatttttggtcgcattgtgccaggctatcgacctccgccacctcgaggagaatgtcaagaatgctgtaaagagctgtgtgaagacggtggccaggaagacactaagcactgatagcaatggccatctccacaacgcacgtttctgtgagaaggaccttctgctcacaattgaccgtgaggcggtattcgcatacgcagatgacccatgcagcgcgaactacccactcatgcagaagatgcgtgcagtgcttgtggagcacgccttggccaatggtgaggccgagcacgacgtagagacgt

SEQ ID NO: 1388 - DNA, 525 bp, Hordeum vulgare
tatacacactgtacccttttataacttaaataagaaaagttctactggctacccaacactaccaagtcatgcaattgcaatctttagcaatgcattgccagctctggaagaacattgcaaacatcaacttttacataatataacgaaaaaacggtattatcactggatctttcagaaatctgagcacactacccttccatttctcaatcctctgttcagcaaataggcaggggctcaccattccactccttgaggcactcaagaagtgcgtcgatgtgcttgccttggttcatggcaacgaacaccttgtccacttcttccccaggagacctcgtcttctctccagtcaagtactctgttccaagctccttgcgcacgaaccggtagagcgggtacgaccggcattccgtgatacggttttgctgtgcggcagtgccattctccacggcgctcctggcggcctcgacctcctttggcagcactgcacggacctcctgctcgaacgtggcaagcttggcaaacact

SEQ ID NO: 1389 - DNA, 543 bp, Hordeum vulgare
  UNSURE (16): n stands for any base
gtcccccggctgcagnaattcgcacgaggcgcctgtggtcatgatgcgcacacagcgatgctcctgggagcggcaaagctgctgcatgagcgcaaggatcagcttaagggaacggtgagactcctttttcaacctgctgaggagggtggtgccggtgcatctcatatggtaaaagaaggtgttctagatggtgttgaggctatattcgccatgcatgtcgattgtcagaagccgacaggctcaatagctgctcacgcaggaccaacacatgcagccgtgtgtttctacgtagtgaaaatagaaggtaaaaccgggaaggctgaaacaccacacttgaatgtggatcctgttgctgctgcggcatttaccatcctggccctgcaacagctcacctcgagagaagacgaccctcttcacagccaagtgctctctgttacctatattaaagctgggaattctactgataccacacctccagttgttgaattcggaggtactttgaggagccttactactgaaggactttatcgactagagaaaagg

SEQ ID NO: 1390 - DNA, 499 bp, Hordeum vulgare
cgacactgccggttgttctggagcctttaaaaaataaaggccctttaagatgttttgtacactctcttcttatggaatccgctagagttgctcttcctgtgaacacacccttccaacttcattttgagtggagcacccagagagatacatttctgcagtagcagtgtgcaacgcagctccaatgggaaggacatcctcgtccacgaagaaatgcgggttgtgataacagtgcaccgcaccgactttctcgtttctaatgccgataccaaagatgacgccaggaactgactgttggtagaaagcaaagtcttcccctgccatgatcttctccccgggcttcacattatccgggccaagcaatcttctgcccacattctctatgtggcgatgcagcctctcatcattcacgacggcgggatacatcgggtaggagggagcccccagtatctccgtaacccccttgcatctatgcacagctgcctgcccttctactacctcc

SEQ ID NO: 1391 - DNA, 1777 bp, Hordeum vulgare
  UNSURE (1)..(10),(18)..(29),(207),(294),(714),(923),(1009),(1011),(1051),(1102),(1122),(1139),(1157),(1159),(1207),(1210),(1231),(1253),(1291),(1311),(1386),(1390),(1399),(1442),(1453),(1459),(1527),(1613),(1631),(1638),(1643),(1645),(1703),(1714),(1716),(1724): n stands for any base
nnnnnnnnnnttaaaaannnnnnnnnnnnggtgcgagtaatcagggccccaaaggaattcgcgcggaggtgggaaaaagccacaagaatttcacgttgtggcgcctgagaaaaacacctcgaaaacacgtcatgttactaacattcagcgctgttatatgtaggcgcatgatctaatatgcagaagagagacgccctgtgcatattntaccggggcagagactcacgccgctaaacctgaacagctgagtcgtgctgattagcagacgtcagggacacgagagtgaatgcatgntacttatgcgatgtggagagcacagtcataatgaagagcagagcgcggtgtgacttacgcgcgcatagacatacagcgtgtcgacatgggctcgtagttcgttttgcgtagtggaaaacgtcgtcttcattttggcatggtggggagtgtgtagttgcactctacatttgtgtttgacggatccacatcgcaatcctctacatggtacgtagagtagtttacctagattctgacttgcctgtcgctggtgtcttctcaatatctagctggtcgtatcacgtggtagcactctggtgctaggacgatactaggcggaatatgaaagcgaccagtatccatgcgaatgctgcgcggcgtggagtatggattgtgagcgtaggcgtttacagtggtagcacgtaatgatagtctttattgcgntcatatttgttacacatccaagatgtgcgcgccctcccttcatgagtctattagtttatgcagcagatagtctcagaccgtcgccgcgatgcgaggcgtcgtgttggcccgcgtgaatcacgctcctgcttaagctcttcatcttatgttatattcggctccacgcctcacgaatatattcacttccgctccgagagcacgtaggccgnaactatccaagacatccgcgccgtggtgtgtgttgttgtgctctacttcctgccgatacactagtagcgtgtgttgtgtatacagngngattattcatgcgtctgctgtccaccttagttcgttcttntcaagtatagtaggagtcgtagcacgcctatatcggatattgtctatatancctctgtgctaccgatctgntgttatcggcagatagntattctataatcatgacnantgtacgttcgtatgaacaactacgtggacgtcattctaggctgcacgncgnatgcagtatgtattgcgagangtgtcagacttcgccaagtgancgtacgcacgctacgttgtgatgatattcgccgcgtanctttgcactatctcatattnatatatcctcacctacttccccctatgattgatagctgcacacttatcgtgatttgcggtgtcgtcgccgaacgnatgnagctctagnaacagttatctcaaatcggacgcgagagaagatgtcatccgtngtagtgcgganagcgtntcttctcattttcgcctcacatgttgttaatgtatatgtctctttattatgcacgcgcctctctttgntgtctacacacactacaccacctctacgtatatatatttgttatatatatatatctgagcgtgtatcacgtatgcctctctactcntcccttctcgcgcgctgntgtgtantgtgntnacacggctcgtctgggttgggcagacgaccaatctgtgtgttctagcgcgacatgtantcgatgcgcantntattcgancaatatgtgtgtcgggcaggatagtagtgctcgtgatatatgagtgtatgcct

SEQ ID NO: 1392 - DNA, 518 bp, Hordeum vulgare
ccacctctcgttccccgggaggggcggagcgccgccggccacaccaagattccggcgaccacgggaggggcggcgcggccacaccaagatttcggcgaccacgggaggggcggcgtgtctccaggacggccatggtggttctgctccgactcaggcacacatggtcctatctgcaatccgagcccggctgggagttggattagtcattccgaggctccccttcataaataaggggagggagtgggacttgaagaccaaacacatcattgccaggtagatccagttagtgcgggaagaacatgtgtaaacgtcagcactcgcacctcgacgtcgacggcaccggaaaaaggccgcgccgtgtgccgaagaagcacctctacctggtgctggatgattggcacaaaggcttcagcatccacaagatcgacgtcgacgccttggagggcaccaccgccgacctacaccatgggttccctgaccccgctgctctccggttagcctcacccgtaaatcgtctt

SEQ ID NO: 1393 - DNA, 408 bp, Hordeum vulgare
cgcggtgctctacatcatcgcgcagtgcctgggcgccatctgcggcgtggggctcgtcaaggggttccagagcgccttctacgtgcgctacggcgggggcgccaacgagctcagcgccggctactccaagggcaccggcctcgccgccgagatcatcggcaccttcgtgctcgtctacaccgtcttctccgccaccgaccccaagcgcagcgcccgtgactcccacgtcccagtcctggctcccctgccaatcggcttcgcggtgttcatggtgcacctggccactatcccgatcaccggcaccggcatcaacccggcgaggagcttcggagctgccgtgatctacaacaacgagaaggcctgggatgaccactggatgttctgggtgggccattcatcgggccgcca

SEQ ID NO: 1394 - DNA, 249 bp, Hordeum vulgare
ttttttttttttttttttttttttttttttgcgtacacattgcatttcaaatttcccccccaagttacctggatgcgtacatgacatgacagtacatcatcctcatcattcataaacattacatggaagcaaacactgactgacgaagacacactcgatcggtagagaaaacaagcagcaagcgcgggcggcgagcagaggaaagcagagacgcgcgcaaagaccagcagaatccagggacccgaacgg

SEQ ID NO: 1395 - DNA, 518 bp, Hordeum vulgare
gcactcgtgcgggccgagggagttgaagggtggtcggggctggccgccgggtgctctctccggtggaccgtggagtagagaagcgccttcatccacgtcgtgccggacttgggcatcgtggcgacgacgatgtccgaggggcgcgcggcgaagcgcgcgtcggcgaccatggcgccgaccagcggaggcagggtgctgtaccagccgttctcgtggcggtagagctggttcgccctcgagagtcctcgggagcacggccaggaggacgccagttcggtgaactgccggtagagctcttcgttggtttcggcgtcgccctcttgcggcggaaagactgagatggaggaggacattttacggcagctgagggtacgggcggataaccggacaaggtgcatcttatcttataatagaggagtgacgaagactaggctgtagcctagtggtaagggtgggcagtggctcaccgtgctcgctttcggtgggattattctataaatataaatcttttgtgttag

SEQ ID NO: 1396 - DNA, 542 bp, Hordeum vulgare
tgcgttgggtcgacttttatgtccgcgccgacctaaacgaacaacagcggacaaaatgggtcactgcgttgaaattgctctcactcttctattaaaaaaagagattcataaatactcctactaacacaaaagatttatatttatagaataatcccaccgaaagcgagcacggtgagccactgcccacccttaccactaggctacagcctagtcttcgtcactcctctattataagataagatgcaccttgtccggttatccgcccgtaccctcagctgccgtaaaatgtcctcctccatctcagtctttccgccgcaagagggcgacgccgaaaccaacgaagagctctaccggcagttcaccgaactggcgtcctcctggccgtgctcccgaggactctcgagggcgaaccagctctaccgccacgagaacggctggtacagcaccctgcctccgctggtcggcgccatggtcgccgacgcgcgcttcgccgcgcgcccctcggacatcgtcgtcgccacgatgcccaagtccggcacgac

SEQ ID NO: 1397 - DNA, 519 bp, Hordeum vulgare
ttgcaacccaactggcctagaccatccactttgaacacgcaatggtcctgaccatggcggctatcgctctcctgccgctgttggtgacgctactagccacggcggccacgggactgtctacaagggcatcctgacggaccagcgcgtggtcgccatcaagagggcaatgctggtggcgagcgccgagatcgagcagttcatcaacgaggttaccatcctgtcgcagatcaacgaacgtcgtgaagctccatggatgctgcctggagtccgaggtccctctgctcgtctacgagtccgtctccaacggcacgctctacggcctcttcaacggcgagcaagatggcaggcctttaccgatgccctgggaggagcgcctaaggatagccgccgagatcgccggcgcgctcacgtacctgcactcggcggcttcgatgtcgatccttcgtcgggacatcaagtccatgaacgtgctcctcaacgacagccacacggcaaaggtttcggatttcggcgcgtcga

SEQ ID NO: 1398 - DNA, 542 bp, Hordeum vulgare
attgtatattgtccttatatctccttgccaacaattctcgcttaaaagagatcagctcccttactaactccaaccggtatattataggaggacatcataaacagtggaatgttagccagggaagacaaattatcgtggtatgcgcaaggacgaggcgaactcttgctccagactgtactgacgtgtgccaaggtgaccagccaccggaaccatgcctccaggccaatctcctcctcctacttcacggtgagccacttcatcctttcctagagcaaccttccgtgccctcaagaatcgcagcctcatctccacgtccttcatgctaggcctcttctgccttctcaggttcaggcactctcgcgccaagaaagccacgtgcttgaccacctccatatcttcttcctccacaacctgtttatccaccacctcctctagaggcctctcccccatagcccacaggaagtagttggacaggttctgcttctcgccattctcgttctcaacgagcggcttcttcctcatcagcagctcgacaagaatca

SEQ ID NO: 1399 - DNA, 519 bp, Hordeum vulgare
  UNSURE (7): n stands for any base
gctgcangctcgccatccaatcactcgccgcaagcctctcccgctctcctaacaaacccaccgaaaagcccccgagcaatggccaccaccacccgcaggaaccaaccagcaccaccaccagcagcagcagcgggagaaggagccttgcggtggccgcggccgcggtcggcacggctctcttcgcgtcccagctgctgccgccgacggcgggcatcgcaggcgcgttcgacctcgaccttcggatcaccatcccggagcagtcgagcgaggaggccgaggccgtggtgaggacgcacgcgaggaacctggtgcgcgtcaagcagtacatcgacgccaggtcgtggcgggagcttcagacggcgctgcgggccagcgccgccaacctcaagcaggacctgtacgccatcatccaggcgaggccgccgggccagcgccccgagctccggaggctctactccgacctcttcaacaacgtcaccagactggactatgcggccagagacaaggatgagctccagg

SEQ ID NO: 1400 - DNA, 550 bp, Hordeum vulgare
tttgtgaaagaaaattttgagggggcaaaagtttatgtaaaatatacatattatcctgtgcatctcatattttatgagtatatttctgtctggtgttacttatggagtcatggttatttctcaggataaaatggttgggccttcatcctggggtacccctcatcctgttcagtcggatacaggagtctctccctttgtgccgcatcatgccattcaaaacagtcaatatgtatctggaggttggtagatcacctgagtatcaggccttctctctttataatttaccaggcccagttgatttattccgtaattccgttataaacctttgtgcataagtccgacgtgtcatccttcagttggtgtcgatggttcatttaccctaggatccaaccgtatggtgtgcaatcaatagttgagcttgagttgagatactccctacacactcaaatatgttttggcaaaaaacaccttgtttgtaagatcacaagatatttcctcccgaacatcaaagatatatgcagcttcggagatcctgatggccgacgagatt

SEQ ID NO: 1401 - DNA, 497 bp, Hordeum vulgare
ccttccagggcttacggcgacggttacgggccacgggtctctgaagagagcagacgcgccactgtcgacgttttcttgaaagcgtctggctacttggactgcgcgattcgacaagtgctcccacagataccaacagaactaaggagacaacttccagttgacctggctgaaggcaacctcaaagctcttagcctgcaagctctgggtcagggtgttgacatgcagcttgggctggcaatcgatagcccaaaggccacactagctgtaaaaaggcgcttagcttgtgagatggtcaaatattggcaccaggttcaggagagcattccagatcttcccgtgtctgacggatggggaaaaaaacatctgctatttgtcaagtggaagtacgtcgaagcaaagtctgcagcatactacttccatggcttgatcctcgacgaaggaaacagcgagaaatctcacggaatggcaatagcagcattggaagcttcagaggaatt

SEQ ID NO: 1402 - DNA, 519 bp, Hordeum vulgare
taaaatttgcttcaatttgtcgacaccaattttttgttgcaacatatctttgtacacttcgtttgcgccgtgttcggcctccgcatggcagaatcctggtcgttgctttctcagtagtgccagagccttcccatcagaaggcactcttgctgaatgctgaatatacacttactggtggccgtcttctttgttccaaagtgggtctaatggaggaagatcgtagtcttccggtgttagtgccaacgagaaatccggcaatgggggtggtgctccaatgatcctttctggagtatacagatcctggttgatccggaccttgcttgaagcctctttcgggatcttgtcaaacagatacttggctgttccgaatggagtggggctcctagatgttggaggagttgcgtggaaggcttcagaggcccttttgctttctttcagaaattcctctgaagcttccaatgctgctattgccattccgtgagatttctcgctgtttccttcgtcgaggatcaagccatg

SEQ ID NO: 1403 - DNA, 953 bp, Hordeum vulgare
  UNSURE (693),(739),(761),(767),(871),(875),(909): n stands for any base
gcaggaattcggcacgagggcgcaaggatcatccaggccggcggcgtggagaaagtcttccggcggtggttcgccgtggagaagggcgagaagctcctcaaggcctcgcagtgctacctgtccaccaccgccggaccgatcgccggagtgctcttcgtatcgtcggagagggtggccttccgcagcgaccggtcgctggagctgacctcgcccaagggcgacacggtgcgtgtgccgtacaaggtggccgtcccgctgaggagggtgaaggcggccaggccgagcgagaaccagcaccggccggagcagaagtacgtccagctggtgaccgacgacggcttcgagttctggttcatgggcttcgtcagctaccaggcgtccctgcagcacctcgagcaggccatcgcggagtcgcacgtcgtctgatccgactgattgatcaaatcgcacgtatgcgcgctgtgtgttctcgtctgggtttgccgttgtacgtgtcgtgtgtgctggtccggttgacctggtgtgtagcgcataggtaagtagggtttcatggtggattgcttgtcgtttttggcattggagcaactccggtaatacttacaatggtaggagaaaaaaaaaaaaaaaaacctcgggggggggcccggtccccaattcgccctaaggggcgtcacaacacctcccaaccgggcntcccccccccataccccatctcccccccccaccaccccaccacccnttcttcactactctcccttctnatactntcccccccccttctttccattccacacccatctccacttttttttcaccacttacctcccctctctattttaccccatattttcttcccacccccttatcccantacnattttacccactcctcccctcttttttttattantcacctttcctccttccttaattctatttctattttttctcttt

SEQ ID NO: 1404 - DNA, 545 bp, Hordeum vulgare
  UNSURE (16): n stands for any base
tggtagtattaccggngttgctccatgccaaaacgacaagcaatccaccatgaaaccctacttacctatgcgctacacaccaggtcaaccggaccagcacacacgacacgtacaacggcaaacccagacgagaacacacagcgcgcatacgtgcgatttgatcaatcagtcggatcagacgacgtgcgactccgcgatggcctgctcgaggtgctgcagggacgcctggtagctgacgaagcccatgaaccagaactcgaagccgtcgtcggtcaccagctggacgtacttctgctccggccggtgctggttctcgctcggcctggccgccttcaccctcctcagcgggacggccaccttgtacggcacacgcaccgtgtcgcccttgggcgaggtcagctccagcgaccggtcgctgcggaaggccaccctctccgacgatacgaagagcactccggcgatcggtccggcggtggtggacaggtagcactgcgaggccttgaggagcttctcgcccttctccacggcgaaccaccgccggaaga

SEQ ID NO: 1405 - DNA, 508 bp, Hordeum vulgare
  UNSURE (486): n stands for any base
gcacgtggggtggttctcggccgagagggcgagaagctcctcaaggcctcacagtgctacctttcgaccccgccggccccatcgccggggtgcttttcgtatccacggagagggtggccttccgcagcgaccggttgctggcgctgacctcgcccaagggcgacagggtgcgggtgccgtacaaggtggccgtcccgctgcggagggtgaaggcggccatgccgagcgagaaccagcacctgccggagcagaagtacgtccagctggtgacggacgacggcttcgagttctggttcatgggctttgtcggctaccaggcgactctgcaacacctcgagcaggccattgccgcggcagggggtgggtgaaggtgcagtcgtcgcggagctccggcaccgggagcgggaggcctaccgcggcgtgaaagcaacgcgagcgcacggcggcgcctgtcactgtctgacttacaaccatgccgtgatttgngagacctcgtcggctactcggc

SEQ ID NO: 1406 - DNA, 547 bp, Hordeum vulgare
agatagtttttaagtttaaatgttttcttgtgtcggtgtggttaaatggcattgcagtggatgagtttatcgccttaagatcgacatgttacacatgtgcgacaaggtgaacgacctacgtcaccgacgacagaaagaaggataactatgagacggataggctactatattatgtgtgtgtggtgatcggttttgatgttattattttttacccggtgcaaagcacgggcttttgatagtacttgctagtgcaacaagattgtccaagaattatcgaccatttccttaagcaccttatcataactctcgccctcgcctccgcagctccagcttgtaactggtacatccgtggcccatcgacatccattgcaggcttccagcacctaccaatccacgccgcgcattgatacgccattagagtaccctcgctgcaaggcgcgtggccctgctcggggcgtcctcctcacggcccagctcgcgcggctcgtcgttcccctcgagcctcgcgtatagccgtatggataggtcgcgtaagccaccagctcga

SEQ ID NO: 1407 - DNA, 519 bp, Hordeum vulgare
tacatcagtgtcaaatacaatgcaacaacggtggctggaagcaagagctctcaataaagaaatactgcaagctgaagttggattgcccgtggactctagcatacctgttatagttttcattggacgtcttgaagaacagaaagggtcagacatactaattgcagccattccggagtttgtcgaggagaatgttcagataattgttctcggcacagggaagaagaaaatggaggaggaactgatgctgctagaagtgaagtacccacagaatgccagaggcatagcaaaattcaatgttccattggcacacatgatgttcgccggggcagatttcataattattccaagtaggttcgagccatgcggcctcatccaactgcaagggatgagatatggagttgttcccatctgttcatccaccggaggactcgtcgacacagtgagggagggtgtcacagggttccacatgggttcgttcaatgtcgagtttgaaaccgtcgatccagcggatgtgacggc

SEQ ID NO: 1408 - DNA, 549 bp, Hordeum vulgare
  UNSURE (50): n stands for any base
gtgaggacgctgcttgtcttgctgaaatcaggggttatgtcacacatggnagatggagtagtagagaaatggcaaagcctagatgaatacagcatcatcatcgttagcaaccttattatttcgtcgaatcttcgaacaccctccatgatatttggggatttcagggagtggccacattttgtttggcaagcggagcgatttcctcgccttcgatgccgggctgacttccctcaactcctaggctaagaagggcctcctcccacttctttgccggtcccttccaagataggtcctgcgccatacaattctgaaccattgcatggaacaccggcgttctgtactgtttcagagctcgggtgacatttgacccgactgccgtcacatccgctggatcgacggtttcaaactcgacattgaacgaacccatgtggaaccctgtgacaccctccctcactgtgtcgacgagtcctccggtggatgaacagatgggaacaactccatatctcatcccttgcagttggatgaggccgcatggctcgaacctacttg

SEQ ID NO: 1409 - DNA, 522 bp, Hordeum vulgare
tccccggctgcagattcgccgggggaggagcctctccacggccggccaaacacgaggattgccgtcgtcaccggcggcaacaaggggatcggcttcgaggtgtgccggcaactaggcagccatggcgtcaccgtcgttctgacggcccgggacgagacgaggggcgcggaggcagtcgagaagctcagatcgctgggggtcgccgacctcattttccatcagctggacatcacggacacttccagcattgctacactggtcgatttcctgaagatccgtttcggcaaactagacattctggtaaacaacgccgcggtcggtggggttgagtacctccaagaactcgatgccagcgaggaaaagtttgctggcatggatttcgacgagatgctcgaatggatggtgaagaacgtccgtgagcccatcgacggtgcaaaggaaggcttgcagacaaactactacggcacgaagcatgtaaccgaggccgtgctgcctctgcttcaatcttcttccgacggaaga

SEQ ID NO: 1410 - DNA, 524 bp, Hordeum vulgare
tctcggtctgaggctctgagcacgtaacaatctatcacagatagtccaattcatcagcggaaatgccaaatcccgttcgttattctcagtctcaaaccacacctaacacggcaggcagtgtgatgagagagctggctagctcatcggcagacggccggaccggaccgtgcgcgcaccgcaagccatccggcccctcacacgaacgatgcctcctggccctcggcgaagtacttgccggtcggcccgccatccggcagcagcgccaccttcaccacgttgcgtgcgccctcctcgggcgtcaggacacccgagctcatggtgatttctgtcctgacgtagcctggatgcgcgcagttgacgcgcagctcggggtgcctcctcgccagcatcctcgagtaggcgttaatggcggccttggccaccttgtacgcggagaacttcgcgggccacccgcgcgcctccagcgcgtcggcctcgaagtcttcgaggaacttgtccagcagctcgtccagcctctcctctgt

SEQ ID NO: 1411 - DNA, 541 bp, Hordeum vulgare
  UNSURE (3),(11): n stands for any base
ggnctgcaggnaattcggcacgaggcaagcacgaaacataacctcaatgagatggaaggcagcactgaggtccataagtcctctagtgtttcttggctttgctcgtcttatctctacatcaggtgttgattatcaggtgcatgtaggagaatatggagtccattggaacttctttttcacccttgcagcagtttctatccttacatccattatcaggattcatcctaaatattgcgggatagttggcatgcttgttcttgcaggataccaggtatggctaaattttgggttgaatgagtatctcacatctgatgagagaagtactgatatcattggccagaataaggaaggcgtgtatagcatatttggatactggggtatgtacctgattggtgtatctctgggttactttttgtttcatgaccttagttcaaaaggaaagactaggtgcactcaagtggtaaaagtctgggttcttgcggcatcattttggattttggcgatcattcttgacagctatgttgaaagagtttctcgacga

SEQ ID NO: 1412 - DNA, 550 bp, Hordeum vulgare
gaacatttactattattttttgcgttactgttcatcctgctgcataaaacacctcaccccctagggcccggtttcaacacacaaacgtgtcttcctcaaaatcaatattaaatactccgtacatacaaagtactgtactagataaaatccgtattcaccaaaattttatcctaacaccagaaaactgagcaagaccagcaaccatgcataaagtaaaggtgtatactgacaaaatcatcaaggcggtgaggggagaggctgaaagcgtgtcaactgagagatttactagaccagttaggatatttgccacaaggaatgcgccaagcatattttggttgaatgcttcctcaagaaccaaattcttgtcatgtgaaatggaacccgctagtgtgagaatagatataacctggaaattctggccaaacacaagcataacataggcgaagttgcacattcgtcgagaaactctttcaacatagctgtcaagaatgatcgccaaaatccaaaatgatgccgcaagaacccagacttttaccacttgagtgcacct

SEQ ID NO: 1413 - DNA, 551 bp, Hordeum vulgare
gtctccccgggcctgcagggaattcggcacgaggctcaagccgcgcgtccgccgctggggagaagaacaagaactgctcggaggcttcctcaccccccgaggagctccggccggcgagaagccgggggaaatccgatcagtgttggaattcgacgtcctgtaccatggcttctttgctttgttcacagataaaactaaacagagcatatgttaggaggcaggttcatgagaatagacttacgagattgcccaggtcgcttcattggagccccttgcagtcaggccattttaaaaacattgcattgcgatgcactaagaatttgccttgggaggcctctcttccgtatgcttctgcagaggacgatgccagcattatcatgggaacaaatgttgttgaagctattgatacagaagaagctccagaaattccaatcctccagagtgatcaggatgttgtggacgtgcagaatgaaccttctaggcagctagcaacatttaaactgccaatgtggctgttagggccttcggttctgttggttaccggtatagtt

SEQ ID NO: 1414 - DNA, 543 bp, Hordeum vulgare
tctacttattaagtaaagtagttcttacacccatattcgactgttcagcatcacgccaatgtacaattttcattttatatgtatactacagcagtcgcaggattcaaagtttctatcagtcaaaacccatttttattctatatgcgctacatctgacaaatacaaatgcaccagaactaacacgacacccattctactgtgcagtgagcagaagcagagtagcacgaaggaacctacttgttcacatcatcgctcgacccatagcttgggttgcttgcgaaattgagcccagcaaaccaagcaactcgcatcaactgaattccaaggaccagcacccaccaggtcaccaagccacggagactctgcaccatccacccaggggcagtgatctcgccggccaactggaggcccctcatcagctgtagcacccggtagccctcgtaaacgactggggccaccaaccaaaccggcgatttccagtgccatgtaagcgtctcggtcagcatctgcactgcaagtagtaatagatatggcccaagcagc

SEQ ID NO: 1415 - DNA, 518 bp, Hordeum vulgare
gcgatccgcactacacaaaagcctggagcttgacgacgaggacatctcctacctcactaaccgcgccgccgtttaccttgagatgggacagtatgatgattgcattaaggattgtgacacggctgttgagaggggaagggaacttcgtgctgacttcaagatggtctcgagggcactgacaaggaaaggaactgctcttgccaaacttgccaagtcttccaaagactacgatgttgccattgagaccttccagaaggctctaacggagcatcgaaacccagacaccctgaaaagactaaatgatgctgaacgagcaaagaaggagctcgagcaacaagagtactacgatccaaaactggctgatgaggagcgagagaaaggtaacgagttctttaagcagcaaaaatacccagaagcaattaagcattacaccgaagcgctcaggagaaacccaaaggatcccaaggtatacagcaacagggctgcctgttacaccaagctgggtgccatgcccgaag

SEQ ID NO: 1416 - DNA, 542 bp, Hordeum vulgare
acatgaatagtgcgaaattccgacaggtagagagtatcacatcacatgcaagccatttaagaacaaccacgaaatgtacttttacacaaacccaaatctggaggcaaattaacccccaatgtactgcatcacatgaaaaagctcacagcaatgtttttccacgatcaactaactaaactccgacactcctcagccttggtctacttcatctggactatccctgcgctcacgagcttctggatcttttgcttcacgccggggttcttgagatgctcctgcgcagccttgggattctcctggaaatcaatcaacacctgccgcatcacagggtccgtcaggatgttctggatttcagggtcctgcatagctttgccctgtctctccttcagttcctccggggtgagctcgcctctgttcgccttgttgatctgctgaatacatctctttacaccatcgagcagctcctggttactcggatcatgcttcaggccttcctgataagtttccatcgccttgtcgtactctttcatgaaaaactggat

SEQ ID NO: 1417 - DNA, 493 bp, Hordeum vulgare
  UNSURE (9): n stands for any base
agtgacagngaaagaaagctcctgcacccccactcccaccacctcaagcaccaaaaccacctggaactgtaccccctccaccaccaagctcaaagatctcaaatgcaccagcaccacctccattactgggaaggggaagagcagcaaccggatcagcaaaaggtcgcggcattggattggcgcttcaaagcaaccccccaaagaaagcttcattaaagcctttgcactgggtgaaagttacacgagcggtgcaaggaagtctctgggcggatgcccaaaatcaagggaatcaggctagggctcctgatattgatatgtccgagttagagaccttgttctccactgccgttgcaaccaatgcaagtgaaaaaggaggaacgaagcgtggctctgctattagcaagccagaaattgttcacctggttgatatgagaagagcaaataattgtgagatcatgcttaccaaaatcaaaatgcctcttcctgatatgat

SEQ ID NO: 1418 - DNA, 542 bp, Hordeum vulgare
  UNSURE (15): n stands for any base
acaataataataatncgcataaaggcacgatacattgtaggcgcttagttaactggctgacttgctcgcacactctgcgaaaatggcaccagtctgctgttgatgttacaagaaattttacaacaatcatgatcttttgctttgcatccacttgagctaactttatgtacatgtaagaaagctatgtatcagcaactgatatatgtacaacactacagcggcctcaatcctccctgcatttcgtttcaggaatgtttgccacgaacccgcctgctagtgagaatcacaaaaaagtttccttacattgcaaaccgtgagcaaccattttagtggatgacgcgcagccaacgagcctaatccttctgacattacacctctgtatactacattgagcatcaaaaagcagaagtgggctccgatgtatgtaacattctgcggcagctcctcagcgggatcacaaagatggaagattggcttagaaatgtcctcactccgatccttttatagtagacatacttgccttttccttttccattttcttc

SEQ ID NO: 1419 - DNA, 421 bp, Hordeum vulgare
  UNSURE (418): n stands for any base
accagccgcgcagattgccgcgtacccacagagagagagagagagcgagcgcgggtttgccctcccatggagaagggggacgggcccgccctccagcctctgctgtgcctcgcctggctcgccgccacgctccccatcgccgccgccgcgctgcccatccccgcggccgccggcggccgcttcctacacagcctcctcgccgccttctcctcccgcggcaagaccgtcaggccgtcctcctcctccaaggcgaagttcacagttccgcagaagtacttcttgcatttctatgtggtgggagtggcggtgacaacaagcttgctgcttgcaatatgcttctatgcatatatgaaaatgacaccgctgttggcagagccatcgagttactccacaatcgctagccatcttattgggtcanatt

SEQ ID NO: 1420 - DNA, 337 bp, Hordeum vulgare
ttttttttttttttttttgagttgcacgacattttaacttacaagctgtcacatttacatgaatatcttttacaagccgggcttatgcattctagccagaacgcacgatttttttactgcacacaaggaatgcctgtagatgctacaatacaaatggaatgatcgcatagcgagaacgggggtagtcttcaaacttctgaaggtaccatctatgagtttgtattgctgcaaatgacaagtttgttatcacaaaaatgaacaggaaccacactgaaatgtctgatccaccactagctatcaacatgcccaaatatatgactagttcagcaaggtaatg

SEQ ID NO: 1421 - DNA, 518 bp, Hordeum vulgare
caggttgatggtggctcgagctcctccaatggaggccccgccgctacgctgcccgcactggagtgaggccccgtctgtcgaaggcgctcctcgctcgtcgagtcaagagcataccgggtaccttcacgtcaaaaatcacttatttgaactcattcacatgccctctaattgaagaagtacatgctgatgtattttcagcattggatgaatatgctcaatcgaactttataaaaacaatctgggtggagaagcttgatgatgagaaatcaatattctgttttgaggttgcggagccagcaaaggatcctaagtcaagggagacatacgatcccaaaggaggggacataatagttgtttccttgcggaaaccgcagcatgtatctgatttgatacaaaataaggcatcttatgttttaggttcagttctaaaatgtggagacaaagatggagatttcccacccaattgttgcattgttcggttttcagctgctattccaattgaagtagatccagaaaca

SEQ ID NO: 1422 - DNA, 552 bp, Hordeum vulgare
  UNSURE (13)..(15): n stands for any base
tatctaagtactnnnacttttaagtatgacctttataacacacacatatatatgttgatgccaggcatagtaagctatcaaaaaggacctaaacttaattttaaatgtaaacatctggcatacccttcgcttgtattgccacaccagatcaacgatgccagtactactgcttctgttctggttttctacttccatacgaaggcaccttccagatccgaatgtatgtcttcatatttatgagaaacacagcaaatgatggcgccacaggcaattttgtttctggatctacttcaattggaatagcagctgaaaaccgaacaatgcaacaattgggtgggaaatctccatctttgtctccacattttagaactgaacctaaaacataagatgccttattttgtatcaaatcagatacatgctgcggtttccgcaaggaaacaactattatgtcccctcctttgggatcgtatgtctcccttgacttaggatcctttgctggctccgcaacctcaaaacagaatattgatttctcatcatcaagcttctccaccc

SEQ ID NO: 1423 - DNA, 518 bp, Hordeum vulgare
cgcaggcattcatttgcatagctctcatcctaggagacggcatatacaattttacaaaggttatggttaagaccaccatcagtatgcttgacaaatcaaagcagaaaaacacaaagaacggtaaacaactcaacctttctcccttcctgatgtatagatgatctgatgttgggttcattatcctttcaggggaaggtactctgtcactcgctgaccaacatcgcaatgaagtgtttacaagagacagtctccctaactggatagccattttaggttactttgcattgtcagtcggcgctgtaatcgctattcccaggatgttccctgagttgaagtggtactatgctgtcgtagcatacttactggctcctgccctgggtttctccaatgcctatggttccggccttactgacatcaacatggccttcaactacggaaaagttgccctcctcattcttgcggccgcggctgggaaagaacatggtgtggttgctgggatggtaggctgtggcatggtg

SEQ ID NO: 1424 - DNA, 496 bp, Hordeum vulgare
  UNSURE (11),(22),(23),(42): n stands for any base
cacattacatncactgcatagnnataggcaccttctcacggnaaaaaataactatcacacaaagataattacacagtaacatatataggcctaattttgtttctgctcagtggtaagcaccctgattttcttggacttgtctttggaaaaggaggaacgaagccccgggcctgtacatcaatatcagaaactcatgatgttgcctgctgcagcatacggtaattcaccgctgcggtaatcctgtcgagggtgctcatctatcttcacacccagtcttatactcattagttcatatacacattacttgacaagtctttctgtgccacgtcatctgacaagccttcacttgatggtgtatatatcgatgacaatatttgcagacaacagctggaaaccgacatttgacaattggatctgctgctcttgaaagatatacttcttacaattttacaccttgtcgattaatatatcattcaacttattcaccctgctatgc

SEQ ID NO: 1425 - DNA, 520 bp, Hordeum vulgare
ggaaaacttgttcagctggctaggcgaggatgtgcttaccaagcccacctactctcgcttctgtgcgcttcttgacaattacaacccacaccaagggtacaaagaagttgttactcagcaggataagcacgaagaagcagcatttattgaagagattgcccggacagcaccgattaagtacttgcaccggtatttagtgctgaagggagtcgcatcccaagactatgatgacttcaaggcaatgctgacatccctttggtttactttgtatggaagatgtggtaactctagctgctcttctgcatttgagcatgtgtttgttggtgagataaaggaacagagacaaggagagaccgaggtctcaggattccataactggattcagttttatctggaagaagccaagggaaatgtcgactaccaaggttacatattcccaagacggcgtggggaatcacctgattcggagacacaattactgaccgtgcaatttgagtggcatggtgtgctgaaatcagta

SEQ ID NO: 1426 - DNA, 552 bp, Hordeum vulgare
tgttcttgtatatggtacgttttaagtagtggcattgtgacaacagactgaacatggttttttttcataaccaacagtgtaaatctcacgaagtgaagggaaaagataaaaaccgaagaattacaaacctgcagaagcaggtcgtgagtcatcactcatcacacaaatcagttctctgcaatgggaaagactgacccaatcttgttgttacccatacggtagcacttgacgttcactgtgtacgggccaatatcgacacggttatcctcccctcccataaagaagcacagtgtgtagagtgccagctcgaactcagggctaacaccaatcaaagagcttgatactgatttcagcacaccatgccactcaaattgcacggtcagtaattgtgtctccgaatcaggtgattccccacgccgtcttgggaatatgtaaccttggtagtcgacatttcccttggcttcttccagataaaactgaatccagttatggaatcctgagacctcggtctctccttgtctctgttcctttatctcaccaacaaacacatgc

SEQ ID NO: 1427 - DNA, 515 bp, Hordeum vulgare
cagttactgatgagatgaagcaaagaaatatctcttttgatgtctgcacttacaacatttggataaagtgttgtgcagccatgaaagatgctgatgcaatggaacgagtcttgaaccagatgactgctgacgagtccgtcgttgccaactggactacttataccacacttgctagcatgcatatcaagctggagaactttgagaaggcagaagaatgcctgaaagaagctgagaagcgagcaacgggtagggataagaaatgtttccattttctcatcacactctatagccatcttcagaagaaggaagaagtctaccgcatttggaattggtacaaagcaactttcaagacaattcataatctgggttaccaggaggtattgtctgcccttgttaggctaggggatatagagggagctgaacttctatacgaagaatgggcatccaaaagttctagtttcgatcctaagaccatgaacattttattagcatggtattctagagaaggctttgtc

SEQ ID NO: 1428 - DNA, 540 bp, Hordeum vulgare
  UNSURE (5): n stands for any base
ctganaaatgcacctaaacgctgtggaataaaaagaagtacagagccataccacatgaactctcaagcgggggttcttccaacattcagattacaagcaagtaattgaagtgttcaagagctattcactaatcatatcattggtgtccatccaccatcacgtgcctgcaaccgccaaagcataggtgtcaatcaaggacttgtactcttcgttctcagcacaccctctacttctgagtacactcattaacctgtcgacactctccgtgtcattcttctccttgaaatatgccaggagagtctcaacattggttggtcttggtctccatttacttgcacttttaactgctgtggctttctccaaacatgacagagcttctgataattggttatccttcaggtacgccgtggcaaggatttcccaggtgtttggtttggggttcccacctttctcaacaaatctgttcagagtttgctgagccttcacgacaaagccttctctagaataccatgctaataaaatgttcatggtcttaggatc

SEQ ID NO: 1429 - DNA, 518 bp, Hordeum vulgare
ggagaggggaagcgacgtctcgtcttcctctagcgacgaggatgccagcgagaaccaacttcgtggtcgcgacaccgattacgtcagtttggcaaagcatctggagtctgcgaatacaatgttctccttcatatggtggataattggattttactggatatctgccgggggtgaagaggttatccgtgatgcacctcaactatactggctttgcatagtctttctggcgtttgacgtgttctttgttgttttctgtgttgctctggcttgcattattggtattgccgtttgttgctgcctcccttgcattatagcaattctgtatgctgtctctgatcaggaaggagcatctgaagatgacattcggcaaattccgaaatacaaattccgtagggtggatgaacctgaaaaggattccgctgatgccactgagtcttctggtggaataatgacagagtgtggcaccaaccaacctatagagaaagcacttgcagctgaagatgcagagtgctgcattt

SEQ ID NO: 1430 - DNA, 542 bp, Hordeum vulgare
tatggaatcgctcaaatataattatacagcccactgagtaactaagctatagtccgaactgtagagatacaccccagaactaattccgtaatatggacaacactttagtcaccttttaagacatgacaggattgacacactatcagcgcatttgggatacaaaaatttacaccacattagcggggactcaggcgtgaagtcggaaccgatggcattctcaagtgggatacgtttatacttcctcgcttccgctgctgctcccgcccttccggatgctgaacttgcacagggggcatgtcgcgttgatgtgcagccacttgtcgatgcaggtgcagtggaaatggtggccacaagggagttcacgcagctctgcaccatcgtcgtatgctgaaatgcaaatgcagcactctgcatcttcagctgcaagtgctttctctataggttggttggtgccacactctgtcattattccaccagaagactcagtggcatcagcggaatccttttcaggttcatccaccctacggaatttgtatttcgga

SEQ ID NO: 1431 - DNA, 541 bp, Hordeum vulgare
ggcctgcaggcaattcggcacgagggagaggtccaattttgtaggtttcgaagtctacgctggcaaactgttttttgacaggaaaaataaaagtataggcgtggatggaaatttgtcatcaaacaagaaagctgatacaactgatgcaagactcacaagtaaagcccttatatggggttccactgtactcagccttgaggatgtcatctctgtatcctataattctggtgtccaacattttactttacatgcatatcctggtaagaagtctctatttggaaagacacatagagttcggaaggacttccgatttatggcctctacactagacgaggcaattttgtgggtaacatgctttgcagaacagaacatatacattaatgtactgccacatcctgcaacatccagtatcaaggaagacacagatgccccccttggtggggttttatttgattacccaccaatcaaatccagaactccgcagagaatacttgttatattgaaccctcgttctggacatggtcggtcaattaaagttttc

SEQ ID NO: 1432 - DNA, 513 bp, Hordeum vulgare
cgaggtattccctctataatcactcaaatatacagatacgtcacaacattgtccgaccgaccagtcacccgcaccctcatcggcaagtaaacgataatatagacaactcaaaatcaactgttacaagtaaacaacagatcatacaacgcctcaaaaacccgtgaagctcgacaggtttatagtgcttaggtagactgtttacattgccggccaataagcctgcactgctccggtagcatggagcagacaacctgccccttgacgcggcagagctcgccgtctatcccacagccattgtgggtgtttgcaccaggtttaaccttgactgatttcaccttgacatattccacatagggcaaagaaagatggcggccaaattgcagtagtatgaaaaatctcaacagcttccatctcccccttccaccaactaaaagtaagtccagactgttatcgtcatggctcgcatttggagcaacaacctgggaactttgaactgttttgcatgagtgatta

SEQ ID NO: 1433 - DNA, 526 bp, Hordeum vulgare
ggcacgagggaagctgcagcctcacacgactgatttcctagacatctccaaccccaaagccatcttggagaaaactctaagaaacttctcttgcttaaccacgggcgacagcatcatggtagcttacaacaacaaacagtattatattgatattgttgaagcaaaacctgcttctgcagttagcattattgagacagactgtgaagtggactttgcacctcctcttgattacaaagaacctgaaaaaccacagcgtcccatagttcctgcaggcaaggcacctgctgaagatcaagaggctaatgttgaagatgaaccaaagttcaaaccattcactggttcaggaaaacggttggatggtaagggcccaaaacaacaagcacctggagcttcttacgctgctgcggctgcatgctctgcaccttcagacacaaacaaaagggcaaaccagcaaactgcatcaccttcaggagccaacacatcaacgcgccagaaaacaggaaagcttgtgtttggttcaagtgca

SEQ ID NO: 1434 - DNA, 553 bp, Hordeum vulgare
  UNSURE (9): n stands for any base
gtaatgatncgtactggcttgataaatagactttcatcgagctaaactgtttataaacaatttccttcagatgaatgcgaagtggagatacaaagttcactacagctaccacagtaaccagacaacctccaagcaagatggcgtgtttgattgcgaaagttgtcgctggcaataaatactagcagctaacgcttcaaggagtagctcttcccagtgaacgcgttgaacttcggttcttccttcttcggaggttcgctccctttggcaggctccttttgtgcttctccctctttcttgctgcttgcacttgaaccaaacacaagctttcctgttttctggcgcgttgatgtgttggctcctgaaggtgatgcagtttgctggtttgcccttttgtttgtgtctgaaggtgcagagcatgcagccgcagcagcgtaagaagctccaggtgcttgttgttttgggcccttaccatccaaccgttttcctgaaccagtgaatggtttgaactttggttcatcttcaacattagcctcttgatcttcagcaggtgcct

SEQ ID NO: 1435 - DNA, 519 bp, Hordeum vulgare
ggacgtacctggtggccgccgtcatgtccagcctaggggtcacctccatggccatcgcctccgtgtactaccgcttcgcctggcaaatggagggcggcgaggtgccgatgaccgagatgctgggcacgttcgcgctctccgtcggcgcggcggtcgggatggagttctgggcgcagtgggcgcacaaggcgctgtggcacgcgtccctgtggcacatgcacgagtcgcaccaccggccgcgcgacgggcccttcgagctcaacgacgtcttcgccatcatcaacgccgtgccggccatcgccctcctcgcctacggcttcttccaccgcggcctcgtccccggcctctgcttcggcgcgggccttgggattacgcttttcgggatggcatacatgttcgtccacgacggcctggtccaccgccgcttccccgtcggccccatcgccgacgtgccctacttccggcgagtggctgccgctcacaagatacaccacatggacaagttcgagggcgtaccgt

SEQ ID NO: 1436 - DNA, 535 bp, Hordeum vulgare
tgaatctccggtattcttgccgaccgccaactttactttcaccgaagtggttcacagtccttctctacatgttatacacagaagagtagtttctagccatatataagaacaagacatggagagttgggtctccactaaacaaaaatgtggacgtggtgagactacgaaggcaggaaaaaaaatcaagtcacaacctcatgaaccatctgtgcttcttcctatagctgtttagacacatccacgccctctggagccgagtaacagggagtacaccgccaccacctgaccatcagattgcttcttggtctggctccccatgtccagcaccatcaattaaatcaatatatagcaaccaccaaagataagaaaaaaaattcttgaaatggagttcatctgctagatgagatcacaaggttcttctagctgcatatgccgccacgccatgtccagagctcagatgctccgagtccggttgattctggcgagctcctgctccagctcgtcgaggccaccaacgtcctccagctccttgggt

SEQ ID NO: 1437 - DNA, 540 bp, Hordeum vulgare
  UNSURE (4): n stands for any base
gggnctgcaggcaattcggcacgaggctggaacgtccccaagaggcgctcctgcggcagatattcaggcccagcaaatgggcatgggagaagcagtaggacgagaagcagtgggaccctggcggccgcgatagcaacgaagcatacttgcatgagtcaggttgatcatgatgtggttacgttaggagggcaggggcgtggcaagtttgttgctggtttggtaccgcggcgcccgtatgatccaggtccgtaaaaggagggagggcagtgttgtaaactactccctccgttcttaaatataagaccttttagaaattacactatggattagatacgaagtaaaataagtgaatctacatcctaaaatatgactacatacatctgtatgtagttcatagtggaatttctaagatgcttatatttagaaacgaagggagtagtacagtacactgttagcgtgcactctgtgagagcatgtaatttgatccagctccgtatgatcaaaacggcaattcgcgtggactctctaaactgtacatcg

SEQ ID NO: 1438 - DNA, 551 bp, Hordeum vulgare
gaagggggtctgaattttaaaattttaaatcctggcctagtacgatgtacagtttagagagtccacgcgaattgccgttttgatcatacggagctggatcaaattacatgctctcacagagtgcacgctaacagtgtactgtactactcccttcgtttctaaatataagcatcttagaaattccactatgaactacatacagatgtatgtagtcatattttaggatgtagattcacttattttacttcgtatctaatccatagtgtaatttctaaaaggtcttatatttaagaacggagggagtagtttacaacactgccctccctccttttacggacctggatcatacgggcgccgcggtaccaaaccagcaacaaacttgccacgcccctgccctcctaacgtaaccacatcatgatcaacctgactcatgcaagtatgcttcgttgctatcgcggccgccagggtcccactgcttctcgtcctactgcttctcccatgcccatttgctgggcctgaatatctgccgcaggagcgccatcttggggacg

SEQ ID NO: 1439 - DNA, 560 bp, Hordeum vulgare
cccgggcgtgcagggaattcggcacgagggttaactgctttggaactaacattaaagtgataggcaacacaggaagtaactcaactagagaagctattcatgcttcagagcagggatttgctgttggcatgcatgcagctctccatgtcaatccttactatggcaagacctcaactgcaggactgatctctcatttcgacgaagtcctcccaatgggtccaacaatcatttacaacgtgccagccaggactggtcaggatatacctcctgcagtcattgaggcgctttcagcccatccaaacatggcaggcgtgaaagaatgtgttggacacgaacgagtgaagtgctacaccgacaaaggtataacaatatggagcggcaatgatgacgaatgccatgattcaaggtggaaatatggcgctactggagtcatttctgtagcaagcaaccttgttcctggtctcatgcgcagtctcatgtttgaaggagagaatgcggcgctaaatgagaagctactgcctctgatgaaatggttgttttgtgagcctaatccgattggt

SEQ ID NO: 1440 - DNA, 510 bp, Hordeum vulgare
  UNSURE (10): n stands for any base
acatacgacntcttgaacaaatgaaatgtctaacaaggagaaccgccgctgttcggcaacgtacattgcacatgatgaactcactaatttaatacctactgatcaacacaaaatcatcatcatccagaacctgcacctctttctgtcccacaaagttctcccgcccaattgcttcgacaatacggacaaactcggccctcctttgaagagaaagaggggcgtatggtctcctgaaaacaggcctcactacaccgagctgagccagggcagtgttgagaccaatcggattaggctcacaaaacaaccatttcatcagaggcagtagcttctcatttagcgccgcattctctccttcaaacatgagactgcgcatgagaccaggaacaaggttgcttgctacagaaatgactccagtagcgccatatttccaccttgaatcatggcattcgtcatcattgccgctccatattgttatacctttgtcggtgtagcacttcactcgttcgtgtc

SEQ ID NO: 1441 - DNA, 212 bp, Hordeum vulgare
tcagatgcataagtatcgccgctctcgaggacttggagtgtacgtggtgagtgcgtggcggtaagaaccagccaagctgtgtccaagatcctcgtgagccgtgaccagcagagagttcttggagaaatggcttccgatgagcttgggtcagacgcgtgcgccttcccctgcgtcggcggcgacgacggagcgatggcggcgcactcgccgac

SEQ ID NO: 1442 - DNA, 323 bp, Hordeum vulgare
cttttttttttttttttaatccatcttcataatccaaattattataatctattgtggtttcaggacctaaacctcgcattggttcttttccaatcgaggttgtgtgtacaagtacaacccctaacacatgcaagttagcaaactttctacgatcatgtacgtacagcccgtgtggacactgggcactcgatcttgtcacgacgcggcacacggcacggcggtgagctcgtgcggctgccgtcaatggctgcggctaccttagtctctagtgcgtccaggttgacgagggtctcttactgagccgccgccgccgctggcgcctg

SEQ ID NO: 1443 - DNA, 526 bp, Hordeum vulgare
ggtacgagggcaccattcttctcctgcatttgctgccagagaaatattctacacgcttcgtcgcccattgtcgtacgtacgtcctcggccggaatcatcgatcatcctccctgacctatggtcctcccatgactggggcctcgcctcctcctcttggcggtcgtcgtcgtcgtctccgcgccgatgctcgccgcggcggcatacgggggttgcacgccggggaaatgcggcgacctgaccgtctccgtcccgttcggcatcgtctccagctctgaggagaacccgtgcgcccagctcgggttccaggtccactgtatcgaccacgtcccctacctcgggtactacgagcgcgactttgggctgcggatcctggatatcttctacgacaacggctccctgctcgtctccgacgtccacaagctcggcgacttcgacctctccggcggcggaagccgttgccatgtccccacggccaacacggccaccggagttgcgtatccgttctccatcagcccactcaacgaga

SEQ ID NO: 1444 - DNA, 552 bp, Hordeum vulgare
gtccccccgggtctgcagggaattcggcacgaggcaaagccgcccatctcgttccgttccagctcaggcgagccagcgaccaccggcctccggcgagggcagcagcgatggagggcaaggaggaggacgtgcgcctcggggcgaacaagtactcggagcggcagcccatcggcacggcggcgcaggggtccgaggacaaggactacaaggagcccccgccggcgccgctgttcgagcccggcgagctcaagtcgtggtccttctaccgcgccggcatcgccgagttcatggccaccttcctcttcctctacgtcaccatcctcaccgtcatgggctacagcggcgccgcctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagctgtcgctgacgagggcggtgttctacatcatcatgcagtgcctgggcgccatctgcggcg

SEQ ID NO: 1445 - DNA, 364 bp, Hordeum vulgare
attcgactccacgcaatcgcctcgttcacacacagtgatcagctcacccacagaccagaccaccccggaacgcaacagagcagaggagcggcaaggatgctgctgaacccggcatcggaggcgctggtgctggacagcatcaggcagcacctcatggaggacacggcggccgcggcgccggcgctggcggaggcgaggaggcagaggccggcctattgccggagcgccagcttcggaagcctggtggcggaccagtggagcgagtcgctcccgttccgcgccgacgactcggacgacatggtcgtctacggcgccctccgcgacgccttctcctgcggctggctccccgacggctccttcgccg

SEQ ID NO: 1446 - DNA, 404 bp, Hordeum vulgare
tttttttttttttttttgtttgtacgggttcacaacttccattatgctcgaattcgatcacaagggtgtaatttttaccacacgcacacggacagtgacgcaaatataaccctacgactcagaaggaaccacgccgaccccgatactagcacggttccgctttgatccacttgggcgagtcgcatgcaccgagcactaacagagagagcaggaaatatctatcatttcaggccaaattgcagcacccagcagttgctccaagcttatcttccatcctcgacccatccagatatccaaatggagccgtcgctgaggtcgctttgcctgattgcactgctcgctcgccatcgcactccattgccatcgccaccttgcaccgcgcaacagtgaaaggcgggctcccg

SEQ ID NO: 1447 - DNA, 517 bp, Hordeum vulgare
gttgattgatagagagtcagacacatatgtgaaaattgctgctatttcttactcgaaacactagcgaaagaatatccctctgaaaatcctgcatatagcaagtgctttgcgacaatcattagtcacataagctctggtgattctgtcacttcttccgggttaataaataccgcagggtctctgattaacgtgctaggatcaaaagcattacctcagcttccacttatcatgaaaaatatgctgcaaagagcacatctggtgtcatgttgccctagcggaaaatatgctcatggttctccgagaactgatgccagcctttcaaaccaatctgtaagtatgttgctatccgtacttacaactattcaggtgattgtgcaaaaacttggggaatttgttagtccatatttggaagaaatactggatctcgtgatattgcatcctgaatgtgctactcaaattgatggaaagttggatgtaaaagcagcagatgtccgagggctactgaccgagacagttc

SEQ ID NO: 1448 - DNA, 537 bp, Hordeum vulgare
acctagttacacatgtaaacaacaaaatatgtgtacccgaagccattcatcctgtgtagtttacatacaacaagcaagatcgatgtgactactgccaaccactggagcgaggactagtctggggagagatatcacaggtactcccggaggctctcgccgctgagggtctccatctccttgagtatctcctggcacagcgttttgacaggaagctcaacgtcctcgagcagttcgcccaggaacgggatggtctccgggaccagaaccacatactcctccttcaggtgttggaccatgtacctcaccaccttgaggcccagcatcttagggcggacattgtcacttcttgtctgcatcagcacctcatggttaagaggcttccacaaaacatctgatcgggcagtcactgccatctgtcccaagcatgaaacaagaatttcatccacttcctcaactgatggagcgtctggaactgattcaagagattcaggcggttccgcaacaaactgagaaacaatgggcttcaaaagagtctgg

SEQ ID NO: 1449 - DNA, 521 bp, Hordeum vulgare
ggcgcgacatgccatggccccgcaccgcaggtcaccgtcctctcactccccccctcgcccctcgtcctcgcactagtcaaatcaggcgcaggcgcaggcgcagagccgcggcggcctggagcggggcccgccagtgtgacaatggtccggggtcgccgccgccgccgtcttttggtaccacgccgtcggtaaccgtctcaaggggaaggaggggcctgggtgggcctgattggcagccccttattcaaattcgggcgtttacagattctataaaggggaatttcatttccattcatttatttatctgttgttattcccgatccgctctcctctccggtgcgcggttctgtgccggaatatgcaccgcctatggatggaatctggtagcctttacgctcccgacggattacgcacggccttactgtgcctgattccgttcggctacctttaacgccccctcctcctaccgtacaacaccatctgtgtgtgtggacagtgggagagttgggaatcacaatctc

SEQ ID NO: 1450 - DNA, 550 bp, Hordeum vulgare
tggaatttttaaaatgtttattctaaactaacgcgttcagtacaagagattatcaaagcggcaatcatatagacggctttatttggcagattatctatacatgcaagaatggacccaaatctatcttgtgtggaatcatgtcatcaatcaccgtggctttggtgaaagaaatacttcgccatttcgcgcatcaagaacagtgttcgttccgttccggtgcgccgttattaccacctgacagcgaggaattattctgtacacatccgagattaccgccgccgtcgtgctgcatctttgtctagtttttcttcgacttgagctctgccactctcccctctgtggccttcatagcttctccatatatgctcacaagctcatcaacttcgccaagggtcattgtcaatggtggtgacatcataatgctgtcgcccgcaaccctaaccaacatgccacgcttctggcactcctgcccgaagatagcaccaacaccccattcagcagggaatgggctatctcgtgatttgttgtcggcgaattcagttccaattat

SEQ ID NO: 1451 - DNA, 494 bp, Hordeum vulgare
ccccaatcctcctccggcgacctcttctccagcgcagcctccgtgccggcgacctaccaaatagtttctccgctgggctcggcagtagcgctccctgcccacggacgcgcgcgaggagagacggcggctcgatctctcccttcgcgcttccgccacggcccttttcttctccgtttgccggcgccgcttcggcccttcctccgccaccggcatcgtctgctcctcctccgtgtccgggcacccgaagcagcagcagcttaagttgccttccttatctgctgaatttagcagcgctcgttttggggggctgggtttgtgtcatggagatacttaactgtaagggcgttcgttttagcttgacaggcatcaatggaaccagagccaaccagttagtgaagataggatcccaacatcaacgagttggccgggcaaggtcagtaacatgctgtgagtactctcctgatcctgctagcaagaagcatgagaggtatcag

SEQ ID NO: 1452 - DNA, 535 bp, Hordeum vulgare
ggctgaatagcctgccgtggatcctttagaaagaaaacataggtctacttcaatggctctctaatcatccatttgatacagcttttgcagccatgttacagagtatacagcacaaaagagtagaggagagagtacattataccgatataaatttgatggtatacatgtagccgcaccgggagcgatgatctgggattctgggggcaggtacaagttgcacagcttttagtccatgattaatcacagccagacgcacaaatacccgaacaaatctcggtgattagtttaatcccaagaatcagctcgccattaagcatggtaccagcagaggaaagggggaagccatctgtatcgagccatcgtaagtgcctcacagtctagcatagggaagaataaggcatctgacgccattaaacaaggtcatatgcaccgtagcggaggacatccttttccacttcctttcttcaagttgtgcatcttttgatgaatacttttagcagatctacgaatcaatttgagagcatgtctgctcatg

SEQ ID NO: 1453 - DNA, 922 bp, Hordeum vulgare
  UNSURE (845),(846),(890),(901): n stands for any base
cgacccccgggcctgcaggaattcggcacgaggggtgccccctaggtattctctacctacccacctgtgtcggtttcgggtacaggtacccttttgttgaaggtcgttcgagcttttcctgggagtatggcatcggttacatacttcagcgccgtagcgcctggtatgagcctcgtggagaagcaattgctagtccacggggctcatacttcagcgctgcagcgcttggtactcggacctcggctcgaggcattttctctaccccttcttaccctgaaaaagcagggtcaccttgtgtccttaaacctataaccatctttcggctaacctagcctcctccgtccctccgtaccaacaaggggtagtacaggaatattgacctgttgtccatcgactacgcctttcggcctgatcttaggccctgactcaccctccgtggacgaaccttgcggaggaaaccttgggttttcggggcattggattctcaccaatgttttcgttactcaagccgacattctcgcttccgcttcgtcgacccccgctttcgcggttgcttccctctaaggcggaacgctcccctaccgatgcattttgacatcccacagcttcggcagatcgcttagccccgttcatcttcagcgcaagggcgctcgatcagtgagctattacgcactctttaaagggtggctgcttctaggcaaacctcctggctgtctttgcacccccacctcctttatcactgagcggtcatttaggggccttagctggtgatccgggctgtttccctctcgacgatgaagcttatcccccatcgtctcactggccgaccttgacccctgttattnntgggtcatatctagtattcagagtttgcctcgatttggtaccgntcgcgcagccngcaccgaaacagtgctttacc

SEQ ID NO: 1454 - DNA, 780 bp, Hordeum vulgare
  UNSURE (725),(727),(747),(779): n stands for any base
agctttttatacatatgatgaatgcgcaatctatgtacagagactgctaggctatagaatcaacgaagatgaacaatggtctaagattgttagctcgaatctaaaggggctccctacatgattaacacatgctgtgctgtgtgctccaacccacggttgccgcggttgcgctgaaaacatgatttcattccagacttgtttccttggctaaggtcaaaaaacctgagctgcagcgcacgagacgagagcagcgggtactcatgtcttcacccaccaatcggcaacacttcatccaagtatctcaagatgcaaccgaacagatgagaccacagttagcagggatgctgtcaaacagctatacacagaccatggagtaaacttatttatcgatgatcccattcacttcacggtacgcacaccgatggttctgactttgaatttatatcgaggcaagtcatcttcttcatcatcatcgtcatcttcactcgaatcattctcaactttgtcccatttcgagtaatcaagccctgaatggccctttggtttttggatggtcccccaacactcaggttttgaaggcaaactgggagacacttgaaccttccgagcttctgttaaaggttccttgtacagactgggagacacttgaaccttcggagcttccgttaaaggttccttgtaatcaagctctgaatggccctttggtttttgtatggtaccctcangntttgaatgtagattgggaangacttcaacctttcagagcttttgttacaggnt

SEQ ID NO: 1455 - DNA, 519 bp, Hordeum vulgare
agcactccagtgttggggcattgtcgacttcagtgcacggccatctcacaacaagcagcaaccgcttgatgggaacatgtttattaactatatcgtcaggaagtgctgtgaccttggcattcagatgaacaagacagcatgttttgtgcatctatcagaaatgtcagtgctatcggatccacaccaactgcacgaggagctgaacaaagcaaagcaggctgcggtgaagaagaaccagaagctgcaactcctcttctgcccgatgtctgagcagcatcatgggtacaagacactgaagctgatctgcgagacgcagctggggatccaaacccagtgtttcttgagccacctcgcaaacaaaacccagggccaggaccagtacatgtccaatcttgctctcaagatcaacggcaagctcgggggcatcaacacccagctccaggacaagctcccactggacaacggtgttccttacatgttcataggcgcagacgtgaaccacccatcacctgggaatgg

SEQ ID NO: 1456 - DNA, 538 bp, Hordeum vulgare
  UNSURE (41): n stands for any base
agtcgctcgttgtggctttgcatatcatcagactggcaagnggccaggcaaccacataactatagtataaaagacacagacctgaagcacacgcacaatgacagaaccagcaatacgttccaagttcaaagttcagaccatacgaaacagttcggagtacatgttctaccggaccaagttcagaccatatgaagcagtctgtatatatgttctaccggaccaagttcagaccatatgaagcagtctgtatatatgttctaccggaccaagttcagaccatatgaagcagtctgtatatatgttctaccggaccaagacgctaagcggcaccggtgagaagccggcgtcagatgaagaacatgttgtcctgaagatccacgtgcagcgtcgggaagttgctgaagtcacaagcccccgccgctgtggaggaggccgacgacgacgagctgcgcacctggggctgggacgccagcatgccctcatagtagagcctgccgcggtacgccgccaggtcggcgtagtagacgggcgtcgccag

SEQ ID NO: 1457 - DNA, 327 bp, Hordeum vulgare
agaacgcgcaggtgctggacgggtcggacatccgggagctggtggagaacaaggaggcgttcgcgaagttcgtggagaacaagttccggcaccttgacgccgacggcgacgggaggttgtcgttgaaggagctccagcccgccgtcgcggacatcggcgccgccatcgggctgccggcgagggggtcgtcggcgcaggcggaccacatctactccgaggttcaaaatgagttcacccacgggaagcaagattcggtgagcaagccggagttccagcacgtgctgtccgacatactcctcggcatggcggccgggctcaagagggacc

SEQ ID NO: 1458 - DNA, 552 bp, Hordeum vulgare
ggcagcaaaagcccttatttatcataaattaccgagcaggttacacacatcaacagtatgcatataagcacccccgtctcaggttgacgttcaggcaagaacgtcacgttattgcagtgtaatcaggtagatcccggcgtcgaccgcagctacagcgtcagcggaaactgttactctaccgaacatgtgtctactcgctcggcgatgacaccgtgggcgacgacggcgacggcgacaacaaggtcgacgaagtggacatgggctcgtggaggacggtgttggtggagaccgcgatcgcgttgccgtctaactgaagcatcaccgcccctaggatctcggtcagcagcttcttgaactcggcctcgtccaccgccttcccgtcgtcggcgttcgccatcttgaacgcctcgttcaccacagcatccacctgattaacagctccatatggtggtagatttactgacgcggccatcttgtcaaacgcaacgcgaaggtacttctttgatgttctatctttgtgttccttggggacatcttcccagacagaatcca

SEQ ID NO: 1459 - DNA, 409 bp, Hordeum vulgare
  UNSURE (389),(390): n stands for any base
gaacctcatggggaagaaactggtagaaggcaaagcactccagtgttggggcattgtcgacttcagtgcacggccatctcacaacaagcagcaaccgcttgatgggaacatgtttattaactatatcgtcaggaagtgctgtgaccttggcattcagatgaacaagacagcatgttttgtgcatctatcagaaatgtcagtgctatcggatccacaccaactgcacgaggagctgaacaaagcaaagcaggctgcggtgaagaagaaccagaagctgcaactcctcttctgcccgatgtctgagcagcatcatgggtacaagacactgaagctgatctgcgagacgcagctggggatccaaacccagtgtttcttgagccacctcgcannacaaacccagggccaggac

SEQ ID NO: 1460 - DNA, 247 bp, Hordeum vulgare
tttttttttttttttttttttttttttttggcagaaccagcaatacgttccaagttcaaagttcagaccatacgaaacagtctggagtacatgttctaccggaccaagttcagaccatatgaagcagtctgtatatatgttctaccggaccaagacgctaagcggcaccggtgagaagccggcgtcagatgaagaacatgttgtcctgaagatccacgtgcagcgtcgggaagttgctgaagtcaca

SEQ ID NO: 1461 - DNA, 518 bp, Hordeum vulgare
gtcacacgcaaattctttgaaagccgtaaatattttggcttagaagctgaccaggtgacctttttccacaaggcacccttccatgtgtttctgacgatggcagatttattatggagacgccatacaaggtagccaaggcacctgatggaaatggaggagtttatgctgctctgaagtctaagaagttgcttgatgatatgtcttcacggggtgtgaagtatgtagattgctacggagttgataacgtattggttcgtgttgcagatccaacgttcctagggtactttatagaaaagggtgtatcttctgctgcaaaggttgttaggaaggcttatccacaagagaatgttggagtatttgttcaaagaggtcgtggtggacctctttccgtggtcgagtatagtgaaatggatgcggctatgactactgaaattaatcaatcaacaggacgccttcgttattgttggagcaatgtatgcttgcatatgttcagtttggaatttctgaatcaagtcgca

SEQ ID NO: 1462 - DNA, 557 bp, Hordeum vulgare
tttcgaaatctgggcccattactaacaaaagataccaacagtctggccagtacctgaaaaccctaatgccgatagctcaaagagctcagctcaatacaccaatgtcccaaaccaccatcccaaactgtgaggcatccgttcggccttgcgatccctgtgcaacactgcttcttcctgccgctatgatgaaccgatgcgcctagaacgagatctcgctgggagcgtggaatgtccgtccgcggcagatcgcctccaggttttctccggcgtaggagctgagcggagaaacctcgacgcctgtcatgtacaagggcacagaatgggtcaggaagccgccagcagcgactacccatctgctgtggagtcggagcagcatcagtttggcgctatcgggggtgtcgtaggctgagccattcgcgttcttcactggagcaaattcctcttcacgtagcacctcaaaaagtgtcgtggacggggagtaattgaatgcatcgaatatgaactgctcaagcttcaggcccattgtatacccatgaatcgaaggtatcttcttctgt

SEQ ID NO: 1463 - DNA, 551 bp, Hordeum vulgare
  UNSURE (11): n stands for any base
gtctcccgggnctgcaggcaattcggcacgagggttctctcagagaggttcaccactacctcgaatctcaagatacgaatgatagcgttgtgactccaaacaagagaaaaaatgaggaccggcggatttcaggggaaaaatctcaacatgctggacggccatcaggtaatagacagatggatacggctcatgagaattctgaaaatatgccatcatcagagcccaagcgtgtatccaaagggaggctggcagagttgaaacttaagatggctagagagaatgatcagaggctgaagcatgaatctgctgcaagagaagaagcaaatgtggatccgaaacccaagggaaagaagcaaaaaactgaacctgtgaaacagattgctgcacctgttcgatcgtcacctcgtttaactgcactgaaaaaggaccaggaagagaataatgtgcctagtgatgcacttgtgggcgcacagacagatatcgccgatcaggtacaaccgacagagcaaattaaaaagatggagcaagttaaaaatcgtaagtcaaaggca

SEQ ID NO: 1464 - DNA, 525 bp, Hordeum vulgare
tacctcagttaacataacatgtcttacaacttacaagcatcgtccatgaatgaactgcaggggcttttcgcatacagagtgaaaaccccagccatgaaaatagggggctttctctgcaccttcagcgtcggcgtctctatccgctaaccgcatgacaaaagggttactgctaagtcaacttactacacaaactcaaaagttctgtcaaagtctactagcatacgatggggtaatattagtagtggatcatctactgcgattacaacaagacacagtctttattgaaacatgcatccttgttaaggtaccctaacgatgagcgctaagaagcttatgtatgacctgaactaaggattccttcttatttgcatttgggcagttgtttgcttattccccagatgaagttcactggggagggaaccagccactgctgtagagcctatctgatggtcttggcattggctgcctgacaaggtcgacttggccatggttcttcctagcaccatcataagtggaaggcgaaca

SEQ ID NO: 1465 - DNA, 555 bp, Hordeum vulgare
  UNSURE (40),(41): n stands for any base
gtccccccgggtctgcagggaattcggcacgaggggttannacgcccagtggaaaataccgagtgacagaatttgtgcaggatcataatcaccagcttgctggtccaattgatattgggatgctgaagtcgcaaagattattgtccaaggttcaatctggaaatggaaatgccataagcattcctccaaggtacaagaattatcttcggaccaagtctacaaacgatatgaacgcagaggatttcagagctcttacggattattttcgaagtatgaagagtgataatccatctttttactatgccatccagttggatgaaaatgacaaagctgctaatgtcttttgggctgatgcaagatcaatcttcgactatcattatttcagtgatgtgatctgctttgatatgacctacaaactgaattactacagcaggccactagctttgtttttgggtatgaaccatcatagacaaatggtcatatttggtgctgctttcctgtatgatgaaacggctgaatctttcaagtggcttcttgagacctttaagagtgcca

SEQ ID NO: 1466 - DNA, 536 bp, Hordeum vulgare
  UNSURE (21): n stands for any base
gctgacggcagttatctaagncacaacggcagtatttggagaaaaaactcatcatggaagctcatactggagtagcactcagactcagtagtggtcctacgttcttcaaacctagtggcaatgtaatagctgtcgtggtatatacaagtgatgtgaagtcgtacatcagagaaaatcccacaccggtatcgacgactgaccctcctcttcattctcatggtcgatctggggatttgtctccatgaattgcaatgcgtgcatgtcaccagtataggcttgggtttcggttagttgaccattcccagggaatggctgctgttgcagggttggaactgcagaagcctgaacaaaatggttcaaattgtcacgaaggttctgtgaggtactaagaccaaagttgtggccaagtacataatgtccctgcattagttgatctggtaggaactgatccgtaacattcacttccctttctcttggtcctgcagctacttcatcaggatgcccttttcttggtttctgccttttattggtttcct

SEQ ID NO: 1467 - DNA, 294 bp, Hordeum vulgare
tgaagatgcggactacctgcacctggacagaaagaccctatgaagctttactgttccctgggattggctttgggcctttcctgcgcagcttaggtggaaggcgaagaaggcccccttccgggggggcccgagccatcagtgagataccactctggaagagctcggattctaaccttgtgtcagacccgcgggccaagggacagtctcaggtagacagtttctatggggcgtaggcctcccaaaaggtaacggaggcgtgcaaaggtttcctcgggccagacggacattggtcct

SEQ ID NO: 1468 - DNA, 371 bp, Hordeum vulgare
ttttttttttttttacacattacaatcactttatattgttcataactgttaaaacgaatgctacacacccaacaccacaactcacacgtgtatacatacatatatatatgtatatgcaattatgcacggtactagtatatactagtatttgatacacaattatacaatgtttgtccgcagctccacaccgaagttagccagccatgcatacatagattacacatgccacataacatattccgtatacgaacttaccttgatgcggtgcaccctcaggcatccatacatacgaagtagatacacatccgagccgcatgcatgaggatgcaggtggtggttgcaatggatggagcggattatgaagggcactg

SEQ ID NO: 1469 - DNA, 533 bp, Hordeum vulgare
ggacattcggcacgaggcgtggacgtgctgaagctggtggcgtgcgtggacgcgctcaacggggtggtgcacgcggtggtgggcgccaacgccagcgagacctgctgcccgctgctgtccggcgtggccgacctcgacgccgcgctctgcctctgcaccaccatcaaggccaaggcgcttaacgtcagcctcgtgctccccgtcgccatctcggtgctcgtcaaccagtgcggcaagcacgtgccgtcctccttccagtgcccttcataatccgctccatccattgcaaccaccacctgcatcctcatgcatgcggctcggatgtgtatctacttcgtatgtatggatgcatgagggtgcaccgcatcaaggtaagttcgtatacggaatatgttatgtgacatgtgtaatctatgtatgcatggctggctaacttcggtgtggagctgcggacaaacattgtataattgtgtatcaaatactagtatatactagtaccgtgcataattgcatatatatatatatatgtatac

SEQ ID NO: 1470 - DNA, 551 bp, Hordeum vulgare
cattacaatacctttattattgttataactgttaaaacgaatgctacacacccaacaccacaactcacacgtgtatacatatatatatatatatgcaattatgcacggtactagtatatactagtatttgatacacaattatacaatgtttgtccgcagctccacaccgaagttagccagccatgcatacatagattacacatgtcacataacatattccgtatacgaacttaccttgatgcggtgcaccctcatgcatccatacatacgaagtagatacacatccgagccgcatgcatgaggatgcaggtggtggttgcaatggatggagcggattatgaagggcactggaaggaggacggcacgtgcttgccgcactggttgacgagcaccgagatggcgacggggagcacgaggctgacgttaagcgccttggccttgatggtggtgcagaggcagagcgcggcgtcgaggtcggccacgccggacagcagcgggcagcaggtctcgctggcgttggcgcccaccaccgcgtgcaccaccccgttgag

SEQ ID NO: 1471 - DNA, 479 bp, Hordeum vulgare
acggacaacgccgtggagggcgccaagagcgccggcgagagcgtggtggacgcggccaaggatggcgcgagcaaggtgagcgagaccgcgcaggacctcggcgggcaggccaagcaggcggcggaggaagcgtgggacgccaccaaggacgccgcgcagagcgtcgccgacaacgtcgccgccgcggttgaggatgtgagcaaatgagctcaacatttgccgtctgaacattgaacctgcatggtgtgcatgctagtgtctgttttgtgggtctcgtcattgacgatgtatgctttgtattaacattggtcaaaagctgtgttgagaaaaccttacgcacgagtctagtcgtgcaccattatcccaagtcctaacgaaaacttgatactccctccgatccaatctaactgatgtgtttcagtaaaaaaaaaaaaaaaaaaaaaaaaaaaaaaaaaaaaaaaaaaaaaaaaaaaaaaaaa

SEQ ID NO: 1472 - DNA, 416 bp, Hordeum vulgare
tgaacacatagttagattggatcggagggagtataagttttcgttaggacttgggataatggtgcacgactagactcgtgcgtaaggttttctaacacagcttttgaccaatgttaatacaaagcatacatcgtcaatgacgagacccacaaaacagacactagcatgcacaccatgcaggttcaatgttcagacggcaaatgttgagctcatttgctcacatcctcaaccgcggcggcgacgttgtcggcgacgctctgcgcggcgtccttggtggcgtcccacgcttcctccgccgcctgcttggcctgcccgccgaggtcctgcgcggtctcgctcaccttgctcgcgccatccttggccgcgtccaccacgctctcgccggcgctcttggcgccctccacggcgttgtccgt

SEQ ID NO: 1473 - DNA, 517 bp, Hordeum vulgare
gatgtgctgggagcactctcactagttctgtatactctgattttgatgccattggtgaagtatgtcttggttgtcctttgggccaatgatgatggtgaaggtggtatatttgccatgtattctttaatttgtagaaatgcaaaagtgagtctcattccaaaccaagtacaggctcaggctgagaagaggatgtcaagtttccgtctcaagcttccaacagatgagcttgagaggtccataaaagtaaaggagaaacttgaatcttcactcttgatgaagaagttacttttaggcttagtactttttgggactgccatgtttatatccaatggagttatcacaccagcaatgtcagtgctgtctgctgtcagtggcttgaaagttgggataccaaaggcctcacaaggtgaagttccttttatttagtggaacaaaagtaagctatttcttttgcacattatatatgctagttcctcttcctaatccatcaaatgttatttgcagatgttgtggtgat

SEQ ID NO: 1474 - DNA, 556 bp, Hordeum vulgare
  UNSURE (21),(22): n stands for any base
tatgtatattgtgatatatanntgacctaatgatccttttaaagctagcacttctcatttcgcaaacaacaaaactggccccacaaaatcaaaggagcacacaacaatctgctgcacaagggaaatatacaggttaaatacatcattgtgtgatgtgcctgcctgctgccacaatgcccgctatgtttcggcaccgtacaaaacttacaggagcgaatggctcctaccgtcctagttatcaccttctgaataaagccaggaaagttgagtggttttctttcatcaatcaccattgtcgttcctttatatatggttagtgtaatctctactggataagtagattgccatgaacaaaacaacctgtgctgaagcggttggttttgcgttcagacataagaggtcaggcgcacctgcagcagattcgagtgcgggatgctcatggacacgatcgccctgcggcaattgttcctcaggaacgcgaaaaaatagtttatggtcaacttcttgaagaaccacgagtccttcctggctttgactatgggattatcgatgagat

SEQ ID NO: 1475 - DNA, 432 bp, Hordeum vulgare
gatggcccggcggctgggtcccgacggcgagcgcgcgctggcgtgggcgcgggacaagtacatggtgatggactactgcgacgacccctggaacctgggccgccccgccgagtgcgacatggaccggctcgcctcggccgtctgattgttttgttccgtcggccataccgcttccacacacgtgtcgtcgtgtattaggcagacagacagccgtggggtgtttgcgttcgtgcttctagttctagcctagcctagcctagcctgctaggtcgtctcactcagatgtgacgtgtaggcgtagcaatggttgtatataggtgtacggatcataccaaggatgattcctgcagaaaccttccatatatatatgctcagataatacaaccatacagtgggtaagattaactcatttgtgaaaaaaaaaaaaaaaaa

SEQ ID NO: 1476 - DNA, 414 bp, Hordeum vulgare
  UNSURE (27),(28): n stands for any base
aatgagtttaatcttacccactgtatnnggttgtattatctgagcatatatatatggaaggtttctgcaggaatcatccttggtatgatccgtacacctatatacaaccattgctacgcctacacgtcacatctgagtgagacgacctagcaggctaggctaggctaggctagaactagaagcacgaacgcaaacaccccacggctgtctgtctgcctaatacacgacgacacgtgtgtggaagcggtatggccgacggaacaaaacaatcagacggccgaggcgagccggtccatgtcgcactcggcggggcggcccaggttccaggggtcgtcgcagtagtccatcaccatgtacttgtcccgcgcccacgccagcgcgcgctcgccgtcgggacccagccgccgggccatc

SEQ ID NO: 1477 - DNA, 433 bp, Hordeum vulgare
aaaagggaaaagccaaggaaaatagccgaggccgaggcgaggcggggcggaggaacacgggcggagcggggaagaaatttcccaagggaatcatccctccatcctcgacgccagctcgcctcctcctacctaggtcgcgccacccccctcctcccccctccatccggggcgccgaatcgggggagctccaacccaaatccggaggagccagtccacccccacctccctcccactgctctctatcccgcgattcccgtttcgtcccatcaaaaccctacccagccgggcccaatccgcggcccgcccccgtccctcccaattccgccgccgcgcagggcccggagcacggaattacccccgataacgtcgcgccggaggatcggggggcatggcggccgccgcctaggatggagctggactcctccggcggctg

SEQ ID NO: 1478 - DNA, 399 bp, Hordeum vulgare
tttttttttttttttttaaggatgtaaccatcgattctattatatatcatagagttcgagagtgtcttgacaatcgaggacccaatggagcaacgcaaatgcagcaacattgcaggaaagaaaaggaaaatcaatagccagaaccatcgcaactccggtttcgccagtacaaataatttatcccggcaatgaatggcattcctccgagtccacactaaaatatgctcccataatcttttctgggaagggacgagggtagcccgcccgtcgtaaatggatgcacgcctgttcctccccagggcactccctcccccatgccatagggaggccatgcaggctgcccactttggtgactccccatcggtggccgcatgtgactgttggttggctggttgtatc

SEQ ID NO: 1479 - DNA, 517 bp, Hordeum vulgare
ccggagctcgtcgactccatcctctccaggtgagggggactgaccggggcgtgctgctgccggaggaaggccaccaggaggtcgccgacgtcgcgcagcagctcggcaagtactgcatcgacgagcccgtcaagtccccgcttatattcggagactgggaggtggtgtattgctcggtggcgacgtccccaggaggtatttaccggacccctctcggccggctggtgttcaagaccgacgacatggttcaggtggtggaagcccccgacatcgtcaggaacaaggtctccttctccatctttggccttgatggcgccgtgtctttgaaaggcaagctgaatgtattagacagtaagtggattcaggtcatatttgagcccccggaactgaaggtaggctccttgggtttccgatacgggggcgagagcgaagtcaagctggaaatcacctatgtcgacgagaagatcaggctcgggaaaggatcccgaggctcgcttttcgtcttcctaagacaaga

SEQ ID NO: 1480 - DNA, 530 bp, Hordeum vulgare
ctaactaaaaggctcctaacctcagaaacaacatgagtaccgcaaacatttttcgctcacaacaaggcagtctgcttcaggtagaaattaatatcataaaaaactactttgtgggctttatctctgaatttacatgtgcaagcagttgtgcagacacccatatgtctgatatcccttgtggcgtcgagcacatgaaagtatgcaatggtggcatggtgccatacgtgcctaaccttctaatcttgtcttaggaagacgaaaagcgagcctcgggatcctttcccgagcctgatcttctcgtcgacataggtgatttccagcttgacttcgctctcgcccccgtatcggaaacccaaggagcctaccttcagttccgggggctcaaatatgacctgaatccacttactgtctaatacattcagcttgcctttcaaagacacggcgccatcaaggccaaagatggagaaggagaccttgttcctgacgatgtcgggggcttccaccacctgaaccatgtcgtcggtcttgaa

SEQ ID NO: 1481 - DNA, 503 bp, Hordeum vulgare
aattaatctggtctccgtcccggcctggtccattggattggaggggcgtcagaacagggaaaggcaggcttcacaagggaaggaaggaagtctcaggtgatcctctgatcaattggcatggacgaacacatgggacggcggacggtgggcggcctcctcttcaccaaagggggctccatcctcctcttcagggaggacagctcccgccgcaaggccggcgcttgctgcccgcgcaatggctgcaacggcacccggcattcgacagacaaaggccggccaacgcccagccacagggaagcagcagcaacagcagccaaggaagcagcgccaaccacccggagatcacagcctctcaggaagaagcctccacaaggaagcagcaatccagcagagccttgtagcgaaaccgacaacaggacgggagagacggcggctccaggtgccgggcgtgacctgctggcgcgcctaaaggacagggtgaatgcgtcaaggaagcggtcgct

SEQ ID NO: 1482 - DNA, 553 bp, Hordeum vulgare
  UNSURE (2),(7),(8),(48): n stands for any base
gngaaannctcaccatctatatcagagtttatttcttgttcccttttntattgtccactggaccttgtgaactgaaggaagacaagaagtcttgaaggcacaaacaaatgtttcgttctagaaaagaatagaaaaaaagaatacagatcttgtgtctagacatttcaggagaatctgtttacactaaacaagcagaggctgctggtgctagcgctagacggtcttggcggcgacggatttgcagatggggcaccagttcttctgccggagccagtgctgtatgcaggtgatgtggtagtagtgcttacacgccatgttccccacctcctcaccaccagagtactcctcctggcatatgctgcattttctgtcgcagtctaggtgcgtctctggggctgtgggcgtgtacaggcttcgtttcaggcacttgtacagcgcgtcctctgaaagcccggtgttcaccgtgccgatccggtcacccaacgcgagcaattcctcgtaggacatgccgtcgatgtccatcctcatcgcccggtgccgatcactgagcatg

SEQ ID NO: 1483 - DNA, 517 bp, Hordeum vulgare
cagtgacaaggaccaacgaccacctcgagctgctcctagaccagttcgaagaacaagtgctagaagaggaacccgtcaagcaaaaatagactatcgtgaatctgacgaaagcggccctggtgaaacaggtgaagaagatcaaaagctgggcacagattccgtcgtaaagatggaagaggatagcctggatgaagaccaaggaccgcctgcaggtgcccagttcatcacattggacgagcgggagcccaaagtcgttaaattgagtgcggcgggggagacgacaagcagtccaaagtacgaaagcaaagaaacctcccaaagaacagacgctggtgaaggagcaagcatggcaggtgataagatagaacagatggtggatcctctgcatgcgatgctcctcgacatgataccgtcgcttagggaagacacaagcagcgatcccccggccaaagtcgagcatgacccacctcgtgcaagaagctccgtgtcggatcacagggttccagtgcccgggaca

SEQ ID NO: 1484 - DNA, 555 bp, Hordeum vulgare
gctcaagtctctggctcttacctccagataacacgggcgatggtaccaacagggttaacaattacaagcatctctcatatttacatgaccgtggaaaacggtaaagacgtgcagggtacacatcaccctgagccccaaaaggccaagcactctcaccaatctttcagaaactcgtcggccagatctttgtagctaacctttttcttcttcggagccgcgggatttggatctggtgctggaacccccacactatatgacgaacttcctgcccgcggtgccggggccacgggattcgatgcagaacttcctgtcccgggcactggaaccctgtgatccgacacggagcttcttgcacgaggtgggtcatgctcgactttggccgggggatcgctgcttgtgtcttccctaagcgacggtatcatgtcgaggagcatcgcatgcagaggatccaccatctgttctatcttatcacctgccatgcttgctccttcaccagcgtctgttctttgggaggtttctttgctttcgtactttggactgcttgtcgtctccccc

SEQ ID NO: 1485 - DNA, 476 bp, Hordeum vulgare
acggatccttctcgtcttcacgtgattcgagtcgcctctctccgtcagcccaaacatggacgcaagcaggcgcccaagtggaatccagcaattgcttgctgcagagcaagatgctcagcaaattgtaaatgctgccagggctgctaaaacggcaaggcttaggaaagcaaaagaagaggcggagagagagatagctgagtaccgtgcgcagatggaggctgatttccagagaaagctcaccgagaccagcggtgactctggtgcaaatgtcaaacgccttgagcaagagacaaacgtaaaaattgaacagctcaagcagcaggcagcaaacatctccccagaggtgattcagatgcttctgaggcacgtcaccactgtgaagaactaaaggttgatgagtcggccctgcatattatgatgacaactttgtactatctgtttattcctttgggaggtgttataagaaatggcttttg

SEQ ID NO: 1486 - DNA, 554 bp, Hordeum vulgare
cgcaaaatttaccgaactaataccaaaggtttagcaagtagtatcagacatggctgctgctcaactgtagcagcttatttccaagacaaagaacaaggaattacagctggaagtggcaaaagccatttcttataacacctcccaaagaaataaacagatagtacaaagttgtcatcataatatgcagggccgactcatcaacctttagttcttcacagtggtgacgtgcctcagaagcatctgaatcacctctggggagatgtttgctgcctgctgcttgagctgttcaatttttacgtttgtctcttgctcaaggcgtttgacatttgcaccagagtcaccgctggtctcggtgagctttctctggaaatcagcctccatctgcgcacggtactcagctatctctctctccgcctcttcttttgctttcctaagccttgccgttttagcagccctggcagcatttacaatttgctgagcatcttgctctgcagcaagcaattgctggattccacttgggcgcctgcttgcgtccatgtttgggctgacggaga

SEQ ID NO: 1487 - DNA, 534 bp, Hordeum vulgare
ggcaattcggcacgaggctgctccacgccccgcaaccctgccgtcaagtgctatggcgacaggttcatcccggacaggtcggcgatggacatggacatggcgcactacctcctgacggagccgaggaaggacagcaagaacgcggtgacgccgtcgccggccaaggaggcgtaccggaagctgctggcggagaagctgctcaacaaccgcaccaggattctcgctttcaggaacaagccgccggagcctgagaacagcatgctcatggagctccatgctgatgcggcctccatccaggccagaccggtgaagaagcgtcgatacatccctcagtccgcagagaggactctggatgcgccagacatcgttgacgattactacctcaacctgctggactggggaagcgccaatgtgctgtccattgcactggggaacacggtatacctctgggacgctgcaagtgggtctacatccgagcttgttaccattggtgaggacgatggccctgtcactagtgttagctgggctcctgat

SEQ ID NO: 1488 - DNA, 526 bp, Hordeum vulgare
tcttatatataatgcgacatatgtatgtataacatacatcaaactggtcttgatgttcatccggatcaatgtaaaatataccaactaaagttaccagcatactgaagcacgcacaaaacacttcagtacacacaaagaatttctacgtaaaatcagcctgctaattcttgtcagcgttgcagcacttgccgggacctgatccctccctagcgtaggtgattgtaactgttgaacattctgctctggggggtcttcactttcactgcagacttgggagcatcaggagtcccaaacacattccagaagcgcagggtctcgtctgcggccgcagatgccaccgtgcaaccatcagggctctgagccatgaagaggacacgggaagtatggccattgagctcggccatcttagtcatcgacgggtacttccacaacgtgagctggttctgagtgaatccatgcgagctcaacagctctctgtcgttcttgttccagagcagtgcgcacacttgtgacccggtgtcgactg

SEQ ID NO: 1489 - DNA, 287 bp, Hordeum vulgare
  UNSURE (147): n stands for any base
aggcaccacaacacttcctcagtagcatatcagaacctcccagctagcaatggcgaagtgtcttgccgtcgcgctcctgctactggtggtgctcgcgtcctgcgatgggagggagctgagccagaaggacagcgcacttggagcggncgcgtggtgccggcgccggaggtggcgtcgccgagtccaaggcttcttcgggttcggggttgccggacttgccggtggtgggaaccggtaccggtaccagtaccattaacggcccgctggtggtgattcctggggtccct

SEQ ID NO: 1490 - DNA, 529 bp, Hordeum vulgare
ggaccggagggagtatgtatctacgttgatgttacatggtagcaaacaaggaaccagtatatattaaacttcaaaaaaaaacggatacaaacgctcattgaggaacgtggacatgagcgaaacgcaggtgtttttcttccgggcgatgccggctatagaaatctagtaaaacccacaagttcagcttcagcttgtatgtatgtatgcaagtcagcacatgcacacaagatgatcatgcatgagtagggaccccaggaatcaccaccagcgggccgttaatggtactggtaccggtaccggttcccaccaccggcaagtccggcaaccccgaacccgaagaagccttggactcggcgacgccacctccggcgccggcaccacgcgccgctccaagtgcgctgtccttctggctcagctccctcccatcgcaggacgcgagcaccaccagtagcaggagcgcgacggcaagacacttcgccattgctagctgggaggttctgatatgctactgaggaagtgttgtgtggct

SEQ ID NO: 1491 - DNA, 241 bp, Hordeum vulgare
gctcaacccaaccgccgtcgtcggcccgagagagtctgcgaggaggagcagcagcagcagcggagaagaagaagaagaggaggagccgctggtctctctccgccatggccggctcgtccgccgacccggagaagctcatggccaaggccgacaaactaacaaaactgagctttacaagatggaatgctgattgggggagtgctaccgccttgtactaacaagctgcaattgcttatagatt

SEQ ID NO: 1492 - DNA, 552 bp, Hordeum vulgare
gatgaaaccataacaatggtcgcaacaacagcaaaccagcggtaccgatgtaggttgtatgtgcacggatccgaaacaaacagaaaatatggggatcgaaatccatggtacagatgcggcctactagtttctatgcaattcagaatgtgtgtttacaacctttcctgttcataatggtgtattcaagtcactcgattgattgtgcttcttgctgggcagtttgggatcaagttaggtcgtcctcgtccaaggaatccccgtcgccgcctcccacgtctttcttgatggcctgcaggtcacctgttggtagtttccttgcgagccgaattaccacatggtcgaggtgattaatagcagttgattgagcagcacgcttgatttcttcagcatcaccttcctcataagcagacaacagtttcattgcacatcgattctggtcactattcaggaagccttgaacccctgagcaatcattgtagcatttctgagcttgttgaaaatcatgtgcataaaggtagataatgattgcactcagataggccttgcattggc

SEQ ID NO: 1493 - DNA, 520 bp, Hordeum vulgare
gcagcccgcaacactaccacacagccacgcaagcaacactatctcatcagtagtattaccagagcctcccagttagcaatatggcaaagtgcctcgccgtcgcgctcctcctactggtggcgctcgcgtactgcgacgggagggagctgaaccagaaggaccaggcactcgcaacggcacacggtgccggtgccgtcggcgagtcgaaagtgttggggttgcctgacctgcctactgtgggaaccgttaccggtaccagcaccactaacggcccgttggtggtgcttcctgggatccctgctcacccatgatcatcactagttcatgtgctggcttacaagatgaagctcacctcgtgactttagacttctagggtctagcttaaggcaaacaccggcgtttcgctcatatatgtccatgttccttaatgggcgtctgtatcaactatcctcatatgtaattcttttcagtccgtgttgctgtatttttcgtcccttgatgtggtacacgtatcgtcaac

SEQ ID NO: 1494 - DNA, 548 bp, Hordeum vulgare
gtcgatttcagtgtttttacgttgacgatacgtgtaccacatcaagggacgaaaaatacagcaacacggactgaaaagaatacatatgaggatagttgatacagacgcccattaaggaacatggacatatatgagcgaaacgccggtgtttgccttaagctagaccctagaagtctaaagtcacgaggtgagcttcatcttgtaagccagcacatgaactagtgatgatcatgggtgagcagggatcccaggaagcaccaccaacgggccgttagtggtgctggtaccggtaacggttcccacagtaggcaggtcaggcaaccccaacactttcgactcgccgacggcaccggcaccgtgtgccgttgcgagtgcctggtccttctggttcagctccctcccgtcgcagtacgcgagcgccaccagtaggaggagcgcgacggcgaggcactttgccatattgctaactgggaggctctggtaatactactgatgagatagtgttgcttgcgtggctgtgtggtagtgttgcgtggctgcctcgtgcc

SEQ ID NO: 1495 - DNA, 516 bp, Hordeum vulgare
gctgtacattgacgctcgccttttcgatgcgcaaaatgatgagggataaagctctggtcaggagactttctgcatgtgagacaatgggttccgcaacaacaatttgcagtgacaagactggaacattaactttaaatcagatgactgttgttgaggcatactttggtggagagaagatggatcctccagataacactcagaagctatctgctcccgtgtcaacaatgattattgaaggaattgctcagaatacatccggaagcatatttgagcctgagggtggtcaagctccagaggttactggatcaccaactgaaaaggctatactctcttgggggttgcagcttggtatgaaattcagtgaaacaagatcgaaatcctccattcttcaagtcttcccattcaattcagagaaaaagcgaggcggggttgctgtgcaagtgggtgactctgaggttcatgtatactggaaaggagctgctgaacttattttggaatcatgcactagttgggttg

SEQ ID NO: 1496 - DNA, 486 bp, Hordeum vulgare
agccacaggggggcactgtcaggcgtgttgttgaagatagcgtggcaaatccccaaaagtgagagccctaatattatccacttcaaacctagtgtatttacaaatccaaatcaccagataattacagccccgacgatcgtgttaaaactccacgcaaaaactgcaaaggtcctcctcgacgccagcccgtcacttcacaccacctcgatgtgcttcacaccgtcgtcttccttcgcatcaccagcctctttcttggctgggcagcagcaagagaacatatctaacaacggacggtctgcaacagggataagctttcccacgagtgctaacggccagctgataaaagcaagacctatggacaccaaccacagctgccagctcaatctgactgttgtcgtgaacttaccaagaaactcgatgataagcacctggagcacaaccgttatggctataatggcaatgaagaggcggttccctgcaataccc

SEQ ID NO: 1497 - DNA, 517 bp, Hordeum vulgare
cattcgtgcaggtcgggggagccatctatgtcgtgtacaagcacatatacctcggtggcggggacagagctttgcttcgggcatccatcatcattctcaccgtcggtgttgccaagtatgtggagagggtattggcactacggcgaggcaacttgggcaatattcggagctcaaacaagaagaagaaactaagcagattcactgatatctcgggctccagaaagggaactgtgctggacaatgagcaagccctgatggttgctcacaacatgttcccgttctgccagcgtgcaatgtctgactcttctgtcaacatggattcacctgaccttgatgcaagcagagaaatgttctcttttgggtgggagagtatgtgcaaggtggtggagatggaactttctctcatgtacgacatcctctacaccaaggcagccatgatccacacctggggcggctacttgatccgttttctttcgccaatcgccaccttcacagcatttgttctgtttctggtcta

SEQ ID NO: 1498 - DNA, 554 bp, Hordeum vulgare
tcaatggtcccaaatgattgagaggcaatcagtccctagatacaacgtagcataccttctactcctctacgatggggccgtggcggacaaagctccggtttgggttccatccacggcggacaaggttcttggagtttttcagtgcccatcggcggcagcgatggggccggacgcggcggtggatacggttcctcctgtttgattcccatcggcggtggtggtggtggcggcggaatcgctaagccccaccacggtggtctctccgacgtatgcatgggtgggtggtggcggcagtggcggcggcggtggcggacaaggttcccgttttttattatctggaccgcgttggccgatctgaaatgggccagcatgctctgccaaaatccacacgatggtcgtgagctcaccgccacggctgagctgcctggcatgggattcccggctgcatcgggtgcccgcatacagcagcttgtccacccacacgttgaagacaagctccagcagttccggcatctctgactcatgggcgctgagcagcaccatggcaatattag

SEQ ID NO: 1499 - DNA, 541 bp, Hordeum vulgare
  UNSURE (4): n stands for any base
gggnctgcagggaattcggcacgaggcaccccaagccctcccgtctccccgccgcctcctcatccgcgtcgcaaaccctcgtccaatccgccgaatcccgcgaccaaggaacccaaggtagatcgatggccaagagctcgttcaagctggagcacccgctcgagaggaggcaggcggaggctaaccgcataagagagaagtactctgacagaattcctgtgatcgttgagaaggctgggaagagtgatattcctgacattgacaagaaaaagtacctcgtcccagccgaccttacggttggacagtttgtgtacgtggttcgtaagcggatcaagctcagcgctgagaaagcgatcttcatctttgtcaagaacactcttccaccaacagctgccctgatgtctgcgatttacgaggagaacaaggacgaggacggcttcctctacatgacctacagcggggagaacaccttcggatcgctcgaatcgctctaggtggtgccgccacgatgacaatcaccctgaatgtctcctgtaaataa

SEQ ID NO: 1500 - DNA, 557 bp, Hordeum vulgare
ggtcgaatacttgatatatattaagtacgaacattcaaataggacaagtcaggatactaggtttttcttggttgcacaatttaaagatcctacgacgaggcaaaccagaatatatacacagttgattggcacgccttatttacaggagacattcagggtgattgtcatcgtggcggcaccacctagagcgattcgagcgatccgaaggtgttctccccgctgtaggtcatgtagaggaagccgtcctcgtccttgttctcctcgtaaatcgcagacatcagggcagctgttggtggaagagtgttcttgacaaagatgaagatcgctttctcagcgctgagcttgatccgcttacgaaccacgtacacaaactgtccaaccgtaaggtcggctgggacgaggtactttttcttgtcaatgtcaggaatatcactcttcccagccttctcaacgatcacaggaattctgtcagagtacttctctcttatgcggttagcctccgcctgcctcctctcgagcgggtgctccagcttgaacgagctcttggccatcgatct

SEQ ID NO: 1501 - DNA, 546 bp, Hordeum vulgare
  UNSURE (66): n stands for any base
gtcccccggctgcagaaattcgcacgaggtgactgtcggcaagaaatcgatgagtgctccactggnaaagccatgcacgcatacctgcatcaacacgaagggcagtttcaactgtgtgtgcccatcggggatgaatggtgacggcccgaaaggagggaagtggctgcagtggaattggcacgctgcagatttcaatagttgtggggctagctctgctactgcttctccttcttctcagtttctggactcactgtcttgttaagaggagaaagcttgcgaagaaaagacagagatattttatgcagaatggtggcatgttactgaagcagcagatgctttctcggagggcaccactgcggatatttacctcaggtgagcttgacaaggcaaccaacaaattcagtgataacaatattgttggtagaggtggattcgggactgtttacaaaggtgtactatcagatcaattggttgtagcagtcaaaaggtcgcagcgagttgatcagagccaggtggaacagttcgtcaatgagttggtcattcttt

SEQ ID NO: 1502 - DNA, 539 bp, Hordeum vulgare
gattgtgaatccaaagggaaaaatacggcctttctgtgtcaaacgggtcgaaaagtgggctcaacagagatacgaaaaggaaaaggagaaaccaaccaacacttcctgatataataaccctactctgggtttctgcctcactggcagctaaaccacaaatggaacagatcattactactatgaaagacctaactgttccatcattaccacaaatgcttgaagcgctcagaaggctgatgaaacgacctttcatgttaggtcctaacatgaaaggtcgctcgatgggagtagaatgagatccatgctttcatccttggcaattccatcatggctggaactcgactgcgagtcgaaattcatctccccgcggcaactcaagtcccgtagcagaggaagcagaggctcttcttcttcactcttcaggacagagtgttgtttcatcagccttctcagagcttcaagctcgaccgcaacctcgatcatcctcggcctctcttcacctctcagcctcaagcatcgcaaagccagctgcgcgaccg

SEQ ID NO: 1503 - DNA, 337 bp, Hordeum vulgare
ttttttttttttttttttttttttttttttgcgaaacggaagctttttttagagagagaaaaaggcacttgcgccctgctttacaaagaagttttgtgagcgtttccaaggcggggaggacgtgactgaaaactcgagacacaatctttctaactttgggttgggttaggaaactgtgtcgcaagttctagcgcagcacgacggtacgtacctatccccagcgccgcttcacagaacacgggttaatcaatttccataccaagatgatgattgtgatggcgaaccgatgggggaaccagtacccacggcagccgaggtgagagcagcaaaaggaacc

SEQ ID NO: 1504 - DNA, 414 bp, Hordeum vulgare
  UNSURE (406),(410): n stands for any base
aggagtccatccccacacacacacccacacccactcttcttcccccaaccgtctcggatcggagcagagcagaggctctcccttggccttcctccctctcggcagcaggctcgacctttgcatggcagcagtggctacctccaaggggcgggtgatcgctgggagcctcgtcgcgcgcgtcctcgccggcaaggccgccaacgcctccccgaggtatgctcacacgcctcctgtgagctcaaagaaagaatcagagtactagcatacgtacttacgttggaagtagatcagtaccactactgctggtgtgctgctagttccaccgtgcctccgagatcttgttgctccggagatttgtaaatggttccttttgctgctctcacctcggctgccgtgggtactggtntccncatc

SEQ ID NO: 1505 - DNA, 515 bp, Hordeum vulgare
cttctggaccctgaattcgtctggtgccccagaagaaaagtatctggatctcttgatcctgctgcatcgatgaaggtgcgggccacatcgcttgctcacaaccaggctgttactacactcaccagtgaaggtggtttctcagttatgggaagcatttcaaagtgggtattctggctagtgatcacactcttgctgttcgggtttgcagtaggtctcttcattcttattgctgttcacaatgcgattgtgctgatagttgttgttgcaatgattggttctgctgctgcacttgtgtcttggaatgtttggcggggcaggagaggcgtgctcaggtttgtcaatagctgtcctgatactgatctcagaactgcaaaagatggagagtatgtgaaggttacaggggttgttacgtgtggaaatttccccctggagtcctcatttcaaaggattccgagatgtgtgtacacttcaactaggctgtatgagtataggggctgggattcaaaaactgcaaa

SEQ ID NO: 1506 - DNA, 556 bp, Hordeum vulgare
  UNSURE (34),(35): n stands for any base
gtacagcaacaatacaatttaagggctttaacanngcggtgcaagggaagttcatcctaaataacacataaacccgattcaacaagtcttcaaacagcccaaaagcaatcatattacacaagtattgagagctcataaccgaaaaaacaggagcgaaggaggacaaaacacattgaaaaaggactatacagccaaacacagattaaccagcagccatactccatctttactagccttaatcacacctaacatttgtacatttttctcagttctaatactctaccaatcaaacccaacccgaggtcaaaagattcgacaggccatcgttccctcttcaacagcagctattccacaccacagcaatcatcagcttgctatactggtatcacatccatgtctgaagtatcttcacatctcacaaccagtccatcgaggttcgctgggaagaaacaagtaccccactggcaaccagatgagatgggctctgatggaggtactatcatcaacacgctctcattcttttgaacaacacccatcacactcacagtgctgcctt

SEQ ID NO: 1507 - DNA, 518 bp, Hordeum vulgare
gtgatggatgccactgatggcgttatgcctggtacaggacaagtaggagcagaacaaggaagtgagaattttgttgaatccttggctcctgataccacaatagaaaagacattaccacattcgccggatgtcaattcaactggccattctgaaccagctgccaatctggaatctcccctaggtgaagagaagcaggaaaaggaggaaagtcgggagaaataaagtggatccgggggtgtagccgtatatcacagttttgttcaccatagtgcacgatgcccggatggtttgtgatctcatggacgtgcagtgcaggtggttggggaaccggcgagaccattcttgtctaaatagctcagggtctgatgtattgattgctgtacaatttgcattagatggccctgccttgcgcccaagatgcaaaagtggtcgcttcatgggtctagtcgagctgctcaagctcgtcttacctcagaattttttggaggtctgttgttttggtgtcactgtactcggtc

SEQ ID NO: 1508 - DNA, 553 bp, Hordeum vulgare
gagcacttggaaaacaagaacggtattatagtatacatattgtgcatgcgagaatataatctgctgtctgaattccagtcaaaatttcagtactactaataatagcaccacctaggggaataatgaacaagtatcagaaccggatatcaccaataatcagttatttaccggacacgacacagtagaactcggctccatgattgcaggaagaaagagacgtctactttatccacatgctgcgtcatatgctgccaacagaccgagtacagtgacaccaaaacaacagacctccaaaaaattctgaggtaagacgagcttgagcagctcgactagacccatgaagcgaccacttttgcatcttgggcgcaaggcagggccatctaatgcaaattgtacagcaatcaatacatcagaccctgagctatttagacaagaatggtctcgccggttccccaaccacctgcactgcacgtccatgagatcacaaaccatccgggcatcgtgcactatggtgaacaaaactgtgatatacggctacacccccggatccact

SEQ ID NO: 1509 - DNA, 1018 bp, Hordeum vulgare
  UNSURE (1)..(6),(15),(19),(22),(25),(26),(33),(35),(39)..(42),(47),(64)..(67),(90),(92)..(96),(118),(133),(135),(137),(139)..(142),(160),(183),(184),(213),(215),(219),(221),(223),(225),(231),(235),(240),(244),(246),(311),(330),(375): n stands for any base
nnnnnnttggaaatntacntangannctaaatngntggnnnnctacntaggggtttgctaaacnnnnttcttgcgcaacccaaaaagatntnnnnnatttttttgttttgggtggccntcaaacgaaaaaccntntntnnnnctactatcctcttactcncatttttatgcgtggttgctgtnnggggcggcctacacccaaaaaaaaacttntnttgntntntntttctntttnttttntccntnttttcttttcttccctcttcccctttctcccctcctccttctttttttttgggtggggggggccntcccttttttttttttttncccgcccgccctcccccccccttcttttctggggggggggggttnttctcctcccttttttttcttttttttctcttcctcttgcccctctctttctttttttctttctttttccttttgcccttcgctccttttcctttctcttcctttttttcttttctcttttttttttttttctttttctttttccctcctttttctttcctccttttctgtttttctcctgcttccctttctctttctctctttcttttgtcttcttttttttttttttttcttcttctcttcttttttctcttttttctctgttttcctcttttgttgctcccttttttttcctttttttttctcttttctttttcttttgttctctctcttcccgccctttttccctttccttctttcttctcttttcctttttttttcgtctccctccgctcccccgccttgttctttcttttttttgtttttttttctttctttctttttttcttccttcctccctttcctcttttttcccccctctttccttttgcgttttctctttcgcgtctccgtttccgtttttccctttcttcttttcttttcttctcttgttcctttttcttccctccctcccttctcttttttcccttcctttctctctccccctttttcttcgtttctttttcctctcgtaatccaccgt

SEQ ID NO: 1510 - DNA, 522 bp, Hordeum vulgare
  UNSURE (6),(9): n stands for any base
tgccgnaancaaccatgcatggcatacgactagaaacaacttcatgaccagaacgctaaatctaccactaaggattcagagacgggaatccttgagttcatagttcaaccgagagtaacagctgaacctagggacaccaccctaagcaatagtcgaggatgaggaggtgtgagctttggtgtactcgtccatctccatcttgtacgcggccatcccttgggccgctttctggctccacaccttcttctccgcggagctcaggtccttccacttcaccgagattagcgcgctaagcgtcgagttgttcaccccgggccgctcctccgccagctgcttcctcgcctccttgctgaagagcaggaaggaagaggccggcttcttgggcctgttcgggtcggcgttctgctgcttcttcttctgacgcttctctttggttttcttgatgatgttgtctgccttctccttcttcctgagaagctgcagagcctcctgcttgaggatcttcttctgctcctcttcttc

SEQ ID NO: 1511 - DNA, 882 bp, Hordeum vulgare
  UNSURE (18),(33),(61),(795),(817),(832),(833),(860): n stands for any base
gtcccccgggctgcaggnaattcggcacgaggnaagcgcccaggctatgaccacaacaagnaaggcaggtgcaatgaatgctctagtccgctcatctgctgtcatgtcaaatggacccttcatactcaacctggactgtgatcattatgtttacaactctcaagctttccgtgaaggcatgtgcttcatgatggaccgtggtggtgaccgtattgcctatgtccagttcccccaacggttcgagggcattgatccatcagatcgctacgccaaccacaacactgtcttctttgatgtcaacatgcgtgcattggatggtctcatgggaccagtctatgtcggcactggctgtctgttccggcgtgttgcactctatggatttgaccctccacgctccacagagcacggtggctgctgcagctgttgctttccaaagaagcgcaagatcaagagcactgtttcctcagctacatctgaagagacacgggctctgcggatggcagattttgatgatgaggagatgaacatgtcaacatttcccaagaggttcggtaactcaaacttcctcatcaactctataccgattgccgagttccaagggcgcccgcttgctgatcaccctggtgtgaagaatggccgtcctcctggtgcccctcactgtccctcgtgaccttctcgacgcctccacggtcgccgaggccattagtgtcatctcatgctggtatgaggacaagacagagtggggtcagcgtgtcggatggatttatgggtcagtcacagaggatgtcgtcacanggtacccgggatgcacaaccgngggtgggaagtctgnntactgggtacccaagcgtgatgccttncgggggactggaccctatcaac

SEQ ID NO: 1512 - DNA, 503 bp, Hordeum vulgare
  UNSURE (51),(56),(67),(73),(80): n stands for any base
ggtagtacgtatttaattatgtacttgttgataccatgtagcgcacaaggnaacgnaaaaatacgangacggngaactgngaaataaatacagatgacagttgatacagacgctcagtaccgaacatggacatgagcgaaacgtcggcctttttcttcctggcggtgctacctatagaatctaaagggacaaggcgagctttagcttcttgtagcgccagcacatgaggtagagatgatcatgggccgatagcagggatcccagggatcaccaccagcgggccggtaatggtgcttgttccggtaccggttccccccagcagaggcaagtccaaagccttggagtcgccgacgccaccgctggcaccggcaccgtgtgtcgctgcaaccttctctttcagctcccgcccgtcgcatgacgcgagcaccaccagtagcaggagcgcgacggcgagactctttgccattgctcactgagaagttttgatattactactgacgaga

SEQ ID NO: 1513 - DNA, 518 bp, Hordeum vulgare
gggaatgataggaacagtcacagcagaagttctaggaagagtaagcatgggtatgattcagaagatgattctgagtctgaccatgatgagagaaagggaaataaatacataaagagatccttcttagatagagtccctgattctgagattcttcataagaatgctaaacagggaaaaggcgcacgccatgattctgagtctgattcagatagcgaccatggcaagaagaaggcaaaacacacgaaaaacaatcgtgatgagggaaagaacggtcctgtgaagagctctcgtcatgactctaaagatgagaagcccagaagaagcaagtacaagggtgattcgtacagtgagtcggagagtgatgtctctgattcagattcaggcagcgactttgatcggaaacagaaaaaaggtgaactccttggttctaaaaatgataagcaggcaccaaaaagtaaagagaaggaggccagtcttggtaagaatgttgataagcgcaagagacatgattctgattc

SEQ ID NO: 1514 - DNA, 546 bp, Hordeum vulgare
gttttagcaggttcatctcgaacacaaaaggctaagaagttagatacatctccccacattgtggctgaggcaacatgatgccactggcataatagtataagctccacattttacacactcaagactggcaccgcagagaaaggacaaagtccatacaaacatgagcaaacaaaacttcaccgctgcgacaatacagcattgctggatgacagctagcagtaactaacatggccaaaatctggtgctaggcgaatgaaccttcttcaatgtagcccgatgttactgtccttgctcaacaagctataccagcgctgcactttgcttcatggaaatgagatgcaatttaagataacttcagcattcaacgacgcctcctgtctctgtgctcatctctagaatagcgctcttcataatccctccttgagtggttataagagtcatcatatctagacctctttgaatcatggctatctgagtatctagctctgtgtcgaccatactcttcgtgcgtcttccggtccctgttttcatcatcgctaagtctgt

SEQ ID NO: 1515 - DNA, 519 bp, Hordeum vulgare
cccaggcagagcccgtaagccaggaaggaaggaagcacaaagagagactctccccccacccacctgcttacaaccaaactcccctccccgagccccccagaaatccagcgcgccggttttgatccacggaacacagatcccctcgtgctcgctcgctcgctcgctccggcctgtcgtctagatttggagcgcgtggaactttgatgggcgtggagtgagatcgagagcggggaccgtgaattcctacgagggccgccattcggcttgcgcgtctgcatgaactgtttcgtcaatctgggactcaactccaactccaaccactacgtcgcctgcctcctcatcttcctgctgcatttctcgccgcagccgctgttaaatcaaccaaattctaatcccaatcccagcggtagcaatcgtcaagaaggagaatccaatcccagtagtagtgatcgctagggggagaacagagctcaacaaatggccaacaacaacagttcatacggtgaaaatgttagcaga

SEQ ID NO: 1516 - DNA, 550 bp, Hordeum vulgare
tcaccaatattaagaatgccaatgtagttaaattaccaatgtttcatcacacatactacaccaccaactctgccctacaaagattggtctcgtaggccgtagctcatagcgccttaccaagcacaagcccccacatcacgctgacagtatacataccgacacccacaactttttattacccgacagtaagtttattcagcaaagcacaggatcacacgaccacacgcctcatgccacgaggaagagcaaggatagattgctcccacgctgccttcctcgagcaatcactggaatgaacaccggcgaacctgccgcgacaatagatagtttataagggggcacgactgtttacagccgagagatgagcagcgggacggagacggtggccgtttgctcggccatcgggtggcacatctccagcatgtccagctccctgaacttctccaggaccctcatcctgcactcctcggccgccatctcccccgtggagaaggcgccatgcaccgtgcccgtgtactggacgctcgtcgcctcccccgcaaagaatagg

SEQ ID NO: 1517 - DNA, 392 bp, Hordeum vulgare
gtctcaccgggactgcaggaattcttcacgaggagaaaaataacctgagctatgtgcttctgagcttgtccaagttagtcaggtgcagacaagaccagtgaggcaactggaagtgccatctgaaggacctccgggaaatgatgccgacatggtggaagggagtcatgcgcgcatgctggtaaacaacctcattgttggccaagcctcagttgttccatcaagcagagatgatgtcatggtggccctgcgtgaacatctgatcaagaaattccttgaaatcgataaatacggcgggcggatgatcgggataaaggaaatgggcaaactgaatgtgaaggcattcgagattgcttgcgctgagaagatacgtaccacaaaagtcgctgatgcat

SEQ ID NO: 1518 - DNA, 549 bp, Hordeum vulgare
gccacttaacttgctctcttttcatacctgaatgacaaatatcagagtagcagctaatttattactagtagtagatggtagatagagtaagtacaaggtagaacagtacaaactgcagatagtcataagctacagcttgatccgacaacatcgaaattggtccaacaacgtgagaagggcttgctctctttgctacagtcagattaattaattattcaaagcacacgctcataacagtttttactacggagtactactttaaccaccaaggggatatggcaacctctttccttgctggtgcatcctacaggtgccatcaaatctacctgcgagtcttcctgcgcttgaccactgtgagttcttgcacacgatcacccatgtactccgtacactccattagggtggctttcctgccctcattgtagttccatagctcatagacgatgctcctgtcgcctaggcagttgtactctttcatctccatcagcgcatcgacgacagctttgtgggggccttctccccattccttcttcagttcttgcagcttat

SEQ ID NO: 1519 - DNA, 541 bp, Hordeum vulgare
ggtctgcaggcaattcggcacgaggcctctgtcttctccgtccccctgcccctccatccctccctgagcactcccagagtcccagtcccaggccattagcctagctagctcgcccctccatgcgagggcagcaatggcgcccgcctccgcctccttcgccgtctccctctccgcccccgtacgcttaatcccgcccagatgcttccgcggtaggccgaggtggccccgcccaatcagggcttcgagcggcacgagtggcgccccggacggggagcggaggatcggcgctctggagaggagggtgggggatttgagggcgcttgtcgcctcggtgccccctgctgttgtctcgatcaggaaaaacattggactaagttccgttgctggtttcggcttcggcattgcatttttggctgctgttgtaaggcaggttgtcataagaacgcaacaccaagataataatggttctgttgctgatctagtaaggcgtgggcatctaaaatcagggcaacgtgggattgcaaaaccacgggtgtacaat

SEQ ID NO: 1520 - DNA, 536 bp, Hordeum vulgare
tctaacatatatagttctcaatatcaactgttcagtacgcaagccttccaaactcctctatctacagctaaaacctgacaacactacataacaaaacgaaatgccgaggggtttatacaattcacacagttattgtccttccaagctttttgatagtgaactgttgtcagagctctcgggctcaggctctaacattggttggccattttggctattcaccatgacaggtttagactgttgcagattcccagatggctcgtctgataacttcgatgttcttgcactgtgttgcacaccccttggactggaagagaatggtgttacatcattagaagcctctagccttgccctcaaagcttcatgttcggctttaacacgggacgggacaccatccttttgataaacattccttttggcagtctcctcatctacttcaactgaaccagcagcaaatgggtggtttactggaatccatctaactgtctctggatcgacatctggtggcaggggatcaccttctttaagaaacacggtgg

SEQ ID NO: 1521 - DNA, 365 bp, Hordeum vulgare
actaaacccacccacctctcctcctccgagcgaaaccaagagcagcaacgagctgtgactagcaaccttctctgaatctctctctctctctgccgagcaataccatggcggcatctgtggcctgcgccttcttcttcgacgccgagccggtgggcgagccctgtttgcacgcgctggacgcgtgcgcgctctgcgccaagcggctggcgcgcgacagcgacgtcttcatgtacagaggggacacgcccttctgcagcgaggagtgccgccacgagcagatgcggctcgacgccgcctgcgccaggcaggccgcccggcggctgcagcggttcacggcggaggcggagtgccaccgtgggcagcgg

SEQ ID NO: 1522 - DNA, 338 bp, Hordeum vulgare
tttttttttttttttttttaatcgcctgattccatggcgtttacttttctgtttccgtttagaaccaaatcagttcatcggcacggcacagaccgaccgagaacaagtacaatttcctcccatccgagcagcttaattagcttgccatggacacatgcgggaaagctacaggcacctatgcttcgtgccgcgtgatgcagccctgcccggcttcccgtaggcggcgccaaggtgcatctgatgcctcctccggttcagcgagagcaccggccggagagacctagacattcagaatacaacggcagttttcttcagaattcattcagatctggtcgatc

SEQ ID NO: 1523 - DNA, 538 bp, Hordeum vulgare
  UNSURE (10): n stands for any base
gggctgcagnaattcggtacgagggccatggcagcatacaagcctgtaatcgcatgcaacagcggcggtccagtggaaacagtagtgaacgaagcgacaggttttctatgcgatccctccccgattgaattttccaaagccatgctgaagtttgtgagcgatcacgatctagcggtccggatgggcaaacaagcacgcgaccgcgtggtgcgggaattctcgaccaagacgttcggcgacctcctgaacggctatgtcctcaatgtctaccaccagaggatcgagtgatctgaatccggtgtcggcagcgccaaatggaagccttttgagtagcacattaactttatccttgtgacttgtgagttctgactttgatgtccacacttggaagcaagttagcatggcactgcatggtgatggcgacattgcattattggcctgtctgtgatgaactgatttccttctcgatctctgtattattctctcggataaataagggtttgactggtcaaatctgaacagtcgggatcagttctca

SEQ ID NO: 1524 - DNA, 557 bp, Hordeum vulgare
  UNSURE (15): n stands for any base
ttgcaaacattgttncttaacacaagtgccagttgcaagtgagaactgatcccgactgttcagatttgaccagtcaaacccttatttatccgagagaataatacagagatcgagaaggaaatcagttcatcacagacaggccaataatgcaatgtcgccatcaccatgcagtgccatgctaacttgcttccaagtgtggacatcaaagtcagaactcacaagtcacaaggataaagttaatgtgctactcaaaaggcttccatttggcgctgccgacaccggattcagatcactcgatcctctggtggtagacattgaggacatagccgttcaggaggtcgccgaacgtcttggtcgagaattcccgcaccacgcggtcgcgtgcttgtttgcccatccggaccgctagatcgtgatcgctcacaaacttcagcatggctttggaaaattcaatcggggagggatcgcatagaaaacctgtcgcttcgttcactactgtttccactggaccgccgctgttgcatgcgattacaggcttgtatgctgccatggccctc

SEQ ID NO: 1525 - DNA, 517 bp, Hordeum vulgare
cctcgtgccgaattcggcacgaggtcttaacctttctacatactgtaccattgatgaacatgtcccagtcgattcactaaagttcttgtgcatttttatcttaggagaggacacgagaagcaccctcggccgctttgtgatcatcatatggctcttcgtggtcctcatcatccaatccagctacactgccagcttaacctccatactcaccgtgcagcagctcatatctccaatcacagggatcgatagcttgatcgccagtgacgagcccatcgggtttcaagtcggctcctttgcggaaagttaccttgtgaacgagctcggtgtctcgagatacaggcttaaagcgctcggttctccggacgagtataagcaagcgcttgagcttggcgctggcaacggaggcgtcactgccatcgtcgacgagcgtccctatgttgagatcttcttgctccagcatcccaaattcgccgtggtgggttcagagttcaccaaaagcggctggggcttcgcgttc

SEQ ID NO: 1526 - DNA, 543 bp, Hordeum vulgare
  UNSURE (11): n stands for any base
tcttatatttnctttacagaggaagtacaactgtacaacagtacaagacacaacccaaaagcagatagttatattagcgttgtatataggaagcggcaggacgcagcagaagaccagaagttacagttgctcgggagctggcactgtaagatgctccatgtgcacaacagcttacgcatctctacaattctgcagcacgaggagagagaacatttgcagcacgaggagaggccactctgcagcacagcgccaattaaattacttacttacgttacgtcgggggttactgctatatgctgcatgtcgcacctagttactactactacgttggaagcttaaccgggagccgtccgtccgaccgtccgtctctctagcacgacgcggcggtgctggcgctgctactcgacgccgcgccgacggagtggtctcctcctgccgccttgtccttggacgctatccgggtgtccatctcccgtcggtcggcgaaggacaggaaggcctggaagctgctgcggctggagcgggagctgccttcggccgaca

SEQ ID NO: 1527 - DNA, 468 bp, Hordeum vulgare
aacattgcccaagcaagttccacactgtgttgaagactctggagctgattgagaaggactacctgcaaaatatccctctgaatcttcttagaaaggttgttcagaaaaagataccaatgatgaagctgtacattgagaagaaagtttccggtgagtttaatgagtggctcgtgtatatcagaaagtttgcaatggagattggacagtcctcgatacgccaggcctctttggatcgtcagaaagatgagcgaatgcgtgcctggcagagggaagcagaagaatgtagtcgtgttgggtttgatgagcatgcttatgccttggatctggagtacatagatgaagaatcaacactagaatatgatctgacaccagtataccgagcatacaatattcatgtgtcccttggccttggggaaaagtttcgagaatattactacagtaacaggctcatgcagcttaacttggaca

SEQ ID NO: 1528 - DNA, 556 bp, Hordeum vulgare
  UNSURE (25): n stands for any base
gtctgaaagaaaactggccttcttnctattttcttctaacgaaagggcactgccaactaagttcagatggaaatttggagcatacaactactgttgacggcctcaccctataagcaagcagcccaagcctaaatgcccgcatgaatcggaggacagtaattatgttctaatagacaggaaaatcataacagcagacaaggttttacagtagcaaatttaagttctactcaagcggtaccaacttgcctaatatccgctaaaatctttcgtccttctcttcaacatagctaatctcagctaaaatctttcagtcttctcttcaacacatccaatgacttctttcgggcactctgcaccacgtttctacttgaaaggctcccaaacaagctgctgtcaggagcatcccgaaatttgtcacagatgatggccaccttcttgtggtccaaggacgcataactcttctccctgattacagcattcatgaagctctcggcgtggttgctcagcaatagattagtcagctgcctaatctcaaccaggcaatctttgaaacttg

SEQ ID NO: 1529 - DNA, 516 bp, Hordeum vulgare
cgcaagctcatcacaaaggaggacatcgacgacgtgcgacgcgagatccagatcatgcaccacctctccggacacaagaacgtcgtcgccatcaagggcgcctacgaggaccagctctacgtgcacatcgtcatggagctctgcgccggcggcgagctcttcgaccgcatcatacagcggggacactacagcgagcgcaaggccgccgagctcaccaggatcatcgtcggggtcgtcgaggcctgccactcgctcggggtcatgcaccgggacctcaagcccgagaacttcctgctcgccaacaaggacgacgacctctcgctcaaggccatcgacttcgggctctccgtcttcttcaagcctggccaaattttcaccgatgttgttggaagcccatattatgtagcgccagaagtgctgtgcaaaaaatatggaccagaagctgatgtctggaccgctggtgtaattctctacattctgctaagcggtgtacccccattttgggcagagacgcag

SEQ ID NO: 1530 - DNA, 554 bp, Hordeum vulgare
gcagcagcaacggtgtgagaatcattttaacccagcttagcatgcgttccgtcgaatcaattgacgagctaaatcagaatccacagaaacacacatccacacaggcattttacaagattcgataatttgcaggaaggcttcgatggagcgggaagacgggaagaagctaaagccacaagctgtatatacatcgtggaagtctagattgcaccaggtgcgtctctcatgctgatattcaggctgtttctcattgttcttcgcccgacccccatgttgcctttggtcatcatggcaacaaattctccatagtcaatgcgcccatcattgtcctggtcagcttctttaatgacatcatcaagaaaagcatctggcatgttatgctccaggcaagcttgctgcagctcatccactgtgatgtaaccacttccatctttgtcaaaatatgaaaaggctgccaccagatgctcctcacgctccagtttattcagatgcaatgttgcagcgatgaactctatatagtcaatggtcccactgttgtccacatccgccgcgtc

SEQ ID NO: 1531 - DNA, 432 bp, Hordeum vulgare
ttcctgcaagcactgcagcagctgggcgggtcccacgtggcgacaccgaagcagatccgggagctgatgaaggtcgacggcctcaccaacgacgaggtcaagagccatttgcagaagtaccgtttgcacacgtcaaggcggccgagctccacggcccagagcagcggcgccgccaccaccactcagcccgcgccgcagttcttcgtggtgggcagctgcatctgggttccccagcaggagtatgccgctgcggccgccgccgcggcagcagcaacagatgcaacaaatgtggcgccgggaagcgcgaacaaagtatacgctccgacggcgacgttgccatcaggggtgaagccacactcaaaagagcagtcgagtaggcggtcggaaggcccgatgagcggcgacacgggcggcgttaactcggactcggac

SEQ ID NO: 1532 - DNA, 545 bp, Hordeum vulgare
tcgtattttctagtctctcttgcatgtgtgtacacaacaaataatgtggcctaccttgctgcaaaatgtgatcttatacactctatttctctaggctatgtaggtcccaactccgaaggttatacgctaaggatgccctgcagatgtggtttgcgacgacgacgacgacatagctgggttgtccgagtccgagttaacgccgcccgtgtcgccgctcatcgggccttccgaccgcctactcgactgctcttttgagtgtggcttcacccctgatggcaacgtcgccgtcggagcgtatactttgttcgcgcttcccggcgccacatttgttgcatctgttgctgctgccgcggcggcggccgcagcggcatactcctgctggggaacccagatgcagctgcccaccacgaagaactgcggcgcgggctgagtggtggtggcggcgccgctgctctgggccgtggagctcggccgccttgacgtgtgcaaacggtacttctgcaaatggctcttgacctcgtcgttggtgaggccgtcgaccttca

SEQ ID NO: 1533 - DNA, 519 bp, Hordeum vulgare
cctcgtgccgaattcggcacgagggtcgatcccagccagattatcaccatggcctagcccctgtcgatctgtccgcctccaggtgcccccgaggccccgaggccccgaatctcccggaccatcttcgtcgccgccctcgaccatctccgccgccaccctctaccggtggacgccctcgatcatcgctgcagctgccgaacgcccccgaccatctctggtgactgctgcagccggacgccggacacccccgaccacctgtgtcagtgtcgccgttggacgcccaagagtatctttgctgttgccgtcatttcgcctcgagtatgtcatcccggacgctgtcgagcacgccatcccggttgccgttctctccaacttgttggacgtaagaatttcttgctggtttccttcaagatcccgttcacctgcgcgattccaagaccgagttgaatctcatgttatgctcctgcgtgattccaagaccctgttgaatctcaacttctagcaggaacacgccaaacc

SEQ ID NO: 1534 - DNA, 552 bp, Hordeum vulgare
gctaagtccttttaactcttttaccagccagtacatcacaataaattcgttgacgatattacaggtttaatgagcatcaagctacatctttcaaggagcagcgattacatttcaaaacttcactaaattatagagaaagctgacatctttttgcttcatcatctactcgaggttaacatcaattgccgcaaaaagcttcagtcttcattgtctgtatttacaaggaaatgttacaagagtaattatgtgcaaatatatgaacagaaattgaaaacaaagaccttattggaaatgaatatccagtgacctcaaaatattttgacatatatgtaatcctttcaaaccctagtgacctcagagtggttagtggttggctacgaaatcgagcaacaagtaaacatagaattgctatatccaaattatacttgccatgcttttggtgggtgtgctgatttatctgaacttacaacagtaaacagcaactgacaggaaatagtaatatgatctacatcacatagaacagcaactgacagaaaacaataaaacttgacc

SEQ ID NO: 1535 - DNA, 525 bp, Hordeum vulgare
aagaaactgccagtcttctacaagttggtacctctgaccttcgatggcgcagcctccagctaaaaagacgctgtcggtgtacctgtacatccctaacatcattggatatttcaggattatcataaacttcattgcatttgctgtgtgctataccaacagaacactctttgctatcctatacttcttcagcttcttctgtgatgggttggatggttggtttgccaggaggttcaatcaagcatcaacatttggagctgtgttggacatggtaacagatagggttagcactgcttgtttgttggcgcttctctcgcagttttacagacctggcttggttttcatactgttacttgggttggacatcacgagccactggtttcaaatgtacagttctttcttatcaggtaaaactagccacaaggatgtgaaacacacaggcaatgggcttctgaagttatattatggatatcgtccgttcatggcgttctgttgtgttgcttctgaggttctgtacattatcctgtt

SEQ ID NO: 1536 - DNA, 549 bp, Hordeum vulgare
gcatggagccatctgaaacacaaagaaaacaacatgtaaatgttggcatgtacaccggtacaacaggagggaggaacccttatcatttctagccaagtactagtaaccaaatcaccacgctgctacgcaaacaagatcgaatcatcatgtagaaaagacgtacacaatacagaacttgtcgatccctgtgtttttgttaagaagcagttctcccttttctagttttctttccacatgctgcttttcccccagaatgtccaacccccggaccggagacatgttaagatacatcaaggagctaccatatgtgccttacaaccaagcccgtctgacggtatgtttttcttggatatgccaacgcaaatgaaaactaaaccatggtggtccatttttgctcacttgcctcttttcgaatcgaacgccacacaagcatctgcagctgttttcatctggatgacattgatcacttgtttgagtgcccacccaattagagttgaaataaacatgaagacaactaggggactttccttcagaatacctctgcacgta

SEQ ID NO: 1537 - DNA, 518 bp, Hordeum vulgare
tcctccagcggcgcttcagctcggcgaccaacccagccatggcttcccacccgccgtcgccgctgccggaacaccccatagtactaccacccgctcccaccaccataagcgacctcgacgacgacctgctccgggagatcttcctccgcctccccaacttccccagcctcgcctctgccgccctcacctgccacaccttcctcggcgccgtccgttcgtcccgcgcctaccgccgccgcttccgcgcgctccacgcgcccccgctcctccctcggttcctcgcacacattataggtcccttccccgccttacagctcccctccgccggattcaccggattcacccctctccaactccaagacgacgacgcttccgactggcgggtcgatttctccgatccttcggttgcctacggcggctccgtcggcatcaaccaccggagcaccattcacgcagctcggtacaaccccgaaacgaaggccctgtttctccgccccaaggagcatcatggcatgccc

SEQ ID NO: 1538 - DNA, 540 bp, Hordeum vulgare
  UNSURE (21),(41): n stands for any base
ggacacatgccttaatatgantcttaaagtcgctcgcacanaagatgcacttctaaaacaagaaggaaagataagatgataaaagctaacgtacataaatgcacttttaaaaagagtctccctgccaaccagtcataccgaatactgaatactcttgatgatggtcacagccatcagtgtttattcagatacctcacataacgtcgtcatagaatctaaaacctgaagtaccaacgcaacaaaaactcacttactcctgataggtaggctgattcatcttgcacagaaagctctccataactttcccttgcacatttgccaccagctctctgttttgatcttctgcctgtagaatacagggtgtgcgaattcagagtctgcacccgccatcaagacacgattcctcacagttattagcagttcatctaaagcaatgattttcctcataagagagttattcccgtcctcaacgtcaatgcaaagtgagaaggcctctgtctctgcaacatttgcgtcaccatccttaaccaaggcttcttt

SEQ ID NO: 1539 - DNA, 459 bp, Hordeum vulgare
cagctgcttcgccacaccggggagttccaatctgtgaagcttatccgcgacaagcagactgggcagcttcagggttatggctttgtcgagtttgcaagccatgcagctgctgagcgagttcttcagacattcaatggacaaatgatgccaaatgttgagttggcatacagactgaactgggccagtgctggcgaaaagcgtgatgataccccagactatacaatttttgttggggacttggcagctgatgttacagactacatgttacaggagacattcagggtccattacccttcagtgaagggcgcaaaagttgtgactgacaagatgacaatgcgttcaaagggttatgggtttgtcaagtttggtgatcccacagagcaagctcgtgccatgactgagatgaatggaatgccctgttcttccagacctatgcgcattggtccagcagcaaatagg

SEQ ID NO: 1540 - DNA, 528 bp, Hordeum vulgare
  UNSURE (27): n stands for any base
attgttatataataatttaacagcagnaggcaatggtaaatgacagtagacaaggacatgcggcaaacaaaacatagtttccagtacacatttgaaggatcacaatgggacaacagctgctcataacatagtgcataatagaccaaatagaccttgccatgaggcgatcaaaatcaggagtccaggaaccctctctctctctatcgacaggtgctacaacattagcctcgacagcgccttcaaacaggggttctcatctcatgtctggaagacccaatggggagggctcactgttgtggcggtggcggctgaggtgcagctgctggttgttggtagtttggataaccagcataggctccataaccatacatgttagggtcttggggctgtgcatacccttgtccataagcctcgtacccttgtccatatccagcatagtaaccaccagcagcaccggcagcagcacctgcaccccactgggtggcttcctgaggctgagtttgtttgttcgaagggcttcgtccccat

SEQ ID NO: 1541 - DNA, 425 bp, Hordeum vulgare
gaagctcgcccagtatgtatgccgtgcacaacgccccccctcgcatgaatcactctcacaagccgagccgatttagttagccttgctctcgcccactgcagatccagcagcccccttctttcccctcggctctgctgcagagcccatcagaattgatcacactggtcgttcattcggcatgtgagtgctgtcctgctccataggccacctgctacaagtgtctagaagctcaaatggccgaggctgtacttattgctgtaacgaagattggttccattttaggagatgaagccatcaaggccatcatatctgagctctccttaaaagttactaatctgaaggaactgccggtaaaggttgaccaaataagaaagcaactgactatgatgagtaatgtaataatgcagatagatactgtatacctc

SEQ ID NO: 1542 - DNA, 461 bp, Hordeum vulgare
tttttttttttttttttttttttaagatgaaatgtttgacaggattattcacagaaggtgttccataagaatgatacacatcattacataaaatcagtactagcacatgtcttaaacaacataaaaccagactgggaccgctggaaggcaatggataccaaactttgaagagtaaatatgttgcacatacaagtgccgacaaatgctgatgacgacatcaatatataatcacaaatttgctgaaacgattaaaagtactacacaactgcaactgacagatgcaccatacaagaccgacaccgcagggagaactgagccgccacatctagatataaacctctggaacatgcagggtcttctgatgcatttcgttagtgtcccaatgacttctgaaatccttgtgcaaatacttcagtgtaagcttcttaagggagcggagggattcaatgccttgagggacc

SEQ ID NO: 1543 - DNA, 519 bp, Hordeum vulgare
tggacgtggagatccagcggccgcgggaggtgggcagctgcagggtggtcaaggtggacaaggaggcgtcctgggagctcttcaccgcccaggccgccaacgaaggccgcaccgtcgctgctcactttggggcgtcatggtgcgtcacgtccctgtccatgaactacaagttcgaggagctcgcccagacccaccccgacatgctcttcctcttcgtcgacgtcgacgatgtcccgggcgtgtcttccaagctgggggtgaaggccatgcccaccttcttcctgatcaaaggcaaggaggtgatgaagaagatcgtcggcgccaactcggacgagctccacaagatggtggactccgacgacgattcgctcagctccgccgttaccactctccctgacatagtcatcgaaaaatagctgttttgccgtagtccctgaaacttttcaaactgctgttcgcttgcttccggtgtgtgtgactctgaatctgatcttgtctgatgtgtgtgtgtgttcctac

SEQ ID NO: 1544 - DNA, 556 bp, Hordeum vulgare
gatgtacttatgtagtagcattttcagaaagcagcaagtcacagttgcagcggccagcgggccagtagccaagtcacacgccctactctcctctagtaggaacacacacacacatcagacaagatcagattcagagtcacacacaccggaagcaagcgaacagcagtttgaaaagtttcagggactacggcaaaacagctatttttcgatgactatgtcagggagagtggtaacggcggagctgagcgaatcgtcgtcggagtccaccatcttgtggagctcgtccgagttggcgccgacgatcttcttcatcacctccttgcctttgatcaggaagaaggtgggcatggccttcacccccagcttggaagacacgcccgggacatcgtcgacgtcgacgaagaggaagagcatgtcggggtgggtctgggcgagctcctcgaacttgtagttcatggacagggacgtgacgcaccatgacgccccaaagtgagcagcgacggtgcggccttcgttggcggcctgggcggtgaagagctcccaggacgcctccttg

SEQ ID NO: 1545 - DNA, 471 bp, Hordeum vulgare
accgccgctgtgccctagaactgcgccgcgcccgccctctgtccctcacgcgcctcgtcgccggcgccctccctgtcccgtagcgtccccgctctctcctccccacccgcaatcttggacttcggttttgagatctgcccctgctatcgattgcaggtttgcagagggctcgtcgacatgtcttgggcgccaatcgagaatgaccctggtgtttttacggagctgttgcaacagttgcagttgaagggtctccaagttgatgaactctactcacttgatcttgatgccctaaatgatcttcagccaatttatgggcttatattattgtacaaatggcgacctccagaaaaagatgagcgccctgttatcaaggatgcggtcccaaatgtattctttgctaatcagataattaacagcgcatgtgcaacccaagctattgtttctgttctgttgaactcttctggcatcacc

SEQ ID NO: 1546 - DNA, 551 bp, Hordeum vulgare
tctcttaaaggacttatatttaggaaaggagggagtacatatcatctttcacggctgtttactttggttacacacatggacaatgttggtacacgaatctacaggtgcgatctctctatccatagcttatggggcattgcagaacaagtttagtactagccacaacaagacttttacacacaatacaagaaaaacgaattgcaccattcatcaagaaaataaattgaacaatgatgttcctctgagctctttctgtgccacagctcgcttgagtttaacctcactttgtcatctctggtcaagaactccaaagaactgttccaagcttgcagagctgaaaacattgggtgacaccctttccgtttgctgtggcgaaatgtgcagctgatacttgataaacctagataactggtgaactatttcaggactcgagtcaatgtgccagtcaggttccagttgccggacaaaagaggtacggccattttccgtactgcagaagagaaccttctctctcaccaaaccgccactggtaaaaagcccagcttcactta

SEQ ID NO: 1547 - DNA, 515 bp, Hordeum vulgare
ctggaatggatatgattatgatacctttcagatttgagacattcttggaagatcttgtgttcttggtagagacaggggagataccattatcacgaattgatgatgccgttgagcggattctaagagttaagttcatttctggagtttttgagcatccattttcagatccaactctacttgacgtaattggttgcaaggagcatcgtcagctagcacgtgaggctgttcgaaagtctttggtacttctgaaaaatggcaagaatcaaaaggaaccattccttcccttagccaaaaatgcaaaaagaatacttgtcacagggacacatgctgacaatattggatatcaatgtggtgggtggacgatagcgtggcacggagacagtggaaagataactcctggtacaagcatattagaggccatacaaagaactttgcaagtggaaacggaagttgtgtatgaagaatgcccaacagaagctaccattgaagaagaaaacttttcctatgcaattgtt

SEQ ID NO: 1548 - DNA, 552 bp, Hordeum vulgare
ccttatacactgtacttcgacaacatgacatctatttatcttatacataaccccatactctcatgtacaacatacatatgtatactattatttcaattcaaatgtatggccaccaaatctgtcatgacattatactaaatcttcattgcttctgaatatttgagcccatatccaaaaggaaataatggatcgtagttagcacctctaatatctataggcagttgatcgtctgatctaaaccaagttactggcaacgtgcctacaaaatcatggtctccaaagaggcaatcagtcactcccatgccctcacttccaggcaaccaagcaacaactagagcatctaccttctcaagaacttgtggctcaataaccaagggtcttccagaaataacaatcactagggtagggacttttctagcaacacgagtaattagatctgagccattaaatggaatactaaggtcggttctatcccccaacccttctgcatagggaacctcacctactacaacaattgcataggaaaagttttcttcttcaatggtagcttct

SEQ ID NO: 1549 - DNA, 500 bp, Hordeum vulgare
ctattaaggcagtatcttttgttggttccaatacagcaggtatgcatatatattctagagcatctgcgagtgggaagcgtgttcagtgtaacatgggtgcaaagaatcatgccattatccttcctgatgctgatcgagatgctacattgaatgcccttattgctgccggttttggtgcagccgggcaaaggtgcatggcattgagcactgctgttttcgttggaggttcagaaccatgggaagatgaactagtcaaacgtgcaagcagtcttgtagttaattctggaacagctaatgatgcagaccttggtccagtgatcagtagacaggccaaggaccgcatctgcaagttagtccaaagtggtgttgacagtggcgctcggattgtgctggatgggagggagattgtggttcctcaattcgaggatggcaactttgttggtccaactgtgttggctgatgttaaaagtgatatggagtgttacaaggaggaaattttt

SEQ ID NO: 1550 - DNA, 560 bp, Hordeum vulgare
  UNSURE (11),(18),(25),(31),(38),(39): n stands for any base
aaggcacattnccggtgnagccttnaaattnccacatnncaaatatgtccacatacatgaggtagctcgggtcacttcacttgtgcagaggtgggcatggagagggaaacgcgctgcgcagacggctccttccactgctgtgtgatggtcttgatctgggtgaagaactgcacgcccgccttgccgtagaaattcaagtctcctgcgaaggaagctttgctacccgtgaaggagaagaatggtaggggtactgggatcggcacgttgatgcccacctggccagcttcaatgtctgtctgaaatttccttgctgagacaccagatgtggtaaagatggaagccccattgccatacttgtttctgttcacaatttgtatggcatcatctaggctctctgccttcatcaagagaagaactggaccaaaaatttcctccttgtaacactccatatcacttttaacatcagccaacacagttggaccaacaaagttgccatcctcgaattgaggaaccacaatctccctcccatccagcacaatccgagcgccactgtcaacacc

SEQ ID NO: 1551 - DNA, 457 bp, Hordeum vulgare
  UNSURE (456): n stands for any base
tgtccagctcccctgcccgcccgcactcgacctctgcttcgtcctcgtcacccctgagttcgaggcgcccaccagcaagatgcgagctgccctgcccaagaatgtcgccctcggccaccatgtccgcaattccagccaggccgctgcgctcgtcgctgccgtgctgcagggtgacgccgcactcatcggttccgcaatgtcctctgacttcatcgtcgagcccaccagggcaccgctgattcccggcatggccgcggtgaaggccgccgctctggaagccggagcactgggatgcaccatcagcggagcgggcccaaccgctgtggctgtaatcgagggagaggagaagggggaggagatcgcccagaggatggttgaggccttcctttcagcggggaagctgaaagccaccgccaccatcgcacagcttgatagagatggcgccagggttatctnc

SEQ ID NO: 1552 - DNA, 390 bp, Hordeum vulgare
ttttttttttttttttggagaatttgacaatactttctatgccataaaatgaacaaaatgatagttctctggtacaatagaatatcagtagttttggcgtgattcaacattcaaagctggagaatgaacaaaagaacgacctactcttccactaggacgacatggacctcgccctgtccaaggagtccatcgtccaggaggcccgccacggggtgctcgtcgaggacgagccctggcgccgcaagatccagtttctcctctccccaacagcatcaccatcaagcacatcaagtccatgtgcctctgatcttgacgacagcatctctgctattccatatcattcattgcttttgtgttgcttgtgcgctactgttccttcctactcaaaac

SEQ ID NO: 1553 - DNA, 872 bp, Hordeum vulgare
  UNSURE (1),(857): n stands for any base
ngtcccccgggcctgcaggaattcggcacgaggcgagttttttttttttttttttttttaccggggctttcccgatttggttggaaaaaacccaaccccttggcccccttttggaataatattccctaaatttccccaagggcaaaaaaacaaccccgggggggaaaaaccagggggccggtttttttgtttttttgaaaacccccaaccttggttttccctggggggggaaaaaagcctcggaaacctaaagggctggggttgtttgcaaaaaaaaggggaaggccccttagcttccaccaagggaccaccaaagggggggggatttggggcaaattggagcttttttttttaagaagcccgtaaaacaaaaattttttttttttttgcggcggcggttggggggggaaaccaaacccgtttttcccttttgggaacggaaccccgttgttgtaaaaaggggattcccctttgggggactttaaaggggcccccgactaaccggggttttctttttcttgggacaaatggaatttggggaccttgttgtttccccaaatttggggaacccccaaaaggggttgggggcccaccccgcccccattttggggggttttttcctgggggcccccattggtggtccctttcggctttaaaagggaaagcttttttattttttttgaagcagtggattccttggccggaaggccccaattcccccttggaagggccggaaatcggtccttttggccaaaaagttggcccttaagtgggcgggtctgggcttgggtttcctgctaggccttgtgggcttacaccagcggaccctaagaagattcaatttcccaggcctgggnatttaagcttttttt

SEQ ID NO: 1554 - DNA, 550 bp, Hordeum vulgare
agggcatatccgctatgtatgaataaatacaatcactatgactacattatgaatcatcatcactcaacttacacaaatgcaagaaaacaaacgcatggctgtaaatacagtcggccggctcttttgtattctctgaaacacccaacacttgctttaccatgatgaggaagagagactcaggaaactagaaggcatgggttgctagtcaaagaaaaggagatgtcacatagcatacaacaaaggaacaacataagttgggtgatcttgtgctaatttgagctctttttcttcagtaagccgctaaacttaaatttcttcttcttttgctgctgctgtttggttggcgatgcgatgccgttgttcgcctttgcggactgcagcccgttgctgtcgagagcggagtctcccttgttggactctagatcggcctccgactcaccgtcgttctccttctccttggacgaatcgtagtctgtgaccttgctgttctcccacatcttggcgaccaccacaactggttcgtcgtccacaccgcctccattctcgttgt

SEQ ID NO: 1555 - DNA, 551 bp, Hordeum vulgare
gtctccccgggcctgcagggaattcggcacgaggggagtgcccggacctgttcccggtgtccgagcccggagtggaggtggggctcccggcgagcggcgccggggcgaggcacgtgctgaagatgagtgtgatggacacggtccaggactactacgttgtcgggcgctacgacgacacggcggacaccttcgtgccggaggacgacggtgactgccggagctggcgccgcctcgactacggccacgtgtacgcgtccaagtccttcttcgacccgagcaagaaccggcgcgtgctctggggctgggccaacgagtccgacagcctggccgacgacctcgtcaggggatggtccggtgttcagactgttccgaggaagatatggctggacgaagacggcaagcagctgcggcagtggccgatcgaggagatcgagacgctgaggaacaagcgagtgaacctgctgatacctgaggtcaacgccggcggcgtgaacgagatcatcggcatcgtgggcgcgcaggcagacgtggaggtcatgttccagatccct

SEQ ID NO: 1556 - DNA, 549 bp, Hordeum vulgare
tacaaatataccttatagatttgaatagtgattattttgtacaactcaacggatatcatacttttacatgacacccgttttcaccttggaaatacactctaaactgatgccaacgcccatcatgcagggcatgcgtgctatactttaccccggtactatattattgacagtatcaaaaccttccaacacctaaacacaaatattcctacaatctttttcctttgcagcatcctagaatcctccttctgtgctgttctggcaaacaatgagggagcctccatttgtacacctgagccacaattgggcaggcaaatccaatcggccgtagaaattcacaatggccatccatccaccgagcgaaaacccagctcccgaatcctaataggcttgagctccgctcaccgagctcgccgcgatcagcccgtcggggagcacgttcacggtcgccgtcgccatctcccacgcgtcgaggctggacaccttgacggcgccggtgccgttgttgaacacgtacaggtggctgttgccgttcacgacgtggtccgggta

SEQ ID NO: 1557 - DNA, 519 bp, Hordeum vulgare
gcacgaggggacggcagcggcgaggcgtcgctcagggccgggggctgtgcctggtgccgatatcgagcacgttcgcggtggcaagcgatgggcccgtcgacttctggactccctttggcggccagtttaggtagatgaaggccgccccgccgggtggaacgaacgtgcggcgcagatcgatctgacggcgttccttgatcgaacttgatgatttagtatctataagtagttcatgatcgtaatttgtaacggatagcactacgtactgatgaagctatatggttagctagatgaacctttggaatgagtgcttcaagacttgtactcattcttcaggttcatcagggaataatcaatggatttaactcagggaccagaggtagctgagaggctgaattatgtcaaagtgatcacccgatcatcgtcgatcgggttcgtatgattggttgttaggcttgcatcatcaatcagttgtgtctaagaactaatttaatggttcaatactttaatccagcgtta

SEQ ID NO: 1558 - DNA, 506 bp, Hordeum vulgare
gctggattaagtattgaacccttaaattagttcttagaccaactgattgatgatgcaagcctaacaaccaatcatacgaacccgatcgacgatgatcgggtgatcactttgacataattcagcctctcagctacctctggtccctgagttaaatccattgattattccctgatgaacctgaagaatgagtacaagtcttgaagcactcattccaaaggttcatctagctaaccatatagcttcatcagtacgtagtgctatccgttacaaattacgatcatgaactacttatagatactaaatcatcaagttcgatcaaggaacgccgtcagatcgatctgcgccgcacgttcgttccacccggcggggcggccttcatctacctaaactggccgccaaagggagtccagaagtcgacgggcccatcgcttgccaccgcgaacgtgctcgatatcggcaccaggcacagcccccggcccttgagcgacgcctcgccgctgccgtcc

SEQ ID NO: 1559 - DNA, 485 bp, Hordeum vulgare
gctctcggcggcctgggccagttcggcatcatcaccagggccaggatcgccctggaacctgcaccaaagatggtgaggtggatccgggtcctctactcagacttcgcgagcttcaccgaggaccaggaggcgctcatctcgacggcgaagacattcgactacatcgaggggttcgtgatcatcaaccggacgggcatcctcaacaactggaggacgtcgttcaagccgcaggacccggtgcaggccagccacttccagtcggacgggaaggtgctctactgccttgagatgaccaagaacttcgaccccgacgaggccgacatcatggaacaggaggttggtgtgctgctgtctcggctgagatacatacagtcaaccctcttccacaccgatgtcacgtacctcgagttcctcgacagggtgcactcctccgagctcaagctcagggctcagggcctctgggaggtgccacacccatggctcaa

SEQ ID NO: 1560 - DNA, 519 bp, Hordeum vulgare
gcacgcccttcaccgacaagatcatcgccgagtacatctgggttggaggatctggaattgacctcagaagcaaatcaaggacgatttcgaagccagtggaggacccgtcagagctgccgaaatggaactacgacggatcgagcacggggcaggctcctggggaagacagtgaagtcatcctatacccacaggccatattcaaggacccattccgaggaggcaacaacatactggttatctgtgacacctacacaccacagggggaacccatccctactaacaaacgccacatggctgcacaaatcttcagtgaccccaaggtcacttcacaagtgccatggttcggaatcgaacaggagtacactctgatgcagagggatgtgaactggcctcttggctggcctgttggagggtaccctggcccccagggtccatactactgcgccgtaggatcagacaagtcatttggccgtgacatatcagatgctcactacaaggcgtgcctttacgctggaattg

SEQ ID NO: 1561 - DNA, 519 bp, Hordeum vulgare
ctcttcttggtcttgctagttatgattcagatgacgaggatgatgatggtgacggtgatggtaagggtttaatttcaaatttatcatctgaaattaaagttggtgcagcacttcctaaagaaagtgagaagaacattgatggcgcactgcacaataatagtaacggaagtattgcttcactccaaagtgtttcatcaggagatgatcataaatccagtgatgaaagatctcagagtaggccaactgcagaatctgaacgagagccaagtattcatgacacacagaatggagaagccaaaacttctattcagccaattggtgtgattcataaaacaaatgagaaggcacatggtcatgcagaggtggatttccagaatgggaaaacctcttccgtccatcatactgaaaataataataataatgcggagagcactcacaggcattttgaaaggaaaagtcacgagaaagatcttaaagagccgaaggttgtcaatggaatagactctgagccttctagaa

SEQ ID NO: 1562 - DNA, 543 bp, Hordeum vulgare
tatgataagataaatacatgtggaggcctgaacacattttccagacctaattatgattcagggataggctagtgcatataaccatacaaaattacatcgcagcatgtcacgacgaaactcgaccagtctccttgcatactaataatacatgaccttaagagaaaatacaagtaataaaatagttaaaagggacgctagcgctacaaattatgaagtctgctgcttgtacaagacattacatatcctaatattggcaaaccggacatatcttccgctgggcaccatgcatcatccttcaaacaacatccatcacgtgagccgtcgagtcgtcttctttgttggaagctagatccagcatcttgtttcgtgggcgtgcaaatgctgtttcttcatcggaaggacaaagggcaagcacccctaggtgaaacaaacaaaaccagctagtttcttctacctcctcttgaccggagttctggatctcgaccgcttcttcctttcagcagatgaataaggtgaatgcctgcggtgagaatgcttgctagg

SEQ ID NO: 1563 - DNA, 457 bp, Hordeum vulgare
acgtcatcgacgagatcgagaacctctgccgcgaccgcgccctcgccgccttccgcctcgacgccgcctcctggggcgtcaacgtgcagccctactccggctcgcccgccaacttcgccgcctacaccgcgctcctcaacccgcacgaccggatcatggggctcgacctcccctccggcggacacctcacccacggctactacaccgccggggggaagaagatctccgccacctccatctacttcgagagcctgccctacaaggtcagcgccgccaacggctacatcgactacgacaagctcgaggagaaggccatggacttccgccccaagctcatcatctgcggtggcagcgcctaccccagggactgggactacgccaagctcagggccatcgccgacaagatcggggccatgctcctctgcgacatggcgcacatcagcgggctggtcgccgc

SEQ ID NO: 1564 - DNA, 446 bp, Hordeum vulgare
ttttttttttttttttgttttttttattggcaaatactcgacattccatgatcccacgcgaacaattcctacaaagaaatatgatggggatgtggacggcaaacagagcacaagaggtgggaggcgtttacaaaactatccagggctccagggcgagccaataaatctcatagaagcacagcacggtgggcattgcgcggcggccaacaaggcttagaagcgagacaaccatggcatatgtatcatcatcctactccttgtacttcatgctctcgagcgtgaagccgggcatgtcaaaggagagggcaaacttctcgacctcgaccttgaggttctcaatgtccttgttgttcaccaggcccttggagaagtccttgagcagcttcccgtgctccttctggatgttcaggcagatggtcactgcctggtggaggaactcggcgatc

SEQ ID NO: 1565 - DNA, 447 bp, Hordeum vulgare
cctctgcgataagaggcgccgggcggagagacgctaacatgggcggccacggcctcctcctcgtcctccgccgccggcgccgccgctcttgtccatgcctctccacgccccgcttcccaccgcgctgcactagctcactaccaccaacccccttttcttccgccgccattctccattgcgttccgttccccggcacgtgccctccctcgcagcggcggcgccttctgggaggagccagacgacggctccgggagcgactacgagggtgagggaaagcaaccgaccgtacacagaagctcccctttcccttcccccttcccgctctccaggctcgttgcaacgcggcagcaggagcgtgaagagcaggagctccggagagaaatcgagcttctcttgacgccggaagaagaggctatcttggatcagaacgagaccgctgatgtcacc

SEQ ID NO: 1566 - DNA, 517 bp, Hordeum vulgare
ggagttcgagaagtccggcaaggtccccgacccggagtccaccgacaaccccgagttcaagatcgtcctcaccatcatccgcgacggcctcaagaccgacgccagcaagtaccgcaagatgaaggagaggctcgtcggtgtctccgaggagaccaccaccggcgtcaagaggctctaccagatgcaggagtccggcaccctcctcttccccgccatcaacgtcaacgactccgtcaccaagagcaagtttgacaacctttacggttgccgtcactctctccctgacggtctcatgagggccactgatgttatgattgccggtaaggtcgccgtggtctgcggttatggtgatgttggcaagggctgtgccgccgcactcaagcaggctggtgcccgtgtgatcgtgacagagatcgaccccatctgtgctcttcaggccctgatggagggcatccagatcctcaccttggaggatgttgtctctgaggctgatatctttgtgaccaccaccggaaac

SEQ ID NO: 1567 - DNA, 917 bp, Hordeum vulgare
  UNSURE (709),(710),(721): n stands for any base
gtctcccgggctgcaggcattcggcacgaggaaactctgaatactagatatgacccaaaataacaggggtcaaggtcggccagtgagacgatgggggataagcttcatcgtcgagagggaaacagcccggatcaccagctaaggcccctaaatgaccgctcagtgataaaggaggtgggggtgcaaagacagccaggaggtttgcctagaagcagccaccctttaaagagtgcgtaatagctcactgatcgagcgcccttgcgctgaagatgaacggggctaagcgatctgccgaagctgtgggatgtcaaaatgcatcggtaggggagcgttccgccttagagggaagcaaccgcgaaagcgggggtcgactaagcggaagcgagaatgtcggcttgagtaacgaaaacattggtgagaatccaatgccccgaaaacccaaggtttcctccgcaaggttcgtccacggagggtgagtcagggcctaagatcaggccgaaaggcgtagtcgatggacaacaggtcaatattcctgtactaccccttgttggtacggagggacggaggaggctaggttagccgaaagatggttataggtttaaggacacaaggtgaccctgctttttcagggtaagaaggggtagagaaaatgcctcgagggggggcccggtacccaattcgccctatagtgagtcgtattccatttcanntttttttttcnctctcttcctcctcctcttttcctaacactcacatttctatcttcatctcctccattattcttatatactaactcatcccttttcttcactttcttttcattttatcactacccctttatatttctctaatttttctccactcattattttaatctattcctatcttttaatttattccattctctttgttttaat

SEQ ID NO: 1568 - DNA, 907 bp, Hordeum vulgare
  UNSURE (762),(843),(871),(873),(874),(893): n stands for any base
tcctacggcagtgatgttctctcattaagcatacagttactaagataatccgcatcaccaaacatgatgcgacacatgaaacagtaaaagatctagattatataaacctcaaaaagatctagagctcacagaatgtaaggttttgtcgttgacctcgtcgcacatgaagtaaacatcaaagtgtaaattgaaggtcaagacacttggtacaaatcagaccatgctaacatgtccacggtttcttctgcccgtgctgggtcatagatcgctatccccatgccgaggcaaacaagggcgcgtttagctcccggctgccgtaggtatggcggctggcttcgaatcctcggccttctcatgctccttgtttagcatcttgttgttgatcaaattgtggagagcgatgacactccggataagggaagacaggtatatgaccagcatcatatcatttgttttcactgcaaaggctttaatgagctcatttacgttgagattggggagcagattaaacacatcctgcaagtggtacaaaatctcgtggttcagtgggagcttcccttcaattacaagatctagataaccccggatctccgtaagcctcgcatcaagtcccttcagggcagcaagcttgctgctgacctctgttgcaagtgtgcttattgttgtgtctttcacatccctcagaaggtgctcaactccgatttcctcaacttcatgagcagcaatttctgatggcacgtggacgaacaccttttgactttnctgagtagcattctctttaacctcttcacagcataatatgctttggtgggtattcccaactccttgggtttgacatcgatnatcaccagcacaggattaggaacatagntnngtaacaatgcatgaacatncaaaagtcgtctcc

SEQ ID NO: 1569 - DNA, 525 bp, Hordeum vulgare
gcctaaacaaaaactggtggcggcggcggcggcggcggcggcgagacgacagacggtgagatggcgaccgcagggaattcaagtggttgtagtggcaagtccgtgttaagcgaggagctctatctggctgcaatctccgtgtatgagagtatccgctggattcaggtccaggaggacaagatggctgagatctccgcagttcgcaataatttgcttgggttgaagtcggatatattcaagttgtttgagaagatctcccgtcagtcagattccgatacccagaagaggatctgcgctatgcagaacgcctgtcatgatttgaaatcgttggaaacccagagcaagattggcgacggcggtgagatagaaatgaggtgtgaggagtcgaagccaaggagtgccgcgtccctagaactcgaggatctgctccatcgtgccgcagtacaaacccagatgtggataggcgaagacgcagaaagtgaggagctgcttgatctggtcgcaagggagacacaggggaggatc

SEQ ID NO: 1570 - DNA, 554 bp, Hordeum vulgare
  UNSURE (22): n stands for any base
ctattaacgataggctacgtanttcacataataaagggttcacatagaatgactataattaaaatgttcatagcttccaatgcctaatagcacaatacatcacgaaacggcagcaaagacagtcttcaaaagatggacatgtccagtagcaagatagccattatcatcttcaacaagcttacacactgcccaaacgtccttgttcctattcatcaggatagtgtcttcgaggttatcaaggaccaagctatagtaatccccacttgatagctaccaaagttgcacttatgtttacttatgttccatttttgaggtgtgatgaagagagcatgagtactttcaacagactgcgatggcgtataggcctccatgagaactttcaactgtccatccaattccacagaaactacatgccttgacaggtcaaggtaaccagttttagccattccaccttctaaatcaagaattacaacttgcccagcaatatctttatcaacatcctgaggtagtgaagagcaaacaactcgcccaccatgtggaaaaggcaatgatcc

SEQ ID NO: 1571 - DNA, 517 bp, Hordeum vulgare
cctcgtgccgaattcggcacgaggccgcccacctccactcatctccctgcccccgccggtctcgcgccagaacgcaccgccgccgccgccgccgcgctcctccaggaacctccacccccgccttctacgcgctcgacgcaagctcctcgctctcagccacggcgtgagggatgatgaggaagctcaagttccatgagaggaagctgctgaagaagaccaacttcctcctgtggaagcgggagggcggccaccgcgaggccgccgtcacgcagcgctacagcctcgtcgacagggacgactacaagaagtacaacgggatttgcctgatgtcgcagaagctcgtgaacatcataaagcagatggatcccagggaccctttcagaatcgagatgacaggcatgctgctcgataagctgtataatatgggtgtaattccaacaaagaagagcttggttaaatgcgagagactttcagtgagcgctttcgccaggcggagacttgcaacaattatggtgaa

SEQ ID NO: 1572 - DNA, 553 bp, Hordeum vulgare
tgatacctgtattatcatttgcaatgcaaaacagaaggcggcaagtacaaactgattaggcatttgcattctatagcagtttagcttttatcacacaagtagctttgcaacagataactatcttaacatattgtagcctcagattcaggtttaaaaaatattacaggagtagctaaactgaatcaccgatggtcccgaaatttctactatcacgacacatcctcaaatcatggcatcataatcatccaatgcaccattatactccatgatctttttcttgatcttcgaggaatccacccaggtgatgaagtcctccatgttcctggtcacaaggaaggctggatcggtgaccgtctctgggcctacacgcacatgtccctgttcaatgtaggtgatagcctctttaaggtgttcagcaaacttgagcttcaccataattgttgcaagtctccgcctggcgaaagcgctcactgaaagtctctcgcatttaaccaagctcttctttgttggaattacacccatattatacagcttatcgagcagcatgcctgtc

SEQ ID NO: 1573 - DNA, 268 bp, Hordeum vulgare
tgcagagattgggctacttgcaacagtgggagtaactactgtcaaggcataccgtcgaccaaccattgctgtattttccacaggggatgagttagttgagccagccactgcaactctcaatcgtggtcagattcgtgattccaaccgggccatgctacttgctgctgctattcagcagaagtgtaaagttgttgacttgggtattgcaaaagatactgaagaaagtcttatggagcatatggatgcagctctacgttctgatgctgat

SEQ ID NO: 1574 - DNA, 544 bp, Hordeum vulgare
cactttatcttccaccgatctgagtatcagtacgtaacagtataatacaggcaaaatgacaaccgtcgttgtgagagaatagactgatacatacaagaccagataaaaataactctcactgctttattggcaagacacgcatgccagccctcaaaagagtagcacatagccaacctgcgcccgaagctggattgcgaaagcagattcccaagagacaggagtgttccaccacctctagatgaagcgccgatcaggggtcgcatgagcagccgccgcccgacgacgcagctctgaaactgcgctcccactggtccacgggcgccgcttcagcgtgaggcacgtggcgggggttcttctccctcttgtcacccttcagctgcttcatggcatgcttcagcgccgggagaagagcctccatgcactccgcgacagcatttgggttgccgggcatgttgatgataagtgtcgatcctcttataccacatgcggcccgggagagcatcgcaaaaggtgtcaccttcaaactctcctgaatcataacaaa

SEQ ID NO: 1575 - DNA, 517 bp, Hordeum vulgare
ctaaagactatgaggcaacgccaaagcctcttggcttagcattcggcggatcaattggaaacgagagggtctttattgatgaggacttctctaaagttacaattcgccatcatgcagttgacaagacttaccaacatggttctctcattcccaatcagggttatttacctgttgcggcttcaatacttgattttgaagtatggggacttggtggccaaacaacaaagcggcaacaggatatttacaagaagagggaggatattttctcaggccaaaggagaaagattgatctcgcagcttttggcaactgggaagactctccagagaaaatgatgatggacatggtttctgacccaaataggcccagtcgggaagaacgttgatcaagttcaacggccaagctcatttgctagtgttcagcagctgcccattcggaagtggacacactatattactttcgaggtatatagagttcagtgcacgcattcgctcctttgatgtaaaggcatttggcagg

SEQ ID NO: 1576 - DNA, 552 bp, Hordeum vulgare
  UNSURE (33): n stands for any base
aggaagatgggcaactttaaactatatgatgtntcatcttttatataacaatatggtacagatgagaattatctaattcacaacacagatgtacaaatcgtttgctcttgcttcccatgaaacaaagggaagagaaggaaactctaacaattgtacttctatacaagcctctgttcaattcagaacctacattatgagtggtcctgccaaatgcctttacatcaaaggagcgaatgcgtgcactgaactctatatacctcgaaagtaatatagtgtgtccacttccgaatgggcagctgctgaacactagcaaatgagcttggccgttgaacttgatcaacgttcttcccgactgggcctatttgggtcagaaaccatgtccatcatcattttctctggagagtcttcccagttgccaaaagctgcgagatcaatctttctcctttggcctgagaaaatatcctccctcttcttgtaaatatcctgttgccgctttgttgtttggccaccaagtccccatacttcaaaatcaagtattgaagccgcaacagg

SEQ ID NO: 1577 - DNA, 509 bp, Hordeum vulgare
tccccagttagtgcctgatgatgtggaagagacactaaggccatctgattctagtgcctttgtggaagagacactaaggtcatctgattctagtggactggaggctcctgaccgtgacccagaggaaacctctatgttggaaatcaaatgtgattctgcaccagagttgatcgaaaaggtcgatgatgatgccgaacagttgactgattcaaaaacagagaatgtcgtggagcagtctttcgacttctctggtcagcaatctacccaaactaatccatcaagggaacccagtcctgttcctgaaaaatctgaataccccagtgaggatgttatgggtaatcttgagcagtcaccggagatggaagctagaagtgcagcaagaaaggcctgcaatccagcatttgctgctgcacagatgaaattcgaagagctgacttcagcagtcagtaggtccaacagttcatcttttctggatgcaccaagcaaaccgaaggtgcacactccccgtt

SEQ ID NO: 1578 - DNA, 556 bp, Hordeum vulgare
gatcatattttttaaaatccacactgtctgttgctcgttccaatacaagtcaagtaggatatgtattacacacaaaagaaataccactatcagtcaaataacacaaccaataagatcaaccaacaaatgtacatatatgatgaagctgctgctcttctccatcagtattccaaggaaaaaatattaagaaacgactgacgaattagagggacctcctgcggcgataaaacaagggcgcgagatgagtgcttctagatatttgatttgatggcacctcgtcgatgtgctgccatccatcatatattccacctcttatcagatggattgtgaggaacagcaacgctgctcttcacattttgctgagcctgggaagatgaccgttgcatgcgaggagatgtctcgtttttaccgtttgtgatgggcaaagaatgcctcttcctcgggttgttgtcttgcacgtctgggcttaacttcggggatagagcggccgcctttgctcttgcagattctgtgaactgcatgtaacttggcaatggagtgctgttgctcatgcgag

SEQ ID NO: 1579 - DNA, 519 bp, Hordeum vulgare
aaccttgctcctgcctcctgtccagtcctggaatggacaaagcttgcaacagggctctgcgccgtgaggccgcctgcgcttggcaagaagaagatcaccctgatgctgcttcttatacgacctcgggagcgtccagcgggtcgtcgttgtgctcattggcgtcgaatctgggcgatgagtcgagttactcccctcctgatgatcgttcttcagggtcatcttcagcatcgtcgagcaccttgcagctggactccgaggccgagggacctctctacgagctgtcttcgctgctagcccagcttcctgccaggacagggctgtccaagtactaccaagggaagtcccaatcattcacatcgatatcttatgctacatgtcttcaagaccttggaaaggaagttacctacagcaagaggatgaagacatgcaagagctatacatcaggattaggcatgaagcagcggtcaaatcacttaccaaggacatgcaacaagatgataacaaagaggtcctcaaaag

SEQ ID NO: 1580 - DNA, 511 bp, Hordeum vulgare
tccatgtgaaaagtacagtaagtgctgtatgttcattggaagtggagtcctggcattctagttgtacatagttaagggttcatatgcatttgtacatcttccttgttctggtgtgcaggtaaattggcactgctgtacaagaggttggtgctgcttgctctggacatttgacaagcaaatgaaccttttgaggacctctttgttatcatcttgttgcatgtccttggtaagtgatttgaccgctgcttcatgcctaatcctgatgtatagctcttgcatgtcttcatcctcttgctgtaggtaacttcctttccaaggtcttgaagacatgtagcataagatatcgatgtgaatgattgggacttcccttggtagtacttggacagccctgtcctggcaggaagctgggctagcagcgaagacagctcgtagagaggtccctcggcctcggagtccagctgcaaggtgctcgacgatgctgaagatgaccctgaagaacgatcatcaggag

SEQ ID NO: 1581 - DNA, 524 bp, Hordeum vulgare
gtaaggtcgccgtggtctgcggttatggtgatgttggcaagggctgtgccgccgcactcaagcaggctggtgcccgtgtgatcgtgacagagatcgaccccatctgtgctcttcaggccctgatggagggcatccagatcctcaccttggaggatgttgtctctgaggctgatatctttgtgaccaccaccggaaacaaggacatcatcatggtggaccacatgaggaagatgaagaacaacgccattgtctgcaacattggtcactttgacaacgagatcgacatgaacggccttgagacctaccccggtgtcaagcgcatcaccatcaagccccagaccgaccgctgggtcttccctgagaccaagaccggcatcattgttcttgctgagggtcgtctgatgaaccttggatgtgccactggccaccccagctttgtcatgtcctgctctttcactaaccaggttattgcccagctcgagttgtggaacgagaaggccagcggcaagtacgagaagaaggtg

SEQ ID NO: 1582 - DNA, 537 bp, Hordeum vulgare
cgatcagaaccgatacggaaaagccaccacctcacataaaccaatgataatggcattatttctgggcaaaagcaaacgcagcctctcccaaccctcacaaggctcaaaacataaccgtaataacaaatcctccgcctatgagacagcatgtaagataatggaagggaaacaggatagttgataggtcgccgtggcagagttcccgttggcgccgctgctcagactcaggctcaggccagccgctagtcgtgctggacacactagtaccggtaggccgcgggcttgtagggaccctcgatcgggatgctaatgtagtcagactgggacttggtgagcttggtcagcctggcgccgagcttgcccaagtggagggccgcaaccttctcgtcgaggtgcttggggagaacgtacaccttcttctcgtacttgccgctggccttctcgttccacaactcgagctgggcaataacctggttagtgaaagagcaggacatgacaaagctggggtggccagtggcacatccaaggttcatcaga

SEQ ID NO: 1583 - DNA, 10 bp, Hordeum vulgare
  UNSURE (1)..(10): n stands for any base
nnnnnnnnnn

SEQ ID NO: 1584 - DNA, 489 bp, Hordeum vulgare
aatagtcactttacctggggagagttatggatattactacatcacactcacacatgagtttaggcaatatcgcaacaagatacaacacagtcgtcagatccaacaccatccactacgaaaccacgatcatcaccagcaaatttattgttaaacctaagccctaaggcacactggttcctaaacttttgttctcacatcagggtacacgtatcctacttccagtttctgtccgtttaaacctgggagaatcaatcaaggcatgtacgtatgtcatcacagtacaacggccacttgtgagtaactcttcgcacctgctttaagcaggcccggtactcccttgaccatggaagaagcgcacaacgacgcaggttatgttgtcgctgctctcccgcttgtaggcctcctgcaagagcctcttcgcagcttcctctgggtcttgtatcgaccgggtcatgtcgacagcctccttgttagagaccacatcccaaa

SEQ ID NO: 1585 - DNA, 519 bp, Hordeum vulgare
agagcccttcacttcagctcagcctctgggagtcagaggtcggaaccgaacatggacgccgggcaattcgtcatcccgatcctcggcatcgtcggcgccgcggccgcgaccttctacgccgtcagcttcatggagatccgggagaaatcgctggaggacctggacgacaagtactccgagtacgaggagggcggagggcggcagcgccgggcacggcggaagtccggccgccaggcgaagaagcgaaaatgattgacggatacgccgtcagcctgagaaataaagaggatgcgcgtgtggcctctgtattgatgttcatcacttcccctttttttgttagcagctaatcacatctacgttcggtccatagccagaggaaatgtgcactgttcactgctgctaggctttttggccctgcacttgcattcagcggttatgcttttgagccacacttctctctgctgcgcatgctgattttgaaattgttttatgcagtatcaaacatggattcatgtgatc

SEQ ID NO: 1586 - DNA, 551 bp, Hordeum vulgare
gtttggcattgtgattaatgtggcattcccatgatcaggtaatctgtccttcgaagtttgaacattgcggttaatgaataaatctcagtggagttcttcgctaaaagaaggaagaagtttgcaagctctttctcttttttttcgtttttcgccaccttctttgctttccttatcactgcattcgcccaaggggatattttctattgtaagtttcctcctttatcaagtttgataactgatttgtttcacaccgtctactaaccaattcgctttaccaaaaaaaactagcattccctgatcacatgaatccatgtttgatactgcataaaacaatttcaaaatcagcatgcgcagcagagagaagtgtggctcaaaagcataaccgctgaatgcaagtgcagggccaaaaagcctagcagcagtgaacagtgcacatttcctctggctatggaccgaacgtagatgtgattagctgctaacaaaaaaaggggaagtgatgaacatcaatacagaggccacacgcgcatcctctttatttctcaggctgacgg

SEQ ID NO: 1587 - DNA, 507 bp, Hordeum vulgare
  UNSURE (2),(7): n stands for any base
gncccancgttggtattgatgcaggagaaccacatatgggcttccagatacattctcgagagaatcacggagcaagctggtgtggtgctcacccttgacccaaaaccaatccagggtgactggaacggagctggctgccacacaaactacagcacattgagcatgcgcgaggatggaggtttcgacgtgatcaagaaggcaatcctgaacctttcacttcgccatgacttgcacatagccgcatatggtgaaggaaacgagcggaggttgacagggctacacgagacagctagcatatcagacttctcatggggtgtggcgaaccgtggctgctctattcgtgtggggcgagacaccgaggcgaagggcaaaggatacctggaggaccgtcgcccggcctccaacatggacccgtacaccgtgacggcgctgctggccgagaccacgatcctgtgggagccgaccctcgaggcggaggccctcgctgccaagaagctggcgctgaag

SEQ ID NO: 1588 - DNA, 551 bp, Hordeum vulgare
  UNSURE (41): n stands for any base
gggaatcctctgtgcgattattatccttttataataacgtnagttctccaaatggactcaggtacagcgagtgtacagacccaacagatcaaatggactcagttcaagcggaaaaaacacgcgggagtggttctacaaactgtgaggattttgtacaggcagtgccccgacggaaccacaggatcaacaagaatggacggccaacggtctcgccgcccgccgatttattttcttttccccggaagaagaatccgtccttttttcaggtccttcataccttcagcgccagcttcttggcagcgagggcctccgcctcgagggtcggctcccacaggatcgtggtctcggccagcagcgccgtcacggtgtacgggtccatgttggaggccgggcgacggtcctccaggtatcctttgcccttcgcctcggtgtctcgccccacacgaatagagcagccacggttcgccacaccccatgagaagtctgatatgctagctgtctcgtgtagccctgtcaacctccgctcgtttccttcaccatatgcggctatg

SEQ ID NO: 1589 - DNA, 527 bp, Hordeum vulgare
ccattccactcgccattgtttcttcgtcgctctcatctgaccaccacccaccgcgaaacggcggcgaagccgaagatagatagagagagagagagatgttggggcatctggttgggctggtgaaggtgcgggtgacgcgcggggtgaacctcgccatccgcgacctccgctccagcgacccctacgtcgtcgtccgcatgggcaagcagaagctcaagacgcgggtggtgaggaagagcatcaatccggagtggaacgacgagctcaccctctccgtcgaagatcccactgttcctgtcaaactggacgtgttcgacaaggacacattcttcgacgacccgatggggaacgcggagctggacatcgggccgctggtggaggccgcgaggatgcgggtccagatgcagggggtcgacggcaccgtggtgaagaagctggtgcccaaccggcagaactgcctcgccgaggagagcgcggtgtacctgtccgagggcacggtgaagcaggacgtggtgctcaggctcagg

SEQ ID NO: 1590 - DNA, 556 bp, Hordeum vulgare
gcaaagaagaagaaaaattacttcatcacccattgtagcatttgctctcccgattgcagatgcaggacacatgaagcaagaaaggaggatggaatcccgagacatttgacgcccctgccatcagttcattctttcttcagtccgccttaggaagcccgaccacagagtcatatatataatatcacagcatctaaatcctagcttaagcttcgattctaaacatgatttaccccagcttttcacttgagaaagaactctgccaagagcagagagtgcagagctaattactgattaaagtttagaagcctgacgcggccttggagccggggatgtcgatccactggagctggagctcgacctccccgcactcgacgttcctgagcctgagcaccacgtcctgcttcaccgtgccctcggacaggtacaccgcgctctcctcggcgaggcagttctgccggttgggcaccagcttcttcaccacggtgccgtcgaccccctgcatctggacccgcatcctcgcggcctccaccagcggcccgatgtccagctccgcgtt

SEQ ID NO: 1591 - DNA, 518 bp, Hordeum vulgare
accgttggtctgtctgcgataaacgacggtgtgctcctgaaatgccacgtccaggccatcatcaagcgctacttcaaggagaagttctacttcatggagctcatggagctatggaacgagattgggttgcagaccgccatggggcagatgctggacctcatcaccacccacaccggcgccaaggatctcgccagatacaggatccaagggtaccgccgcattgtcaagtacaagacgtcctactactccttctacctgccggttgcctgcgcgctgctcttgaatggcgcgaagctgagcgactacgtcgagctgaaaaatgtactgattgagatgggagtctactttcagatacaggatgactacctggattgcttcggtgaccctcaagttattggcaaggttggaacagacatagaagactacaagtgctcctggctaattgtccaggctatggaactggctaacgagaacgagatgaaaatactatacgagaactatggcaagtcttccccaga

SEQ ID NO: 1592 - DNA, 551 bp, Hordeum vulgare
  UNSURE (27): n stands for any base
tccaggctaggcagtgccttctccgtntatatcatacatgttgtacaagggagcgcatgacatccccatccgtggaatgtactgtatttaaggtttctccatagtaatcatagttatgaaaacaggaaaggatcgtctacttctttctcctataaatcttcttcaaaaagatctttaaaatctcccgaatcgcacgatccggttcagcgtcgatggttgaaaccaggtgcttgtaaactcttgactcgtactccaagaatatgtcctgaagatcaagctccttataaacattcttcactgctccgacacattctggggaagacttgccatagttctcgtatagtattttcatctcgttctcgttagccagttccatagcctggacaattagccaggagcacttgtagtcttctatgtctgttccaaccttgccaataacttgagggtcaccgaagcaatccaggtagtcatcctgtatctgaaagtagactcccatctcaatcagtacatttttcagctcgacgtagtcgctcagcttcgcgccattcaag

SEQ ID NO: 1593 - DNA, 440 bp, Hordeum vulgare
ggtcgctcccgcgcccccacgcaagcgcactctctcgctctctagccgcgcagccgatacaaatcgtgcgtgccggcgtcagtcacgccacgcacggtgcgcgtccacgccgagtggagcggagctgagcagagcagggctttgctcgaccggcaatggcgggagcctgctcgtgcgccggcctcctggcgctggtcgtgctcgcgtgcatcgccgacgctgcgaccgcgcagctgcggctggacggcaggtcgttcagcaaatccatcgtgaagcacgtcctcccgggccccggcttcgacctcaaccagctcaacgcgctcttcgccaccaacggcctcacccagttcgacatgatcgcgctctccggtgcgcacacgatcggggtgacgcactgcgacaagttcgtgcgccggatctacacgttcaagcagcggctc

SEQ ID NO: 1594 - DNA, 415 bp, Hordeum vulgare
tgcccacaaaagcagagtgattgcatttgtttcagcgtaaccatgtgactaatagtcccattttccgttaagacccattccatcccacatcccgatcaaagaatggttaacataatcccaccacaaaacgtagcgtatgagcacactaacgcacacacgcgagcaaaaacaccctgcatctgcgctgcatcacaagtaattcacgaccctaccgacccaggctaacccacacgcacgcgcacgcacacgcacacacgaccgaaatagaaagctagttgacggcggtgcagacccggcgcacctcgccggcgctgccggtcttgaccccgatccgtcccagcttggccatggcggcgacgaaggcgtcgaagaaggcggtggagttggcggcgaataggttgacggtggggcggga

SEQ ID NO: 1595 - DNA, 542 bp, Hordeum vulgare
  UNSURE (16),(68): n stands for any base
gtcccccggctgcagnattcggcacgaaggggacctcctgccgtcgtgggccacggcgagctcgcggnggtgtgcgcgtgggcggacaggcagcgcttccggtaccggtggtcaagtcccctgcacttcgccgacacccccggtgactgcaacttcagctacgccagggactgccacgacaccaaggggaacaaggacgtgtgcgtggtgggagccatcaacaactacaccgccgcgctcgaggacccgtccagcccgtatgacccgacggagagcctgatgttcctggcgcacttcgtgggcgacgtgcaccagccactgcactgcggccacgtcgacgacctcggcggcaacaccatcaaactccgatggtacaggaggaagagcaacctgcaccacgtgtgggattcggacgtgatcacacaggccatgaaggactttttcaacagggaccaggacaccatgatcgaggccatccagcgcaacatcaccgatgactggtccagcgaggagaagcaatgggaggcgtgcggcagcagaac

SEQ ID NO: 1596 - DNA, 551 bp, Hordeum vulgare
  UNSURE (22),(29),(32),(40): n stands for any base
gtcaggtcacttagtattattnccaccgnggnatggaagnagatacaatgggtgcgaataaatacaacaccatatacatatacatacctacatacatacaatatacagaattacagatacagtgatgtgctgcagcaacagcgagtctaagccgctttggacctttagtggacgactcaaaacaaatttcatcgcgaattcgtgattgtggtgtagctatgtatcgttgtcagacaagacaatcttcttgttcgtcctccttaatttctagtatagcactagattatatccatatcaatatcattcatcagatgctctgcagcctgctattcttcccactgaagatctggttaaggatcaccgccagcctcacgcctccctgagctatcctcttctcgacaaccggcaacgcccggaagtaatagtcgtctcctaaggtgtcgccttgctcgacgccctcgtacgcgtcgcaggccagcaatgcgctctccttggcgtacttttcggcgcaggtgatcttggttctgctgccgcacgcctcccattgcttc

SEQ ID NO: 1597 - DNA, 521 bp, Hordeum vulgare
cttaccatcttttatggtgggtcagtatgtgtatatgactcagtgccaccagagaaggcccaagcaatcatgcttattgcagcagcagcagctgcagcctcaaaaagcaatggccccgctgctgttaagcctccagtgatgtctgcgaccaatgctatccaagctatgcttacgcggtcgctctcactccagagcacttctgtagcaaatggacaacctcagcctgccgctgatcctagctcgatttgcaagcttcaggctgatcttcccatcgccaggagacactcccttcagcgcttcctggagaaacgtcgtgacagggtggtgagcaaagctccctacggcaccgggaagccgtcggaaggcatgggagcctctgggatggaggcggtcgcggaggggaaggcccagtaaccgaaaggaagaaagatagccccacccctgatgtgtttggaaggaaagggcgcgtgttagctgatgtgatgttacaccgtagaattatcatcgttcgtgataataat

SEQ ID NO: 1598 - DNA, 529 bp, Hordeum vulgare
  UNSURE (3): n stands for any base
ctngcagtttggttcctcggagtaaaacaggttcagatacagagtacactacccaatgacaacagaacaatgacaatagaggttctggtcgaatcattattatcacgaacgatgataattctacggtgtaacatcacatcagctaacacgcgccctttccttccaaacacatcaggggtggggctatctttcttcctttcggttactgggccttcccctccgcgaccgcctccatcccagaggctcccatgccttccgacggcttcccggtgccgtagggagctttgctcaccaccctgtcacgacgtttctccaggaagcgctgaagggagtgtctcctggcgatgggaagatcagcctgaagcttgcaaatcgagctaggatcagcggcaggctgaggttgtccatttgctacagaagtgctctggagtgagagcgaccgcgtaagcatagcttggatagcattggtcgcagacatcactggaggcttaacagcagcggggccattgctttttgaggctgcagctgc

SEQ ID NO: 1599 - DNA, 516 bp, Hordeum vulgare
ccattgcggagagggaggaggccgtggccaggctcgagggggagaagactagccttgagaagctgctcgccgtgcgcgagaaggagcaagcgcaagaggcttcagagttgcagactagtatgattgaaaccatggaagctacagagatagagaaaatacggcataacagcactagaatggaagccctcgtgcggttggctgagcttgaggttacaaatgcagagcttgcaaagtcacttgccagggagcaatggaatcttgaagttcaagttgatcaagtggctcatcttcgagaggaagttgacttgaagacttttgctcaagataagtacaagagaaagatagcgaagatacagaagacaagtgcccctttagttgatgaaatagaatccttgagaaggttaaagctggaagacgaaattattgatgcagaatacactcagacctgtgatagaattgtcagcttgaaggacaaggcaaggaagattgaagaaaacattgagctgacaagaaggg

SEQ ID NO: 1600 - DNA, 534 bp, Hordeum vulgare
aaaattctattcgggttgtcatatctgagttggtataaccatccatcaggtcacttaacctaccgaggacaaaaccagtaatgtcatctgtgatctgtcaacaagtcttataacgtgcctcgctgctccctgcacagcaataggctacgtacatatatctatgatgtacacaaagaaaacaaaactacagagagagaacacacagggttaaatgctagtcttgttgatcgactccagagagaaggtggcgccggggcgggtgtccggcacagcgggatgcgacgacagtatgtacatgacccatatgtggaggcacaccaggtacaccgcggccccgacctgcgccttcggattcctacgcaggaagatgtgaccggccgagaagatggagtcgagctgccgtatcgcgtatcccaggtgctgcttcccactccgtatcctgtcacgcagccttggggaagaatatggtgaatatgattcttgccatgtaccggcctcgatgtctatcctcgacgacgagcttgaagacgccag

SEQ ID NO: 1601 - DNA, 336 bp, Hordeum vulgare
atcggccctggtgctgttcttcgttcacactcaactaccagtgagaccagtctttgcgtcggcgatcgggttaggcatatcggctgcactgctgtcagtcatgggatctcgcttcaagaagtctggaaagatattcccagcaggcgtcgtgtcccttctttccttggtcatggtcggcggctacgcccatgggattatgcgtagctcgcatgtgtgatgcaatcattgtagttatcgtatgcacttccagacttagacatgcgaggtcttttttattttccgtgtttcgaagcagttgcctgcatatcttccgtgtttccggacattttgggactg

SEQ ID NO: 1602 - DNA, 315 bp, Hordeum vulgare
tttttttttttttttttttttttttggctataagaccgctattcacacacgatcttctaaaaattattggtttcctgtccatctgcccatacatacttcactagagctcaacgggaatgtaacacgacagtcagtcagtcccaaaatgtccggaaacacggaagatatgcaggcaactgcttcgaaacacggaaaataaaaaagacctcgcatgtctaagtctggaagtgcatacgataactacaatgattgcatcacacatgcgagctacgcataatcccatgggcgtagccgccgaccatgaccaaggaaaga

SEQ ID NO: 1603 - DNA, 382 bp, Hordeum vulgare
  UNSURE (313),(335),(353): n stands for any base
acaggatggtgctggtttcctctactccttcccaagagcaaagttatgcaccagtattgcagcattaacactccagcttatagtggcaacgttagcagctccaatagccctgcctggttgcccggaagtatgtggcagcatagctatcccctacccttttggcctcgggcaagggtgcttccgcgcgggcttcaacctgacgtgcgacgagacgcgccatccaccgaagctgttggtgggcgatggcgcagaagtgattgatatttctctggtggatggcacgttgcggatccacagtaagatgctgaatatnccgttgaacacaagctctactnaatcaaatggctcatggnccgttggtctgaaggacgagggcccactg

SEQ ID NO: 1604 - DNA, 467 bp, Hordeum vulgare
tctgtagtctgtacttctctagctacatcttctttcagtactgacctatttccaaatgaaaatcggctgggaatagtgaaggacttgagcacttcaatggccagtgctggcaacaactctgtttcactctgcttccgctctgaaaatgacagacagcgttccatttccagaacctaaaattaaatccactcctccttgaagttgttgagcctagctacctcctgcagtactggtggcaaccttgtgtaactcggttcatagtagtagtaaagttcttgaggcatacttacctactttgatagccggtgctggtggcgaccctgtctatctcacttcattcttagctgtttttccatgggtggttggtgtatgctgaaactatccgtttgacattctgcgtgcatgtgtatgttcagagcatgagatggccgaagttcttctggatctcagcgtgtgctcccttggcg

SEQ ID NO: 1605 - DNA, 371 bp, Hordeum vulgare
gaagaagaagcatagaggacagagtcacggagccatacctgattaatattagatcatggggaacacacaccaggccggcgtcaagaaggatgatcagggtggcggtgacaaccagcagctacaggtggtggtctccgttctcgagctccaggccggcgttgaagaaaaccagctgcagccgcttggcggatggcatgccgtcgaggcaacctccttgttggaaaatagcaagacaaataattttgctataggtggagcatgcatcaacaacaagacaactattctccagcctgcagctgaatcaaatatccttacacacgatgatcctctacatccattgttgccagagggcgtgcaattcgtgctcaaca

SEQ ID NO: 1606 - DNA, 322 bp, Hordeum vulgare
tttttttttttttttttttttttttctcctctgacccctccagcttacggtgcaaaactatgtttacacctgcaaccttttcacaaaaatatttcaacttcacagcttgcccctctactacctggagctgatcgttcagttttctgttctcagccacaacactctccatttcactttctgcctccatgactcggtcctcagccttcttattgtcattttctaaaaccttaatcttattgtgcaaatccatgtttacagctgcaacacttcctgagaagaaatccaactgtaaaactcggtcctcagcctcctttctattcct

SEQ ID NO: 1607 - DNA, 1108 bp, Hordeum vulgare
  UNSURE (1)..(5),(13),(14),(21)..(23),(25),(30),(32)..(38),(41),(49),(53),(54),(77),(78),(80),(160),(190),(926): n stands for any base
nnnnnttgaaaanncaatgannncncaatngnnnnnnnctncagaacgncctnntgtgcctttgcatagcaaacaanngntgatggttttttgtgggggggacccccaaaaaacccgtccatcatgctatgtgacagcaggagcagttttttttttctgnggggagcggcaccgcccccataaaaatcgncgtgtgcaatttgcttatggcactctctgacaccgccacgcttttgttcattatctcatatctcgtttactcttggggggggggcgattgtttcattttttttttaactcctccacatctcgccagagctgaaagcggggggggtcatatttaccacctcttcattgtttccaggcaagagtgaccggttttccccttgctctacaacccaataatacacaactttggcttttctgtttccccccttctcgtttttttgtcgtttccaatgtcttctacgcctatgcctatatcgtatttttatatcccatttgttgtctaacagatcgttattccccgctcaccttctacctataaccctttccccccttcctctttttttttagacctgttccattaagtcctccacccgtaatcccccttttggtgcccaatttcacgccgattccgtccttatattctgtccgctaaccccactctcttttcgttttttataccttctttcttctctactcctgttcctcccatatttccccctatattttgggatgtgttatttatattcacatatttcgaacagacgcatttccacaatttctatcctttcctctttgttttcaccgcccctatatcgcctgattactcgtgctatatatttattccctctttttcatcatttatctcgcatatttcccccccacccctttcttcttccacacattcacattccattctntactatatgccttcccgcctttcacacacgcttcttctccctcgttcttgttatcgccttgttcccccgctcgaattcgtggcacccccgtttcagcctagaaacgatatccatccccaagtctgttccgctatacaatcactcctatatccccccaattctatatatcctctccctctctt

SEQ ID NO: 1608 - DNA, 558 bp, Hordeum vulgare
  UNSURE (20),(69): n stands for any base
ggttttgccgaggaactcanttgttgattcgaaccatgaatgtacatatttcaagcacctaatttcatnacatagacttgaagggcactgaagatagctacaaacaaacttgtgaaatgctttgttgcaggcatattcactgatgagaaggcaatgcaaatttagcattgcaatcagatgatcaaaatggcaattcggcaaaaccgctctaaggtgttgccatcttggcaaatccagaaagtgaagcgattgcttccccggtggtcaaatagaggcagtcctgcctgaaatgattgtgtgcatcgttcgctcgttgtattttctccataacctctccggttggattcacaagtacaagctctaggccatgcttctctgttgatttctttaggtcgatgaggaatgctatgccgcttgtgtcaattgcagggacagctgatagatccaagattacgacacggagttcactttgtttattccctgaaaaactttcatcctctatccatcttttagtcctttcatttaggtagttggtgtttgcaaagtttataggagcct

SEQ ID NO: 1609 - DNA, 517 bp, Hordeum vulgare
gctccccaccacccaaccctagatcctagacccggcggcggcggccaggccaagatggtgtgcatccggcaggcgacgatcgacgacctgctggcgatgcaggcgtgcaacctgatgtgcctgccggagaactaccagatgaagtactacttctaccacatgctctcgtggccgcagctgctgttcgtcgccgaggactacggcggccgcatcgtcggctacgtgctggccaagatggaggaggacccctcggagccctgccacggccacatcacctccctcgccgtcctccgctcccaccgcaagctcggcctcgccaccaagctcatgtcggccgcccaggccgccatggaccaggtcttcggcgccgagtacgtctccctccacgtccgccgctccaaccgcgccgccttcaacctctacacctccaccctcggctaccagatccacgacatcgaggccaagtactacgccgacggcgaggacgcctacgacatgcgcaagatgctccgccagc

SEQ ID NO: 1610 - DNA, 528 bp, Hordeum vulgare
tttgagttggaacaaatgaaatgtcacatttaaggcaaaaatgggatgtagttaaaatatgtgcatgtcattaattctcgaattacaaggagtcttgccaaaggtgtgggacctgaccaggcaagcctacaaaaacatatgtaatcacagtacaatgttccctctgtatcattggtacatggatacaatcatcatccagaaaagagcaccatatgattcatataatccggtaggttcagcagctcctcacacatgaaatgtctttcctcttatgagtcggccttcttctccggcgaagcggtagttggggacgatccggccggcgcaggaagggcgtcatgggagcagcagccgccgcctgcgtggtggtggtggtggtgcttcttgggcacgggctggcggagcatcttgcgcatgtcgtaggcgtcctcgccgtcggcgtagtacttggcctcgatgtcgtggatctggtagccgagggtggaggtgtagaggttgaaggcggcgcggttggagcggcggacgtgg

SEQ ID NO: 1611 - DNA, 387 bp, Hordeum vulgare
actgctcccagctcgctcgctccagcccaagctgtaaacaaacacctacgcgcgcccgctccggcgagatgaagctcccgctgtcggccgggtcgcccgacgcggcgcccgagctggccaagccgtcgctgccgacgacgtggctcatcctgcacgcgctcttctgcgccacctccatggccgtcggcttccgcttctcccgcctcgtcgtcttcctcctcttcctgcccacgccgcccatgaacccctccgcccacctcgtctccctcgtcaccccgcccctcatgctcgccagctccaacgccaccgccaccatcaccaccaccaccaccaccaccacaaccgtcaccaccaccaccaccgtggccgagaccgacgccggcgcca

SEQ ID NO: 1612 - DNA, 439 bp, Hordeum vulgare
tttctttttttttttgttaatgaaaagcaggctgatctttcacctcctctttaaaaaaaattgtgtacagtattagaaaactgagagctggattgttattatttcacacttacacaaacaaatgtcttaaccccagaccaatttggcgagcccatctgctctgacctatattacacgaaagcaatgcgcctaggagaactcttcctaccagaaaagggacgatgaatggtgcatataattaaacttttttcttatctattttacaggatgatacagaacatggattcagatgtatcgtctgtgactttctgtagggtcccaacaaatgagctgagctgccttatgttactcaagagttgagatgtcttggtacaaggatgcatcagaggagactcacacagatcagaccagccgtagcagagtctgatttgccctgatt

SEQ ID NO: 1613 - DNA, 512 bp, Hordeum vulgare
ggcacgaggcttccccagccctcctacactaccttacacctcccggcggcggcagcggcggcggcgagaatatttgcatctcgcctctgcaccttggatctgcaatatgcctctgtttcacttagtatgctaatctgctcgatgattaagccgtgtagattcatggcgatatacgctattctgagtctttaggatgtcaacaaacgttatgagagcagatcttgatattgttttctgtttcatgtctatttatcttccgcgggtcaagtcttgtgaagtaatcctcaatcaccattttattgtcttctcgtcccctgtatctgaattctgcacgggcactgctcatcttgttgtctgtttgtgacatgttttgtttcctttgtgttctaaatccccggcttcgtatcttttatctggctttctgttccccttacccctcccctcagcatataaagctcagtgattagagccaattacattggcaatatacgctatactgaccatattttgat

SEQ ID NO: 1614 - DNA, 485 bp, Hordeum vulgare
cacagtagaccatcaagttctttcacaaactgagccaagcaacaacaacaacaaaaactatgttcccaccagggtatgagagaggtctctcaactgcagcctgaagcaaggtaggaaaatggtgcactgtggctattagaaaatggtgccagaatgctgcctgaggtggtggaatattttcccaggccaagctaaccaagtatgaatttgtttggttcctaccttgcctggcaaccttcaggcacaggagaaaggatgctatgctaattacactgctgggaatatagaggccaggcaggcaaattttccctttcaacacactaaccagagaagcatcaggcatgctctaggaggtaagaacacatcaggccagagatggagcatggtgtacaccaaccaaacagctccaaaacgactgtgtgagcaaaagcctgaacacaagacatacatgctgagattccttaagatcaagacattgaacgaac

SEQ ID NO: 1615 - DNA, 518 bp, Hordeum vulgare
ggtaggagccgccccctttcgtcgtcgccgccatcgccgtactccagcccccggccgccatgccgtacctccagcccccgcgcccccacccccaccccacctcccgcctctcgcccgcgtcgccgccatctccgttcccgttcttccccgtcgggacatcgcgctcctgctgtctccaccccgtcgcagtctccggccactcggtttcgagggttagtaaaggaaagtttgcagttgcagccgtcgctctagatgattatcttccgatgcgaagtactgaagtgaaaaatcggacatcaacagatggaatcaaaagcctcagacttatcacagcggtcaaaaccccgtatttgccagatggaagatttgatcttgaagcatatgattctctgataaacacgcaaataaatggcggtgctgaaggtgtaatagttggaggaacaacaggagaaggtcacctaatgagctgggatgagcacatcatgctcatcgggcatactgttaactgctttggagcc

SEQ ID NO: 1616 - DNA, 549 bp, Hordeum vulgare
tttttttggtgcaaacactgaaattgtaactagcccgactgtccatgtctcaggctattctcatttcttactggaacaggcatcacaaggtgccaagaaaccaaacgggttcaaaattaacatgcagtcagagaaaagatcgacaaatgactggtgaacgaatgaagcatctaaaacgatccacaaatgacactgcgactccaccgctgttcgtcagcatacactgggcacaaagaactcacacacttattcaatacctgctgatcaacacgaaatcatcatcatccagaacctgggcctccttctgtcccacaaaattctcccgtccaatggcttcgacaatccggacaaattccaccctcttttcaagaggaaggggggtgtatggcaacctgaaaacaggcctcaccacgccaagctgggccagggcagtgttgagacctatcgggttaggctcacagaacagccatttcatcagaggcagcagcttctcatttagtgtcgcgttgtccccttcaaacatgaggctgtgcatgagaccagggacaa

SEQ ID NO: 1617 - DNA, 552 bp, Hordeum vulgare
  UNSURE (19): n stands for any base
gtacccccgggtctgcagngaattcggcacgagggtggaacagcacttgacctggtgtcgccgccgttggttatggtacagagaatggcaaggactactggctcgtcaggaactcctggggtagcgtctggggagagaatggttacatccggatggagcgtaacatcaaggcatccagtggcaaatgtggtattgctgtcgagccttcttacccgacgaagacgggcgaaaacccccctaaccccggcccaaccccaccgtctcccgccccaccgtcttccgtctgtgacagctacaacgagtgccctgcgagcacgacctgctgctgcatctacgagtacggcaaggagtgcttcgcctggggctgttgcccacttgagggtgctacctgctgcgatgatcactacagctgctgccctcataactatcccatctgcaacaccaagcagggaacgtgcctcgcggccaaggacagcccactgtcagtgaaggatcagaggcgtaccctggccaagcctatcggtgctttccctggcattgcaaatgacggca

SEQ ID NO: 1618 - DNA, 552 bp, Hordeum vulgare
tgcaatctgcttatactggtttcttgatgaattcataataacaatggcagctccaaactgcgtgtgaatgagctgagttttacatatacatatgcaaaagcaaatttggtggttctgtaaacgaccgaacccgattttaggattatgtacaggagcatctattataaagaagatacttgagagcatagctatcgccatgctgcgccttcgatcgtggatcaccaggtgatcatttgcagaagttaatcaccatggccgttggctgtacgaatgccgtgatgcaaatgtttacgcgctgctcttcttgccgtcatttgcaatgccagggaaagcaccgataggcttggccagggtacgcctctgagccttcactgacagtgggctgtccttggccgcgaggcacgttccctgcttggtgttgcagatgggatagttatgagggcagcagctgtagtgatcatcgcagcaggtagcaccctcaagtgggcaacagccccaggcgaagcactccttgccgtactcgtagatgcagcagcaggtcgtgctcgcagg

SEQ ID NO: 1619 - DNA, 518 bp, Hordeum vulgare
cgacttcttctccttcgcccacctcaccccgcccctccactttatcaggaggaaggagaggaatggggctgcccaggacggcgattacttcgaaatcgaggtgaaggtttgcaacgggaagcttctgcacatagttgcttcggccaagggattctacctggtgggcaagccgcacaccgtaagccggtccttggtggacctgctacagcagctcagcagtggatttgccaatgcgtacgaggcactgatgaaagcttttgtggatcacaacaagtttgggaatctgccattcggctttcgtgcaaacacatggcttgttcctcctgtatatgtggattctgctacgaagagcccagctttgcccgctgaggatgagaactggggtgggaatggaggtggctgcggacgagacggaaaacatgaccggagacgctgggcaagagaattttctattttggctagaatgccgtccaagactgaggaagagagggtgatcagagaccggaaggctttccttt

SEQ ID NO: 1620 - DNA, 438 bp, Hordeum vulgare
  UNSURE (23): n stands for any base
ttattgttaaagtgcttgccggncctttgacgatgaatctttttcagatttttttgcattcttctcactgtcctcagaaacggaagcatcttttttctgcaagtgctggagccaggaggacccaagttcccacctgatacgtccaggatttttgttcggggtgttccccagcttcctcaagctggtttcaagtaccgtacatgctagtttcctcgcataactatcaacatgtggtttagatgcaaggtgctggctactggcagcgatttctgggttggtaattttcggcagtggtattcttagactgtgagcattcaaggcattagaacctccatctggatgatcatccacatcgatgttaggtatttcatcaagatgatcagagatatcactggtttgtttgccatcgctgctgttctttgtgcgtcccgaaacttt

SEQ ID NO: 1621 - DNA, 526 bp, Hordeum vulgare
cgcacgagggttgaggaggtgtacgtggcgtcgatcgatcaggggacgaccagcaccaggttcatcgtctacgaccgccacgccagccccgtcgcctcccaccagctcgagttcaagcagcactacccggaggccggatgggtcgagcatgatcctatggagatcatggagagtgtgaaggtctgcatggcaaagacactcgaaaaagctgcagccagtggacttaatgtggatgctagtttgaaggccattggaatcacaaatcagagggagactaccgttgtgtggagcaaatccacaggccttccgctctacaatgccattgtgtggatggatgttcgcactagctctatttgcaggagactggaaagtaagctatcaggtggtagaacgcactttgtggagacatgtggtttaccaatcagtacctacttcagtgctctgaagttattatggttgatggagaatgttgacgctgtcaaggatgcagtcaaggctggtgatgcattatttggcacaatcgata

SEQ ID NO: 1622 - DNA, 549 bp, Hordeum vulgare
tcgcacacacttctttctgagaatcagatgctcgtgtacttatagatatacaaggacatttatgctccagatcttcctataaagccaaagaagaatcgcaccgaaataatgtacaacacaccgtttattcgttgacaagacaaacaagggctggcacaaactggtccaatttacggcgcagcaatgtgtaacaaactagagagaaaggtcagccaggtcaaatgatctcgaaaccgccttgtaccaggagtctcctcttttcttcctgtgtgcatcgtctaacttggggcggaacaccgttgtgttctccttgtgcaggcctgcgaatatttcctccttcgtccagactccggcagctaaccctgctgcgtatgcggccccgagggccgttgtctcaatgtcggctggcctgacaacagggctacccagcaaatcagcctggatctgcatgagaaggttgttaacagtagcaccaccatcaacacgtagcaagaactccccttctgcactcttgacttctcctgcctccccagcatccttatgcatgga

SEQ ID NO: 1623 - DNA, 519 bp, Hordeum vulgare
gctcgagcagtgctcgagagtatgtgctttcaggtgaatgatgtcctcagctccatgcataaggatgctggggaggcaggagaagtcaagagtgcagaaggggagttcttgctacgtgttgatggtggtgctactgttaacaaccttctcatgcagatccaggctgatttgctgggtagccctgttgtcaggccagccgacattgagacaacggccctcggggccgcatacgcagcagggttagctgccggagtctggacgaaggaggaaatattcgcaggcctgcacaaggagaacacaacggtgttccgccccaagttagacgatgcacacaggaagaaaagaggagactcctggtacaaggcggtttcgagatcatttgacctggctgacctttctctctagtttgttacacattgctgcgccgtaaattggaccagtttgtgccagcccttgtttgtcttgtcaacgaataaacggtgtgttgtacattatttcggtgcgattcttctttggctt

SEQ ID NO: 1624 - DNA, 555 bp, Hordeum vulgare
  UNSURE (25): n stands for any base
tccgatgctcgtgtacttatagatntcaaggacatttatgctccagttcttcctataaagccaagaagaatcgaccgaaatatgtacaacacaccgtttattcgttgacaagacaaacaagggctggcacaaactggtccaatttacggcgcagcaatgtgtaacaaactagagagaaaggtcagccaggtcaaatgatctcgaaaccgccttgtaccaggagtctcctcttttcttcctgtgtgcatcgtctaacttggggcggaacaccgttgtgttctccttgtgcaggcctgcgaatatttcctccttcgtccagactccggcagctaaccctgctgcgtatgcggccccgagggccgttgtctcaatgtcggctggcctgacaacagggctacccagcaaatcagcctggatctgcatgagaaggttgttaacagtagcaccaccatcaacacgtagcaagaactccccttctgcactcttgacttctcctgcctccccagcatccttatgcatggagctgaggacatcattcacctgaaagcacatact

SEQ ID NO: 1625 - DNA, 543 bp, Hordeum vulgare
  UNSURE (3): n stands for any base
ggnctgcagggaattcggcacgagggggaaacttagagatgtcatggttccagaaatgtatctggaacagacgagaagacgggtccttatcatggaatgggttgagggggaaaggttatcagaagtcagagatcaatacctggttgaggttggagtatactgttcgctttcccagcttttggaatatggattttatcatgcagacccacatcctggaaatcttctacgtacagttgatgggaagctagcatacttagattttggaatgatgggagaattccgacaagaactccgtgatggatttattgaagcttgtctacatcttgttaaccgggattttgatggtttagcaaaagattttgttactcttggtttgcttcctgcaactgctcagaaagatgaagtgacaaaggcattgacaggtgtatttgaaagtgcagtcaacaaaggagttcaaaatataagctttggagatttgtcagggaatcttgggcagacaatgtataaattcaagttccagataccttcatacttctctcttgt

SEQ ID NO: 1626 - DNA, 543 bp, Hordeum vulgare
  UNSURE (2),(4),(5): n stands for any base
antnngcatagatctaaaaagaagtttgtttgttacagcatgctggcattatggtgcctgcttttcttccgagatatgtacatattctctcacaaagatgtacagggaaaagtaatatctccaaaataatcacagctaagccaataattagatgtgcctatttgataatgctactgtatgggaaacaaatctctttatacatctagcggacagctaaacagctaaacaaaaacattgcaggaacctgagattgaaaacctgtacatgtaggctttaagttcatatgaacattcttctgatggttcttgcaacagcacgagataaaacgagatttgttaaatccgcaggcaggagtagaaactgctgttgggactctggtgaaagctcaggaatgatagaaagaactggcaaaaactctggaaaagacctcatttcatttaacacaagagaaatatcatctgtgccatcatcccctttctccccagtgctttcgtatccaggagcccaagatgtgttttccttctgaggagtcttagatacaag

SEQ ID NO: 1627 - DNA, 517 bp, Hordeum vulgare
ggactccgcagcgcgagagagcaatggaaggggggagcctctggcacgagttcgagacggacctcccggccgccgacgtgtgggaggtctatggcagcctcgctctcgggcaactagtcccccagctgctcccgcacgtcctctcaaaggtcgagcttgtggagggagacggcggcgtcggcactgtcctgctcgtcactttccctcctgcaggagcttccgaagaaccaagaagctacaaggagaagttcaatgtggtcgaccatgagaagtacatcaaggaggcagaaatagtggagggaggctttttggatctccgcttccggaaatatttggtgcgattcgaggtcgtaggaaaagaagatggcagatccgttataagatcgaccgtcgagtatgaagttgatgccgagtatgcaaagaatgcctcccttgtcagtacagaggcattggctgctgttgctgaggccatcaccaagcacatcaaggagcagaagagcccaaagcaagccaagga

SEQ ID NO: 1628 - DNA, 496 bp, Hordeum vulgare
ccacaacaaacaaaaaaaaatgtacggcagtcacttcagttggagttggacgctgggcttcttctaaattttactctgcggcttcaaacttggctgccagtcacttcaggtggacacttcggctttcggacaatgtcaatgctcatgtatgatattcaggtacatgcacgcgttcttatggattttactccttggcttgctttgggctcttctgctccttgatgtgcttggtgatggcctcagcaacagcagccaatgcctctgtactgacaagggaggcattctttgcatactcggcatcaacttcatactcgacggtcgatcttataacggatctgccatcttcttttcctacgacctcgaatcgcaccaaatatttccggaagcggagatccaaaaagcctccctccactatttctgcctccttgatgtacttctcatggtcgaccacattgaacttctccttgtagcttcttggttcttcggaagctcctgc

SEQ ID NO: 1629 - DNA, 517 bp, Hordeum vulgare
gacgatcgacgacctgctggcgatgcaggcgtgcaacctgatgtgcctgccggagaactaccagatgaagtactacttctacccatgctctcgtggccgcagctgctgttcgtcgccgaggactacggcggccgcatcgtcggctacgtgctggccaagatggaggaggacccctcggagccctgccacggccacatcacctctctcgccgtcctccgctcccaccgcaagctcgggctcgccaccaagcttatgtcggccgcccaggcctccatggaccaggtcttcggcgccgagtacgtctccctccacgtccgccgctccaaccgcgccgccttcaacctctacacctccaccctcggctaccagatccacgacatcgaggccaagtactacgccgacggcgaggacgcctacgacatgcgcaagatgctccgccagcccgtgcccaagaagcaccatcatcaccaccacgcaggcggcggctgctgctcccatgacgcccttcctgcgccga

SEQ ID NO: 1630 - DNA, 551 bp, Hordeum vulgare
  UNSURE (7): n stands for any base
tttgtgncatgtattaattctcgaatacaaggagtcttgccaaggtgtgggacctgaccaggcaagtctacaaaaacacatgtaatcacagtacaatgttccctctgtatcattgatacatggatacaatcatcatccagaaaagagcaccatatgattcatataatccggtaggttcagcagctcctcacacatgaaatgtctttcctcttatgagtcggccttcttctccggcgaagcggtagtcggggacgatccggtcggcgcaggaagggcgtcatgggagcagcagccgccgcctgcgtggtggtgatgatggtgcttcttgggcacgggctggcggagcatcttgcgcatgtcgtaggcgtcctcgccgtcggcgtagtacttggcctcgatgtcgtggatctggtagccgagggtggaggtgtagaggttgaaggcggcgcggttggagcggcggacgtggagggagacgtactcggcgccgaagacctggtccatggaggcctgggcggccgacataagcttggtggcgagcccgagcttgc

SEQ ID NO: 1631 - DNA, 522 bp, Hordeum vulgare
  UNSURE (19): n stands for any base
gcaccacttcacagctgangctgaaagcaaaatcagtcgtaagcaggcgaagcggagcaaagcagtaagcagctagcactgttcgattcgctaagctaagcaggttgaaatttaccagcacgagctcccatggccagcttcgccgcccagctcctggacgtgttctacgacctcgtcgagcgagtcgccggctacagcgcccgcgccgaggacgacaaggcgcatgcagatctacagaagcgcaccatgttggcaactacggaggctttccggacagaggaagttgtcgagatccggtccagaaatcacccggatgtatcaggagggtcaggcgcacaggtcaacatggatggtatgtagagctagcctctacgtacggtagagatatacataacggccgtgtgatttggcagagcctccagatgctgcggcgcctgctggtgtgttcagaacttcaaataacataagctggtgtgtgtgtgtgccccagtaatgtttcagtttgttacaatgtccttaatt

SEQ ID NO: 1632 - DNA, 535 bp, Hordeum vulgare
agcctgctataattactgctctttagccttgcacttaaagcgcgcgagaacaatacacacaaaactcgatcaggaagttaacattgcaattagcaagatacgatagtaattaaggacattgtaacaaactgaaacattactggggcacacacacacaccagcttatgttatttgaagttctgaacacaccagcaggcgccgcagcatctggaggctctgccaaatcacacggccgttatgtatatctctaccgtacgtagaggctagctctacataccatccatgttgacctgtgcgcctgaccctcctgatacatccgggtgatttctggaccggatctcgacaacttcctctgtccggaaagcctccgtagttgccaacatggtgcgcttctgtagatctgcatgcgccttgtcgtcctcggcgcgggcgctgtagccggcgactcgctcgacgaggtcgtagaacacgtccaggagctgggcggcgaagctggccatgggagctcgtgctggtaaatttcaacctgcttagc

SEQ ID NO: 1633 - DNA, 540 bp, Hordeum vulgare
  UNSURE (4): n stands for any base
gggnctgcagggaattctgcacgaggctgatgctggtgatgaagatggtgaagatgatgatggggacgaggatggcgactttgctgagggcgaagaggagatctcggaaggagaggagtatgacaaccccaaggccggtgatgccaagaagaaacaaataggtgagggtgaggagaatggcgaggatgacgatgaagaacccgaggagcaggagggtggaggaggtgacgatgatgacgacgacgacgacgatgatgataatgaagatgacgacgacgacgatgatgttgctgctgaagacgatgaagatggagtagaagaggaggatgacgaccaggacaatgacgatgatgaggaggatgacgacgaggactcgctccagcccccgaagaagaggaagaagtgaagcccttcgacgtccttcgacgcggctgctttagtcaccatgggatgggatgtgcctgttcttcactgtgttctggaaactttcctttagagttaaaaatgccccacacgatcacaatgtgtgggcttgtagga

SEQ ID NO: 1634 - DNA, 542 bp, Hordeum vulgare
gggttgactgacattattaaatcttcgaggctttcgccactcaggtacaattatgttagcgaaacatctgttcgatcaactccacagaagcaaagtaacgatgacaacaaagttccctctaatcgctcctacaagcccacacattgtgatcgtgtggggcatttttaactctaaaggaaagtttccagaacacagtgaagaacaggcacatcccatcccatggtgactaaagcagccgcgtcgaaggacgtcgaagggcttcacttcttcctcttcttcgggggctggagcgagtcctcgtcgtcatcctcctcatcatcgtcattgtcctggtcgtcatcctcctcttctactccatcttcatcgtcttcagcagcaacatcatcgtcgtcgtcgtcatcttcattatcatcatcgtcgtcgtcgtcgtcatcatcgtcacctcctccaccctcctgctcctcgggttcttcatcgtcatcctcgccattctcctcaccctcacctatttgtttcttcttggcatcaccggccttggggtt

SEQ ID NO: 1635 - DNA, 517 bp, Hordeum vulgare
caccattagaaacctctacagtaatggcactgaccatgagttccatatcacctcgatccttgtgttctttattgcatcatatttcctgggcattttcagctatggcctcgccttaccatctggcctttttgtaccagttattttgactggtgcagcttacggtcgtctggttggcatgttgattgggtcgcaatcaactttggatcatggtctttttgctgttcttggttctgctgcccttctaggtggatcaatgagaatgacagtctcagtttgtgttgtcatcctagaactgacaaataatctgctgatgcttcctctggttatgctggtccttatcatatcaaagacagtggcagatgcttttaatgcaaatgtctatgatctgcttgttaaattgaagggttttccttttcttgaagggcatgctgaaccgtacatgcgacaactgtcagttactgatgttgtaactggccctctgcagacattcagtggcatagagaagattggccgtatt

SEQ ID NO: 1636 - DNA, 535 bp, Hordeum vulgare
  UNSURE (2): n stands for any base
gnagcacatacattgtcatgtgatttgtgatagcagaaaatgctattgccgctatcatacaactagcttatccgtatatggttggtaaactacaacccgatggttcccatacaatgtgtcgatggtcgcttagttaattctctgaatcattagttactactatggcaattgtcaaaagaagttggaaaaggctgtcttgccaaatcgcaccttcttccatctgctcttgaacaggtacggatggagacccaatacgtgctcaggcatgaagtcgtgccgtgttaatatgccaacaacaggcgccctcttggaagtttttggaagaaccaaaaggtgtcttaatccaacttcacgaaagagtataagagctttagccaaggacatagtctcaaccacagtgtaaggggatgtgtttgtgaaaggatgcaagtctacaaacatttccagttcttctgcagtcaattcaatgtcctcaattctgtcatgctttcctgaaccacgtttagcaaaatcatcaggtgagaaatgctttgaa

SEQ ID NO: 1637 - DNA, 518 bp, Hordeum vulgare
gtcagacttgaggaaaagtcgccagcaggttgcttatgctgggaaagctggtgatgcaagatatcccaatccatcttactggggaaagatgtgttttatgtccactcctgatggtgaaaattgtggacttgtgaaaaatttagctgttactgctattgttagctctagagtggcacaaccattgattgacagatttgtttcttgtggaatgaataaactggatgaaattcctgctaaggagattcccaaaatggacaagatcttcctgaatggtgattgggtaggatcctgtgctgacccagcttcatttgtcatgcgtttaaggtgcatgagacgtggtggtctgattgatccacaggttgaaatcaaaagggacaagcatcaatctcctggagaagtacgggtgttttctgatgcagggcgattactcagacctcttcttgtggttgagaacctaaataaaattacaaaacggaagggctgtccatactctttttaggcactaatgcagcaagaaa

SEQ ID NO: 1638 - DNA, 528 bp, Hordeum vulgare
  UNSURE (25): n stands for any base
aaggatatatcctgcactgcaggangcagcttcgctccataggaacaaacccgtccaagctacgcaaacgccatcctcacaaggagtttacatagctacctactacatgtccatgaccatgaccacagttaaacttaccacgtgtccataaccataaccatagatggataaactatatacacgccagaccagcccatgctgaagacctaagtctagcagacctccgtctggaacttgaggcagatgcccatgctgaagagctcctggtagagcagcttggcgccgtaggggacggcgatcttgacaatcttctccgaggaccggcagaacccgcagtaggggccccggatcttccgaccgccagagacgggccgcatgatcacgttcgccgcacgctcacacgtctggcagatgcgcatctccgagaagtcgctcagcgtgaagagccgctcgtggaggttggcggccgcgccgtgggccaacaggcagtcgcgctccatctccccaaacttgaccccgccgaacctc

SEQ ID NO: 1639 - DNA, 533 bp, Hordeum vulgare
ggcaattcggcacgagaattcggcacgaggcctcgtgccgaattcggcacgaggcagccacacaggtgcctcgagcaacgagaccgtcagaccgacattggcaatggcatcctcaggcgcgttcatggtagcggcggtgctcgggctggtgctcatctcggcgccggcggcgcgggcgtggagcgccgaggggcacatgctcacctgccagatcgcgcaggatttgctggagcctgcggcggcgcaggcggtgaagaaccttctgccggaggaggcgggcggggacctgtcggcgatgtgcgtgtggccggaccaggtgaggcactggtacaagtaccggtggaccagcccgctgcacttcatcgacacccccgacaaggcctgcaccttcgactacgccagggactgccatgaccccagcggcgccaaggacatgtgcgtcgccggcgccgtcgccaacttcacctcgcagctcatgcactacaagcaaggcagcgccgaccgcaagtataacctgacggaagccctgctat

SEQ ID NO: 1640 - DNA, 552 bp, Hordeum vulgare
gacagtgaatttgtggtagtactacatccaaacaatgtctgcatctttggacatgtatgcaggtgcctagctcttcacaccgcatccaattattcagtgatcatctgtctacatctttggacaagtaatcatttccatacaagttagcagtagtttccatgcaaagtgatgaaacggctgtcacataacgctgtgctagagctcatcatcatgagcgacggccaagttcaccggcgcggcgacgtcgcggctgctgtgcgctttgtggtctccgaaggcccggttgaggaacatggccagcctcactcccccctgcgcgatccgccgcgtcacgatcgggagcctggaagcgaaatattcctcggacagtgtgtctccgtcgtggacgccgtcgtagccccacttgcaggccaaccctatgctctccgttgcatacttggtcgggcaggacatgaggtccgcgcaatctttccacgatgactcgtcggaccacgatcctttggtgatgttgtgctggaggtccttgcggaaggcggccatgtccttgccgta

SEQ ID NO: 1641 - DNA, 547 bp, Hordeum vulgare
gtcccccggctgcagattggtgcgattcgggtcgaggaaaagaaatggcagatccgttataagatcgaccgtcgagtatgaagttgatgccgagcatgcaaagaatgcctcccttgtcagtacagaggcattggctgctgttgctgaggccatcaccaagcacatcaaggagcagaagagcccaaagcaagccaaggagtaaaattcataagaacgcgtgcatgtacctgaatatcatacatgagcattgacattgtccgaaagccgaagtgtccacctgaagtgaccaagtttgaagccgcagagtaaaatttagaagaagcccagcgtccaactccaactgaagtgactgccgtacattttcttttcttttttgtgctcatgcctttggaattaatgtttgtatgccttggatcatagtttctactcactagtcatcaacccgtgcatctgcacggcctaactaatatcgggatattctcagaagtacattaccttgtaaaatataagatgttagatttgatatatcatacaattggaaagcttt

SEQ ID NO: 1642 - DNA, 531 bp, Hordeum vulgare
gtatgatatataaatctaactcttatattttacaaggtaatgtacttctgagaatatcccgatattagttaggccgtgcagatgcacgggttgatgactagtgagtagaaactatgatccaaggcatacaaacattaattccaaaggcatgagcacaaaaaagaaaagaaaatgtacggcagtcacttcagttggagttggacgctgggcttcttctaaattttactctgcggcttcaaacttggtcacttcaggtggacacttcggctttcggacaatgtcaatgctcatgtatgatattcaggtacatgcacgcgttcttatgaattttactccttggcttgctttgggctcttctgctccttgatgtgcttggtgatggcctcagcaacagcagccaatgcctctgtactgacaagggaggcattctttgcatgctcggcatcaacttcatactcgacggtcgatcttataacggatctgccatcttcttttcctacgacctcgaatcgcaccaaatctgcagcccgg

SEQ ID NO: 1643 - DNA, 253 bp, Hordeum vulgare
aattcgatttcaaagagaggattttggtaaggcatttgatgaacatctcgttactctaaatatcacagaaccattcttcttagttgtccagggatttcttgtaggttcttatggtctgacatgggcactgaagaactcgaacaaacttcttaagatagcaatccttaacagcccacttactgtttcttctccagtgcctggagtctttaagcagctcaggttcccacttcttggtgaatttacctgccaaaat

SEQ ID NO: 1644 - DNA, 553 bp, Hordeum vulgare
gctaggtttacttcaacatatattacacgcaagttgtcctcaaccctttcatttacacactgtgcatctaaactgtacaatattatatatgacgtaactatataccaactgattgaccacatctttgaccctgtatgatgggatggcctccttcagtggactaatacaggaaggaattcagggccgtcaccaccttctctggccagtcctcttgcggcatgtgaccggctccttcgatgggcttcagcttcaccactgatggattgtttttcttgaactcctcagctatcgagagcggtaggtacttgtcggactccccccatgccagcaatattggtttgtcccagctattggatgaaaatccagccgaaattctgcttaatacatcttgaaaattggccttcctggcagtttcaagtaatgcaaatccaggtgcaccacttgatagatacggcaatctgtatacatcggccttctctgacttcagcacgtacgggctacctgcttcaatgaatctctcagccaggatagcattttggcaggtaaattcacc

SEQ ID NO: 1645 - DNA, 407 bp, Hordeum vulgare
agaccgttagaccttttgagtatgctgaggttgtgttgaaagatgaagcagatgtcgaccctaatgatcaggcctctgttcttgaacatttggataaaattgtaagaaatctgattgaaaagagtagtcaaccagcagccagtagatctgaagccaaacttccattagttcgaatcaaggtagattactctgggttttcaacaataaacccacaacgatttggtcagaagtatgtcggcaaggttgcaaacccccaagatattctcattttctcaaaagcagcaaagaagcgtcagactactacaggagagaatatcgacgagtccgagaaacttcgtcctgaggaactaaaccaacaaactattgaagctttggtcggagaaaataacttgaaaatggagattctt

SEQ ID NO: 1646 - DNA, 546 bp, Hordeum vulgare
acgggaccccagttcccatcccttagttagtacacgacagacagcctggaacagagtgtatgtattttcgatgataatagttcccaatggtaaactggcaaactagtactaccagggtttagcagctacaagcatataaattacatggtacacgagaacgtgtaatcgagtttccacttgtcgttcactgcgaacagaccgccagccaggttgatgggagcacaccagctattctaaccccgcccttgattctccaaatcgcttcacaagaacgagaatcatctcctcttgacggctccgtagttcctcgtggcccgaggcggaggtttcttaggcttgtcatcttcgtcgctgtcatcatctttgctcatcaccatgctcggcatggaaccggtgtcggctttcctccctctttttgcggtggtagtgcctctggcccgacctctacctctaggagccggcctcttccgtccactttgtgggaaactgtcctcaggttctgaattttcaacaacttcatttgctccgtcccctgcatcctcatcc

SEQ ID NO: 1647 - DNA, 552 bp, Hordeum vulgare
  UNSURE (12): n stands for any base
gtacccccgggnctgcaggcaattcggcacgagggaaggctcttgctaccatctacgacaaagttctggtggttgacacggtcgaatcagctaggagcgttgttcagttacttaccacaaagtacaagagctttattcatgcatgtgacacagaggtgtcaaatattgatgttaaacaagagacaccagttggccatggagatgtcacatgctttagcatctattctgccagttctgatgctgaagctgattttggaaatggtaaaacatgtatttgggtggatgtactggatggtggaagggatgtcctcatggagtttgttcccttttttgaagattcagcgatccggaaggtatggcacaactatagtttcgataaacatgtaattgagaactatggaatcaaagttgctggatttcatgccgatacaatgcatctcgcacgcctttgggactcttcaagaagacttgatggaggatattcactctaaggactcacaaatgacagcagagtcatgagtgcggtcccaaaggaactacaaaagattggaa

SEQ ID NO: 1648 - DNA, 538 bp, Hordeum vulgare
acctgcatttgctccattgtatcggaacaaagttatatcgccatgagcccatgatcgtgtccacatcagggaatatgttatctaacctaatgcattagcacactgcagcaatgcttatacacaaaatgcatgccaatcttaactacaatccctctagctcgattcagagtgcctactaggaagggtgtggagtccagctatccagcctaaatggtagtgtacaatgccttcgctgctaatctcacttttctgctgccatggcaggatgagccttatgcatgccctgtgctattatgcagcagttaacaccagctcaggacggaccaaaattggctggagtatgtgcgcatctggggcgcacctacgccttgttggggagtcggcggagggggtgatgatgctcggagtctacttggccgcaaaccagttctgtgcacatttcgcatcaacagccaggtcgaccgacaggatgttggtgccgtagaagggcttagacatgcactcaaccactattgccttggccacgtcagccgactcg

SEQ ID NO: 1649 - DNA, 544 bp, Hordeum vulgare
  UNSURE (11): n stands for any base
ggcctgcaggnaattcggcacgaggctttagatacctatatcaaacatccatctggtcatggcagcagcaatgctcccaaggctcgttgccgtggcggcgctggtcgcgctgatgtgcgccgtcgctgtggcccaggtacccgctgccggtggagcgccgacgtgcgacattgttgatcagaacgtcgtgaatgcgtgctacaagagcttcggagtaggtatgcaaaatgccatggccgacaggattatttcgggtaatgtcggtaaggttccagttgactgttgtgttgtctttggaggccactcatgcctctgcaagatgaagaagaagtggcaggctcaaggcaaaaaggcccaggataatgtgcaatgcgtcagggagaaggcctgctagtgagtgcgtgctgaaagtctcttcgtccatccaagacctctagttctttggatactatgttggtttcaagtggtcgatgttcacctactccttgtttgcttttatttgcttatgtgtgtcatctgagtctgttctatttttctatgttga

SEQ ID NO: 1650 - DNA, 555 bp, Hordeum vulgare
acaaaatatgatgaaacaaaaaattccacccaaatttattctgattggtacaaactagaaagactcaactgaccgatcaacatagaaaaatagaacagactcagatgacacacataagcaaataaaagcaaacaaggagtaggtgaacatcgaccacttgaaaccaacatagtatccaaagaactagaggtcttggatggacgaagagactttcagcacgcactcactagcaggccttctccctgacgcattgcacattatcctgggcctttttgccttgagcctgccacttcttcttcatcttgcagaggcatgagtggcctccaaagacaacacaacagtcaactggaaccttaccgacattacccgaaataatcctgtcggccatggcattttgcatacctactccgaagctcttgtagcacgcattcacgacgttctgatcaacaatgtcgcacgtcggcgctccaccggcagcgggtacctgggccacagcgacggcgcacatcagcgcgaccagcgccgccacggcaacgagccttgggagcattgctg

SEQ ID NO: 1651 - DNA, 552 bp, Hordeum vulgare
  UNSURE (20): n stands for any base
gtacctccgggcctgcaggnaattcggcacgagggccatatcaaaccgacctttcttccttccccgtcgccaatcgagacgccgattcccttcatcccccgcccgccaacgtccgtgatccatggcggaaaagaaggtcgtgctgaagctggacctgcacgacgacaggcagaagcagagggcgctcaaggccgtctccactctccacggtatcgaccagatcgccgtggacatgaatgaccagaagatgacggtggtcggcaccgtcgaccccgtggacctcgtcggcaggctgcgcagcaagctcttccgcacggcgcagatggtctccgtcggccctgccaaggaggagaagaaggacgccgccaagaaggacgacggcaagaaggagggcgacaagaaggagccggtcccggtgtacacgccgtggtacccgccgccgccgccgtaccacccgcacccgtactaccacaaccacagcgccgaggaggaccccagctcctgcgtcatctgctgatcggcgcgcgccgcagattccctcctcccattgta

SEQ ID NO: 1652 - DNA, 551 bp, Hordeum vulgare
ttgatatctgcactttataaactaagcagatgccacaggaaccaacagccgcatcacgggcgcaaaaatccttacgcggccttatgtatggcgcacgccgtcgatcaccgtagcagggaggcatgatcggccggcaggcagcacagggccagctacggaatgtacaatgggaggagggaatctgcggcgcgcgccgatcagcagatgacgcaggagctggggtcctcctcggcgctgtggttgtggtagtacgggtgcgggtggtacggcggcggcggcgggtaccacggcgtgtacaccgggaccggctccttcttgtcgccctccttcttgccgtcgtccttcttggcggcgtccttcttctcctccttggcagggccgacggagaccatctgcgccgtgcggaagagcttgctgcgcagcctgccgacgaggtccacggggtcgacggtgccgaccaccgtcatcttctggtcattcatgtccacggcgatctggtcgataccgtggagagtggagacggccttgagcgccctctgcttctgcctgtc

SEQ ID NO: 1653 - DNA, 517 bp, Hordeum vulgare
gttcaggtacctgcaggagaaagagtttttgagaagtattacaagcaacacttggcaaaacgccttctatctgggaaaactagttctgatgaagctgagaggaacatgcttgtgaagctgaagactgaatgtggctaccagtttacctcaaagttggaaagcatgttcactgatttgaagacgtctcaggatacgatgcaaagtttctatgccaatcttgctggtgacgttgatggcccaactatatctgtccagatactcaccactggatcctggccaacacaaccatgcgctacctgcaatcttccacctgagatccttgttgtttctgagcagttccgggcacactaccttggcacgcacaatggcaggaggttgacatggcagacaaatatggggaatgcagacattaaggcaacatttggagaccggaagcatgagctaaatgtctcaacttaccagatgtgtgtcctgatgctatttaactcaacagatactctgacctacaaggaaattg

SEQ ID NO: 1654 - DNA, 546 bp, Hordeum vulgare
ttctatattatgtaccaaagatggcagaccagaggtttccaagccaccacgactctgcagaagaactacagccaagatccaagtcaacggtaccgggacgacatggtttttgttcattcgttcatggacagtctaatgtttcgacagcaaaagaaacctaattacgcaagatagcggtagagcttcctatctaccttgtccctctccaggaactcacgctcaatcagggactcgatccttttcttgatcaccaccgggttcggcaggaagcgtgcctggagctgcttcgtaacctctgtgactatgctgttgtggtccaggaccctcctggacttcatgatcctcacgatggcggcctcaatctggggcttccggtcttcctcgaccctgtggcgcgtctcctgcttctctggctctgactccttctgtgcaaccacagtgccaatcttcaccttcaccaacttgctggtaaacttgtcgttgaagtggaaagagtcgctatcagatatatccttgctcatgggctccttccgcagtacgttcttg

SEQ ID NO: 1655 - DNA, 513 bp, Hordeum vulgare
  UNSURE (468),(469): n stands for any base
tgggtttatgcagttactaagtatgagcctgtggctaccatagcaaatgcagtatatggtgtatgggccaaataccgtatggaagttacaggtcgactctcccctggaggaaatctttgcagcccgaagacaagcgggcgaatgtaaagatgataaagcatgcaagatgtgagcagtgctctgcacgtcttcacttctacatactgttagataggcacacatacatatacagttagtcttatatttgaagggttgcgagattgacgacagagacaatgatgttttctgtgctgggtagcgaataattccataatcttgcacggattctatgggcaagatacacaagtttaagaagttgattccggggtgctgtcttcagttctgcattgagctcgcctgttgtagcatatccttcagtgttcaccttctctgttctactatatatgaccagacttgttcttttctgcnnaaaaaaaaaaaaaaaaaaaaaaaaaaaaaaaaaaaaaaaaaaaa

SEQ ID NO: 1656 - DNA, 454 bp, Hordeum vulgare
  UNSURE (9): n stands for any base
aggtctggntctatatagtagaacagagaaggtgaacactgaaggatatgctacaacaggcgagctcaatgcagaactgaagacagcaccccggaatcaacttcttaaacttgtgtatcttgcccatagaatccgtgcaagattatggaattattcgctacccagcacagaaaacatcattgtctctgtcgtcaatctcgcaacccttcaaatataagactaactgtatatgtatgtgtgcctatctaacagtatgtagaagtgaagacgtgcagagcactgctcacatcttgcatgctttatcatctttacattcgcccgcttgtcttcgggctgcaaagatttcctccaggggaggtcgacctgtaacttccatacggtatttggcccatacaccatatactgcatttgctatggtagccacaggctcatacttagtaactgcataaaccca

SEQ ID NO: 1657 - DNA, 191 bp, Hordeum vulgare
gcttggccgttccgatcccctctcctctcgtcccccgactccgcgccgccggcgagggtttggctcgcgcccggccacccccacggccgccgccgctcctcctctccccaagcagcgcttaccctcggcgacgggcgcgcgagtgccgagccccctgccgccgccagatccgccgtcttcgagctcagcga

SEQ ID NO: 1658 - DNA, 370 bp, Hordeum vulgare
tttttttttttttttttgcgttcaccaatatgaaattcagattacctcaacattcagcaatgaactggaatctactactagcagtaatcctataaaatttagcgagcatcgccatcaaccaaggtcgcctaacctatacagagtcagaattgtggccaagcttacggatgcacacctccacactgccatcctcgatgcccggcaggtccttcgggaccagcaggaagaccttctccttctctcccagcccgtgacgcagcgatgtgttccgtgccgtcgactgcatctgcacccagggccgtctgccactgtttcctgccggcgtcttcagctcatacacgaactcctgctcccgagcgttctcagggcg

SEQ ID NO: 1659 - DNA, 515 bp, Hordeum vulgare
gggttgccgtagcccacaatccgtcgccagagcccagagagagacagagttcactccacacgtcgccagagccctcctgccttgtcctgttgctgaattcccttcggctcgccgggaaaggcaattcaccgccgttgaagcaccgtccgtccccggtcgctcgccgccatgaagaaggtcgtggtgaagctggacgtgcacgacgacaggcacaaggccaaggcgctcaaggccgtctccggcctccacggcatcgaccagctgggcgtggacatgaaggaccagaagatgaccgtcgtgggcacggtcgaccccgtcgccgtcgtcggcaagctgcgcaagctcttccccggcgcgcagatggtctccgtcggcccggccaaggaggagaagaaggacgacaagaaggacggcggcggggacaagaaggctggcggagacaagaaggacggcgacaagaaggacggcgacaagaaagacggggacaagaaggacggcgacaagaagcagccgga

SEQ ID NO: 1660 - DNA, 540 bp, Hordeum vulgare
ataaaagttctttctctttatagttcttctacactggtgtgcccactctacaaactgatcagcagatgcatactactggcatcccggcggtcgacatcttcccaaaaataagacaaacagcacctatcgatgcagtgcaactggtaactacacggccgtatacgcaagtgtagcgcccgccgtcgatccttgcggcaggtgggcttatgagtacagcaaccaccaaccgccggcggcagaggaagacaggcaggataggacagcgaccaaatgtacagggagatgggcggcggcggcggcgcgtgccgatcagcagatgacgcacgagttggggtcctcctcggcgctgtggacgacgtagcgcggctgcggcggcatcgggtaccagcagggcgggtacaccggcacgggcggcttcgcctccggctgcttcttgtcgccgtccttcttgtccccgtctttcttgtcgccgtccttcttgtcgccgtccttcttgtctccgccagccttcttgtccccgccgccgtccttcttgtcgtc

SEQ ID NO: 1661 - DNA, 523 bp, Hordeum vulgare
cgccggggcgattccgccttcatctgtgaggctgtactcaggtcattcccaccgctggcaaagagtacgtaattcagatgctgtacgtgtcggcaccaatgcctgctgcggctatgcaggagtgggtgctggatgagtatgcctccaagcacaaggttgccatcgataggctgctccaactcagggtctttgtggaagtacgtgatagaaggaaggaggtgagctacaagatgaataataaattccaggctaacatgcagaaatatttggttagtggcgggtgtttgccaagggaaccactaccattcagcgtcactgccagattgcctacactggtggaattagaaaattatgctcttgagcaatgggagtgcttcttgctgcaattaatcaactcgtctcaagttgagaaagggaccactttcagctcatctatgatgaagacgttccagcgaggtcttctgagttcaagggatggtgaagctgcaaagttaagtgagaatggcttccagtttctgctgat

SEQ ID NO: 1662 - DNA, 525 bp, Hordeum vulgare
  UNSURE (4): n stands for any base
ttgntacagttttgcaaacttgtctggttccaaactgactgacacgtgccaatctcaattgtacgtgacttccatataaaactgaaatggaaaagtggagcacgtacagttcatctgattttggtttgcgtaacagaataatccactaccttctgtgacttacatttagcatggcgcaaactgcagactaaacctatacaatatatgattacgctcgatttatgaccgtcgagtccaaatgatttcaacatctaccagactaccacgctgcctcctgcagacggatcttgtaaagacttgtctggtgtctaggtagattcaggccttcctcacatgaaggagcatgtgggacggacaagttgcttcttctcttctctccagatggtcacttcccttggatcatctttgccggcggaggaactcccgcatttcttggtggaactccccgctcactatcaatcgcatcttcttcgcgtcctcccacagcaagtacccgttatccctcgcgtggtcacagcattgttc

SEQ ID NO: 1663 - DNA, 517 bp, Hordeum vulgare
ggccgcactactagatcgctttgcctaaggaccgaacgctcattatcccttccaaattgccacctttgtcttcagcagttcttgcacaaccacctgcagaggctcctttaatggaggtaccatgggcgccctccctggtggtcctgctggccaccgccgtcttcctggtggccattctccgtcgccaccggcagcaatcgcgcaagtacaacatcccgcctggtcctcggccatggccggtgatcggcaatctcaacctcataggccccctgccacaccgctccatccatgtgctctcgtcgcggtatggcccgctcatgtccctccggtttggttccttccctatcgtcgtcggctcctcccttgaggcggccgagttcttcctgaggacacacgacctggcgttcctcgaccggccccggatggcctgcggcaagtacaccgtgtacaactactccggcatgctgtggtcgcactacggtccctactggcggctgctacgcaagctatggctgac

SEQ ID NO: 1664 - DNA, 545 bp, Hordeum vulgare
  UNSURE (109): n stands for any base
aagcttttattaagtctcatcgtcgttacatcaagatgatacaatcatgccgagatcattccggcttatggacaaccagaatgcatagagccctaaaactatccgcagnctgaccagtaaatcaatactgtacatactctccagcaacatcaaagctaacattcatgacccgaaatagaggtgatccataagcttgggctcagggatagcatggagatgatgcatgcgagacacagatatgccaaacttctcctccatgctcagctcctcagccgccatgccgtcggggagtctccacgcatagccgtgcagcaagtttgccagcaccagctgaaccatcttgagcccaaggccgtgggctgggcacatcctgcgaccagccccaaaaggcagtagttccaggtcgtggcccttgacatccaccttgcttccaaggaaccgctccggctgaaattccgcggccgtctccccccacacggtcgggtcccggccgatagcccagacgttgacgagcacgcgtgtgcccaccgggatttcatagcctg

SEQ ID NO: 1665 - DNA, 543 bp, Hordeum vulgare
ggactgcaggaattcggtcacgaggccacaacaagcaattcagcgttgggggctcctagaggccgaatgtattcatctagaggaagcagtcaagcagctgaaactaatatcgtaaccagcgaggaggatgttttatctgttctaatcgaagagcatgatctatttttgagttcaacacgatcgcgactgacaaaattgcagattctgcatcaaatgtggcaaagaaatgacatcaggggtgttttctcagcgctggcgaagatgtctgatcatgctgtatgtgctgatatggcaagtgttctgatggagaaaagcgaagccatcacactagatttatgtaccagtatcctgcctgtccttgctgaccttctggatagtacaactgacaggcatgtagctgtatcactggaactggtggtgaagcttgtcaggacttttgggcctgtaatacattcaacagtatcagttggtccatcttctgttggtgtagatcttgaagcagaacaaaggcgggagaggtgcaacttatgcttcatagaactg

SEQ ID NO: 1666 - DNA, 541 bp, Hordeum vulgare
gtaacatattgaaaacacttacaaatacgccaccaacattctttgtgtaacatggagtcactgagtggaatcgatcccacttccgggagacacagcacacgacaaatcaaaagataatgtgtcgaaactcttcaacaaaaaatggtgtgtaattgtacatgtatcagatcaacactcactcactcgtcaatcttgtcactgaatcgaccagacatcatacaagcccaacagcacactaccacaccaaaaagcaagctgatacacaagaagagcgggacaggctacagcatttacaggcacgggcaaaggccttctgacttcgaggtcgagaccaaacgaaaaccatctgaagccagccagtgaaacaatcatgacacgaggaacaccgccccgcgctcgtctttggtggcttctctttccaaatggcaaggatgccaatcaataagggttagtgttgtacaaagggcatggatcggtcggtagcaacaaaaggttactaccttgggcgtgaccccagggcttcacggtagcgcgaaaacaa

SEQ ID NO: 1667 - DNA, 476 bp, Hordeum vulgare
gtctattgggccttggatttggctttgtggaagttggctctgtaacacctcagcctcaagagggaaatcccaagcctcgaatattcagattaaaagagcatggtgctgtcatcaatcgctgtgggttcaacagtgaaggaattgtagtagttgctaagcgtcttggggcacaacatggtaagaggaagatggaggaaacttcgagctccagtgatgtaaagcaaggagggaaagcaggtcctggaattttgggagtcaatcttggcaagaataagacaagtgaagatgctggtgctgactacgtgcaaggagttcattctttgtcacagtatgctgattacctggtcataaatgtttcttccccaaatactcctggtcttcgccaattgcaaggtagaaagcagctgagagaacttgtgaagaaggtgcaagatgcacgagatgagatgcagtgggctgaagatggtccaccacca

SEQ ID NO: 1668 - DNA, 553 bp, Hordeum vulgare
  UNSURE (18): n stands for any base
ttaaaattcctccttgtngcaactcgctcacaagcaaacaagaaccggatgccatcatccatggatacaccactggcacgtagaccactacgtacttactaaaggctgtatatgattagtaacacatcctcaaaatagtttcgacttggtttcgctcgcttttcgagtagcgtccgagtgagtgagtggggcaaaagcacgctcatgggaaaattctgctagcgtcgtcgaggatatcagttggtgttcaggctttcaagggcttgaagtctgcccccactgcctcctggacagacttgaagccatctctttccaagcattctgcgagctcggcctttattctcgggatgagagctggacctccgtaggcaagtgcagtgtaaagctggacaagcgtggctccagaacgtatcttcttgtatgcgtcctcgccgctagttacaccaccacagcctatcagggtaaccttgccagatgtacggatatacatatccctgagaacttgcgtagataagtcaaacagaggcttcccacttaatccgccggcttcctg

SEQ ID NO: 1669 - DNA, 463 bp, Hordeum vulgare
agaacacagttgcttaatatttacacttcggatgcgcagtctgaatcagagggtggcaacgttgtagctcgaacatacttactccgactgaaaaacgaagaggcggctacaaacctgtcagcggtcatcaaagagaacgcaccgctggactgatactgcatggcctgtattaattactgtctcgaaggtatgcttgtggcaatagtggtaatgtttagaggggctcgataacttgctgcgatgagcgaaaggatgccttgcagagtttttgtccccaagttcacccagatgaatttttgttgtctagtatgtttagctggtcgtgttgtatcacctgttctttatttattgacagtgtgttgtatcacctgttggcaccagtacggtcatgccttgttaatgcgaggcaacgcatcttgtcagtggcccaaactacatagttgaaaaccaaaaaaaaaaaaaa

SEQ ID NO: 1670 - DNA, 453 bp, Hordeum vulgare
  UNSURE (10),(11),(34): n stands for any base
ccttttgtanngtttggggccactctggacaagnaatgctgttgcctcgcattaacaaggcatgaccgtactggtgccaacaggtgatacaacacactgtcaataaataaagaacaggtgatacaacacgaccagctaaacatactagacaacaaaaattcatctgggtgaacttggggacaaaaactctgcaaggcatcctttcgctcatcgcagcaagttatcgagcccctctaaacattaccactattgccacaagcataccttcgagacagtaattaatacaggccatgcagtatcagtccagcggtgcgttctctttgatgaccgctgacaggtttgtagccgcctcttcgtttttcagtcggagtaagtatgttcgagctacaacgttgccaccctctgattcagactgcgcatccgaagtgtgaaatattgaagcaactgtgttct

SEQ ID NO: 1671 - DNA, 544 bp, Hordeum vulgare
ggcctgcaggcaattcggcacgagggggaaagaagactttgcattcgttacatactactgtcctcactgcaatgctctcaacggatcgcggcaacacgaggacggtgaaatggtgcctaactctggcaaggagactcctaccgatcgttcctatagtaacagcgtccaagccggcgccagccttgcggactcaggtgtcagcagtcctgttgggaggagcttgccgaccgttgaagaactgcctgcagaaagtcctgctgcgagtaacctaacagtcgctgaaaagcctcaagcagagagttctgctactgcaaataacataccaccaactgtcgaagctccaccagacaattataccggggagaggggaagcagcgatcagcccgccagctgaactttcttcttctgaaagaaatatgttccccagttcttgtttccgtgctagttgcatcgtaagatggcgtaccagagctttcgacacagattcttgtgcctaccaccacctagcgtatagatgtggattattggtgtgttgtgcttggaa

SEQ ID NO: 1672 - DNA, 555 bp, Hordeum vulgare
acccccagcatataccatattgcctgactgatataatattacaaaaggcgtagaattcaacttcccaaaagagaaagaaagctatacaatggagagatgccggcaaaggggcatatgcatcaccctagcagcaccaagtggaacaatccattccaagcacaacacaccaataatccacatctatacgctaggtggtggtaggcacaagaatctgtgtcgaaagctctggtacgccatcttacgatgcaactagcacggaaacaagaactggggaacatatttctttcagaagaagaaagttcagctggcgggctgatcgctgcttcccctctccccggtataattgtctggtggagcttcgacagttggtggtatgttatttgcagtagcagaactctctgcttgaggcttttcagcgactgttaggttactcgcagcaggactttctgcaggcagttcttcaacggtcggcaagctcctcccaacaggactgctgacacctgagtccgcaaggctggcgccggcttggacgctgttactataggaacgatcggt

SEQ ID NO: 1673 - DNA, 521 bp, Hordeum vulgare
  UNSURE (32): n stands for any base
gtccccggctgagattcgacggggcagtttcngcgctggtactgcccgaacacgttggtgccgtctatgcccagttatgggataaggaacttctcgtcggacgaccggccaccagttggcttcatggagaccgacgacctcaccttcgtagcgacccgtgcccgtgaggtgcacagacttctgacacgtgctgtttggcctcccaaccaacctgatcggtgagactgtcctcaaggtgatccattttgaacaaatgttcctcccgatgagcatggtctccgtcgtcgggggctccgagagggtcaacgtgaaacacatgaagctggtcttacaggcactatttcccatgggcgaccaaggcgggtgtgagggccactgatctgatctgcgggtactatgagaagtacttccatgaagatctgggggaggtgaggaaaaactgggggatcgtgccatgcccggatcccaaagcgagcagcaatgcttagactttaggtcagtgcattctgcatcgaaaacgt

SEQ ID NO: 1674 - DNA, 542 bp, Hordeum vulgare
  UNSURE (514): n stands for any base
atacatataagtggtttgcggccaaattgtaggatctcttaagaagcaacatccaagtaccctatttacttgctaatatatcaccagtaagtacaattcatggtatcacccacgaaagaggaactgccacaagcaacgctgaaaaaccaagatacagacgttttcatgcaaaatgcactgacctaaagtctaagcattgctgctcgttttgggatccgggcatgggacgatcccccagtttttcctcacctcccccagatcttcatggaagtgcttctcatagtacacggacatcagatcagtggccctgacacccgccttggtcgcccatgggaaatagtgctggaagaacagcttcctctgtttctcgttgaacctcgcggagcccccgacgacggagaacatgcacatcgggaggaacatctgctcaaactcgatcaccttgagggcagtctcaccgatcaggttggttgggaggccaaacagcacgtgccagaagtcgtgcacctcacgngcacgggtcgctacgaaggcgaggtcgt

SEQ ID NO: 1675 - DNA, 518 bp, Hordeum vulgare
ttatagtgaggctatcttattaaaggactggccattggcatggagttctgctccaattcttgcgaaacaatcaattattccacctgatttttcttggggagcatttcagcttcggagtcctcctgccttctctacagttctaaagcacttgcagactgttgggagaggcaatggggaggacacactggcacactggccatcttcatcagggataatgacagtagaggatgcctttctcaggatcttgcagtacttggagaaagtatggggaacaatatcgtcttcaggaaaaacagaattgatggaactggcatttataccagttgcaaatggtactcgcttaatagaagcaaaatcactttttgctcgtctgactatcaacatgtcaccttttgcttttgaacttccaagtctgtatcttccatttgttgccattcttagagaaattgggatgcaggaaagccttacaaactcttatgcaaaggagcttcttttagatatccaaaaagcatgtggtt

SEQ ID NO: 1676 - DNA, 553 bp, Hordeum vulgare
gcacgctcgcagctatatttccactacgacctttcggtcagctccagaaattgataagtttctactcaaatactgaagactattacatcgtatcgtatcgtgtcgcgtcgcaccaagtctaaaactaaactagaatgcgctgtgcctctgcctgtgctgtacatggactggactgctagtggggtttatatttacacacgctcgttgagcaaagaatgcgggatctgaagaatgtcgggccggtgcccctccctcggtgtcttcatggcctgaatatcttcatcattttggacacttgggtccggcaaaatgggcatcgcgacaccgagctcgagcacctgttgcacaggacgtggccgcacggtacgatggtcatgttcacctcggagttcaggcagacgcggcatgaccatgccgccttggctatgtcggcttctttcaccgctgactcggctttctcctgctccaccaagagagccacttgagattctttaagctggtcttgcaaggaaagggtagtctgtagcagagtttccttctcagcatccatcct

SEQ ID NO: 1677 - DNA, 515 bp, Hordeum vulgare
atccgtccagcttggttggcttggagctcggcgaaatccggagcgtgcttgggggaggtgagcacagccacagccacagccacagcagccatgaccgccaagaaggtgctcctgctctgcggagactacatggaggactacgaggccatggtcccgttccaggcgctgcaggcgtacggggtgtccgtcgacgccgtctgccccggcaagaaggccggcgacgcctgccgcaccgccgtccaccagcccaccggccaccagacatattcggaatcaaaaggtcataactttgcacttagtgctacatttgatgatgttagcgctgctgcatatgatggattggtaattcctggaggccgtgcaccagaatacctggcgttggatgaaaaagtgcttgccttagttaggaagttctctgacgctaagaagcctatcgcatcagtttgccatggacagctgattctggcagcagctggagtagtcagggaccgtacatgcaccgcgtatcctgctgt

SEQ ID NO: 1678 - DNA, 554 bp, Hordeum vulgare
aatgctttattggcttgctttaaacacaaaaaacgcccaagacggtgattcgggacttgaggtataggtagagagtctccgattcaaggacaacccatccaaggcactgtgaggtgaagttacagtacagtgctaaacggtgtgcggcactagtacatccatcatctatgttgcatctgtgttgtatatcatgtgatgaaaaagcagagctaacagcgagcactcacgcgaaggagaccttgatgccgagcagggccatgagctgggccacgaactccgggtgcgcgggccacgccgcgcccgtcaccaggttgccgtcggtgaagcaacggtggatcgggtccggctccagccacgtccccccgcccagcaccacgttcagcttcaccgccgggtacgccgtgcacctccggccctgaagaaccccagcagcagccaggatctgctgcccgtggcagatcgacgcgaccggctttccgttgtccatgaaccccttggccaggctaaggaccttctcgttcaaggcaaggtactcgggggcacgcccaccgggg

SEQ ID NO: 1679 - DNA, 467 bp, Hordeum vulgare
attggctgtcgattaaaaccagttgtcgggtcaaatctgtttcaagtcttgatggagcagctggctacagagtcttggagaatgatggttcagtggaaacatacgacagtgtcatctttggggtccatgcatccaatgctctcaaattattaggagctgaagcatcacatcacgaacgaagaattctaggtgcctgtcagtatgtccaaagagatatatacctccactgcgatcaaaatttgatgccccgaaaatcatcagcatggagtgcgtggaatttccttgggacaactagtaggggtttttctattacttactggctaaaccaaattcagaaatttgaatcgggcaggcctttcctggtgacactcaatcccccttgtgttccggatcatgtactacttaaatggaatacaagccttcctgttccgtctgtggccgcggcgaaggcttatcttcagcttcat

SEQ ID NO: 1680 - DNA, 540 bp, Hordeum vulgare
  UNSURE (2),(4),(5),(20),(25),(34),(35),(57),(58),(80),(81): n stands for any base
gncnnaaacaaacctagttnccttnacattacannattctcaaaatttcttagttannattgatggataacaaggacacnntcccacgaaaaactaaccattgcatggttaaacaacaagatagatcaccaaaccacctgagtaggattcgggcatgagcgaatcattccaggactgacttattaaaatctcgtacggtactgacaagtaacgattcggccgctgaacggagaaggatatgttgtctccggccatcaaggctggcctagacgacgattgcctggacgagagaaaacaacctggtaatctccaattgctcgtgacttgaaaccagccgcagagaatatgaggtagtactcccatatacggaggaacctttcatcaaagcccagggccaaaacttggtctttgttggccatgaagttgtccctccagtgcatcagagttgtgtagtaattgggcccaatattctcgacatgctctatgcagaaccttgatgacgcggtcatggcagacattatacgggccaaagaaggaagg

SEQ ID NO: 1681 - DNA, 518 bp, Hordeum vulgare
gccgcgctggcggcagccgccgccgcggccgaggtggaggaggggttcaggtaccatccaccgccagcggctgcgctggaagatgggatgctgcaggggcttggggacgatgatgatgtccgtgcgccgctgcctgtgaggcgcgagactctctacggcgacaccccaaccatcattgctcggcctaatgcgacggatgcatttcgtaactttgaagaggaggcaaggcaatctgcttgggattctgaacagaatgccacatccagttctagtgataagctggcatctttatatcgcccaccttttgatttgatgttcaatggaccatttgacaaggcaaagttagaggcctctgttctagataagtggctgttgatcaatttgcagtcaacagaagagttcagctctcacatgcttaatcgagacacttgggcgaatgaagcggtggctcagacaatcaggtcaaacctcattttctggcaggtttatcaagataccagtgaggggaggaaggtatg

SEQ ID NO: 1682 - DNA, 541 bp, Hordeum vulgare
gctccgagaagcgcgctagctaaatagttactcactaggtcggtgccggcaccggacacgactatatataaataatactatgtgcatcaggtcgaaccaagtcctactacagggaggggggtctataaacaaaaacatgaccgacgcgagaaacagcatttttcacacttgggctccaaccctagaccgaccaccggacaaggaagaaaacaaaaaagcggcgacgataagtcaataaatccttgcgaagaaacaacatgcaatgcatgaggcccaccaaagatgagatgggccggcctagtcccacaagaggttgatcatcgagttggccagcccggcctccttgaaggtctgctcgctctcgtactgcagcttgttgatggccgcgcccgggatgggctgcccgaagtggaaggcccgcttctccccgtcctccacctcagaggagcacaacgaccacagcagcttgatgggatccgtgtggaggaaattcctctggatcctccgaccgccgggaagccggactgccaccctgcacaca

SEQ ID NO: 1683 - DNA, 516 bp, Hordeum vulgare
cagagtccatccgtccggcttggttggcttggagctcggcgaaatccggagcgtgcgtgggggaggtgagcacagccacagccacagcagccatgaccgccaagaaggtgctcctgctctgcggagactacatggaggactacgaggccatggtcccgttccagtcgctgcaggcgtacggggtgtccgtcgacgccgtctgccccggcaagaaggccggcgacgcctgccgcaccgccgtccaccagcccaccggccaccagacatattcggaatcaaaaggtcataactttgcacttaatgctacatttgatgatgttagcgctgctgcatatgatggattggtaattcctggaggccgtgcaccagaatacctggcgttggatgaaaaagtgcttgccttagttaggaagttctctgacgctaagaagcctatcgcatcagtttgccatggacagctgattctggcagcagctggagtagtcagggaccgtacatgcacagcgtatcctgctg

SEQ ID NO: 1684 - DNA, 550 bp, Hordeum vulgare
  UNSURE (24): n stands for any base
taatggcttttattggcttgcttnaaacacaaaaaacgcccaagacggtgattcgggacttgaggtacaggtagagagtctcagattcaaggacaacccatccaaggcactgtgaggtgaagttacagtacagtgctcaacggtgtgcggcactagtacatccatcatctatgttgcatctgtgtgttgtatatcatgtgatgaaaaagcagagctaacagcgagcactcacgcgaaggagaccttgatgccgagcagggccatgagctgggccacgaactccgggtgcgcgggccacgccgcgcccgtcaccaggttgccgtcggtgaagcaacggtggatcgggtccggctccagccacgtccccccgcccagcaccacgttcagcttcaccgccgggtacgccgtgcacctccggccctgaagaaccccagcagcagccaggatctgctgcccgtggcagatcgatgcgaccggctttccgttgtccatgaaccccttggccaggctaaggaccttctcgttcaaggcgaggtactcgggggcacgc

SEQ ID NO: 1685 - DNA, 524 bp, Hordeum vulgare
ggcacgaggtctttacggcttgagggtttgcaatatgaagtactgcagtggtgcatttgtcgattggaagcatggtttgccacagacgtggataatatatctttgaaaaattgggatcaggaacatgttcttactggtggacatgggcttatggtgaatggctatgaccctgttatcaaagctctctctcgagatcttgatgtccaccttaaccacagggttaccaaaatcatccagcggtataataaagtcattgtatgcgtggaagacgggacaagctttgttgcagatgctgctataataactgtccctctcggtgtactcaaggcaaacatcatcaagtttgaacctgagctcccagactggaaactatctgcaatctctgatcttggcgttggtctcgagaacaagatagcccttcggttcaacacaatattctggcccaatgtagaggtactgggcagggttgcccaaacatcaaatgcatgcggctactttcttaaccttcacaaagccacaggaca

SEQ ID NO: 1686 - DNA, 547 bp, Hordeum vulgare
tgatacagaccatagtgatgaaatagagggaaagtccgcatgttattcagagatacatcatagatcagacactgggaaattgtacagtttcagaggtaaattacagctacgatgttaacagaacacgtgtcgaatagtagacaggcttgttcttccttcctttcacagcctggatatctggagggggaccatgacttcagtcatctcctccctcatcacaatcttcccgacctggaacaggtcagagataccgagctgcgtcgagaggcgccttcggcagtcctctgcagcgtcgatacctgacgaatacgccccgtgcacagacccagagtggtctatgcaggcggcctccccggcgaagaacatgttgcccaccggagcgcagaatctttcgtacaagtcagctggttttccgaccaagtcacacgagtaggagccgagggagttggggtcagttccccaccgtgaaaccagatactggacctgcaaatgtgtgacattagcggttagaacctgcaagcaactgcgaagaatatgaaatttacag

SEQ ID NO: 1687 - DNA, 1616 bp, Hordeum vulgare
  UNSURE (839),(949),(1009),(1209),(1291),(1321),(1567),(1573),(1605),(1607): n stands for any base
tatataatagtgtatatatataaagaaaagaagaaagaaagagtgtttcgcgggtgctgagagccatttcttttacgtaggggagaaagtagcgggtatagtccatgaatgtgcatgggggaccgccaccaaggaagggatgcatgaacgcagcccaagtccagagcgcgtacagcctggcctacgagcgatcgacagcacgacatacataacagagaagaaccactgtaccagcgtgtgtgtgtagcgagtaatctgagtatatgtctcctgttatgtaaatgaacctagtatgagtagaatataattcagagattgaaggaagactctcagagaaattgaatgatgaggtgaatgtgttgcaagcaatccagcttggctgaatacaaatttttttatatacgggtcatcgtatagcgaagtgagaggtttggaagatgaacggaagatgtagttagagttaggacaataggtgaggagtggagtgacgggaggtagcgtggttggaggagagagtagttcgcgtttaagtgagatagaagagtggatagtataagagagtagttgaagagatagcgagtaggtgtgatgagttagggtagagatagaggtagatgaatggtagaagggaggcgagatctatagaggtatgatgttagtgcagattagtattcagagtctaggaggtggtactgcagacgggtagtagcagtgataaggcatataagagagccatatagtattatgagtattaagaaaacaatttaatagatagtaatagctgcgagagggaaaagagatgaggcggatagttgctatgtcagttacatgcatatcgnatatgtccagttggtgagcaggaggaatgggagacagaatggtgagaagtgaaggaatagagatagcacatataattaagcgagaagttgaatgttataggcagctagcnctctctatttatatggatcgcgcttgactcttgtgagtaagagagagaagaacaggtggntataaagaggagttgaggtggggagtggagatctcggagagatatcgtgtatagagtcatttttgcataagctacgtatagagagtgagtgcgatgagtgggcacgtagcaataggatgagcgaaagagtaagatatagatgatctgtatacaatatgagttagtaagcaggtggagagagttagcgcaacatatagacnacgtagatagaatgagagacgacgagtaaaaaataatgtatgagaagtgacgataagtgtatagttagtaaggttatagttntataagagacacagagcgagagagtgaatngtcatagactatgtagagattgcagaactaatatagatagtctgcaggaggagaacagaggtggaggccagaacgttggtgatagtacgaagcaggtagtgcaggtagagagttaagtcgagacagtatgagctccagatgctgcaccgtatggcgctaagattatagtcgtcacgatactagtcatgtgtgtcacaagatgaatcatatgtgctgcactgtggtagacgtagaggtcacactagnggtgtncataggtttaacagtagagaggaggagctagntngtgtgatag

SEQ ID NO: 1688 - DNA, 549 bp, Hordeum vulgare
tccaattagccttttttttcttccgaatatttttaagatagtaccagtacaaatgggagcgagctatgtacaatgaatacatgtagtagtagggatatataaagcgagcagtactgctagaatcgtactaagcaacaattcttctacacaaaagcaatgtctggtttaaattttgaacaaaggtttgttggtgtgcaggagggagaaaagctccacacagccgcatccttctattccaccttagacaccgctttccctcgacgacttcatgccgtgtttcgcatcgccagggtgcgcttcaaagccttcacgctcagcgggctgttcttggtcgctgagcaagtcccagccctgatgttgcagacggggtagtccggtgggcagcagctggaatgatccttgcagcaggtggcaccttccgctgggcagcagccccacaccaggcaaaggttcctgaagccgaacgagcagcagcaggtgctgcctgcagggcatgagaagttctcgtcgcagacgtggtcaggggcgactggaggaggcggcgtcggc

SEQ ID NO: 1689 - DNA, 518 bp, Hordeum vulgare
ctacttcgaggcgtcggcgctgcgggagcacggccgcctctgcccggaccacgtcccggaggtctaccacttcgaccgcgccatgtcgctcatcgggatgcgctacatcaagccgccccacatcatcctccgcaagggcctcatcgccggcgtccactacccgctcctcgcccaccacatggccgactacatggccaacaccctcttcttcacctccctcctctacaactccaccacccaccacaagaaacaagttgctcgctactgcgagaacgtggagatgtgcaggctcacggagcaggtcgtgttctcggacccatacatggtctccaaatacaatcgctggaactcgccgttcctcgacaaggacgccgaagcagttcgggaggatgatgggctcaagttggaaattgctgaactgaagtcgatgtttattgagagagcccaggctctgattcatggggatctccatactggttccatcatggtgaccccagattccactcaagtgatcgatc

SEQ ID NO: 1690 - DNA, 552 bp, Hordeum vulgare
  UNSURE (32): n stands for any base
gaaaacctaccacatagggttttattggtggncaaccaggcctgtatctactgataattgtacaacgttcagatacattgtacattctgttattcaacacacatctatgatgcaaggccgcctgccttacactagaaatacacacaggatgttctcgacccaagtataggaatcgctgcagcccacataagccacatggacccaaggatgtttcacaatgaacaacacatctccatacttgagcgtgggtgctcaatcctgataacaaccaaaggaaggtctcctcaaccggaaaccccgaacaggcgggctggttttctcagtcatgagttactgatcggacgtgcgcaatcacttgctcgatgctctcgaactggcgtcggcccttcaggattgccttggcacaatcaagcgcgcggcgctcacatgatgctctcttgctggcatcctcaattgagtcaaaatcctccacatgggcaattccaacaattctcctgatcattttggccgaaccaaatccaagactatcatgaagtaaatctgtcatgtact

SEQ ID NO: 1691 - DNA, 518 bp, Hordeum vulgare
gacgaaatcgccgaaccctaatccccctcccgaatcgacgaaatcgccgaaccctaatcccccaccgccgcctaggtcttcctctctccccatggcgcccaagcatcttcctccggagtccctcccccaccgcaaccccgccggcggcttccacccgatcacggtccatgtccgagtcaacagggacggcacgtacctccccaggcatcttcccgtcacgggcgggccgttccgagacttcagggatctcgaagacgccgtccgcgcgcgctacgtctccatctacctctcctggcatcgccggagcaagcaccgggatctgccccccccttcaaccgataggatgttccacttcctgttcgtggtggcggatgggaagcaggcttcacctccttcgttgcaggaacctgctgcaggtgtctcgtccctcaaggagtcgctgagcgctacgacattggaggagaactctgggcagccggatcaggacactgttatggcaccgacaccatcgcctcccg

SEQ ID NO: 1692 - DNA, 532 bp, Hordeum vulgare
atatcagccaacttaaaaagatatcgagcacacagagtattatgtactctttatggagggagtagctaatataaagcacaagaccacaggggcgctaacaataggcgctaggaaggaaatcctgctcaatttgctagcgtggccttcagtctcggcacttaacttttcgtcaatacctaatgatgcgccggacgctccatcagaatcacacgcccaagcacacccgttggaaacacggacttattatttgctttatctcttgctcttgggtctaactttttgtgctgggtccagctctctggctctcatacacaaagctcctctccgctgccctccggcacaaattcatttggaggcacagtggagacttccttcatctcaggatcacaagcgcccgtgaacacaactctgagctctttcttctttgcttccacatcgtcataatcccagtagctccactctgaatagcatccaaatggcataccaacatccaagtgaccaccaacgtattcatcagcgctgttggggtgct

SEQ ID NO: 1693 - DNA, 518 bp, Hordeum vulgare
agttgctcttgcaaaggaccaaggaagaagatccatctctcaaattgattcgttctaggtgcaactcgagccagcaaatcatgcaacccatggagggggttctggttgctttggcatcctacggcgccaacatgctcgccgagatggccaaagataaggtggcaatgctgaccagggtctccggcgagatcgacgaacttggagccaagctcatggacctcaagaacttccttgctgacgctaataggaggaacatcaacgacgagaacatgcgggagtgggtggaggaactgaagcgtgccatgtgcaacgacgtcactgacatcctcggccagttttggctcaaggtctcggagtaggatccatccaagggtaacctcatttgcacgaggaatccctttcacgcatcacaaaattattggaagtgaacctcatttgcacgaggaacccatttcttgttggaaataaccaccgacatgtgtggtctgtgtccggttcgtacacaggacaatcatcgt

SEQ ID NO: 1694 - DNA, 550 bp, Hordeum vulgare
tgtcaagccttgcatttttattgcttttgatcttttgatctcacgatctcacggttacagcttacctatatataatagtcaggacattagataagataacctacacggctacgaatcttaatcctaccactatacgatgattgtcctgtgtacgaaccggacacagaccacacatgtcggtggttatttccaacaagaaatgggttcctcgtgcaaatgaggttcacttccaataattttgtgatgcgtgaaagggattcctcgtgcaaatgaggttacccttggatggatcctactccgagaccttgagccaaaactggccgaggatgtcagtgacgtcgttgcacatggcacgcttcagttcctccacccactcccgcatgttctcgtcgttgatgttcctcctattagcgtcagcaaggaagttcttgaggtccatgagcttggctccaagttcgtcgatctcgccggagaccctggtcagcattgccaccttatctttggccatctcggcgagcatgttggcgccgtaggatgccaaagcaaccag

SEQ ID NO: 1695 - DNA, 452 bp, Hordeum vulgare
agacggtaccagtgggagggcgagagggcagagagcagagcatagcgagggggagagcagagagcagagcataggcgttgagcaggatgagggtggcggtggtcggcggcggggtgagcgggctggcggcggcgcacgagctgctcggcgccagcggcggaggcgacgtgcgtgtcaccctgtacgagcaggaggagagcctcggagggcatgccaggacggtggccgtcgacgacgacgacggcgccggcggctgcgtcaacctcgacctcggcttcacgagcttcaaccaggtaacatattcccacatgatggaatggttagtagggctcggggtggagatggagagaacagacatgtctttatcagtgagtacacaatcagacggtgctggaggagggtgtgagtgggggaaatagcaacggtatctctagcctcttggcacaaaaggc

SEQ ID NO: 1696 - DNA, 371 bp, Hordeum vulgare
tttttttttttttttcgaagggttgtagctgatctttattaagaaagggaaagcagataaaaagtgacaaaggcgagcaggttacatgtcatcagggccgttgcgtacacacatacaaggtctattgatagataacaatacaacaccacgaaaaactagatatcacatgattaaaacagggacgaaagcctttttcgataaacaagaaggtagatcaccaaaccatatggtttattcgctaggcggcctatatgaattatcgaaaagtaacagttcgacagctgaacggaggataagttggctttagcctttagccaaaggctggtctagacgacggttgcctgggcgagagaaaacaacctggtaatctc

SEQ ID NO: 1697 - DNA, 517 bp, Hordeum vulgare
ctttacggtctgcaacgatgtcccgtccccctcttgcagctgcatgaagggctactccatccggtcgcctcaagactgggagcttggtgatcgatcggctggatgcgcgagaaatactccactctactgcaacagcaacagcaacagcagcagagccggcggtgagacagataagttctaccctatggcttctgtccaacttcctactgatgcccagaacgttgggacggccaccactgcggatgaatgctcacttgcgtgcctggggaactgctcctgcaccgcgtattcctatgatcaaggtgcctgctccgtttggcacgacaacctgctcaatattcgggaacaaggtaacagtgttcttcaccttcgcctcgctgcaaaagaagtgcaaagtagtaaaacgagtagaaggggactcatcattggcgttgctgttggtgcaagcactgccgctttggtttttatatttctgctgatgatttggatgagaaaaaagcagcactatggtgatgat

SEQ ID NO: 1698 - DNA, 553 bp, Hordeum vulgare
gaatcttaaggttagcatcgtagtttgttggggagaccaaattacaagagtagcacaaagggaaaagcaacaacacgcccaactaccatgtaaagagggtggccaaactagcaactacattatcttcggatttgggtgtccggcaatggcttgaagtaacctcggcaccggaggtgtctcaacttcagacagacactcgagaaattgcaccacctcggtcatcgtgggtcgatcaagctcatcatcttgaatacaccagcatgccactttgcaaactctttcaacctcctccagattcacatcgcccagcaatttcgcgtccaccagacttgcaacgtctccatcgacaagactgcgtgcaactcgcaccggaaaatacccttcatgaacgccattctgggaggatgcttgcttgctggatttccggctgcccgatacgatctctaacagaaccatcccatagctgtaaacatcgacttttgatgtgatggcagttccgctgatccattcaggagcaaggtacccaatggttcccctcatcgtggtaacaacc

SEQ ID NO: 1699 - DNA, 518 bp, Hordeum vulgare
aattttcgttggaaacctccccgccgccgccgtcctccgcgagggcagtggcacaagtcttgatgccgtcgcagccgccattcgagtgctggaggatgaccccatcacaaacgctggccgaggttcaagtttgaccgagagtggtcaggtcgaatgcgatgcgagtatcatggatggaactacaggttcctacggagctgtcggagctgtgcaaggtgtaaagaatcccatccaagttgcattgcacttggcaaaggaacaaatgtcaggttcttcactgcttggtcggataccccccatgtttttggtcggtgagggagcatgccaatgggcaaaatgtaaaggaatcgacataatcgaagccacatcggaggataataactggttagtgacagagaatgcaaaagcacagtgggtaaaatacagtgcgttgcttgctagtgccaagcaatcggttaatagctccactgcttccggttcagaatctagttcaatacagttggacccatcaggagctc

SEQ ID NO: 1700 - DNA, 545 bp, Hordeum vulgare
ataccatcattattacctgttaacaaatccacgccatacagagaatctgttcgccccttaacaacacaaaaaagtttccccaaaaagaacaacaacagagtcgacgagcacacgaaccaccatcgagctcttcctccttcagggaagatcaaccacacaagcggctgatcgttgtcatccttcgctcgacggtgcgccgaaattcacacgggtagcgaaatgctggatggagccggaaggtgctcttgaatccctgagcatcgaaacctttggactgctcatattgctcccgaaatacccgatgccgaacgatggggaggagtaggcagcaacaagctcggcagcttcgagtacagtcgattctcctctctttgtaacgtcagactggacgagcaacagcccagcaccggtgtcgtgagacatctcgctgctgctctgcaccaccgagcgcagaactttggtgcaggaggaggcagggccagactgtgacaatgatgctgagatacaacattcacgggaagcaaatcctctaattaagtgttcgc

SEQ ID NO: 1701 - DNA, 542 bp, Hordeum vulgare
  UNSURE (4): n stands for any base
gggnctgcaggcaattcgtcacgaggttcttgatgggagagttcggagggaacgactacaccttcatcttggccgccgggaaaaccttggaccaggtcgcgtcatacgtgccagaagtcgtacaagccatctcagcaggcgttgagaagttaatcaaggaaggaggcaggtacgtggtggtgccggggcagctgccaatggggtgccttcccatcgtcctgaccttgtacgccagcccgaacaagaagcactacgacccccggaccgggtgcctgacaaaatacaacgccctcacgcgctaccacaacagactgctgtccaaggccatctatcggctccggatcaagtaccccgcgaccaacatcatctacggcgactactacacgccggtgatggagtttctcaggacaccaacaagattcgggtttagtgcttcgtcgaggctccgcgtgtgctgcggcgccggcgggccgtacaactacaacttgacggcggcgtgcggctttcccggggcgagcgcgtgcgctaaccccgccacacgt

SEQ ID NO: 1702 - DNA, 550 bp, Hordeum vulgare
gacaaactaaaattgagctatatctacggtaaaatagtgtggcaaaggaagggaaacagcggccacgaattcaggatttacatataccatgctgctttaatttataccgccatgggccgcgaatatgccaatgcaacagaattattacattaagcacactttagctagtaagtgtggagtttattgaaagagtagcatgcaatgcatggagaatgaaggttgctgccgcaggacagagcttgaagaaacctgcgccgtccgttgcaactagctattactcatgagctagcgtagccgaaggtgttcatttctaagattgaaggtgtcttgagatccagagatcgtggcatggccttgagaataggcggttgcgcgtaagggccccagagccaaccggcggcgatgtacatgtatgcagtctccgtcatgtggatgccgtcccagttgatacgtgtggcggggttagcgcacgcgctcgccccgggaaagccgcacgccgccgtcaagttgtagttgtacggcccgccggcgccgcagcacacgcggagcc

SEQ ID NO: 1703 - DNA, 547 bp, Hordeum vulgare
gtcccccggctgcaggaattcgcacggggcgattggcgtgcccagcttcagcccgaggcgcgcagcagggtcgtcaataagataatggtatctctgcagaagcatctgccagtatcagggccagagggaccgaacgaacttgaaaaaatcgctgtgcgattcgaagagaagatctataatgcagcgaccagccagtctgattatttgcggaagatttctctgaaaatgctatctatggagacgaagacataacaggctcctggaaatgctcaggtgattccaaatcaaaacaacccctgtcaagatgcataacccaatgatttttgtgatactgagttcgctagcaagtatgatgactaggtgtcgtctcaattggctgttcgtgtggggatggcgcctctccatgttcgagcgtgatggatgtttccgctgccaaacaaggaagttgtgcttgtaggcacgatcgaggtgccatgtaataagttagacatataacattgtgtacgactgttgtttaatgtatggaatttctgtattgaccatgctt

SEQ ID NO: 1704 - DNA, 538 bp, Hordeum vulgare
ccttcactttctgctttgaattgttaatatccattacattcagctttcatatccagtagtcttactagccccaggatcattcaaagctaggaagcatggtcaatacagaaattccatacattaaacaacagtcgtacacaatgttatatgtctaacttattacatggcacctcgatcgtgcctacaagcacaacttccttgtttggcagcggaaacatccatcacgctcgaacatggagaggcgccatccccacacgaacagccaattgagacgacacctagtcatcatacttgctagcgaactcagtatcacaaaaatcattgggttatgcatcttgacaggggttgttttgatttggaatcacctgagcatttccaggagcctgttatgtcttcgtctccatagatagcattttcagagaaatcttccgcaaataatcagactggctggtcgctgcattatagatcttctcttcgaatcgcacagcgattttttcaagttcgttcggtccctctggccctgatactggcagatgct

SEQ ID NO: 1705 - DNA, 475 bp, Hordeum vulgare
gcagatgatggtggagaccgggctcgccaactacgacgacctcttccggatcaagggcgccgccgcgcagtccgacgtcttctgcgtcatgtcggggctctggaggtcccccgccgagcgcttcttcctctggatcggcggcttccggccgtccgaggtcctcaagatcttgagcccgcagctgcatccgaggacggaggcgcagtcggtggcggtgtacgggctgcagctgacgtcggcgcaggcggaggacgcgctgtcgcaggggatgcagaagctgcagcagacgctggccgagtccctgaccgacccattcgccgcccccgacgcctacatggtcggtgccgtggagaagctcaagggcctcgtcggcttcgtgcagcaggcggaccacctccggctggagacgctgcagaacatgcacaggatcctgacgacgcggcaggcggccaagggcttgctcgtgctgggggac

SEQ ID NO: 1706 - DNA, 519 bp, Hordeum vulgare
tacatgatatataccggataccagcgctacaattcctccctgtgtaatttcttatagcaatttcatcgctacaccatccaccatcatcacaccaaaatatgaagtatttacacatcctcgacctgcccatctgattaattaccctggtttactctgtcatcatctggaaaatacgcaagctagcgagcacgtacgtacgcgcgcgcttacatgcggcgcggctctgaatgcctacatcgatcgtctccggttctcccttcaacccagcgagatggatgatctcttcgtcctccgctggccagcggatggattactacgtacgtacgtactaccttcttctgcgccatcatcgacctttctctgcttccgccattgctaagtgagtaggaagtagagtttagcttatggccgactcgcgcgggcgggccgcccagagcgtgctgagcgcgcggaggcgctggaagtagtcccccagcacgagcaagcccttggccgcctgccgcgtcgtcaggatcctgt

SEQ ID NO: 1707 - DNA, 510 bp, Hordeum vulgare
tctttgccgccgccgcctccgcagccgcagccacgccgcctccgccgactacgattccgcagaattgactctgtctgcctcaggaacaagatcaaaatttggggcggagggaatttaattaaatgaaggagcggcagttggtgaatttggtgcagaggtatggcagaggcggattgtatacggtgagtcgcatgaaggcggaggagcaactcttctacggatccacggcggaagcacaagcagcagcaacactagcggcatccaggatggagaggatctcgcggttgcctccgcccaggctcagattcgagtcataccgctcaaaatacaagaggctcgatttccttcccttctatggaggaggaggcagaggccgcgatagcaagatgctctgcgtggactctgccggaagcgccatcctctgcaacgcggacggccgctctctccagccggttcccaaccttaacgaacccaagggagtcagccccgccttcttctccatccccagga

SEQ ID NO: 1708 - DNA, 544 bp, Hordeum vulgare
  UNSURE (60): n stands for any base
ggtatctgctatagatgctcttagtaagaggtgatttgatccatatacattccacgttanttcctccaacaaacacaaagatgcaactattctattccatgtaaatcctcgctaatcagacatgagaatataaccattgcatcccactattacagttcattcacctgataacagagacccagttgtaatgaaaacgaccactcggcactctttcaagaaatggcaataagttatttgctaccgctggtatctcagaggacacactcgatgccatcatagctgacaaaggacttgtgcttgatcatctggagttgggatgatccttcctgcaccgcctccataccagaagctccgcaggtcatctccaccccagtgcacacagccacgacgccactgctgatctcttgtgtttcttggtcgccgatgtcaaagattttggttatgcaaaacttgcccgctcccaggtacagcaggctgctccttatctgcacccagccctcaggggggtcaaggtctggccagtcactaagcaccttgggaaccc

SEQ ID NO: 1709 - DNA, 546 bp, Hordeum vulgare
  UNSURE (16),(34),(51): n stands for any base
gtcccccggctgcagnattcggcaccaggctcgntgagttcggcatggggnagcaccaccgagggctctgggtttcaggtgaccacaaacccttgggacgattcgcgcgtgcctgggggatcctcaggtggttctgcttctgcggtttctgctagacagtgtgtggtgtccttagggagtgacacaggtggaagtgtgaggcaaccggcatcgttttgtggtgtggtagggttaaagccaacttatggccgggtatctcgttttggcctcatggcttatgcttcatcactggatgttgtgggatgctttggatcatcagtttttgacactgcaaccatattgtctgtcattgctggccatgacaaaatggattcaaccagcagctctcatgatgttccagactatagatcagacttggcatctctaagtttactagaatcaaaaccattaaataatgtgagaattgggattatccaagaaactcttggagagggtgtggatgctggagtcatatcatcaatcagggctgctgcttcgcatctggaa

SEQ ID NO: 1710 - DNA, 526 bp, Hordeum vulgare
  UNSURE (11): n stands for any base
gtgaaccaggnttacaaaaaattaccatcgacgtgggccgataccgaatgtgggcgacgcagctgttggcttgcaggaattgcacatgtgcacatgccgtctcagactctgtccccaaccactcccacaatgggaaatctcacgcattgcgtacaaccagtttcctcgccatacaacgacgaaataatatatctcaaaactttaggaatgaatgaaaagaggggcctctaaaacccacgcagccctaggaaccgcttgaacgagacacgaagaaaggcgctagttatctgccgccagtggtggaacgaagctgagatcctgcagcgtttgttcgaagatgtggcctactctcagcaaattcccctcactgaagggagatccgatcatctgaagtccgactgggagacccgcagacccaccttcgacgaatccacaaggcacaaccaatgcaggaagcccagccatgttaacattcaccgtcatgatgtctccggcgtacatagctaatggatcatttgtcttttca

SEQ ID NO: 1711 - DNA, 516 bp, Hordeum vulgare
gccctggacaacgacgccgtcttcaaggagatgatcaaggccgcacccctcccgatgagcccgctcgagtccctcgcctcctcggcggtgcggaccgccaacaaggccagggccactctgattgtcgtcctgacccgtggcggcaccacggccaagctggttgccaagtaccggcccagggttccgatcctttcggtggtcgtcccggtgctgacgactgactcgttcgactggaccattagctccgagggccctgccaggcacagcctgatctacagaggcctgatcccgctccttgccgaaggctccgccaaggccacagactcagagtcgacggaggagatcctccaggctgcgctcaagtcggctgtgaagaagcagctctgcaaggctggagacgccgtcgtcgtcctgcaccgcattggcgtcgcctccgtcatcaagatctgcaccgtccagtgatgtccgccgggcatggtgacccgagcaccccggtccttgctgccgtggcgaaac

SEQ ID NO: 1712 - DNA, 537 bp, Hordeum vulgare
ccaaaaccttattattgacgacatgtatcgacagacatcactaccaaacgagtacttcagagttcagaatacaacaagcagcagcagcagctaattagagaaaaaattgtgcaggcatgacacctgccacacaccatactacagggggcataccaacggtaataaaagagctctatataacggagtcctctccctcctaatttaccagctcggatcggatctatgcaacaaactgcaacggacggtacgatatcaacttgtttccacaagacccaggtttcgccacggcagcaaggaccggggtgctcgggtcaccatgcccggcggacatcactggacggtgcagatcttgatgacggaggcgacgccaatgcggtgcaggacgacgacggcgtctccagccttgcagagctgcttcttcacagccgacttgagcgcagcctggaggatctcctccgtcgactctgagtctgtggccttggcggagccttcggcaaggagcgggatcaggcctctgtagatcaagctgtgcctggc

SEQ ID NO: 1713 - DNA, 159 bp, Hordeum vulgare
gtggggcggatgctggaccttgcccgctcgacacctccacggctcggcgacggaggcggcgtgtacgacgtgagcctggtcatgcggctcgtcagggtgttcgtgagctccgtcgaggaggctggctcgccgtcgtcgtcgcagaggatgaggaaggcg

SEQ ID NO: 1714 - DNA, 552 bp, Hordeum vulgare
ttagcaattaacacggcacaaggcaaatatatcaacgcagcaaaacaactttacaaaaggatcaagaggaagaaaagggtcaaactgcatgacagcctcaccccacaaaacaaaaatcatgcccccattttttcccattatgaaagctactagcacatccaaggcaagcccctcccagccaaggccttgttgcccttggccgcagcccggggcgacaacttcatttgtcctctcatctctttgcacaccatctccagttccgccacacggccctgcatccgtcgtaggttcagcctcaggacctccttctccttctcgtcatccggcacgacccgcttcggtgtgggcgatgacaaggggttcttgagtgcatcgggtggccgctgcaaggacaatgcttgcacggcgatcctcggcgggatcagtctgttcctcgccaggtccttgcacgcctcgagggtcagcttctcgtagttgaggcatcggcatagtgtcgcgcgctcctcgacggtcagctcggcatgagactcgaggtagatgtccagtgctctg

SEQ ID NO: 1715 - DNA, 502 bp, Hordeum vulgare
tgaccgtcttttcgactgccttccgagtacgcttcggccatcagccgagtctcggtctgaaggtgggaaacacccgccgggtggcgcgcaatccgataaccatgaaaccgcggaggctgccgtatacagccctcctgcacttattgagcccaagtttgttcctttgcttgcgaaattggcacaacagctggtccaagctggatgccaacagcaatgtgcagaaatatacagcgaagctcgtgcttcagctttggagtcgagtttgaagaacttgggtgttgagaaactgagtaaagatgaagtgcagaaaatgccttgggagattttggagtctaaaataggaaattggattcatttcatgcgaattgctgtgaaacttcttttcgctggggaacgccagctctgtgaccaagtttttgaatgtagccaatctttgagagataagtgtttttctgcaataaccaagaacagtttggctactctactcagctttggcgaggca

SEQ ID NO: 1716 - DNA, 526 bp, Hordeum vulgare
  UNSURE (20): n stands for any base
ctatgcagagaactacaatngccgaacagggaaacaccgacgaactacgtcgacgctgaactgctgcagaccgccagtaccgaatatgctataacaagaatttcagcattccaatccccccaaaagaacaaaaagaatctcagcacaccgaaaccacctactactatgataagcaaggcaagacatacagctagaccttacgctctgtacaaaagaccatgcaccgaggggcaagggccgatgcagttcgactcagtcacatggacaaactaggggtccaatttacaggaacaccgtcgcaccctcacagagcacggcacgcagcgaggccggctatcaagaacgttcttgtttcccctcgaataggttgcccaggaacagctcgagctgctcaggcgtgtgcttgacgtacttcccaggcgctttgctgttctcgatgagaggcccgaagcgcttttggaaagatctgtatgcgggtaacagaatttctgcaactgccagtctcagtgactctcgcaactctgaa

SEQ ID NO: 1717 - DNA, 552 bp, Hordeum vulgare
gtcctcccgggcctgcagggaattcggcacgaggaaaaaaggcacacatccacctttccatccctcgctgccccgccgtcgtccgtcgccggcggtagccgcctccacccgccatccgccgccccaatcgggccatgcctcgccgctctatatatgatatgcgtcgcccccatccatcgccctgatgtcgtctctcttcccggtggcgcccagtcgccgacctctgctgatgtcgtttctcttcccggtggcgcccagccgccgacctctgctgatgtcgtctctcttcccggtggtgcccagccgtccctctctcctctccaaacatcctgggcgaaaggaggcccatcgcatcagttgtggtcgtgggctgtgggcaagatggtgccatggtccaggctgtcgaagaggagctatggaggcacgacgtcaaaagccatggaaggaacccgagctggggacggcagcgaaggtgcgcttcaggagatgcggaccgtggtgggcctgcctacccctccatcagtcactttttgcggaattttgtctgtgcgg

SEQ ID NO: 1718 - DNA, 552 bp, Hordeum vulgare
ttctaaagcgtgaattgaaatggggaagataatacatcacattcgatcccgcacagacaaaattccgcaaaaagtgactgatggaggggtaggcaggcccaccacggtccgcatctcctgaagcgcaccttcgctgccgtccccagctcgggttccttccatggcttttgacgtcgtgcctccatagctcctcttcgacagcctggaccatggcaccatcttgcccacagcccacgaccacaactgatgcgatgggcctcctttcgcccaggatgtttggagaggagagagggacggctgggcaccaccgggaagagagacgacatcagcagaggtcggcggctgggcgccaccgggaagagaaacgacatcagcagaggtcggcgactgggcgccaccgggaagagagacgacatcagggcgatggatgggggcgacgcatatcatatatagagcggcgaggcatggcccgattggggcggcggatggcgggtggaggcggctaccgccggcgacggacgacggcggggcagcgagggatggaaaggtgga

SEQ ID NO: 1719 - DNA, 517 bp, Hordeum vulgare
gcaatattggaagctatgggaatggctgcggtaaaggcaatagctgctataactgccatcattgctggaggtcgtttgtttcttcggccaatttacaggcaaattgctgaaaatcggaatgctgagatattttcagcaaatactctccttgttatatttgggacaagtcttcttactgctcgggctggcttatcgatggcactgggagcatttttggctggtttgttgttagcagaaacagagttctccttacaggttgagtcggatattgctccttaccgtggccttctattaggtctattctttatgacggttggaatgtccattgatccaaagctgtttctttcaaacttcccagcaatctctttgatactaggtctcttaattatcggaaagacactgttagtaacatttattggtagagtatttggaatttccaccatatctgctgtccgggttggacttttgcttgcacctggtggggagtttgcttttgttgccttcggagaagctgtta

SEQ ID NO: 1720 - DNA, 533 bp, Hordeum vulgare
  UNSURE (8): n stands for any base
gaactttnataagagtggagtagaacagcacacgcaaaatggcggacactttctgcaaaattctcagtgtcctgcgtgcaaccctgacagccaaatcttccaccgtctacttgacgggaagtaaaggggctggaaacagaaaagaagaagccatggtttggaagagaaaagaaacaaatgtcctaccataccaaaatggaagagctgaaatgttgccaaagatcggtaacagtgtttgctcggattattagctttgctacctttctatgcgcgaacacatctactgtacagtcctgggaggagccttttacgtttgtgtattgggctcagattgccagggctccatcaatggggtcgctctcgtcgtcggagaccagaggcttcgtttttgacatgactcgagagaagccatagcccagggagctcccacttgtagaacaaagctccgtgagttctgacaaatgacgattcctgaactcgttgatcgttgttgcaatctcagacattggaagttttgcttgagcaagaacagc

SEQ ID NO: 1721 - DNA, 518 bp, Hordeum vulgare
ggtctgcagcagcaggagcctcggggaaacattggaagaagcttgtgcagatgtggagatagtctcaccttttgctcagttggatattccgctaattggccaatagagttacattattttccgagcaagaatgaagacccccagtttctcacctggatccgaatcgctagaatgtgcactttttgctctggatgatataccgttcgattctctagcattttcttcaatcattgtcactttgagaatgtatattgaagatgtcaaggctggaaacatcaaattccactattgcactataaacaagaggatcggggccggcccttcagatctccgtagcttcgatatcgacaaccatttagccgtgtgagatcgggaaggtttcagacccgttgtggtacataggagattgcttttgttaagtaccagctgtgagacattggcgcagcaatcacattggtaattaatggagctggtcatgggttgcggtagattgtttaagctgctgctggaattgtaaa

SEQ ID NO: 1722 - DNA, 539 bp, Hordeum vulgare
tcttcccctccattgtaactgaaagagtttacagcaacagttggataaaaaaatacagaatttagtttcaaattgccatggcactagcccacaactatttctgtaagcgggcaaaaatcaaaatgaaccattctactgaatcactcaagacatccttggaaaaaggaaaagggctgaaaatggacttcgagaaacagaagcatttacaattccagcagcagcttaaacaatctaccgcaacccatgaccagctccattaattaccaatgtgattgctgcgccaatgtctcacagctggtacttaacaaaagcaatctcctatgtaccacaacgggtctgaaaccttcccgatctcacacggctaaatggttgtcgatatcgaagctacggagatctgaagggccggccccgatcctcttgtttatagtgcaatagtggaatttgatgtttccagccttgacatcttcaatatacattctcaaagtgacaatgattgaagaaaatgctagagaatcgaacggtatatcatccagagcaaa

SEQ ID NO: 1723 - DNA, 511 bp, Hordeum vulgare
gcttcatgaagctctgcagggctccggcgaccacggctcccccgtcatcttcctcaagcacaacgtgattgacgagtacgacgagcagtcggaggtggcggaccggctgcgcatcaaggtggtgccgctcttccatttctacaaggccggggtcttggtcgagtccttcgccaccagggacaaggagaggatcaccgccgccattgccaagtacacatcccctcagcaggagaaggagacggagacggagccggaggagtaatttctactccaaatacatacagacatcaagagccatctagctagactggtaatcgagtggtctgccaaaatgaacctgcattgtagcaggaagaactgggattggttgtaataataaagcagagcatcatgagatatagttgtaaacagagagatcgaggtagaatggccgaggatggatcctgccattcccgatccagcgacccccccgttgtaaacaggcagacctgatcatttcaacacctgagtt

SEQ ID NO: 1724 - DNA, 520 bp, Hordeum vulgare
ggtgtagaacttcaggtgttgaaatgatcaggtctgcctgtttacaacgggggggtcgctggatcgggaatggcaggatccatcctcggccattctacctcgatctctctgtttacaactatatctcatgatgctctgctttattattacaaccaatcccagttcttcctgctacaatgcaggttcattttggcagaccactcgattaccagtctagctagatggctcttgatgtctgtatgtatttggagtagaaattactcctccggctccgtctccgtctccttctcctgctgaggggatgtgtacttggcaatggcggcggtgatcctctccttgtccctggtggcgaaggactcgaccaagaccccggccttgtagaaatggaagagcggcaccaccttgatgcgcagccggtccgccacctccgactgctcgtcgtactcgtcaatcacgttgtgcttgaggaagatgacgggggagccgtggtcgccggagcccttgcagagcttcatgaagc

SEQ ID NO: 1725 - DNA, 881 bp, Hordeum vulgare
  UNSURE (813): n stands for any base
gtcccccgtggctggcaccaattcgcacgaggggcggaggcgcgcagggaacaaggtgcggcctttcttgcctaaaattgccagcggcgggggcgaatccaggggagtggcagggagggaggctaaatcctagctgttcgtctgccggatcgccatcttgcgcgcgagcgagagattctgcctgcgccggacgtgatgcaggccgccggcaccgtggagcaagggccttcccggtctgcggagccacctgtgcgccgccgagtctgttaccactccacgcccgcctgccccagcgagtggcaagggcatgtgctattccgagcatgaacatggggaacggcagctattcgataaagatgagagatacgtagctcgtctaaatcgagctgaagggaaagagggacctgagaactgtaccttctgtgtgggaagtcaacacgtcatattcaggatggtagtacgggcagctttgctaattcacatgatattccacgatggaaagcattcaggaaacgacagggtcacaggtcaacaaaacctcgacacggagtacaccctcaaggaaaagacagagagggcgatgcgaagctctacaactgtttctatgaagcccattatgtgaatcctgataaagttgtttgagaccatctttggtgagcatcaccagggttttacctggctccatgcatcatgtgagggttttcacttcacagattcagcgttagcattccgacagcctggtgaatcacgaatacaaatagttgaaagccagagcgaacacgatagcgacgactacgacaccctggaggcatncggggttagatcacatgcgcacagggtcacccttggattggcccctactggtccactgaccctagatg

SEQ ID NO: 1726 - DNA, 558 bp, Hordeum vulgare
ttccgagcagagtgtcctgtttattctccccatcttcgaaatcaagagatgatatgaaataaccatctggatttcttgttacagcttacaatgacatgttgtagtataatttcgtattgctacatgttacaacacaatctccttccatgacgtcggagcttggctctgttggctggctcaaatctctagtgaaagaaaacgaatgctgaagaaaggaacaaacaacaggtgggtgcagggaagagctctagctccggttcaggagcccccactcccggcaagagatggaacgattttcttgccaaaatcacgcgctcgactctgacatggaggaacggggttatcacgcagtcttcaggacggtacagagcgagttgtatgcattgacgcagagcttgaacttctcctcggctaccgcctgtgaagagcccggatgcttgtcagggtgccacctcagagcagacgcgcggaaggctgttttgacatcatctaaggttagtggaccacgaggtggcaatccaagggtgaccctgtgcgcatgtgagccgacgccggctg

SEQ ID NO: 1727 - DNA, 464 bp, Hordeum vulgare
ctggattgtggtctatcaaaggaggcaactggcagctagctgctggattgctcaagacttcgaacaccactcttcatctccaagaaggcatagagtcaatctctgatgcaggagattactatgttctgaaatcgaataaaggacatgagtacaattgcacggtgacggttgttgcaacacctcttgatgaggtgaacattacgtttgtccctccaatctccattccaccaaggaagatgcagcatacccatacaaccttcgttagaggcctcttggaccctaaattctttggtctgagctcagcgtcagacattccagagctgataggaaccatggagctccctaatatccccttctcgtgcatctcagttcggaagaagcacagcgaacatgacatgacttacaaaattttctcacgtgcgaagctagaggatgctttgctggatcagatcttcagcacaagg

SEQ ID NO: 1728 - DNA, 437 bp, Hordeum vulgare
  UNSURE (30): n stands for any base
aatatcccacttttactttctctatacagnttgggtctaatacacggtagtgttaattgtatgcacaatgctgtgtgttgcacattgctgcagacagtggcaatgtggagaatacatgtctcagcacattatacaactaagctcatgtgttttttcagagtactacacactggatgcacaacagtttctgaaactgtaacattgcatttcattctacactccacattcatccacagctagcctgcaatcgatatcactcagggaaacatgagggaaaaacaggcactggaagaactacagtgatcccaggcatcaaaactaagaagcatcttccacattcactcacaggtccacacgtcgagaaccttcctcctcgcccgcgaacgacttgatacggccttcttccggcggcgacgggagcccagcgcgtagtttga

SEQ ID NO: 1729 - DNA, 550 bp, Hordeum vulgare
gtctccccgggactgcagggaattcggcacgaggcgccgccgaggggatgaagccgttctgcgccatctactcctcgttcctgcagcgagggtacgaccaggtggtgcacgacgtggacctgcagcgcctgccggtgcggttcgccctagacagggcggggctcgtcggcgcggacggcccgacgcactgcggcgcgttcgacgtgacgtacatggcatgcctgccgaacatggtggtcatggcaccagccgacgaggccgagctcatgcacatggtggccaccgccaacgccatcgacgaccggccaagctgtttccggttcccacgcggcaatggcgtgggcgccgtgcttcctcttaacaacagaggcaccccgattgaggtaggcaaggggagggtgctcgtccgaggcaacagggtagcgctggtaggatatggcaccatggtgcaggcctgcctgaaggcggcggaggcgctgaaggagcacgacttgtccatcaccgtcgtggacgcccgcttctgcaagccgctggacacggagctcatccg

SEQ ID NO: 1730 - DNA, 494 bp, Hordeum vulgare
tactacttgtacattacaaggtctgtttaattaacacacgtccattatccgtttgtacaaaaacccaagggaagaccatatggatgcatgcatatgtatgtatctatccaacgaattggcagaaatgacactctcttggaatcatttgacaggactaccgctgtagcacttgacgccattgccgattgtggcatgtactgttgatgcacggggatgtggttagtgagtagggagcggcagcagcagttccgttattttatctgctgatccataggagtattgtggatgtcaatgtgtaacactaacacatggttggttggttggttggttgattgattcacttgaggtgaagcgcctcgagtggccgacccacaagggacagcaccgtggcggcgatgtgcctcggcgtcagcccggccgcctccatctggtcatccgcggcgccgtggtcaatgtaccggtccggcaggaacatcgatctcagcttgaggggg

SEQ ID NO: 1731 - DNA, 517 bp, Hordeum vulgare
tgaatttgaaactgcgctttggtgtctattttcccagacgtcgcatttgaatgagcaaggtgttttgatgggcagatgcaagcaaacaaaatattcacattcatatgggatacagctggaaaatgtcaggttctatgaaggtgtgttggagatggttgaggattttttggttgagctttatgacttggagatggaagatttgacgcaaaccaatgtaggccgtatgacgccaaccaatcaaggccgtttggtgtttgaaacactgtttgtacttttgggtgagtgtcccagatttggccccttagaagataacacctgcagttcgatattggttcgagacaaatcttgggcgaaacccattggagtaggtcgtttgtttgatttggttaagaactggagaaatctgtctcatacaacattctgtttagtgttacttctcttggaggagcagctgactgctaagatgaaggaggataatcctgcctggcaagatgaggataatgctctggctgtgttt

SEQ ID NO: 1732 - DNA, 550 bp, Hordeum vulgare
  UNSURE (28): n stands for any base
tcgttcaagatactacatattgcatgtntcaactacagggcatagattggtcaagatgttcagggaaactacacataacatgttcaacataagagatacaagattccacaacacagattggtcaaggtgtttagaatactacgcataacatgttcaactcacagggcacaaaagtacccacacagattggtcaaggcatttatggcacacaagtacccagacagattggtcaaggcgttcaggttactccatgttcaacacaagagcagggttcaagattaccatgcttaagcacctttatccacagtcgtgacgctgatatcaaggggaccctggtagccagccttcctcacaagaatcccagggacaatcttctcatcaaacctaagaatatgaaggaaatgatctattagctgatccaatgttgtacctccacgcacactcacatcagcagtgacagtcacaaaggggcctaactgatctgcttgggcgaccaatctttctgactcacgcttcatagctggaaactggtctaacgccttgcaactgt

SEQ ID NO: 1733 - DNA, 554 bp, Hordeum vulgare
gtctccccgggtctgcaggcaattcggcacgaggtgcaatccaatcggacaagttcagattactgtgttacttgtccatacatgcgcgagactctctagaagcatcaggagtcatgcatcgccaactgcaagcaaatcttctcaggatgctgcaatttctccttacaaggagcgccgtaagagctgggagtcaatttggggcagtccagtattaagatgtggcggcttctatgacataaccacactgtctcctatgtactttaccccctgcgcccctggtatcatcccatcctccgcctttgccaccaaggccttgcagatctactcgttcgaaatctttgagctagatgacagcttgaagtggccactctgtgtctacggcgtggtcgctgctcgagacactgtggatggtaaccgcaacttgctcttctctcgctccagggctaactgccaagtactcactaaagaggatccttttttgcacttgactggcccttctcgtgctattctgcacgagtaccctgttgacttcgaagttgaactaaggataacag

SEQ ID NO: 1734 - DNA, 542 bp, Hordeum vulgare
  UNSURE (30): n stands for any base
ttatatattacataatgatgaaggtacctntccagcagggcaacagttatatattacataatgatgaaggtaccttcccagcagggcaacagttgtacgagcggagcaaaagaaaacatgtctacttagtttcatgacacgtttaatcacacaacacaacacaacacaacatataggtctacttcaagttagattacacaagacaacaaagttctaagcttgatcaactccgcaaagttgtccaactagccacacagagaggggtaagtgaaggcatacccctctgccatgttgtcaagcttatccctcacaagtaaggaccaagcaatgacaacctgcaccgtagaatcaccaataacacttacctgactgcttatctgacaatgcttggcaccgaattcaagctgagcctggtgagcaaccagatgagattctgtgtaactttttatgatgatcctcagtgagccttttgattccacagtaacaacattccttaccaaaggaaagcaacctcccggattttcactagaatcaaacaacac

SEQ ID NO: 1735 - DNA, 336 bp, Hordeum vulgare
gcagtagtcaccagcagtgtgctgattactacccctcggcggcggcgaggccaccgcccagtcccaccgtcgtctcgtcgagcacagcgagcttgatcgcctcgagatgatcgacccgttgagcctggtgggcttgatcctaacgatggtgcagctgatcgcaaaggaagcggagacggcacggcagaacaagaagaagtgcttggacctggccgaacgcgcacgcactctggccaacgtactgcccagctacggataccctgcggtgaaagacgaggacacggagagagtgctgaggaggctcaaggaggccctcgacgaaaccttgacgctcat

SEQ ID NO: 1736 - DNA, 558 bp, Hordeum vulgare
  UNSURE (31),(33): n stands for any base
ttgtctgcaaataaaaatgatttattacttnanttactgtctgcacaaatggatacagatttgtcatccagaaagataacattactccagatgcaacgaacgagcactagcgaaatccattacacatactgtcaaagaccttgttgatggttggaagtgtgtaaagggaagatagattgtaacccgaggccgagggggctggggaagcatggtagggagacggagccggagtccagtgaacattgacgggtgcgtactgaggcggggggtagccaacacaggcgctgctggaggcacctcctcctgcttgtgcctggtactgattgtaggagccgtggtcataagtttgagctgggactgagctagctgctgctacctgatttgtgcgagcgtttctgatgaaattgaggtccctgatgcagtcgttgatctttccgttaacgccgtctaattcggcggccttccggttacgggagcatatacttacagtctggcaggactggatgagcgtcaaggtttcgtcgagggcctccttgagcctcctcagcactctctccg

SEQ ID NO: 1737 - DNA, 544 bp, Hordeum vulgare
  UNSURE (16): n stands for any base
gtcccccggctgcagnaattcgcaccgggtgcaatgccttgtgcatgataagagatgatttcgagaaagagatgcgttccatggtctgtgcgcaatggtggcagcaaaccccacaggggctgtgagctcactagtccacgtatgccaggcctgtgcaagttggaatgagatcaaaagcgaaggtttgcacaatgaagtgtcccagattttgaatggctacaagcagatgttcggagctgccggctgggaacagtgcatgtccaccctggaaccggcagtggtgcagagattagcgagatacggggtctgatggtgccgacagatcctcgtcacagtttctcgctataccaccaccaccaccaccaacggagctgaacatcagaaaaggagggaagggcatgagattgggcaaagtcgtcggtccgtcaggtgtccagggcgtagcacattgtgtggtttcctatatgatgatgatgcgattgattggttgattctgcctgcctgggttggctggtgttgtatgctgtcctctggttgtatacag

SEQ ID NO: 1738 - DNA, 534 bp, Hordeum vulgare
tttttttattgttgggaacgaatcaatacaaggacgcccttcctattaattaaggattacaaaagcaaaccctagacctaaactctctctctctctttctctctttttctctcacatagaatagaatagaatacatgctacaaaagaactctttgaatgttgctgctggggttgccaatggagcgcgacaccaaaaccccaaaaaagcccccactggaaccagccaatacaaattttgactcgacagacagaccaaacccaagtcctcctataacctacaagacgcacaaccacaccgccttttccgactcgacaaaagcagacgtcctcccgtcgcaattcaattcctcgactcagtcacactacacttttgagcagacctgtatacaaccagaggacagcatacaacaccagccaacccaggcaggcagaatcaaccaatcaatcgcatcatcatcatataggaaaccacacaatgtgctacgccctggacacctgacggaccgacgactttgcccaatctcatgcccttcc

SEQ ID NO: 1739 - DNA, 367 bp, Hordeum vulgare
cagtatagcatctaaaagaaccccaagaaaccacggcatgcaaagccctgttttgccctcctgaatcaaccgcttcctgacatagagcacgagacacgtctgtgcgggactccagtacccgagctaaggtaaactgggcatttgaagcacaaggaaagatctgggcaggatgggattgtaatgcatgaagacccttaagccctcgctgacaggaagatctttcattggcacaaaagggataccatggaaacaaaataaacatttgagcatttaacccttcaaggcagagatggaagcggtttgtagagccatccatccgaggggttccagctggaggcatctggaggcatcagcaagaggctgccgc

SEQ ID NO: 1740 - DNA, 82 bp, Hordeum vulgare
tttttttttttttttttttttttttttgttcttttttttttttttttttttttttttttttttttttttttttttttttttt

SEQ ID NO: 1741 - DNA, 522 bp, Hordeum vulgare
  UNSURE (46): n stands for any base
gcacgaggcacctcttcctcttcctcttcctctccctctccaaagnaaacaagaaaaaaggaagaagaaaaagaagcaagccttggcttttgacttggtgatgggcagtggaattgttcccagcaattaatccccttttttggttctcaaagagagattcattcataccaagaaaggagcaggaaacagttgcttgttgaatctcccctcgcctccttttctttgctcaaaaaatttcccatctttgttcgtgggcgtgggcgtgggcgtggacgtgggtgttgggagaagagacaagagggaagagggcgccatggcgaagaaggagggaccttgcggccattgcggagtcacaagtactcctctttggcgaaacgggccaccagacaagccagttctctgcaatgcgtgtgggtcaagatggaggataaagggtacgttggtgaattacacaccggcgcatcgttgggaagatactgatgctgacaagctgaagcataagggacagaaacagcccaagaa

SEQ ID NO: 1742 - DNA, 491 bp, Hordeum vulgare
  UNSURE (42),(473): n stands for any base
tttcccttctttaccctgcatagtagggattctattccattnccccatacatacaacagatatacaagttacaatttctccagccatatatatatgctataccaaaaaaaatatcaagcccaaacaaattcggcaggtgcgtgtcaggacgatcatcgatgaacggtatggtatgatgatgatccaggaaccaaaatgtaaacagaactaccactgatgcctgttcttaagctgatcgccaacggaaccaggactatggttgcgcggaggagaggctgtggttacggtcacggagctgagctgagatggtggggggccgcagagaagaagctctgcttccgagtgccgcgtgttgcaagggacctccagcagcagcgaatcttggtcagaatccttgtccaagggattcagcatagatgataatttatctggggctaacatgaacaggttgagtgatgctgccactgctccgntggcattgccagatttcg

SEQ ID NO: 1743 - DNA, 517 bp, Hordeum vulgare
ccggtcgcccttgccgcagtacggagacagcggctctgcgagatttcatcatggttcaaccctcacaacacgcatttcgtgttttctcggagtcagaggcacaacaacaacaacaacgaagaggtgccagttagcccaagtaataactctgcagactatagtgtttcggcttgggggccatcacacggggggtcgactgtcgggagtaccggagcttttgttgcaatcgccctagcttttgttatccttgcatggtttgttgctccacatgttggcaagagagcggctgcgatcatccttcacatgcttctgggaggcttatgttcgttgactataataatctcgctgagatttgtgttcccgagaatccagtttgggtcgatgcgatactgggcgatcctgttcatgtcctggttcctcgtgtttggagtgtgggcctcgagaacccgcaccatccgcagcgcttcatgataataatatccgagtgagccctcggtgagccgttgtgaggaactag

SEQ ID NO: 1744 - DNA, 545 bp, Hordeum vulgare
cactatcatttcccatatccacaatgctaacaaccagcattccatctgcatctcaaactgagtagcagagcagaccaccataaaagcccccactaccataaattcttgttttctcggcccaacatatacatctgaaacataatacagctacaaagaacgcacccatgatatagcggcggatatagacaaggacgacaatacctaacgctgccgtggacgctacccttgcgacgcggtcctagttcctcacaacggctcaccgagggctcactcggatattattatcatgaagcgctgcggatggtgcgggttctcgaggcccacactccaaacacgaggaaccaggacatgaacaggatcgcccagtatcgcatcgacccaaactggattctcgggaacacaaatctcagcgagattattatagtcaacgaacataagcctcccagaagcatgtgaaggatgatcgcagccgctctcttgccaacatgtggagcaacaaaccatgcaaggataacaaaagctagggcgattgcaacaaaagctcc

SEQ ID NO: 1745 - DNA, 518 bp, Hordeum vulgare
ggtgtacgatgttacttcgccgagacacgttcacaaatctgtctgacatatgggccaaggaaattgacctgtattcgaccaaccaggactgcataaagatgcttgtaggaaacaaagtggacaaggaaagcgagagggctgtcacgaagaaggaaggcattgattttgcgagggagtacgggtgtttatttctggaatgcagtgcaaagaccaaagtgaatgtggagcagtgctttgaggagctcgtgctgaagatattagacacgccgagcctgctggcggatgcgtcctctggggcgaagaagaacatcttcaagcagaaggcgccggaggctgatgctgcggcgagcggctgctgttgatctaatcctgggcgtctatgtatctatctatctatctatctacgatctatctttgttggttgacgatggatgaaaacggttgttgttggacaaagtgatgatgatacctaggcggcagcagcctgtttgtttctgttgttgttttattttgcgttt

SEQ ID NO: 1746 - DNA, 552 bp, Hordeum vulgare
ttcgaattcaggcccaataaaaacacggcgatgtcaggttcacaagcattcattcattcctaaaaagtactagtaagtttatagagcttgattaataatacgtatccgccgtcttctgttttgtgattctggttaacaaggaggaggtccactcactgactgactcaccaactgattcatatacatcaacacaaacgcaaaataaaacaacaacagaaacaaacaggctgctgccgcctaggtatcatcatcactttgtccaacaacaaccgttttcatccatcgtcaaccaacaaagatagatcgtagatagatagatagatagatacatagacgcccaggattagatcaacagcagccgctcgccgcagcatcagcctccggcgccttctgcttgaagatgttcttcttcgccccagaggacgcatccgccagcaggctcggcgtgtctaatatcttcagcacgagctcctcaaagcactgctccacattcactttggtctttgcactgcattccagaaataaacacccgtactccctcgcaaaatcaat

SEQ ID NO: 1747 - DNA, 518 bp, Hordeum vulgare
cctcgctccccctctcgctctcccgcataggatagggttcctgttgcagccgccgccgcctcgtgtcctccgcgtcgcggttagctccggcgacatggccggagggtaagagcccgtctgccgccgcttcttcaagctcgggcgcgacccctacctcccccggcggccagcaacagctcgtgtcagtccggtcggcgcccctctccggcgatagaatccacgaggaggttaagcgtatgcagttggaactcaaggaattggagtccggtgtcatctccgtggagagggtgcacagaggcctagccaggaagatggaccaagagaaatcccaacccgaacccctgctgaaggatgccatctccgtggagagggagcgcagagacctagccaggaagatgcaccaagagaaatcccaatccgaatccctgctgaaggaggtcatcaccatggagagggagcgcagagacttgcttgcctcacttactcccactgtttctctctggaaagaaatcgattct

SEQ ID NO: 1748 - DNA, 543 bp, Hordeum vulgare
gaaatcatcataggcggaatacaatctgcatggtgctcacatttaacaaaccagaatgcacgattcaccgcatacaatttgtatagccagcatataagcatcacaatcttatatagatagccacctgggcaatcaactaagcaagacctggagatccaccttttccttgacaagcaaggaccaggctacaacaacctgcaccgtggcgtcgccaactgaacatatgctcgtgcttatttggcactgctgaacaggaaagtcgatgtggcccttgcgagcaatccagctacgggacttcccataggcttctatggccactctcagcgttccttgtgattccactgaaaccactttcctcgatagttgaaggtacttctccgatcctctatgcaatcctttaccacggtggtcaagcagcacaactggcctgcaaatggtatcaaggacatctgccgcagaagcaggagcccaaaagcaaataacccggcatccatatttgaaaggccaaccccctttggttacacgtatacccacgatagtagc

SEQ ID NO: 1749 - DNA, 518 bp, Hordeum vulgare
tacaagttgaagcatggcggtgcgaagcacaaaggagtcttttcaaggcttgagtatcaggctaggcagtctatcagtggggcgtcatcatttaagaatcttcttgcaaggttgcctcctcgagttcattcagtctattatcgtgatgagattggtaacatctcctcatcccatctgcgtagcgattcatacaagtcagaactagaaattgaaccaagatttccattgtttggtgggtggcactgcactttcaccattggctatggtatgccactgcaagatttcctgtttgaatcggctgacggtcgacgctttgccaaccttacatttggatcccctctactgaataccgtggttgataatcttaccatcaaggttgtgcttcctgagggatcaaaaagcccgcaagctgttgttccttttgagaccgaccaacatcttgagactagctattcataccttgatgttgtggggaggactacagtggttataaagaagaaaaacgtagtaggagagca

SEQ ID NO: 1750 - DNA, 552 bp, Hordeum vulgare
  UNSURE (65): n stands for any base
gtttgcacatgaaaaagatatataaactgcatgtatactaatccagtattataacatgctcctgntcacattcctacaacaatgcaatcaattatcatgcttgcttcttctacaaaactccccaaagctaatacaacaccatcggttccatcttcatgatattgatatagtttgcgacccctcactatcctgtcgttcatccatatgctactagctattactccttcaagaggcatgtgatttcgcaattgagagatccatgtgaagataggcaatgcacgcagtgaagaagagcagcgctgccgttatcagcatcagcggctccgccagcatgaagatcgggctgaactcatagtatacctggaatggaacattgtgctctcctactacgtttttcttctttataaccactgtagtcctccccacaacatcaaggtatgaatagctagtctcaagatgttggtcggtctcaaaaggaacaacagcttgcgggctttttgatccctcaggaagcacaaccttgatggtaagattatcaaccacggtattcag

SEQ ID NO: 1751 - DNA, 519 bp, Hordeum vulgare
  UNSURE (43): n stands for any base
ggcgacgccgcaggcaccctcccctcccacgccgcccccatgngtcttccccacgaccctacccatcccgccgccgccgcgcagcacggtgccgtcctcctcccccgcctcccctcggctggccggcgaggtcccgggctccgattcgcgaaaaggtacgagctttctgccctccggcggccgccccaatccccggccagtccccccgtattttcggccgcgccgcccagatccgcccccgccagatccgcccctgccagctccccctgtgtttggataggaaaaatgttgcggacaagcaggtgaggtggacagatatcggtgagaagaaacaggagctcgtccccaacattgaaaaggaccatgccaagcaggtgaggatggcggagaacagcagtcggatacaggagctagtacccaacgtaaaaaaggatcgctcatcacatagaagaagcatcgctgagctgcggaggaggacggagatcagcaagcgggtgcggaatctgcaagagcttgtcc

SEQ ID NO: 1752 - DNA, 527 bp, Hordeum vulgare
aaaattcatagcatccatatatacatatagttccatagcatccatacatacatagctccatagcaaatataatacacagcgatactttgcgggcattagtaagtaatatttggcactaaatcaaatgccttcatgtccatatctgctaaaaaatggaacactaattttggcatcatagactacgcagtgcttgctatctgctcaagcgctgtgtgaaaaaaatgctaacattttagatagcagtaaaatgagactcggaagaattcagcactgtgacaaatgtgtggattctttcaatattcagcacgggcaaattcagcacttggttgtgtgtcaagtaaagttcgaatgggtccatgaaacatcgcgaaaagcgaatgagattctttcaatattccttgcaatgcccacaagcgaactaagatcgcagatgcttcatccagcgtcggcttgctttgcgtcggctgttgagcttcatcagccggcgagtggttctgcttgctcggcaagcacgtgcaaatcacctc

SEQ ID NO: 1753 - DNA, 527 bp, Hordeum vulgare
  UNSURE (19),(21),(24): n stands for any base
gcacgagggggcgcctggngnagnaacgccaacccggtgtggcaacagctcttcaccgtctccgccgcccacctgcaatccaaccagctgcaggttatcgtcaagcacaagcacaaggacgtgctccgtgatgactttgtcggtcgtgtcgtctttgatatgtccgacatccccaaccactccccccctaatagtccgcagtggcaccacctttccgatgcccatggcgagaggttcccacaaggccgtagcctcggcaagatcatgctcgccgtttgtcttgccacaaaggtcgacgaggccttcccggaggcgccctccctgtccttgcaggagctcaccgatacacagtccaaggtgtactactcgcccaagctcatctaccttaaggtcgccgtcatcgcggcgcacgacctcgtcggcactaaggaggaccgaccgttggcgaatgccattgccaagatgcaaataggcagccagattaggcggacgcggccgcagggatctgtgaatccaacatggaacga

SEQ ID NO: 1754 - DNA, 563 bp, Hordeum vulgare
  UNSURE (16),(23),(31),(49): n stands for any base
gccttgggtggcgagntgtaagncccaattnctattttattatctcatnctcttcagtacatgtacttgtaacgatatacattcttgcgacacgacgagatgcgcttctatccctgacgaggccttcgtgccaaattaagaatagggtcgcatcatgggcgtgacatcctccgctccaaaattcttgtcttaggattgtctagaaatgaatgtatcaaaatactaaaacgtgactagatacattcatctttacctaataataaagaggctatcacttccgtcggaaaacccaccgaggtgattttacaaaaaaaaaccttactgtttatgacattaaactcgtagtatatattaaatgttttttaaaatactcatatcttttaaaccgtaacttcaaattaaacatattatatatggaatttgattagaaaaatatgtagaatttaaatatgatattattttatctgttaaacgtttaataaaaatactatctagggtgcaatcttaataaataagtcattattcgtctttctttcataccggtactcatccgggttgggaat

SEQ ID NO: 1755 - DNA, 431 bp, Hordeum vulgare
cacgaggtgcttaccaggagttcttgaaatgccttcacatctacagccaggaaattattacgagaagtgaactgaagaacctggttagcgatatactacagcactaccctgatcttatggttggatttaatgaattcttagaacattgtgaaaatatagatggatttctggctggagtctttagtaaaaagcaacctggaaggctaatcaaaacagaggataaagaaagagataaggaccatgagagggaggaaaggaacagagatcgggacaaggaaagagaaaaggaacgggaaagactacatccaaaggaaggccctagccagaaaccctcggttgtcaaagagaagtatctatgcaaaccaatatcagagctggatctctcaaattgtcagcgatgcactccaagttaccggcttctacctaaaaat

SEQ ID NO: 1756 - DNA, 518 bp, Hordeum vulgare
acagcataactagaatcatacattaaaaaaatgactgttgcaatacttgcatttaaccgaccaaggctacatatcttgaacccaaaaactgagtcaatatgacataacaagagacctataccaacatcaacaaatggtgatcatccttctacgaccaaaaagacactacaggtaacatgttaacagaacaaacaacattcttctgacagtacatatttacaaatagacacgcacacacacatcttttttcggcgcggcctaaggctgactgaggtggctctaacatgctttgctttgctgtatttaccaagtatatcatctatccagcggccagctgattattattattcttgtcactgtcgaagcaagagcaaggcggtcgcaaccccagcggcatctcctgatttggatacaatgtctgcaaggcgccaatgttttttttttgcctatggccctcttaaggcttggatagaaacaaatggaagcgctgcacttttgcagcatactttttggaagtc

SEQ ID NO: 1757 - DNA, 463 bp, Hordeum vulgare
  UNSURE (12): n stands for any base
ggtcttccgggnctgcaggaattcggttcgagggagaaggtggcttcatgacgatcatggcgcgttcttcttcgctcgctctcacggtggcggtggtggcaatcatctgctgttccatgccacgctcaacaacggcaatacgagttgttcccgacggatttcatgggtcactgaatccccctccgtcgccgcaaccccattatgcggcgcatgggcaaccctacacgggacggccgtgcaggttccatggccataattactgcgaaagggaaggtcagcaacctccgccggcgacatccccaccaccgatgccgcgccgcaagaccatacaagttgctgcgaattaacttgccttacacttgaatcaccacatattatatgcggcgatgactatcctgcgacatgattatgagctactgtctgtgcctgctggcttcaggttgtacaactttttattttatgt

SEQ ID NO: 1758 - DNA, 471 bp, Hordeum vulgare
aagcgtcttatttattgactggagagagtagagtctggtgacataaaataaaaagttgtacaaacctgaagccagcaggcacagacagtagctcataatcatgtcgcaggatagtcatcgccgcatataatatgtggtgattcaagtgtaaggcaagttaattcgcagcaacttgtatggtcttgcggcgcggcatcggtggtggggatgtcgccggcggaggttgctgaccttccctttcgcagtaattatggccatggaacctgcacggccgtcccgtgtagggttgcccatgcgccgcataatggggttgcggcgacggagggggattcagtgacccatgaaatccgtcgggaacaactcgtattgccgttgttgagcgtggcatggaacagcagatgattgccaccaccgccaccgtgagagcgagcgaagaagaacgcgccatgatcgtcatgaagccaccttctc

SEQ ID NO: 1759 - DNA, 542 bp, Hordeum vulgare
  UNSURE (36): n stands for any base
gtcccccggctgcaggaattcgcaccaggcggcagnaggagctatgggaggggtggcgggcaggaagactcgtatcctcagcgtggcggcagcggttcatatggaagaggctgatgacactgccccggccatcgtcatatcacactggtgttgtagccctttacttacttactactactacagctcatctcacttgctcccgttctgctgcaaataagcgcgacttggcttgttgtcccttggtccgaccctaccctaccctaccctacccacccagcagggcaggggtggctgctgccgtgtaggcttgtgtatcttgatgatgatcgtgtgggtttactttttataggccctcagtactgtgcttgtgctgtgtaaggaggaagagttggcggtagatgatgagcaaccaacccgctgctcctcttaagcgcgcgcgtgtgtgtagcgcgagtctgagatgtagttgtataggccgatctcatacctggtgtctgcagtgttgggcttttacctcatcatcactcattgtgtctgtctgg

SEQ ID NO: 1760 - DNA, 530 bp, Hordeum vulgare
  UNSURE (3),(29),(33): n stands for any base
agnatgtactttttgtaaaacaaaaccgnacanacacaatgagtgatgatgaggtaaaagcccaacactgcagacaccaggtatgagatcggcctatacaactacatctcagactcgcgctacacacacgcgcgcgcttaagaggagcagcgggttggttgctcatcatctaccgccaactcttcctccttacacagcacaagcacagtactgagggcctataaaaagtaaacccacacgatcatcatcaagatacacaagcctacacggcagcagccacccctgccctgctgggtgggtagggtagggtagggtagggtcggaccaagggacaacaagccaagtcgcgcttatttgcagcagaacgggagcaagtgagatgagctgtagtagtagtaagtaagtaaagggctacaacaccagtgtgatatgacgatggccggggcagtgtcatcagcctcttccatatgaaccgctgccgccacgctgaggatacgagtcttcctgcccgccacccctcccatagcctc

SEQ ID NO: 1761 - DNA, 518 bp, Hordeum vulgare
gtacacctttacacactgtgttgagaagatcgtggagaatggagcgatcttcctcttcatcctccatggcaacagccgtggccgtcctggctatcatgttcatatgctgctccctgccatgctcagctgccatccacggtcaaacggagggaaaacaacagggagagaggcctcctccatgctgcggggcgaacagggatcccgctacttatcagagatgctgcgtcgaccgcaagaccctgcagcagcctcttcccaactgaacgccgcctttggtttatgtatgaaatacgcatcatcagcactcctaatgttcttttttatggagcactccaattagtattagtactctttatccgttctaaaatacttgtcgtggtaacacgacaaaaatacttgtcatggtaccacggcaagtattttgaaataaagggagtattacgaaccgcatgcatgcaggagtctcaaaaggtttatcattacaagcaagctactattacaccgtgttagcggtgtgc

SEQ ID NO: 1762 - DNA, 557 bp, Hordeum vulgare
gtacaatatgaatatggtacattagatgaatcttacaactgtttacatagacggagagagccctagaagatatatacgagtggcactcgcacaccgctaacacggtgtaatagtagcttgcttgtaatgataaaccttttgagactcctgcatgcatgcggttcgtaatactccctttatttcaaaatacttgccgtggtaccatgacaagtatttttgtcgtgttaccacgacaagtattttagaacggataaagagtactaatactaattggagtgctccataaaaaagaacattaggagtgctgatgatgcgtatttcatacataaaccaaaggcggcgttcagttgggaagaggctgctgcagggtcttgcggtcgacgcagcatctctgataagtagcgggatccctgttcgccccgcagcatggaggaggcctctctccctgttgttttccctccgtttgaccgtggatggcagctgagcatggcagggagcagcatatgaacatgatagccaggacggccacggctgttgccatggaggatgaagaggaa

SEQ ID NO: 1763 - DNA, 518 bp, Hordeum vulgare
tctcttcttcttcttcctcctcctcctctattgcacaaactatggcaatcctggctattttattactctgctacttcctgccatgctcgacggccacccaagttcatccggatgctaaccgcgagccgggagagggtcctccaccgccgcggcccgggagacccgttaactgccgcaatggctgccggcaccttgacactacgccaccagcggcagtagcgccaaaccgcaagatcatgcggcgggcaggtgccagtgcgcccctaatgtacgaagcaccaccgatgccatgaccaccggaactcgaactcttctttttcttgccgcgccgtgtcgagttctctgttatttcatgatattgcccgtcatcttcggtccacactgtgttaagggtgtttgtgccacattgccactggtatatgagcgagaacctggaaaacaactccgtatgtggttgagtcgttcctagaattatataaaagtgagtcgtgcctgttggcgccgcctctcgcagtgcc

SEQ ID NO: 1764 - DNA, 509 bp, Hordeum vulgare
  UNSURE (2),(133): n stands for any base
gngtggcggcgccacaggcacgactcacttttatataattctaggttcgactcaaccacatacggagttgttttccaggttctcgctcatataccagtggcaatgtggcacaaacacccttaacacagtgtgngaccgaagatgacgggcaatatcatgaaataacagagaactcgacacggcgcggcaagaaaaagaagagttcgagttccggtggtcatggcatcggtggtgcttcgtacattaggggcgcactggcacctgcccgccgcatgatcttgcggtttggcgctactgccgctggtggcgtagtgtcaaggtgccggcagccattgcggcagttaacgggtctcccgggccgcggcggtggaggaccctctcccggctcgcggttagcatccggatgaacttgggtggccgtcgagcatggcaggaagtagcagagtaataaaatagccaggattgccatagtttgtgcaatagaggaggaggaggaagaagaagaagag

SEQ ID NO: 1765 - DNA, 450 bp, Hordeum vulgare
actccactcctcacctcagctttcccctctcgtctctctctctcagcgtgagcgtcagctcgctctagcagcagccatggcggacgcggtggacgctcgccgggtgtgcgggatgccggagaaggcgcagctccacgtggcgatgctggcgctgcagttcggctacgcggggttccacgtggtgtcgcggctggcgctcaacatgggcatcagcaagctggtcttccccgtgtaccgcaacatcatcgcgctcttcctcctcgtccccttcgcctacttcctcgagaagaaggaccggccaaggctcaccctcggcttcgccgtccagttcttcttcctcgcgctctgcggcatcaccgccaaccagggcttctacctcctgggcctcgacaacacgtcgcccaccttcgcttccgccatccagaactccgtgccggccatcaccttcgg

SEQ ID NO: 1766 - DNA, 391 bp, Hordeum vulgare
ttttttttttttttggggagctggccaaatgatattatattataggacagaggcatagttttaaatagcgttatagcctcattatagctttgttatagccttttcagcagcgtgtcgctatagcccaccatagctgatttagagtctcgccgctatttaaaacattggacagaggtagtaattattaattgtgaattataggataatcatactagtagtgcttacggcgtagaggatggtgaagacttcggagccagagtggaagacccacgcgccggcatccctctcgaagaaggcggcgatgatgaggaactggatgacgccgaagaagcaggtgtaggaggtgaccgacagcttcgcggggtacttcttgagcacgggtgcctgcagc

SEQ ID NO: 1767 - DNA, 518 bp, Hordeum vulgare
tggtgatggaaatggagacactgagcatgacggttcctccgccactggccacgctgaacagaccgatgacgagcctgctgcagatgaagcctctcccgtcaacgtcgagaaaggagatgtggcgcaacatggtgttgaaagtagagcttatgaacaagagaatcaagaaaagtttccagcgacagaaacagcggggagtgatagcacctcggtcacatctatggaagatgttgtgcaccccaaaaaaggtgctcagtcagagccaggagatgatagtgggtaccatcctgatctacccaacgacaagcactccactggaaatggaaatgtctatgagaacgcaaagtgcgtattgacgagctcgacgaagaagatgaagagaagcgcgtctgcgactacaaggaagccactgcaagctacaaacagaaacagtccggatgactggaatgcttctactctcaccaactccaaatcatcaaacggaaagactattactgtcccatcaagcccggtcttca

SEQ ID NO: 1768 - DNA, 519 bp, Hordeum vulgare
cagcaagcaaacaagccctctgtttgcatgagtgcgcaatataacttacatcaagaaaccccacaaactgaggaacgaacatcattttgtacagagacagcacatgccactctcacatctgtgataaatatgcaaagtgagatgaaataattagcacacaaaaacccttgtgactgacctcacccatggcaccccgtgcgcataacttattttcatgacataacttaaccaccgtaaacctcgattgaaaccgaagtcactctcataatttaaggagaaaaagccttctcctcctcctcctgtactcgggtttcaccatgatccatgaagccaaaaggatctagcagtgaagcaagtactaccggaggaagaagaagaagcagatgctgcaactagcacacggcgatgttgagcgccgatagcttgtgggcatggttcttggcctgcttcttggacgagcttgctgcaggatgttgctgttgatgctgccgtggcttgctgctactgttgtggcatttg

SEQ ID NO: 1769 - DNA, 543 bp, Hordeum vulgare
  UNSURE (42): n stands for any base
gtcccccggctgcagcaattcgcacgagcctcaggtgtgctngatactacaagcagggtgcacgctttgcgaagtggcggactgttgttagcatcccttgtggtcctactgcattagctgtcaaggaagcggcatggggacttgctcgctatgctgctattgctcaggacaatggtttagtgccaattgtggagccagagatccttcttgacggtgaccatggcatcgagagaactctcgaggtagcagagaaggtgtggtccgaggtgttcttctacctggcccaaaacaatgttctgtttgagggcatcctgctgaagcccagcatggttacccctggtgctgagcacaaggagaaggcttctccagaagccattgcgcagaacaccctcacaatgctgaggaggagagtaccacctgctgtccctggaatcatgttcctttcgggtggacagtccgaactggaggcgaccatgaacctgaatgcgatgaaccagtccgccaacccgtggcacgtgtccttctcctatgcccgggccctac

SEQ ID NO: 1770 - DNA, 555 bp, Hordeum vulgare
caagctgttctatactaactttctagggtatgcatacagtattgtttgttctcataaatataacttcaggcaactctagagtttccgcactgccaatacagctaacagtccttggcaccaacacgctggcgattggttgttattcacaccaataataattaagaaaacaaaaccccgcaaaatgacgtgcatctcatatataaatcatcccgccgccgcctcatcagtaggtgtaacccttctggaacatgcccttcttggcctcgtcgctctcgccctcgccggtgtagctgccaagctgcgccaacgagttggccttggcgcggaccagcagggccttctgcgccgcctcgatgttctcgggctgcccctgccacgtcttcaaaaccgagttctgtagggcccgggcataggagaaggacacgtgccacgggttggcggactggttcatcgcattcaggttcatggtcgcctccagttcggactgtccacccgaaaggaacatgattccagggacagcaggtggtactctcctcctcagcattgtgagggtgt

SEQ ID NO: 1771 - DNA, 533 bp, Hordeum vulgare
gcaattcggcacgagggtggtggtggaggttgtggcggcatggccattgaaggttccagggtggcattgccaagcctagcggctgcggttcaggttgtggtggcagttgtggcggtatggtggttgaaggctccaaaactggccatgccaagtcaggcggatgtggctcaggctgtggcggtggttgcgctggcatgctgatcgaacactccaagactagcttcaccaagtctagtggttgtggctcaggctgcggcagcatgatcatggaaggctccacgactggcttcgccaagtcaggtggttgcggttcaggctgtggcggtggctgcggcagcatggtcattgaaggctccaagagtggcttcaccaagtcaggcggttgcggttcaggctgtggcggcggttgcggtggtggcggttgtgccagcatggtcatggaaggctccaggatgagccatgccaagtctgagggctgcggttcaggctgtggcgccggctgcggtggcggcggctgtggcggcatggtcatg

SEQ ID NO: 1772 - DNA, 259 bp, Hordeum vulgare
aacaaattattatgatttcatatcatcgcttaccacaagtacaaccgcatatattcaccacaacacattgtgcgctgtgagtagaggcatggtaaactgcacaggacagagtgtgtggtttttattcgacttcatctccgactagagcgtgtggcatgccatcgccgacggtcaccacgcgcacaccggccacctcaggcatagttatgcttatgaggctgtgttgagcacgctgccacagccagagccacaacctgaa

SEQ ID NO: 1773 - DNA, 867 bp, Hordeum vulgare
  UNSURE (788),(793),(796),(814),(865): n stands for any base
gtcccccgggctgcaggcaattcggcacgagggaggtcggaaatgatttcagctcgccgtcgcaccaccatggccaccaacaaactcatcacgttcgtggtgttgctggtggtactagaaatggtgcgctccgaagattccccgtgcggcttcccggccatcttcaacttcggcgactcctcctcggacaccggagccttcccggccctcttcccggcggtgcagccgccctacggccagaccttcttcggcatgccggccgggcggcagagcgacggccgcctcgtcatcgacttcatggctcaaaacctggggctacgttacctgaatgcgtacctggattcactagggagcaacttcacgcagggagccaatttcgcgagcgccgccggaaccatcagacgggtgaacgggagcctgtggacctccgggtacagccccatttccctggacgtgcagctctggcaattccagcagttcatcaacaggagccgcttcgtctacaacaacataggcggagtctaccgggagatcctgccgaaccccgagcacctggtctccaaggcgctttacaccttcaaaatcggcgccaacgacctcgccatgggctacctagacaacatgaccacggagcaagtggaagcctacgtccccgatctgatggagaggcttcgagtcggcgatccagacggtgtacaacctcggcggggaggtacttctgggtgcacaacacgggggacgtttcgggtgccttccctacgggcctggtctaccgaccgggaccttgncgganagnaaggatgacgccggctgnttcattggggctcaacgccggcccccggttctttaaggcccggtcaagggngg

SEQ ID NO: 1774 - DNA, 553 bp, Hordeum vulgare
ggagcaacagcccaagacttgtcttgagctagctaccaatgtctggaccaacattgacagataacataaacaagagcaacttaacataaccagcagctactataacttatcacaatgtaacctactatcaaaaatactctcaccataacgctaatgtgctcgggaaaacagacaccatcttgggcacgagctggttgagctgcccggcgaaaaacccaagaggatcctcctcctccctcccaatgcacaccgattacactcacacgaggccggtccatcacaccagcattacttaagagatagtaaaaccttaaacctctcccaattcagacgcagaaatcgacggtttgcaggaaatcatccatgcctcggccaaagtcgcagccgggcatctccaggaagtcgtcaccgatgtcgaggtccatgtccagctccagctcctcgtcggccaagtcgccgagcagcaggtcctgttcgccgtccaagtaagccgacgcctccgagacgtccaaggcatcaagccccgcgcggaagtccatcgggtcaatgtccg

SEQ ID NO: 1775 - DNA, 522 bp, Hordeum vulgare
  UNSURE (2),(6): n stands for any base
gnccgnaggcccgtggtgatcttctcctacttcagccccattgcacagcgagggacggcgagcttcgccgccgcggtcaaggaagccggcgtaaaaggtcttatagtacctgatcttccttacgccgagataagtgctttcagggatgaagccatcaataacgatctagagctggtgctacttacaacaccatctacatcggcggagaggatgaaggagatcactgaagcttcaggaggcttcatttaccttgtaagtgtcgacggagttacaggtgcccgtgcaaccgtgaacccacgcgttgagagtcttcttaaggagattaagcaggtcactgacaaggcagtggctgttggctttggaatttcgacccctgaccatgttaagcagattgcagagtggggtgcagatggagtgatcatcggcagtgcaatggtgaagcagttaggtgaagctgcttctccagaagaagggttgcaaaggttggaagtctatgccaggagcttgaaggatgcactgcca

SEQ ID NO: 1776 - DNA, 533 bp, Hordeum vulgare
acgtagatttgtttttaagagaactgaattagtggcacatgtttgcttcagttggatataaatgtgaaaatctactaaatggggtaattaagccaccaacgtgatccaagggggtaaaaatggagttcactcattcatatatcatggcagtgcatccttcaagctcctggcatagacttccaacctttgcaacccttcttctggagaagcagcttcacctaactgcttcaccattgcactgccgatgatcactccatctgcaccccactctgcaatctgcttaacatggtcaggggtcgaaattccaaagccaacagccactgccttgtcagtgacctgcttaatctccttaagaagactctcaacgcgtgggttcacggttgcacgggcacctgtaactccgtcgacacttacaaggtaaatgaagcctcctgaagcttcagtgatctccttcatcctctccgccgatgtagatggtgttgtaagtagcaccagctctagatcgttattgatggcttcatccctgaaagcac

SEQ ID NO: 1777 - DNA, 525 bp, Hordeum vulgare
cttagctagtagctagctagtaaccagccatgaagatgatgaagagatgcgttgttcctagcatgctgctgatgctttccctcgagtccgccctcctcgtcgccgccggccgcccctccacggccagcattctcctgccgagccaaggcaaaggccaagcaggaatgctgcccgtgcccgtgcccgtggtagcagcgaagaagaaggggggagacgaagagaggccgtggaaatgctgcgacttcggtgtgtgctaccgtgcgcttccgcgggcgtgccgctgccttgacgaggtcgagcagtgtgctccgacctgcaagagctgccagccggcaccgtccgatccatcccgtcatgtctgcaacgaccggtacaccggcgatatagggcccacgtgcacggagactgttgccgccgccatactcaactatggagcccaaggtactggtcaagacgcccaggtgattgtggccggcggtaactagccagcttgcgcgttgatcaggcacctgatcaacgcagtgc

SEQ ID NO: 1778 - DNA, 560 bp, Hordeum vulgare
  UNSURE (449): n stands for any base
agaaacctacatttacctttattaaaacattgtcacgtacactccattttcacggagctagtagacacgcaagaagacttgtcttattcatgactgcctgagcttccatttttattttattgtttacatgcacacactgcaggctgctgcagcgactcaagctcaggctgcactgcgttgatcaggtgcctgatcaacgcgcaagctggctagttaccgccggccacaatcacctgggcgtcttgaccagtaccttgggctccatagttgagtatggcggcggcaacagtctccgtgcacgtgggccctatatcgccggtgtaccggtcgttgcagacatgacgggatggatcggacggtgccggctggcagctcttgcaggtcggagcacactgctcgacctcgtcaaggcagcggcacgcccgcggaagcgcacggtagcacacacncgaagtcgcagcatttccacggcctctcttcgtctccccccttcttcttcgctgctaccacgggcacgggcacgggcagcattcctgcttggcctttgccttggctcggca

SEQ ID NO: 1779 - DNA, 542 bp, Hordeum vulgare
  UNSURE (3): n stands for any base
ggnctgcagggaattcggcacgagggcaagctcagtatggggacgatgaagcgatgcatggttcctggcatcctgctgatgcttgcgctgcaggcagccatgctggtcgccggcgacgaggtgggctccattctcctgccgagccagggccaaggcgaagcagctgccatggcggcgggcaagaagaggccgtggaagtgctgcgaccaggcggtgtgcaccaggtccatcccgccgatctgcacctgcatggaccaggtcttcgagtgccccaaaacctgcaagtcctgcgggccgtccatgggcgacccgtcccgccggatctgccaggatcagtacgtcggcgacccagggcccatctgccggccgtgggagtgctgcgacaaggctatctgcaccaggtccaacccgccgacgtgccgctgcgtcgacgaggtcaaaaagtgtgctccgacgtgcaagacctgcctgccgtccaggtcgcgcccttcccgtcgcgtctgcatcgacagctactttgggcccgtcccgcccctatgcac

SEQ ID NO: 1780 - DNA, 548 bp, Hordeum vulgare
tacattgcctgatgtcttactataattggcagtaggaggccggccatccattttattttattcttacacgctgctggtgctgcagcagggcaggaggacactcgacggccgggcgttgatcgggtgaccaacgcgcgtgcatgcggtacctagttaccgctggcggcaacgtcctcccggggcgtgcataggggcgggacgggcccaaagtagctgtcgatgcagacgcgacgggaagggcgcgacctggacggcaggcaggtcttgcacgtcggagcacactttttgacctcgtcgacgcagcggcacgtcggcgggttggacctggtgcagatagccttgtcgcagcactcccacggccggcagatgggccctgggtcgccgacgtactgatcctggcagatccggcgggacgggtcgcccatggacggcccgcaggacttgcaggttttggggcactcgaagacctggtccatgcaggtgcagatcggcgggatggacctggtgcacaccgcctggtcgcagcacttccacggcctcttcttgcc

SEQ ID NO: 1781 - DNA, 440 bp, Hordeum vulgare
agagctttccaataaacaaccatggcgagacgagctgcagccatcctgatgctgatgctctcgctcccggcggcgtccctcctggtcgccgccgatgccgtgggcgtcgacacgatccgcctccccagcgacgccggcgaaggtctcgcaacgagcaagggacgcgaggaggagacactccgactccccgaccacgttctggcaccgccgagggaggagaacgacgtcagcggcgtcctcggcgaggaggagaggccgtggtcgtgctgcaacagcaccgtgtgcaccaagtcctttccgccgacgtgccgatgcctggacgaggtggaggagtgcgctcccgcgtgtaagcgctgcgagccgaaccgtcacgtctgcaacgaccagtaccacaacgacccagggccaacgtgcgccaagaaggagaggccgtgggcgtg

SEQ ID NO: 1782 - DNA, 426 bp, Hordeum vulgare
ttttttttttttttttttttttctcacgtaccatgatgcactaccatgaaatgaaagtacacgcaggcatctagcgactctggataaacattaagaccagagaaaccaagagtagctgcatctgcgtgccggcggcagcgagggacgcagagccggcggggacgtcgtcgtcatccttgccgcacctaggcccaaggtcaccgtggtactggtcgttgcagacgtgaattttcgggttggtcccgataggctcgcagcgcttgcacgcgggggcgcactccgtcacctcgtccaggcagcggcacgtcggcggaaaggacttggtgcacacggcgctgttgcagcacgcccacggcctctcctctttggcgcacgtcggtcctgggtcgccgtggtactggtcgttgcagacgtggcggttcgggt

SEQ ID NO: 1783 - DNA, 455 bp, Hordeum vulgare
ggaatgccactcactcactcaatacatgcagcgtactaccacacactgacatcgccctctctctctctctcccccctcattactcgcatcattacagccccctcagtctcactctctatccgcccctgctctctctcccggagtagaagtcgagcctgcgacattgctgctgcacagagcacacggactgtacgaagcacccagcgatgctccctcgccccccttcccacctcctgccatggcggtgcctcctcctcctcctcctcaccctcaccatggcctgcaccagcaatggcgtctccgcaaccgcgaaggccaatcacaaggccaaggcgccggcagcggcacccaagccggccgggttcgggtaccggctggtgtccctcgtccagcgacccaacggcggcggcctcgtaggcctcctccaggtgaagcgccgctcctccaccttcggc

SEQ ID NO: 1784 - DNA, 315 bp, Hordeum vulgare
ttttttttttttttttttttttttggccgaatgcagtttcattcccctgcaagactgagcttcaatgggtgaatcagagttcacaaatggtgttcgagggtaaccaacccccacacaagttacataaccgactcaagcacgatgaactactttttaagctctataaatttaaattagacacgacgacgacgagtcgaacgaagaaggcgcatgcagacggaagcagaggcaaatgcagctcgattctcctatgcttcgatgtgcatgttccatgtcatggtgaagctcttccccagcggcaactccagcccgcca

SEQ ID NO: 1785 - DNA, 494 bp, Hordeum vulgare
gccgcgtcgacgacctccgatggtcccccgacggcatgcgcatcgtcgtctccggcgacggcaagggcaagtccctcgtccgcgccttcatgtgggactctggcagcactgttggtgactttgatgggcactcaaagagagttttgagttgcgatttcaagccaacccgaccattccgcatcgtcacatgcggtgaagattttctggcaaactactatgaaggaccaccattcaaattcaaacattccataagggatcacactaactttgttaactgtatccggtacgcacctgatggaaccaagtttatcactgtgagttcagataagaagggtttaatatatgatggcaaaactggagacaagattggagagctatccagtgaaggcagtcacactgggagcatatatgctgttagctggagtcctgacagtaaacaagttctaacagtttctgctgataaaactgcgaaagtatgggatatcaatgaggat

SEQ ID NO: 1786 - DNA, 480 bp, Hordeum vulgare
  UNSURE (28): n stands for any base
gttgatgatgatttactgaaaatggaangcacataagttgtcttagttattaacaaccactccactccagggagcacacggaaaacaaaatgtcacaacacaccatcaccccctgtattctcagcatctcacaaaaccagacggcgcgtgggaaggaaacgatgaccgtagggttcttcctcaaagcacacgaaagaatcacaacacggagaaaaagaaaaaaggaaaaaaaaaacagactagaaagcgccgccaccgcggcctgaggaaaacagcgaccgaccatagcgatgtttccttcgataggcggccattgctaattgatgaacgaggatgcgcgcctactgctgcgccgccagtttccagacacggacgcacgcgtcctcgccggcggtcaccagggtgtcgttgtcggtgaaggagatcccgtggaccccgccgaggtgagctcccttgatggtgctgcggctggatgccggc

SEQ ID NO: 1787 - DNA, 517 bp, Hordeum vulgare
gcaagtggcacaccataccaagatggcctattcttctttgacttctaccttccacctgagtttcccaagctcctccgtcggcatactatcattctggcggcttgcgtgtaaatccaaacctttatgtggatgggaaggtttgtttaagcctcttaaatacttggactggcagagggaatgaagtatgggatccatcctcatctagtattctccaagtactagtctcacttcagggactagttctcaatgaaaagccctatttcaatgaagctggatatgagaagcaagtcggtactgttgaaggggagaagaatgcactgccatacaatgaaaacacatatctgctaagcgtgaaatccatgttgtatatcttgaggcggcctcctatgaatttcgaggattttgtgaaaagtcacttctgcaagcgtgggcactacattctcaaagcttgtgaggcctacttgcaaggagcagtggtcggcacgctgaacgacgatgcctgtcccacagatagtaa

SEQ ID NO: 1788 - DNA, 550 bp, Hordeum vulgare
gagggcacacctcaattccagtttggaagagatgatgatggttttcatttggaaccacgtttcccaaatgttcagataataaaacaacaaatgttgaatgtacatttatacggaaacagcaggcggtttagtttgatcatgttttctgaacccaagagaagctttgaatacaaccctcaggctcggtgttcagctttcttgagcggcttcggtcttcccgaggtgctcgtactggctgcagtctgctcctatgtccttcaaggctgtgatcaaccttggcaagattttgcccaatgcaagtttgaagcccatggagcaggagtactccttgttactatctgtgggacaggcatcgtcgttcagcgtgccgaccactgctccttgcaagtaggcctcacaagctttgagaatgtagtgcccacgcttgcagaagtgacttttcacaaaatcctcgaaattcataggaggccgcctcaagatatacaacatggatttcacgcttagcagatatgtgttttcattgtatggcagtgcattcttctccccttca

SEQ ID NO: 1789 - DNA, 518 bp, Hordeum vulgare
cctcgtgccgaattcggcacgaggctcagtcatggggacgatgaagcgatgcatggttcctggcatcctgctgatgcttgcgctgcaggcagccctgctggtcgccggcgacgaggtgggctccattctcctgccgagccagggccaaggcgaagcagccgccatggcggcgggcaagaagaggccgtggaagtgctgcgaccaggcggtgtgcaccaggtccatcccgccgatctgcacctgcatggaccaggtcttcgagtgcccgaaaacctgcaagtcctgcgggccgtccatgggcgacccgtcccgccggatctgccaggaccagtacgtcggcgacccagggcccatctgccggccgtgggagtgctgcgacaaggctatctgcaccaggtccaacccgccgacgtgccgctgcgtcgacgaggtcaaaaagtgtgctccgacgtgcaagacctgcctgccgtccaggtcgcgcccttcccgtcgcgtctgcatcgacagctactttgggc

SEQ ID NO: 1790 - DNA, 553 bp, Hordeum vulgare
gtcgaaaaacacgcacccaccgctcattataaagattaaacattgccatgatgtcttactcataattggcattaggaggccggccatccattttattttattcttacacgctgctggtgctgcagcagggcaggaggacactcgacggccgggcgttgatcgggtgaccaacgcgcgcgtgcatgcggtacctagttaccgccggtggcaacgtcctcccggggcgtgcataggggcgggacgggcccaaagtagctgtcgatgcagacgcgacgggaagggcgcgacctggacggcaggcaggtcttgcacgtcggagcacactttttgacctcgtcgacgcagcggcacgtcggcgggttggacctggtgcagatagccttgtcgcagcactcccacggccggcagatgggccctgggtcgccgacgtactggtcctggcagatccggcgggacgggtcgcccatggacggcccgcaggacttgcaggttttcgggcactcgaagacctggtccatgcaggtgcagatcggcgggatggacctggtgcaca

SEQ ID NO: 1791 - DNA, 515 bp, Hordeum vulgare
aggactcgaggagagagagtggggtggggagctgccatggcgacggcggccggcggcgagagcatgatgacgagggagcagctgctccacctcttctcccgcttctccttcctcaccgcgctcccagagttcaaggaccgaatcgccgacgccgtcagcgaaaagcaggaagctgtggcagtgaccaccgaggtacaggaggagattcttcgcgagatggggatcgatccaagttttggtattgcttgcctgggaaaggtgaacgtcgtgtatgagaatgacatggatttgatgattaagttctaccaatttgttgccaaagaagagatggctattgatgaggccgagcttgagcctctagaatttgccgagaaaatgcacactcaacaggaattacaacaacagcaactggagatgttagtacaaattagaaaatacagtcccgagagccaatctgtcatacttgagactttgcgcaagcagttggagcatgctgatttcgatcctagtgcatc

SEQ ID NO: 1792 - DNA, 550 bp, Hordeum vulgare
ttaaatatattctcatattaaatatagaaaagttatatcatgcttgggcacaattcaaaatgctgataatatttagtagaacacatgtagccttttcgctgaacaaagcgcatattacataaagtaaaaccggatgacagttatttgcttcgtgtatagggcagattacaaccatcagctatagtagagggagaagagactggatgggatgtaaatcccttatctcttaggccatgttcggttaattctctaaccaaagggataaatccctttaaacctctccaaaccctgcctaaccgaacaagcccttaaaatatgtgatctatttctgaacaattcctttgatctgctccggagtcaagaccgatgcactaggatcgaaatcagcatgctccaactgcttgcgcaaagtctcaagtatgacagattggctctcgggactgtattttctaatttgtactaacatctccagttgctgttgttgtaattcctgttgagtgtgcattttctcggcaaattctagaggctcaagctcggcctcatcaatagc

SEQ ID NO: 1793 - DNA, 518 bp, Hordeum vulgare
cagaatagtttctttctctctttcccctcctcattgctagatgtagatgtagatgtagaatccgttccatatcttctagccccatagatagatgtagcctattgtcttccaagttgttcccagcatgcctccttggatgctgatgcgtagatctcggttcttctctgtttttgcttgtttttctgtgatccgtttgctgtgttttggatttggtttggaggtggagctcctatcattccaatgaagggtctaccggaagggtttgtgcagctgcttgttcatggttcccactatcctatctccattagaacacgaggagataggcttgtggtttgcatgatcgaggagccgcttcgatccctcgctgaccgctgtttggattgaagggagctctgcatcttgatctattactaattagtttcctcttctgctgcatgcaagcctggaaatgttttgcagatttttctcctccacggtccagatctgggtgcaagctgtttcttgcgtttagatctctc

SEQ ID NO: 1794 - DNA, 551 bp, Hordeum vulgare
agcataacctgaatctttcattattaccttgaggggaaaacaaaacaccggggtcatacaatcacagcttgaaaagttcaagctcaaggagagatctaaacgcaagaaacagcttgcacccagatctggaccgtggaggagaaaaatctgcaaaacatttccaggcttgcatgcagcagaagaggaaactaattagtaatagatcaagatgcagagctcccttcaatccaaacagcggtcagcgagggatcgaagcggctcctcgatcatgcaaaccacaagcctatctcctcgtgttctaatggagataggatagtgggaaccatgaacaagcagctgcacaaacccttccggtagacccttcattggaatgataggagctccacctccaaaccaaatccaaaacacagcaaacggatcacagaaaaacaagcaaaaacagagaagaaccgagatctacgcatcagcatccaaggaggcatgctgggaacaacttggaagacaataggctacatctatctatggggctagaagatatggaacggattcta

SEQ ID NO: 1795 - DNA, 423 bp, Hordeum vulgare
  UNSURE (3),(11): n stands for any base
cgngagtcggnaaacctgctattccaatccccgcaggtagcacggggaggatacatacagaacgccgtcaagttcctcgagcatccaaaggtgaagggctctccggtgtcctacaggtactctttcctggagaagaaagggctcacaaaggaggaaatcgacgaggccttccgtcgggttcctgatccgccgacaaacagtacggatgctgcggctgtcggttcgcaacaagcaagcaatccaaatcaatctgccggggtgcagccttacgcatccattcagtcgccacaagcaccaactggctctgtcgccactggccatatcgtcccacaaacgcagacacaatttagctggtatcatacactccttggtgctggtattttccttggagtaggtgctagttcagtgctcatcatcaagaag

SEQ ID NO: 1796 - DNA, 549 bp, Hordeum vulgare
ttttaaatgttttcggtatgctgtcgatttggaattttacatacaggtagaaaatataagtaactccgtatacatggtaccgtcaagtgaaccacacagatatctaacccattttttcttatacacgtgctgctaattacaaccatcatatacagtttccaatacctaattaacaatgcatagataattcgatatgtgaaccgcatacaacggaaaatcatatgaattgccctcgtcaaaatcaggcggctccaggcccttctccattctcaccgttggccgcaccagccatggtacccatggcagcgctgctactaggcgactcgtcactggtgacagcggatgatacaccgtccatctgctcattcatggcagagtctgccagtctcggagcgtcggctgagtctgctgctggctgtggctcttgtcttggaagggaccttggctgccgaatggcagccgccgcctctggcatggcgacgcccggtggctgtgggggaacccagtggcgctggaatggactttcctgtgcaactggtgtcgctgccg

SEQ ID NO: 1797 - DNA, 518 bp, Hordeum vulgare
gaattttctaacaaacttgctcagaagtctactagaaagcaaaggcgtggttggtggagacaatttcgtttgctgttcaagagagcatggatgcaggcttttcgtgatggaccaacaaacaaagtgagagcaagaatgtctgttgcttcagcaattatatttggatcagtcttctggcggatggggaaaactcaaacttccatacaagataggatgggacttcttcaggtggctgccataaacacagcaatggctgctctgacaaagacggttggggttttcccgaaagaacgagctatagttgacagagaacgagcaaagggttcctatgcactaggaccatatctctcatctaagctgcttgccgaaattccgattggagcagcatttccattgatgtttggatcaattctctatccaatggctaaacttcatcctacaatttctagatttgccaagttctgtggcatcgtgactgttgaatcgtttgcggcatcagccatgggtcttactgtggg

SEQ ID NO: 1798 - DNA, 550 bp, Hordeum vulgare
gcttgtctaaatagaagattaaatatgatacttcctccgtccggacgtagttaacgctcaaatggatacaaatcgagattacgccgcttagtccgcctgctgcttactttgatcttcctcggatggcggcacgagctgctggtacctcggtctgtttttcttcaggaggaggtaggtcagccagtaccagaacatcaggatcctgccctgcgcagctagcgtgccggcaatgcggattcctcccagcgaaaatctctccagggcctgttcgccagtttgaacatcgtaagaatgttggtgctcaaactgcagacccttgaactcgttgacacaaagtccttgaaaggcccatctgatcagagatgcttttgggatccaccggaagatgacgggagtgttatcagggttcacatagtatcctccaaagacaatgaacaccgtcataagtgatggcccaagagccatcgcagcttcggttgtaggagcgattgctcccacagtaagacccatggctgatgccgcaaacgattcaacagtcacgatgccacag

SEQ ID NO: 1799 - DNA, 982 bp, Hordeum vulgare
  UNSURE (55),(645),(705),(720),(723)..(725),(770),(771),(790),(799),(804),(819),(831),(839),(843),(844),(849),(860),(862),(865),(866),(874),(875),(883),(911)..(913),(915),(922),(924),(925),(936),(949),(955),(963),(968),(979),(980): n stands for any base
gtcccccgggtctgcaggaattcggcacgaggcaaaagcagcagcataccaaagnacccaaagaatcaagaggagatgcttactcttaacaccgttcggacatcccttccctcgccgcgcagatcctccccgcgccgacatgcagtgcatcaaagcaggaggagattttccatctgcaagagcagctccgaagatgctggatccgacgcccccctgccgcacggcggtgaccaacgccagcaggaggtgcttgcaaaaatcgccatgcttcagacgcagaaggtccggatcacaaacttcctggacgagcggtctgcttacctgaccaagttcaccaaggacgccgacaccgagttcgacatgattgggcagaacgccatgaaagagctcgatcaaattggggaccagataatggagcgtctcgacagcaagatgcagtcctacgaggagacagctgaaatgcaaaggcaggagatagaaatgaatgagagagtgttagaagacttcgaagactggatcgaagaggagaaaaacgaaggcatgttcttcaaaagccttggcaaggtcaaaaaacctcaaaacaatgaggaaatcaaggtgaaggccaagatcgaagcacagaaggtcagagagattgcagagganagtgcgggtcaaaaactcggatgaatatttacccttgcactcatggcgatactcggggcntacaatcgcaaatgncgnnntttgcaacaccagaggtggaatggaggaaggttgctgctctgggnnttaattttcatttggcccngggttggcncaggnccccctttgagcaanattttttccccnccgggggngctnnccagnattggaaaaangngtnnattgaaanngccttggncccccctggggaaaaactttaaaaaagnnncnaggagcntnnctccctttagnaggggaccgggtnaaaaanaaaaatanaaatngggggaatttnntt

SEQ ID NO: 1800 - DNA, 549 bp, Hordeum vulgare
tagggaggtcatttcttattattgatttttttacaagagttataaatagatactcattgcatattttatttggagtacggacgtcagaaaaaaatcctacatccgcagtctaattaatgaacatcatgttcattgccctttgccctggcaggcccgacgcaaaggcaccggagggtcggagagagcgccgtccacgatctggtcgaagataaacttgtaagccgcttcggtcaagtgcaccccatcccagctcacgctcttggacgggtccacgcacgacttcccccccaggaccggatcgccacaccggatgttcttgtcgaagttgtattggccgccgccgtacccgcagcacacgcgcagaggatccccaaaaccgaactttttggcttcgctcatcagcttgtacatggcggcgtacaggtcgacgtaggtgaaggcggcctctgggagagcgaccctaagcctcgccacgacctccttgagccgggcgttgaagaaccgggggccggcgttgagcgcgatggagcagccggcgtcatccttctc

SEQ ID NO: 1801 - DNA, 551 bp, Hordeum vulgare
gtacccccgggtctgcaggcaattcggcacgagggctagcatcttctgttttgcttgctgcactttctgttacaccatatgaccataaatatggtgcatctcatcttgagcttgaaaatgaaaaggaccgtagcttgcgtatggccaaccttgtcaatttctcccttgactccaagcgcgagaatagagaaatggtttcaagagcaactcttctttctgagttggctgccaaaggtgtgatttcatgtgcttcccaagaagtaaaagatctatacaaccttatggagcatgagttccttcctctggacctagcatcaaaagtacagcctctgctttccaagatttctacgattggaggaaagctttcagctgcatcttcagttccggaaattcgtttatcacagtaccaatctgcactggagaagcttactgcactgagggtgctgcagcaggcatctcgtattttccagtctatgaaaattgatatgctatctagaatgatcccattctttgacttcaatgtcgtggagaagatcgctgttgatgctgtc

SEQ ID NO: 1802 - DNA, 512 bp, Hordeum vulgare
tatttgacgctatggtcttctttacgtttttaataattgattttctcgcaaggagtcttctatgttctttctccaccactccaggaagactggccaagttttcactaggtttggatggcttatacacaggtggatgaataagactccttgctttgttcagggaatcagcaaggacactaaggtgactactaagcacatcagattctatgtccatgttgccaaaatgaacagctcctgccaaatggttaactttcatagcaacaaaattgtgcttgacagcatcaacagcgatcttctccacgacattgaagtcaaagaatgggatcattctagatagcatatcaattttcatagactggaaaatacgagatgcctgctgcagcaccctcagtgcagtaagcttctccagtgcagattggtactgtgataaacgaatttccggaactgaagatgcagctgaaagctttcctccaatcgtagaaatcttggaaagcagaggctgtacttttgat

SEQ ID NO: 1803 - DNA, 1364 bp, Hordeum vulgare
  UNSURE (13),(18),(19),(28),(35),(94),(111),(356),(357),(390),(577),(579),(586),(667),(939),(954),(958),(1001),(1002),(1006),(1017),(1020),(1027)..(1030),(1035),(1042),(1044),(1047)..(1053),(1082),(1085)..(1089),(1094),(1095),(1126),(1130),(1197),(1236),(1245),(1249)..(1251),(1266),(1283),(1306),(1311),(1319)..(1321): n stands for any base
aggcacttccctncgagnnctgagcggnaaattanctggcacgcaaggggcaccggcttcggtaggaacaaagaacagacggcttacgacccgnacacttctttccgagantgggggttggcttcggcttccttttcttcctttcctttcgggggcgggggtttccgggcggggcggcgggcgcctcctcggcctgtggtttcctttcctctcccctcttaaaaggggccgacaccaaaaataactttttggaaatttttaaaaaatttttttaacaaagaggaaagatgtgcccacaaaaacaatcccttttgtcccccgccccccaaaagccttttgatgggcctttgcctctnnaaatattattcacacaataaaaaaaagggcggngcgcggtgtttttctcctctcctcgtaagaaaaccacttttaattccccaaattttattttctcatactccgaagatagaaacaagaagccccacaaactccccccccactaaaaaaaaaaaacgggctttttttgtgtgtgctacccacccgcagaagcccacacccacctttttttctctttttntnccgcgtnttcgtgtggggggggggttggtggggagagagaaaaaaacaaaaataataatttttttcttctcctcccaacaatatgggncgagctattagttttttttgcgctgcgcgggtgggtggggggtgcgcctttttctttatcctctatcattaaaaataacaccctctcttaaagaggtgggtgggaggacagaaatttctttcctccacaaaaataacaacgaacatattctcaccccgacacctcaaattaaatacaaaacacaaaaagcaaggacaatttgttttttccggcactgttattgtacccacgcccaacccgcccgctgttccatcactcattccttctttttntacattttcatatanaatnatcacaacaccataataacaatttcatcgcgtttgttacaaannatcnacacgcgcacnctnccccccnnnntcatnccttttncnccnnnnnnncatccatgaatgtggtgtagtaagtgtgncgnnnnnactcnnactatgaagaaataagcatatatataagtanactncctccaacgggtacgcataattagtctagatggttgtctcccacatcccgccaagaaattgttgtanatatcttcaaatatatatatataaagagacagacgtggnaagtaggcngccnnnggcgacgctggtgangagaagaggaatatgtntgatggcaggatcaagacaccgngatgnacatgtgnnnaagagagaggaggaggagggagaggaagagagagagagagaag

SEQ ID NO: 1804 - DNA, 545 bp, Hordeum vulgare
cgtatccgacaaggtaaattatttcatccatggaagaacagctgtcctggggtacattgttactcacaggtctgataagttaggaacaagagagggaggatggatacatatacatatatttcatgtatgcaggaaagcaacggtggcgatgcaaacaccatcgacgtttgggtaagcttgcacatggtcgaggtacttgaacaccacagcatcgctggtcagcgctccttcagatagcgtggcgcccaactttctctgattgaagttctccacctcctgcactagctcatccttggtcctgctgcaggatgtgatcaccagtatgccaccaggagaaaccaagctagccactgactgccaatacatcattctctttacaggtccatcagggtggagccctattgcatccagagttccttcatccatcacaagttcaaatctcctctccaacttcgactccagaacatcatcaaccaggaaattaatgtgctcaaatccatcacgaattgcgaggtttcgagcaagctcaattgcggcttcactat

SEQ ID NO: 1805 - DNA, 518 bp, Hordeum vulgare
gtggaattgaaggtgtgcatcgttttctaggtaggacttggagactcgtggttggcgcaccattatcggatggatcatataaagatggaactatgtccactgatgacgaaccaacctttgagcagcttcgtgttcttcacaaatgcattgcaagggtttcagaggagattcaagaaacaagatttaacactgcaatttctgcaatgatggagtttgtgaatgctgcatacaagtgggatacccaaccaaagtcagtcataggctcctttgttctgttgcttgcaccttttgcaccacacttggctgaggagctttggtttcgtcttggacactcacaatcattggcccatgaacagtttccagaggcaaataatgagtatttgaaggaatcagagattgtgctccccgtgcaaatcaatgggaagaccaggggtacaatccttgttgacaaggagtgttccgcggacgatgtgttccaaatagcagtctcagacgagagactctccaaatatttggac

SEQ ID NO: 1806 - DNA, 548 bp, Hordeum vulgare
  UNSURE (21): n stands for any base
ggccttaagtgaaaattattnaaagagagaggccatataaaattatattgttaaacatagcagcatcacaaaagatgcatgccaatagctggaaatgttactagaaaagaatggaaatttacagatctctagactctatcaactactctggcaggactcctgggaagattgatggaaaaaaccagagcaatgatcacgtccttgccttttgttgatctagtataacattcaagatccttccaggcacataaattctcttcctgatggccttcccgtccaaatatttggagagtctctcgtctgagactgctatttggaacacatcgtccgcggaacactccttgtcaacaaggattgtacccctggtcttcccattgatttgcacggggagcacaatctctgattccttcaaatactcattatttgcctctggaaactgttcatgggccaatgattgtgagtgtccaagacgaaaccaaagctcctcagccaagtgtggtgcaaaaggtgcaagcaacagaacaaaggagcctatgactgactttggt

SEQ ID NO: 1807 - DNA, 1537 bp, Hordeum vulgare
  UNSURE (1)..(26),(79),(917),(919),(1375),(1483),(1488): n stands for any base
nnnnnnnnnnnnnnnnnnnnnnnnnnaaatttccaacaaatcaaaaatttgtaattctcccgggcctgacaagccattnttttcccgacagccaaccacaaaccttctctctatactgttgccgcaccaattgtttcttttttttcctcccccacacatacccgcgggcgggtccttgccacacacctccaaaaaaaacaccacaccacccccctacccactaactccacctcctctctcccctcctcttctcattcatccctccacgcccattgcctcctccacttcattccttcccccccctccacccatctcacccctacaatccctatctatattcccttaacatattccttctttttttaacttctatcataacctcttttttttgggggggggggggaaaaacccacaccccccctcctactcacctcttccctccacccacttccacccaccccaacacaataaaccaccaatcctcctccccccccctccctccttctcccccttctctcctccctccctcttttctacttcctcctcactttctccatctactccaccctcctcttacccttcaatcataaccccttcatcttccctcctcctctctttccaccttcctaccctccaaatcaccctccatcccccatctctctatctatcactcccactcaactcacattagctttacccccatcacttctccctcacctccaatactcccacccccatctttctcctctaatctttttaccagatattatcactccacctaccccacctctttatccatacttttcttcatcttctaatacttattactcctcttacccactccctacctcctctcctccccatactctcccttccccccctccccctctcctaccttcccttctcctctctccccncncctttcacctctttctcaactcccctcctctcccttcatcttatcttctcttttctaccctttctgcacgctcctcccaccactttctacgttcctcctatctctcttttctttcatctcttttcctcatccgtcctcaccccctcctatcttctaacacctctacttctcctcctccatatctcattactccttctattcattccatacctctcctactttctacattctactccctctcctcctaattccctcaacccacacaacatccacccttctaccataacctcaccttaccccatcgtatctctccactacctcacctaacactccttcacagcccccaataccatatcccccccactcttcacacacctacttcctccaccactcccttaacccccctcaactaaccgactccacgctctcgtcaacaccgcacgaaatacccaccantacactcaccacacatcatcgatcccccccctcccaagtccacacatcccgacttctccccaccaccctcgaaccctctccaccagatccatgccttgctacctctanatacnccactccctaactccaatgccctctatccgtttcctatctcgacatatt

SEQ ID NO: 1808 - DNA, 549 bp, Hordeum vulgare
ggactgaagcacagttgcacaagacttataggctcgcttcagcaaagcgtgcttgcacttggaagcagtttccagtgttcgagatcaagtcctcaacgctcttgcagatttcacaagcaattcgccgacccgaccccatctcatgaggatggcagctgcaaatccgataccaaagcccagcccgatgaagagaaacaagatgacatccacatgagaggacttttccgcatgcgccgcacttggaggagcgggtgaaacgccgcatgggttggacaatggtagtccacacaaccccagattcccttcaaatgaactgttttggaatgtcgcaaattgacctgaccgaggtatcattcccaccaaatgattgtcgcgcaagttcaacataccgagaaagttgagatttgttaggtcctctgggataccaccagaaagctggtttcgagacaggtccagcgattctagttgagtcatcgcaccaaattccttgggaatatcaccggtgaaggcgttgcctgacatgtttagtacatgtaacgaaataagccc

SEQ ID NO: 1809 - DNA, 875 bp, Hordeum vulgare
  UNSURE (735),(794),(797),(820),(840): n stands for any base
gtcccccgggtctgcaggcaattcggcacgaggagaaaccgatgtttgattctgtcccaggcaccccaatggagaagtcgttatttgattctgtcccaggcaccccaatggagaagtcgttatttgattctgtcccaggcactccactacagaaatcagtcttcgattattccgtccctagcacaccgatgcagaattcatcctttgactactctgttccgagcacaccgatgcagaagtcactcttcgactcttctgttccaagtacaccgatgcaaagatcactctttgattcttctatgcccagcacgccgatgcagaaatcactgtttgattcctctgttccaagcacaccaatgcagaattcattctatgactcttttccgagcacgccaatgcagggttcactctttgattctggtccaggcagagtggaatctcctacggccgggagcacctatggtggcggtcagcagaagggattctttgactcttccgttccaagcacgccgatgtataactccagcttctcgccaaggtacagcgaagccggggacgacagctcgttcgacactttctcccagatggactcctttggtgcgaaagacagcagttcgttcgggcagccgcgtgacagcttctcacggttcgattccttcggggagcagcgccgagctcggtggcagcaacgacacatttgggagggtcgattctttccgcagcaacgcagaccangggtggtggcagcagcttcatgaggtacgattccatgagcagcaacgccgatcaaaggnggnggcaacaacaacagcttcatganggtacgactcgatgagcagnaacgccgaccaaggcgggagcaacaacaacagcag

SEQ ID NO: 1810 - DNA, 551 bp, Hordeum vulgare
ttgagtgacttatgtacttatattaaaatgccatatcctcgaatttgctcctagtacatacacctaccgtttgaatcattgccaggctcacaaatgcagagttactgcagccatgagcgtgtacttattagttagatgaatcacctcattagcaaactctatgctatatacaactcatccgattgacagggcggccttatttcttcagaatcaatcaaagcacatcataatccgctagcattcgacgctaccgagtgattagttgactggctatggaatctatggatgaccgtgtcaggcgaaaactgcagggcatctgtgagcaagtgcacatcctctttctgagacgccttctttctcatgctcttagattgatagtctccgtccctgacgtaagtcaggatctccaccacctccttgatcgatggtcgcatctccctctccatctgcaggcactggaaggccacctccgccactcggtcgatcgttctcttcgtttcagggtcggtgtcgtagccgagctccggatcaaccaactgaacaacttcatg

SEQ ID NO: 1811 - DNA, 515 bp, Hordeum vulgare
ctcaaccgagtgccaagcaaaagcagacagcatcctacctacgatccgagatactgaattttccctcaggtacaaaatcgaaagcaacacctacaatgtcgatcgtgaggcgtagcaacgtgttcgaccccttctccgacctctgggcggaccccttcgacaccttccgctccatcgtcccggcgatctcaggcggcaacagcgagacagctgcgttcgcgaacgcccggatggactggaaggagacgcccgaggcgcacgtcttcaaggctgatcttcctggcgtgaagaaggaggaggtcaaggtggaggtggaggacggcaacgtgctcgtcgtcagcggcgaacgcactaaggagaaggaggacaagaacgacaagtggcaccgtatggagcgtagcagcggcaagttcgtgaggcgcttccgcctgccggaggacgccaaggtggaggaggtgaaggccggactggagaacggtgtgctgacggtcaccgtacccaaggccgaggtgaag

SEQ ID NO: 1812 - DNA, 549 bp, Hordeum vulgare
ttcaatgtcccttcttgatagtgcatcaggtactacatttattcattgcgattacacaagtacacaaacgaccgaggaaagaaacgcgatacagagatgcctcaaccagactcgacaagaacaaatcacaactgtatttaggctgcagaactcgcacacacatcaaccagaatggctccgactcgaatactcagccggagatctcgatggccttcacctcgggcttcttcacctcggccttgggtacggtgaccgtcagcacaccgttctccagtccggccttcacctcctccaccttggcgtcctccggcaggcggaagcgcctcacgaacttgccgctgctacgctccatacggtgccacttgtcgttcttgtcctccttctccttagtgcgttcgccgctgacgacgagcacgttgccgtcctccacctccaccttgacctcctccttcttcacgccaggaagatcagccttgaagacgtgcgcctcgggcgtctccttccagtccatccgggcgttcgcgaacgcagctgtctcgctgttgccgc

SEQ ID NO: 1813 - DNA, 363 bp, Hordeum vulgare
  UNSURE (286),(292),(293): n stands for any base
gtccccccgggcctgcagggaattcggcacgagggctggcaaagctcgcgcgattggtgtgagtaacttttcatcaaagaagttgggtgacttgcttgccgtagctcgtgtacctccagctgttgatcaggtggaatgccatccttgctggcagcaaactaagctccacaacttttgtcagtcagctggtgttcatcttagtgcttactcgcctctaggttcacctggtactacttggatgaacggtaatgtccttaaagaaccaataatcatctcaatatccgangaaacnntcggcaaggaacacctgcacaagtggctctgcgctggaacattcagacgggtcacagcgtgctaccaaag

SEQ ID NO: 1814 - DNA, 543 bp, Hordeum vulgare
cggcgcgtgaagaaatacgcactggattcatgattatcttcgggcttaaaatagaacagaagaccaaaaacgcgacgcccacggcacaatatccccaagggcacattaataatgaagctttgtctaaaaaaccacataaataatgaagctgctaacaacatagttcgtgaatcgagatacgggatagaatcgcaaagctcagagcactgaaccttggtctctgaagagcgaatcctgagataaacgaatcgacagttcctgatatgtatgcttgctgctccctgctcaggatgagcgacgccagccttcctaaatctcactgtcccacagctcctcgtgggtcttgtaaacgctctgtggattaacggcgaagttgcctctgagcagcctagcctgcttaatttccgagaactttgcaagcacgtcatctggaattgaccaatcatgaacatcaaggttttgttttatcctttcctgattcgtgctctttggtagcacgctgtgacccgtctgaatgttccagcgcagagccacttgtgcagg

SEQ ID NO: 1815 - DNA, 439 bp, Hordeum vulgare
cattagcacaaaatcctgcatggtggaggacaatgtttggaatttcagtagttccatctattttgctggctctaggaatggctgtttcacctgaaagccctcgctggctattccagcaaggaaagattcctcaagcagaagcagctataaaaaaattgtatgggaaagagaaggtaacagaagttatgtatgacctaaaggctagtgggcaaggatctaatgagccagatgccagctggtttgatcttttcagcaaacgctattggaaagttgtgagtgtgggagcggcactgtttttgttccagcaacttgctggcataaatgctgttgtgtactactctacatctgtgttccgcagtgcaggcattgcatctgatgttgcagcgagtgctcttgttggtgctgccaatgtttttggcaccatgattgcatcttcact

SEQ ID NO: 1816 - DNA, 451 bp, Hordeum vulgare
gactgatttactggctgcatcaagagctcattcatacagtactacgaaatagagcatttccagatgatgaatattacttactacggagtacacgctttgaaattcggcaaatcggagttttatttcctaatgatgacatataggaaggagttcatcggtacactgaaaacgatgacatccaaggactagcagccagcctaaatcgtccacctccagaagcaacaacacagcagctctttgattctgagatgtgatgagaagtagctgagctttactggcagacacagcaaaccctgagtcccggtcagttcgaatggcatcaggcggtcctgcggctcgcttatttcgggaactacataaaagccagaggcagcatccccaggtccaaggacgtttgtgctcgatgctcattcgtcgctcaccaaaaaggcgttacttgcatcgactttgc

SEQ ID NO: 1817 - DNA, 948 bp, Hordeum vulgare
  UNSURE (823),(895),(921): n stands for any base
tgtcttcccgggtctgcagggaattcggtacgaggggcttgccgggtctgaggagcctcaaaaggcaaactgcccggccaagaggtgcggcaacatcagcatctcacacccgttctggatccctgagtgggaggcgggaagatcgtgtggccccttggattttgtggtcacctgcaacaacggcaatccagttctcaagagctatggattaaatggctttgcaatcatggacatctcctacgagaaacggagtatgcatgtctttgatatacagaaagaggaagacttcaaatcctccagcggctgccatttcccgttatggaacacctccggcaaactggcacccccgtttaaggtcagcaactccaacctgaacctcatcttctacaactgcaccaagacgttggcgcatcgggacagggcgctggtggagatgagatgcgtagacgggatcaacacgtttgttcgcgccggagggcgtttcaatgagacggggaactacggcggctacgccttggagggctgcaatgccaccgtcgtgccggtgatgagctcgtcgggcaaggcgaacgcgagcgactacgagcggctcatcagcggtggcttcctcttgacatgggaatgggatgatccgagacctctctctgcacctctacctctccctacgcctgcaccagcacgtagcaaggggactagcaagaaggttatgctaatagctgtaatatcaggagctggaaccttgctcttgacatgtatttatatgctggtatggcgcaaaaaagggaaaagactatggcttcaccttttgcagaagactagcagncacaccgagaagaattacgaggccatgctagtatcgtacggatccctagctccaaaagatacacgtattcanaggtaatgaagaatacgtcttctcgncacgaccagctttggaaaggagttata

SEQ ID NO: 1818 - DNA, 531 bp, Hordeum vulgare
accaattttattcttgtcggtaaatcaggttactagcatgcagatgttgttgactcttggtcatgctcatgctgcatacatggaaatgttctactacaatgccaagttgcattgcgcttgtttaatttctgaatgcactctagtacatgccaccttctctaagcgttgacaatcaatgtaggtttctttgattcagaaggcttatatttgctcaaagagttggccgtcgttgtaggatttttgaattcgcaaggcttgtcttctccgatctggtagaacttgcactctctacatccatattgtgagctgaactttctagtagttcacagaagttctgcttcggcggcatgtccagatcatctaagcttctctcaaacatctctagaacttttgttatagttgggcgatgcacaggtaatacttgtatgcaccacaagccaatgaatgtcatctttctcgcaatctcctcaatttcccttgtcacttcacatgcttgtaatccatcatcttgcgcaaagtggtcataaatcc

SEQ ID NO: 1819 - DNA, 517 bp, Hordeum vulgare
caacaacagggccatgttctacaatgatatgtcaccccggaatgagatgaagcgagacatgccggtgggaactgatgcctccagctatcgcgcaccagcgccagctccagatgctgccgcatcggcagccgctgcacagccgccgcctggttatgtctatgcgcagatgcagccgcaacagcagttacaacagccacctcagcagcaattacagcagcagcagcagcagcaccagcagcagcagttacaacagcaagctcagcagcaattgccacaacaaatacagcagcagccacagcagcaattgccgcagcaattacagcagcaagcacagcagcagcctccgcagccgcagcaagcacatcagccagctccacagcaatatgtcaccgcgggaaatcagcatttcattcacaaccctgccacgggcacgttcatcccaatccagtcttactaccaacagcccgtccctcagcaagcgccacagcaacagcagtcgcctgcatttgacccaaat

SEQ ID NO: 1820 - DNA, 542 bp, Hordeum vulgare
gtgtatgatgatatttaactcggaccagtttctacaaggcaagctaaataataaacacatatctgacatttcaacctcagtaccatcgatgagttttaaatatacagaggggctacacaaatgatgagttctcgattcggaagtttttactgagctttttagacaactatatatttattcaaaaattaagacaagcaattggaactgtaatccaacacttcattcacaggccttcttccaccccagcttaatgcaacatcggcaaatggactctccaggaccaaaaggaaactcccccagactcagcaacacaagaaccaacatagtaccattttgatcttattttggaccgaacccctaatcacaactccagatgcatgcttgatttgatcccgaatgcacagctgcccaatcataccatccaatgtttgccatcgacttgcgcaacttgtaataacaataatgataagtaacagcaggattacctctaggatacgcagcataacagaattcacccatccttcgctatgaaccaccacggt

SEQ ID NO: 1821 - DNA, 519 bp, Hordeum vulgare
gaccgcgtggcagccaaccagcattccctcctgcggcccgccgtcgccctccccctctccgtcggcggcgaaaatccccgcttccgttccgtcgccaccctcctctccccctccaggggtttaattcccaggggaatttccgaccgtctcctgcctgcctacggcgaaactccattcacgaagaactactcacagaccactgaggctcttggcacaccggtctctggccagcaggataggatgcagcaggttcagcacacggttcagacgcatggatatgggctggccagaaagcacacgtatgactgggtcgctcttattctcctagctgctgtcgcggtcgtcctgcattatgctcccccgtttaaccggttcgtcgggaaggatataatgactgatattaggtacccggtgaaacagagtactgtgcctgcatgggctgtccctgcgatctctatgctgtgtcctgtgcttgtcttcatagcactgtatgttgctagaagagatgtctatgatctt

SEQ ID NO: 1822 - DNA, 552 bp, Hordeum vulgare
atcacaggtggtcctagaacaactaggtagaataaactgagcgggcgatatttgtacacaagatgaacgggcataaacatgaggtggagatagcacatatctagttctaaactcctaatacttgctgagtgcacacattaaaaaaaattaagcatgcttactgtagaaggtacgctacacggaggggtgagttacacagttccagattccaaatcatttcttgatctcccgttatggtgttggccggtcaatccgatatgatgctcacctgcaggctgttggttttgtgcattatttgaattggccgcctcaagctcctccagcatgtggaagtatgcatagggcccccagccttgatggtgatatggaggaggaaagaagtgcaaatagcacagcactgccacgatatatccaatcaggccaccgacaaacacgtactcccagtggtgtcgatagttgtctattctagaaatcccaacaagtgaagcgagaagtagaggaagaatcacgatgcaaagctttgccacgtgacctttgcgatcaaatgcctga

SEQ ID NO: 1823 - DNA, 509 bp, Hordeum vulgare
tggttcctcgacaccgctggactgaagaagtcgagcgcctacctgatcaatggtattttgatatttgttgtatggctggtggcaaggatatttttgttcctgtatgtgttttaccacatctatctgcactacagccagataatgaagatgcatgcatttggctattacctgacactaaccgtgccgtcggtgctctttgtcatgaacgtgatgtggtttatgaagattttgaaaggggtgatgaaaacactgtcgaaatggtcgtaatcggatcaaggctttgcggaccagaagcacaaccaacgtaatttggtgttcctgccgagctgcgtgtgaccatataatatgtaaagttatggatatatgaattaggctttgcggaccagaagcacaacacctggtgttcctgcagtgctgcttgagacctttgatgtgcaaagctatgaacatatcgacgtaactagggaaagtgaatatgtaaaatactgtagcaaacaagttagattagg

SEQ ID NO: 1824 - DNA, 564 bp, Hordeum vulgare
  UNSURE (9),(10),(23),(37): n stands for any base
tttcatgtnnctcgaattacgancactggaatttatncatgaataacgagatgagaatgggatattattctcctgggcctgatatacacattgcaggattgcttggaacaggaaagctggccaggaaattccagctcgccggaaaattgcacgatttagcctaatctaacttgtttgctacagtattttacatattcactttccctagttacgtcgatatgttcatagctttgcacatcaaaggtctcaagcagcactgcaggaacaccaggtgttgtgcttctggtccgcaaagcctaattcatatatccataactttacatattatatggtcacacgcagctcggcaggaacaccaaattacgttggttgtgcttctggtccgcaaagccttgatccgattacgaccatttcgacagtgttttcatcacccctttcaaaatcttcataaaccacatcacgttcatgacaaagagcaccgacggcacggttagtgtcaggtaatagccaaatgcatgcatcttcattatctggctgtagtgcagatagatgtggtaaaacaca

SEQ ID NO: 1825 - DNA, 449 bp, Hordeum vulgare
tggagaggtggccaagacggttgactccgaggagctcaccgtcgaagagcgcaaccttctatcagttgcttacaagaatgttattggtgcccgccgtgcctcgtggcgcatcatttcctccatcgagcagaaggaagagagccgtggcaacgaggaccgtgtcacactcatcaaggactaccgtggaaagattgaagttgagctcactaagatttgtgatggtatcctcaagcttcttgattcccaccttgtcccctcatctaccgctccagagtccaaggtcttctacctgaagatgaagggtgattactacaggtaccttgcagagttcaagagtggaactgagaggaaggatgctgctgagaacaccatggtggcatacaaagctgctcaggagattgcactggcagagctgcccccgactcatcctattaggcttgggctggcac

SEQ ID NO: 1826 - DNA, 529 bp, Hordeum vulgare
  UNSURE (61): n stands for any base
gttcaacaagaggcaataaccagatgcagcccgataacaaagcaaggcaggcagctacaangcttccctatcacaacacaaattggagcctccaattaccaacaaccacactgacgacattacaatctacactgaacaagcaagaaagacaagtttctggacacatagacaatgtttactgtccatctccagattcacccttgggagcatccttcatttcttcagcggcgtcctccgagatgtcggaagtccacagcgtcaggttatcacggagaagctgcatgatcaaagtgctgtccttgtaggactcctcgctcagtgagtccaattccgagatggcctcgtcaaaagcctgcttggcgaggtcgcaagcacggtcaggagagttgaggatctcatagtagaacaccgagaagttgagtgccagcccaagcctaataggatgagtcgggggcagctctgccagtgcaatctcctgagcagctttgtatgccaccatggtgttctcagcagcatccttcctctcagt

SEQ ID NO: 1827 - DNA, 515 bp, Hordeum vulgare
  UNSURE (22): n stands for any base
ggtcctgctacgtgtttgactnagaacgccgttgagatggcgcggtgcatactgagggttgtgatcgggacttccggccgtggatggtcacttgtacatgcatgcacacatactggaccgcagcctattgatccaataaacgcgtgctcggaggtccgagcacgctgacgttcgcgtggctaaaaagatggtgaagccggaaaaaccgaagataattaaacgtaagacgctttgggacagcgagaagaatatggacttactgaaaatgggggtggatcggctgcccggagtaagaattgcattcatcggagatgggccatataggacagagctagagaagatgttcgaggggatgccggcggtgtttaccgggatgatgcaaggggaggagctctcgcaggcgtatgcaagcggcgacgtcttcgtgatgccctctgagtcagaaacacttggccaagtagtcctcgagtccatgtcgtcgggtgtccctgtggtggccgttcgtgccggcggta

SEQ ID NO: 1828 - DNA, 221 bp, Hordeum vulgare
caatctgcgcctgttgcttccgccagtagtcgattgccgagctgtagaactcgttgcggatcatcttggatgctgccctccagtcgcacttctccatctcagccctggcggccctccccatgtcgtccctaaactcgtggtccgtcaacagcagcctaatcttgccaacacagtcgtcgaggtcccccggagcgaagaggaagctcgtccttccctctacg

SEQ ID NO: 1829 - DNA, 408 bp, Hordeum vulgare
gcgcaaccttctatcagttgcttacaagaatgttattggtgcccgccgtgcctcgtggcgcatcatttcctccatcgagcagaaggaagagagccgtggcaacgaggaccgtgtcacactcatcaaggactaccgtggaaagattgaagttgagctcactaagatttgtgatggtatcctcaagcttcttgattcccaccttgtcccctcatctaccgctccagagtccaaggtcttctacctgaagatgaagggtgattactacaggtaccttgcagagttcaagagtggaactgagaggaaggatgctgctgagaacaccatggtggcatacaaagctgctcaggagattgcactggcagagctgcccccgactcatcctattaggcttgggctggcactcaactt

SEQ ID NO: 1830 - DNA, 559 bp, Hordeum vulgare
  UNSURE (64),(65): n stands for any base
gtagcagcagtaaatttctagtaactacccaaagtaacaggaagggttcaacaagtagggcaanntaaccagtgcagtcccgataacaaagcaaggcaggcagctacaagcttccctatcacaacacaaattggagcctccaattaccaacaaccacactgacgacattacaatctacactgaacaagcaagaaagacaagtttctggacacatagacaatgtttactgtccatctccagattcacccttgggagcatccttcatttcttcagcggcgtcctccgagatgtcggaagtccacagcgtcaggttatcacggagaagctgcatgatcaaagtgctgtccttgtaggactcctcgctcagtgagtccaattccgagatggcctcgtcaaaagcctgcttggcgaggtcgcaagcacggtcaggagagttgaggatctcatagtagaacaccgagaagttgagtgccagcccaagcctaataggatgagtcgggggcagctctgccagtgcaatctcctgagcagctttgtatgccaccatggtgttctcagc

SEQ ID NO: 1831 - DNA, 440 bp, Hordeum vulgare
tacgagggtcacttattagcaaatctagagctcaccaccaccactattgcaaactccttagggatggctcgcgctgcagctactcagctcgtgctggtcgccatggtggccgccatgctcatcgtagctaccgacgcggccatctcctgcggtcaggtgagctctgccttgagcccctgcatctcctatgcccgcggcaacggcgccaaaccgcctgtggcctgctgcagcggtgtcaagagactggccggcgcagcccagagcaccgctgacaagcaagcggcgtgcaagtgcatcaagagcgctgcgggtgggctaaacgctggcaaggccgccggaatcccctccatgtgcggcgtcagcgtcccctacgccatcagtgcttccgtggactgctctaagattcgctgatcaaccacttgctgcctatagccccagcg

SEQ ID NO: 1832 - DNA, 554 bp, Hordeum vulgare
  UNSURE (70),(548): n stands for any base
ggtagtagagctgagtgtatgaatcatatatcaacagtgcacatgttacaaagtacaataaactcatagngtcccctcaaagggagtgaaggaacaaccaaacatcgatagtacagtatggccggccatgcagaactggctcaacatacgcactcctctctctctctatatcccacatgaagataatattgtgcatttattcatatatatgtatgtatgtgtgacctcaacgtactcagcgtcgatcgctggggctataggcagcaagtggttgatcagcgaatcttagagcagtccacggaagcactgatggcgtaggggacgctgacgccgcacatggaggggattccggcggccttgccagcgtttagcccacccgcagcgctcttgatgcacttgcacgccgcttgcttgtcagcggtgctctgggctgcgccggccagtctcttgacaccgctgcagcaggccacaggcggtttggcgccgttgccgcgggcataggagatgcaggggctcaaggcagagctcacctgaccgcaggagatggnccgcgt

SEQ ID NO: 1833 - DNA, 519 bp, Hordeum vulgare
cttacattcctctacctgacgcgaaagctaggcagcatatgtttaaggtacatcttggggatacacctcacagcttatcggaaagtgattttgaggtcttgggtcgtcgtacagaggggttctctggttccgatgttgctgtctgtgtgaaagatgtgttgtttgagcctgtgcgcaaaacacaggatgctatgtacttcttcaagacagatggtgacatgtggatgccctgtggatcgaagcaaccaggtgctgtgcagaccacgatgcaggatcttgcatccaaaggccttgcctcacagattctcccacccccaatctcgaagagcgatttcgagaaggtcctcgcgaggcagagaccgactgtcggcaagaaggacctggaggtgcacgagaagttcaccaaggagtttggcgaggagggctgagtggtacgcagccgcgagaactctctcgacccatgcacagccgcaccacagaaatgtatattgtttacaactttgattcgttgcgcttggg

SEQ ID NO: 1834 - DNA, 550 bp, Hordeum vulgare
ttccttaatcacttgcagaaaattcaagcacacagagtgtaaatgaaatagagttgacaacagaggcacagtgatagcccagcataacaaggctgccgtcgtcgccatacgttaagcacagtaagggctaccagagtgtacagatctgcgaatttaactcccaagcgcaacgaatcaaagttgtaaacaatatacatttctgtggtgcggctgtgcatgggtcgagagagttctcgcggctgcgtaccactcagccctcctcgccaaactccttggtgaacttctcgtgcacctccaggtccttcttgccgacagtcggtctctgcctcgcgaggaccttctcgaaatcgctcttcgagattgggggtgggagaatctgtgaggcaaggcctttggatgcaagatcctgcatcgtggtctgcacagcacctggttgcttcgatccacagggcatccacatgtcaccatctgtcttgaagaagtacatagcatcctgtgttttgcgcacaggctcaaacaacacatctttcacacagacagcaacatcgga

SEQ ID NO: 1835 - DNA, 518 bp, Hordeum vulgare
caaatctagctatctcatcatctccggcttagctcaccaccactactattgctagcttgtgatcgaaatggctcgcgctgcagctactcagctcgtgctggtcgccatggtggccgctatgctcctcgtagccaccgacgcggccatctcctgcggtcaggtgagctctgccttgagcccttgcatctcctatgcccgcggcaacggcgccaaaccgcctgtggcctgctgcagcggcgtcaagagactggccggcgcagcccagagcaccgctgacaagcaagcggcgtgcaagtgcatcaagagcgctgcgggtgggctaaacgctggcaaggccgccggaatcccctccatgtgcggcgtcagcgtcccctacgccatcagcgcttccgtcgactgctctaagattcgctgatcgaccacttgctgtcatccttgctgcctatagctccagctatcgatcctgagacactgagtacgttgaggttatttacacaacacacacacacatatatatg

SEQ ID NO: 1836 - DNA, 551 bp, Hordeum vulgare
ggctgagttatgatacatatataaaaagtgcacatggtacaaagtacaacaaactcacgattcctctcaaaggaagtaaatattaattataacatcgatacaacagtgtgccggccatgcagagctggctcaacgtacgtacttctctctctctctttctctcccacatggagataatatatgagagcatttattcatatatatgtgtgtgtgtgttgtgtaaataacctcaacgtactcagtgtctcaggatcgatagctggagctataggcagcaaggatgacagcaagtggtcgatcagcgaatcttagagcagtcgacggaagcgctgatggcgtaggggacgctgacgccgcacatggaggggattccggcggccttgccagcgtttagcccacccgcagcgctcttgatgcacttgcacgccgcttgcttgtcagcggtgctctgggctgcgccggccagtctcttgacgccgctgcagcaggccacaggcggtttggcgccgttgccgcgggcataggagatgcaagggctcaaggcagagctc

SEQ ID NO: 1837 - DNA, 552 bp, Hordeum vulgare
  UNSURE (25),(33): n stands for any base
gtacccccgggcctggcaggaattncggcacgnagggcaaatctagctatctcattgccaccctctccccgtgagcccaccaccacaactgcaccttagtccgtcgagatggctcgcactgcagcaaccaagctcgcgctggtcgccctggtggcggcaatgctcctcgtagccgccgacgcggccatcacctgcggccaggtgagctctgccttgggcccctgcgccgcctacgcaaaaggcagcggcaccagcccttctgcgggctgctgtagcggagtcaagagattggccggcttagcgcggagcaccgccgacaagcaagctacgtgcaggtgcctcaagagtgtcgccggcgcgtacaacgccggcagggccgcaggcatcccctccaggtgcggcgtcagcgtcccctacacgatcagcgccagtgtcgactgctctaagatccactgatcgaacacgtgctccccatatctccagcgatcgacgcttggtaggttgaggtcacatacacatatatacatatacatgaataaatcctctgttatg

SEQ ID NO: 1838 - DNA, 532 bp, Hordeum vulgare
tatacctaagtgcccatggtacaacgtacagcaaactcccgtatgtgtctcctcaaagggagtgaacaaacaatcaaacactgatacaaaaccgatacaacagtgagcggccatgtagagctggctcagcgtacgtcctcccctctctctctcatggagatcataacagaggatttattcatgtatatgtatatatgtgtatgtgacctcaacctaccaagcgtcgatcgctggagatatggggagcacgtgttcgatcagtggatcttagagcagtcgacactggcgctgatcgtgtaggggacgctgacgccgcacctggaggggatgcctgcggccctgccggcgttgtacgcgccggcgacactcttgaggcacctgcacgtagcttgcttgtcggcggtgctccgcgctaagccggccaatctcttgactccgctacagcagcccgcagaagggctggtgccgctgccttttgcgtaggcggcgcaggggcccaaggcagagctcacctggccgcaggtgatggccg

SEQ ID NO: 1839 - DNA, 413 bp, Hordeum vulgare
aaaaccaccgcacggcaaccatcttgtctagccctagctagcaagctatagaacaccaactcatctgaacctgtaaacacacatacacacacaaaattgtttctatgtgtaccaagcttagctaagatagtatcacagcccacaaaggcacacagaaacacactacgaagaacacacacgccaagaaaccacacaaaagcaacaagccatgggggtggagatcctgagctccatggtggagcactccttccagtactcttcgggcgcgtcctcggccaccgcggagtcaggcgccgtcggaacaccgccgaggcatctgagcctacctgtcgccatcgccgacgagtccctgacctcacggtcggcgtcgtctcggttcaagggcgtggtgccgcagcccaacgggcggtggg

SEQ ID NO: 1840 - DNA, 393 bp, Hordeum vulgare
ttttttttttttttttatccaaaacatcttatatttacatacaactcattttgcaatcagacttaagaatgagttctacgcaaaattgaggaacacaattgttctaatccacgaatggatcaacatatttcatttgacaacaacaagaagagggacgaaaaaatgcagatgctataaggcgaagtcacctagggcaggagagtgctggccgtgtgccatgcattgcctcttgaaccacccctgcgggccttgctccgccgtcgccgctcgctccctcttcaccccggcgatgtcgacaccgaacagtctaacgacgcggacttgttctgctttggcaatctccatcacctgcagcggcgacgccgatttgcctccgttcacggtcgtgttctt

SEQ ID NO: 1841 - DNA, 517 bp, Hordeum vulgare
caaaaactattctgttagctgtcgctgacaagttccttgtcgatagacaagcaaataaatgtggtgcaagcattctatgctttgatgagatacagactattgatgtattcgctattgttgccctatctggtattctgagcagactattaagcactgggactgtgcttgttgctaccagcaataaagcaccggaagatctgaatcaggatgggatgcaacgagaaatcttccttgagttattatctaagctagacgagacctgcaataagattcttgttggaactgaaacggattatcgccgccttattcctacggatggctcaactcagattcactattattggccgaccaatcctgacacaaggagtatgtttgaggctatgtggcatgacataactaaccaggcaggcggaaacataactgcagttactattcctgtaatgtttggaaggtctattgagattcctcaaagttgtagcggtgtagcaaggtttgacttcgagtatttatgtggacg

SEQ ID NO: 1842 - DNA, 551 bp, Hordeum vulgare
atgaatactgtcccctacagaagcatcgtatataactgggaagcaaggcaaatttgcgcagatgcaacggggtgtcttgctgatatcacttgtgttacatacatatactcgatacagtttccgacaatgtcgagcttggcttctccaacctcattccccgacgtttccgagattatttttacaggaacgaatagaatggtactaccaagtctacaagggagcagactgagagacagtgctctgttttgtgagaacaggggcgccctgctgttgttgaagcccagaagaatggacatgctggacacgctcgagatacaacggggtctgcatttctatgagccgagatatcgcccttcggaacgcaaacatctcttcttgaccagacagcattgacactagacctttagtagagggtcctacaccaacattgccttctgcggaaacatccctccttaactttgacccttccgcttcagtttcaaactggaaactctctaaatcaaaaagaggcccttcctcagttccttgaaacagattatcaatgggtaagg

SEQ ID NO: 1843 - DNA, 499 bp, Hordeum vulgare
catctgcggcttagctcaccaccactactattgctagcttgatcgaaaggcccgttctgcagctactcagctcgtgctggtcgccatggtggccgctatgctcctcgtagccgccgacgcagccatctcctgcggtcaggtgagctctgccttgcgcccctgcatttcctatgccagcggcaacggcggcatcctgcctccggcctgctgcagcggcgtcaagagattggccggcgcagcgcagagcaccgccgacaagcaagcggtgtgcaagtgcatcaagagcgctgccgctgggttaaacgctggcaaggccgccggcatcccctccaagtgcggcgtcagcgtcccctactccatcagcacttccgtcgactgctctaagattcactgatcgaccacttgctgccgtcgtttctgcctatagctccagctatcgatgctgagacgctgagtacgttgaggttatttacacaaccacacacacacacacacacac

SEQ ID NO: 1844 - DNA, 551 bp, Hordeum vulgare
ttataatgacgcgagccaggcatagcctatatcaaaagtgcacatggtacaaagtacaacaaactcacgattcctctcaaaggaagtaaatataaattataattaacatcgatacaacagagtgttggccatgcagagctggctcaacgtacgtacttctctctctttttctcccacatggagataatatatgagagcatttattcatatatatgtgtgtgtgtgtgtgtgtgtgtgtggttgtgtaaataacctcaacgtactcagcgtctcagcatcgatagctggagctataggcagaaacgacggcagcaagtggtcgatcagtgaatcttagagcagtcgacggaagtgctgatggagtaggggacgctgacgccgcacttggaggggatgccggcggccttgccagcgtttaacccagcggcagcgctcttgatgcacttgcacaccgcttgcttgtcggcggtgctctgcgctgcgccggccaatctcttgacgccgctgcagcaggccggaggcaggatgccgccgttgccgctggcatagga

SEQ ID NO: 1845 - DNA, 532 bp, Hordeum vulgare
ggaattcggcacgaggcgtcgtcgtcgtcgagctcgatcccccaccccccgtcccgcgccggcgccccggagatcggagcgccccgcggcaggatccagaccccgccatgaatccggagtatgactatctctttaagcttttgcttattggagactcaggtgttggcaagtcatgcctcctcttaagatttgccgatgactcgtacctggagagttatatcagtactatcggtgttgattttaaaatacgtaccgtggagcaagatggaaagactatgaagctgcaaatctgggacactgctgggcaagaacgcttcagaactattactagtagctactatcgtggggctcatgggatcattattgtctatgacgtgacagacctggacagcttcaacaatgtgaagcagtggttgaacgagattgatcgctatgctagtgagaatgtgaacaagcttcttgtagggaacaaatgtgatctcactgacaaaaaagttgtatcgtacgagacagcgaaggcatttgctgatga

SEQ ID NO: 1846 - DNA, 554 bp, Hordeum vulgare
gtaaaagtagaaatactcttaaatttagggaagaaaagcacagctgcaaatcgtaacataaccattcaagatacacaactagaagatgatgctgtctccaaactccatccggtgttacaagtccaacgattcaagagctaataagtacactagaaagaatggaatgaaggtgtaagatgtagtaggcctatgtagaagcatggactcaaggatggcgcagccaagtttgcatctccattagggtaacacggacagcggctgcctgcgtttctaagaagagcagcagctcgtattctgttcaacaggttgcccgcgaatctgcaccgtggctgggcgagcgctgtttgcggctggctggctcgccatcctgtccttgattgaagcagacatggccatgaaagcctgctcaacattcaaggcattctttgcactggtctccatgaatgggatcccaatctcatcagcaaatgccttcgctgtctcgtacgatacaacttttttgtcagtgagatcacatttgttccctacaagaagcttgttcacattctcactag

SEQ ID NO: 1847 - DNA, 448 bp, Hordeum vulgare
gagtccggcatcgaggggagccgcaagctggagcacacgcggcagttcaggttcctcgacaaggcggcggtggagacgcaggccgacaggacggcggccgcgccgtcgccctggcggctgtgcacggtgacgcaggtggaggagctcaagagcgtggtgcgcctgctgcccatctgggcaagcggcatcgtgttcgccacggtgtacgggcagatgagcaccatgttcgtgctccagggcaacaccctggacgcctccatggggcccaagttcaagatcccctccgcctccctctccatcttcgacaccctcagcgtcatcgcctgggtgcccgtctacgaccgcatcctcgtccccgccgtgcgctccgtcaccggccggccgcgcgggttcacgcagctccagcgcatgggcatcggcctcgtggtctccatgttcgccatgctcg

SEQ ID NO: 1848 - DNA, 447 bp, Hordeum vulgare
ttttttttttttttttaaagaacttgacatctgaactttgtttctgccagatttttccaagcactagaattaatcaacaacacaacactcttgattcttgaggtcacaaaccacaccatgcatttcatttccctcccttaatttcacctatctgagctctgaagtcccaatccttgttttcttcttctttcaacaatctagtactgtattatgttttgtctcttgaacacattcagacaccaatcgcagacagagcatgtcagtcagtcactcactgatcatgagctcctcctttggcgtccggagaatcttcggcggtcttcttgtaggtgtaccagctggcgatgagcaggtagacggcgaagttgacgaggctgagcgcggcgagcagccagaagaagtagtcgaggtgaccgacgttgaggttgtccgggatccacccttgct

SEQ ID NO: 1849 - DNA, 518 bp, Hordeum vulgare
  UNSURE (10): n stands for any base
ggtccatggnaagtacaaacagacggaataacaaagagatgccgacctcatggaatgatggccgagtacatttctgagatctccaagttcgagaagtttgctgctttggtgtctgatccagtagagatgccaaacaatgacgtccgccggctttcctttgaagctggcagtgctgcagatgatgggaaattttcgaagatggatttaagtatagtcctgactctagcagtttcaggaaaaggatgcaaagctattctgaatttcaaaaagtatgagctgattgcagttttggatctgaaagaatgtactaatctggaacacagtcatgtcaattatatatgcaagctggtgcatctgaaatacctgagcctcggggacagtataggggagataccaaaggccattgggaaactgatacatttagtgacgctggagatgagcacaaacaaaacagtgaaggtgtataaagacgtcctccagctacccaagttaagacgcctcattggaaggtttattat

SEQ ID NO: 1850 - DNA, 543 bp, Hordeum vulgare
  UNSURE (501),(512): n stands for any base
ttacaacaattgcatagcaatattgtaggtcccattagctttcttacacaacataataaggacacaacaattgcaatccatgttgcacaatataattaagatacaacaacagcaatcattatttcaccatataataaaaatacaacaatttgcaagcacaagcactcacgtagtttgtgtaaggtaaggtgaacaacgtggtaaacttgatcatgggagacaaaggaaagcaagcacacatgacggtatgtccaaactgaagcatccatcaatgctgtcccgatccttgcagcaagcaagcaaagaagtggctccgtacgttgatgaatacaaacaggggcgagtatacatcatttattaggaagcagctaacggcggctggggaccttgtccgtgcttaattatgcgttgggaggaagcaacagaacggcgggcctattggaatggccctttgcaactctttcccacgctgcgtgcatggcatggttgactccgcattgnagtgcgatttnccttagactttcgaggcatccgttcggaagc

SEQ ID NO: 1851 - DNA, 231 bp, Hordeum vulgare
aatacaactaccggaaatgccacgaaggagactcttttctgcaaataaagaacaaggatgaaagagaatggagagactagagttcggaggctgatttagttcttgaatagcactgccaaaattttctttaacttccttgtcccccagggtgcagagagtttattccagtttgtataatgtgaaatggttgctataggaaatcagtgggtggtatcaaaaaaaaaaaaaaaa

SEQ ID NO: 1852 - DNA, 210 bp, Hordeum vulgare
cccccactgatttcctatagcaacccatttacattatacaaactggaataaactctctgcaccctgggggacaaggaagttaaagaaaattttggcagtgctattcaagaactaaatcagcctccgaactctagtctctccattctctttcatccttgttctttatttgcagaaaagagtctccttcgtggcatttccggtagttgtatt

SEQ ID NO: 1853 - DNA, 910 bp, Hordeum vulgare
ggacccccgggactgcagggaattcggcacgagggtagtctcgagttttttttttttttttttgggaaaatgggccattttttattggattaattttttccgaaaaccccttttttacaaaaaaaagctttttaaggcatataacacaatttttagtttagttaaattttgggaactacatgcgggatttgggaaccaaaaatagtttttctttccgagggagggttagccaaaacacctttgtaatataaaggttttttttcccaaccccagggggaagttcccagtcaaaagggcccacagggttggccaacataagctcaactttcggaattccggggttaataccagggcaaatcctccggcctgttcaaaagggcaaaaacggaaaatctttcccctggaagttgatatgcatagggcggccttaatttgaaaatttttaaggaatgaacttttcggggtcctcccaggagctgggatccttaccaagggcccacgctttgacaaccacacccgtcccagggggaacaatgtttccattgttgatgcattcacccttggaaaggggcggaccagggaaaggaccaccaggttgtccccggagcgacttttttatgactgcttttaggaccgcaatattattaaggggggttacactgaaaatttttggcccttggggaaaaacacccctaacctaatttgggagcttttccataatggggggcctcctcatgagctcacccagggggaattcaaggacgttagctgatgtgtctatcgcaccaaaaaagacatctgtgaggagagctttaatgtgctcttttgtaagagaatactccttgtggaacagataccataattcccacaaatcgccatccttgggatcagaccctaactgccgttggtt

SEQ ID NO: 1854 - DNA, 554 bp, Hordeum vulgare
gaattggtacttatttatttgtcatacttatttccgataaccaccttctttacaaagaaaagcattataatgcatataacacaatatttagcttagtttaatttttgcgactacatgcgtgattttggaaccaacaatagtttctccttccgacggacggttagcccaaacacctctgtcatatcaatgtcttttctcccaaccccaaggggaagttcccagtcaaaatggcacacaaggtttgccaacataagctcgacattcgcgattccgaggttcataccagggcacatcctccgtcctgctccaaatggcaagaactgaaaatcattccccttgaagttgatatgcatagtgctgccttcatctgtaaatctttcaggaatgaactcttccgggtactcccaggagctcggatccctaccaatggcccacgcattgacgaccacacgcgtcccagcaggaacaatgtatccatcgatgatgcagtcagccatggcaaggtgcggagcaaggagaggagcaacaggatgtagccggagcgactcttttat

SEQ ID NO: 1855 - DNA, 381 bp, Hordeum vulgare
  UNSURE (305): n stands for any base
atagacaatgaaactcacaatggcatcctccacctccttactctatcttcttaccggccttcttgctctggcctcatggcacgccactgcatatgatcctagccctcttcaagacttctgcatcgctgatatgaagtccccagcacgagtaaatggatttgcgtgcaaggacccaatggttgcaacctcagacgacttcttcaacccagccatgctggataaggctagggatacaaaggccagcaaggtcaggtccaacgtcaccaacatcaatgtcataaatttccctggcctcaacaccctgngtatctcgctagcacgcatcgattatgggccactaggtgtgaacacgccacacatacacccccgtgccactgaact

SEQ ID NO: 1856 - DNA, 326 bp, Hordeum vulgare
ttttttttttttttttttttttttttttatttgacatgaatccgacgaaaagtatgtcttgtcacggttcaaaaagaaaagaaaaactcgcagcccgcaggcatgcataaatattaattacatgccatttattctatagagtgtcgcatattaactttccaataggtgcaaataacagataatatttagtagttgttgttctcccagaactgagattggagccagtgtattagatccttctccacctgaaacgccgtggccagaacatcatctgaaatcggtggatttgagccaaacactgcattggcaatagaaataaccccagg

SEQ ID NO: 1857 - DNA, 513 bp, Hordeum vulgare
gctcttcactgtcatttttcctacatcctcctccttggcctctatacaccaccaagcctgtcagatagtccacctctgcaagatgtgtgccctatggcacctcagagtgaacggaatccgttcatgaacggttacgtctgcaagcaccctagcaccatacttgcttctgatttcaagacattgcttctcaaccatgccgggaaactagacaacatggtccgttcatctacaaacatcgtcaccgccgccgagttccctggcctcaacacccttggtatgtcgatggcacggaccgacatcgacccctatggcctagtgcttccccactctcacccaagggcgtctgagatgatgtttgtccatgatggcagcgtgctggccggtttctttgacacaaccggtaagctgtttcagaagagactgtgtgagggggatgtgttcatctttccccgtggcttggttcacttcatgatgaactatggttttcgccttgcgacaacattctcggttctc

SEQ ID NO: 1858 - DNA, 424 bp, Hordeum vulgare
ataatttactttaactggatccactatcttcactagttacataattaatcagtaagtccatggaaaatcagtagttttattgtcagggatttccatatctctgaacttcatcattctggccatcagcccctcaactacatctgaatccggtgcaaacatcgcatgggtgattccaaccacaccagggttctggctgttgagaaccgagaatgttgtcgcaaggcgaaaaccatagttcatcatgaagtgaaccaagccacggggaaagatgaacacatccccctcacacagtctcttctgaaacagcttaccggttgtgtcaaagaaaccggccagcacgctgccatcatggacaaacatcatctcagacgcccttgggtgagagtggggaagcactaggccataggggtcgatgtcggtccgt

SEQ ID NO: 1859 - DNA, 516 bp, Hordeum vulgare
gttgatgaagaggggatgagcgtggttattctgaaaagggactacaaggatgagaagattgaggtcattgtcagcatgcccaatatggaaggggaccctgagtttgatgaagatgatgaggctgacggtgaggatgctgccaaggatgatgacgatgaagatgagggcggcgaagacagtagccttgctatgaaggtgatagtctccaagggatctggcccaaacctcgagttcacctgcacagcctttcgtgaggagatcaccattgacgacatgatgatagcagagaaaacagaacctgatgcagagaaattcccctttgagggccctgaattcaccgagcttcctcccaacgtgcagaagggcctgttcaagttcctggaggtacgaggtgtgacgctgacaaccaccaacttcatgcacgattacatgatcaccaagcagaccaaggagtacgtccggtggatgaccaagctcaagggtttggtccagtagtgaggttgaacagatggccct

SEQ ID NO: 1860 - DNA, 545 bp, Hordeum vulgare
  UNSURE (32): n stands for any base
gtcgcgctcgtttaagctaggaagtcttgttntatcgctagtacccacctttctacaggatattttttttcaccggccagctccagaagaacacaaatgaaacttactctgcctagctgctgatacaggcctacagatacacttcatactactggtttcgtggggctcttaccgctcttgctacgcgtgctaaaaggctaggctaacccaaaactgcggtcgagtcacgcggcagggccatctgttcaacctcactactggaccaaacccttgagcttggtcatccaccggacgtactccttggtctgcttggtgatcatgtaatcgtgcatgaagttggtggttgtcagcgtcacacctcgtacctccaggaacttgaacaggcccttctgcacgttgggaggaagctcggtgaattcagggccctcaaaggggaatttctctgcatcaggttctgttttctctgctatcatcatgtcgtcaatggtgatctcctcacgaaaggctgtgcaggtgaactcgaggtttgggccagatcccttgga

SEQ ID NO: 1861 - DNA, 551 bp, Hordeum vulgare
  UNSURE (26): n stands for any base
cgggctgaggaattcggacgaggcangattggggtttaaaggaaaaataaagactttgtggataatcgtttctagatttatagttgatgcatttcccttacggtctatttttattcatcaacttcaacttcgttattggctctctttctttccataggtggtgacattctgggagggggagatagtagatgctaaaaattatactttttttactggcaagtgggaggcatcagcagaggatgatgtaagacactggtccaagttctcatcatttacccctcttctgagtcagattgaggcagatggtggcaagtctgtggaccttagcaactatccctttatatttatgagatggaaagagcagtactttgtcaatgtgggagtggactgtgggttgaccatagctggtttctattacgtctgcttttcttgtagcgatggatccattagtggcttttattacgacccaaacagcaggtaataaataatttggcacagtttacacattgcaagcttaccatgaaatttcttaattaggaagttgctccaaa

SEQ ID NO: 1862 - DNA, 563 bp, Hordeum vulgare
  UNSURE (16)..(18),(42): n stands for any base
ggataagttcataatnnntgtttggtcttgcaacaattcacnttggcacaaccgtacatacataacatctcaactattttaaaggaacatcaggaactacgggtttaatacacacacagtatttgttcatattggcaagcgccgaaagttcccctgtgtaatctctgccacttcaattaatagcgtcatgcatgtcactgcagctcatatgaagaaaaggtgaacccagattgtttctcgttggtgcacttcaattcaagcttctgaaatggactacacaaacagaaaagaaaagatgtttggagcaacttcctaattaagaaatttcatggtaagcttgcaatgtgtaaactgtgccaaattatttattacctgctgtttgggtcgtaataaaagccactaatggatccatcgctacaagaaaagcagacgtaatagaaaccagctatggtcaacccacagtccactcccacattgacaaagtactgctctttccatctcataaatataaagggatagttgctaaggtccacagacttgccaccatctgcctcaatctgact

SEQ ID NO: 1863 - DNA, 501 bp, Hordeum vulgare
aacgcccactccttctcgaaacatccatccagcctcgtcgccggcgacctcacccgccgccgccgccgccgcagaagatgccggtcagggtggtcgacaccgcgaccccttcctcgcagccatcctcaggtcaagatgcaaatgctgtgcagccgtctcctcctagctgttcactcttaactgctggaagatgttttgcaggaactcagaatgtttcaagtttacaaaaagatgaagcatggaaagtcaatgttcgtatccatggttgtgatatggaacagggttatttatgtggaacgatggaggcacttaatgttcccttagccgacacacctgtggtgacattctgggagggggagatagtagatgctaaaaattatactttttttactggcaagtgggaggcatcagcagaggatgatgtaagacactggtccaagttctcatcatttacccctcttctgagtcagattgaggcagatggtggcaagtctgtggacc

SEQ ID NO: 1864 - DNA, 509 bp, Hordeum vulgare
gagattgcaaaaggataagttacataattgtttggtcttgcaacattcactggcacaaccgtacatacataacatctcaactattttaaaggaacatcaggaactacgagtttaatacacacacagtatttgttcatattggcaagcaccgaaagttcccctgtgtaatctctgccacttcaattaatagcgtcatgcatgtcactgcagctcatatgaagaaaaggtgaacccagattgtttctcgttggtgcacttcaattcaagcttctgaaatggactgctgtttgggtcgtaataaaagccactaatggatccatcgctacaagaaaagcagacgtaatagaaaccagctatggtcaacccacagtccactcccacattgacaaagtactgctctttccatctcataaatatgaaaggataattgctaaggtccacagacttgccaccatctgcctcaatctgactcagaagaggggtaaatgatgagaacttggaccagtgtc

SEQ ID NO: 1865 - DNA, 527 bp, Hordeum vulgare
gcccaacctagtcactggagacgagccggagcatgaccaggacgaggatgacaaggagaaagacgatgatcaggatgacagcgagaagcccccaaaatccactcttcccctcacagtcaccatcaccaagagcagcagcggcccaagcctcgagttcacctgcaccgcctatcctgacgagatcctcattgataccttgtccgtgaagcagccctctgcgaacttggaagaggaggacattgcatacgagggtcctgacttcaatgacctcgacgagaacctgcagagggcattccacaagtacctggagctgcgcgggatcacgcccatgacgacaaacttcctgcacgagtacatgatcaacaaggacagcagggagtacctgttttggctcaacaagctcaaggatttcgtcaagctgtagagagtacaagctatgatcctatcataagagacgagccaatgtgctttgcacatcctgtcctgagacctttggggcttcggaactcaaaactgctccgtgttta

SEQ ID NO: 1866 - DNA, 553 bp, Hordeum vulgare
agagcataattatttcttagaaatagaaacactactcaaggaagtatattctatctgaagccctacccaggttttcagctctagcatcacccggtcgtttccacgctgccaaaaaagcgatctaaaacacgacgataagcatgtacatacacattgtcatcgtatactaaacacggagcagttttgagttccgaagccccaaaggtctcaggacaggatgtgcaaagcacattggctcgtctcttatgataggatcatagcttgtactctctacagcttgacgaaatccttgagcttgttgagccaaaacaggtactccctgctgtccttgttgatcatgtactcgtgcaggaagtttgtcgtcatgggcgtgatcccgcgcagctccaggtacttgtggaatgccctctgcaggttctcgtcgaggtcattgaagtcaggaccctcgtatgcaatgtcctcctcttccaagttcgcagagggctgcttcacggacaaggtatcaatgaggatctcgtcaggataggcggtgcaggtgaactcgaggcttggg

SEQ ID NO: 1867 - DNA, 2121 bp, Hordeum vulgare
  UNSURE (1),(12),(21),(22),(44)..(47),(148),(328),(414),(472),(543),(563),(581),(598),(640),(652),(748),(851),(870),(923),(1090),(1303),(1460),(1481),(1531),(1533),(1541),(1591),(1616),(1651),(1654),(1701),(1702),(1725),(1835),(1856),(1919),(1946),(1953),(1999),(2000),(2022): n stands for any base
nttttttttttnttttttttnnttgttttgttggtttgtggcannnntgtgtggagagaaaaagagagaggaaacatggtagatatttcgcgaggagaaagggtgagaaaaaagaccggcccagaaaattttagagagaggggggggngggagtatgaagagacgccccccaaacaatagagggtgcgcctggacacggtatcgcgctcgcgctgtgtttgcagccgcccacgaagttattaccttccggtattcgccagagacgcccgtttaagcgtgcgtattgatcgtcacttatgctagaggacgtgttactgttgtgttgtanggatggcgcgcgagggagccgcgcggcggggacagcgggcgaggacgcggcgaatataaacgcatctcgtttcccgctcactgagngctctcagacccccgtcttttcatctgtgtcattgtaccctcgttggcgtgttttccngatcgttgccgcaccgcgtctttggatacgcaggggagggcgacgtgggtgtatgatttgaggtgggaagntctgggcccgcgcgccggcnaccgcgaggggcgagcgnggcgttggggtcagttntggtgatattgatgcggaagtgagacggaggacaggagtaanatcaccgatgtnttgtcccgcggttcattcgatgggcgcggctagggcgaatcgactacatgtcattgtacaagacaccattacatgaggaggcagaaacgatgaagnaacagtccggtccatatacacactggtcaatataagaacgagaagaacatgacagagggctgtggttggtacgagagctacgcacgaactcactcattgtcgntgacggcatccacgcgtgntgtgccgtcgtagtgattataatatacagacctcaatgtgttacggttctagngagtgaagcagcgcgacactcgagaagttgatatgctaacgacgagaagctataacacagtactgtagtaaacagtcatttagaagaagtatttgtaatacgtaacagttgagacagacgtgtacaggaaacgaccaccgaaatctggtatacatatccggattaanttctctgcgttctgcgacgtacattcgaacaacgtacttctggtaaaggagtacaggtaagtgaatatatgtatgtaaacaacagctcgaccgagattgaggcgcagaattatccttctcaccaataccgaagatagctcacagtatatagccgtgtacgatgtacgcgatggtacatagcggcagtacagcgtaggactcacctcttcgatnttacgctagtaattaagatatagagtagagacagaaagacacgaccaccgccaattagagatgtaacggctatatgcctgtccagtattgtgaagataacgtgataagagaagaataaatatacatgaaagatcatataatagcaatatagtgtcgnagagagtaatatatcgcatcntatggcggcataatgatacatcactgatatacgaatagtacgtatagtcnantgatttgnatcgaattattatagagcaatatatcggtatagaggtgcgagcataatanatatataagacaacgttgacacccngtaacacaccgagttattgagcactccagcatgcngantatctacgagacttatatatccgaatacaacatgaacgccgtagagnntgacgtatcagtgtacaagtaangtgtgtgtgaagcgaaaactataatataacgacagatgataaataaggtagtatcgccccacgcgcgtgagagtgattatacggagtatagagagcagcagagaaagtantaacttgttaaagatggatancccacacatataagcacccgacagagaagaggtagtatctccggcggcgacaaatgcagaaantgtgtagcatcagagtcgccgcgcaantatcttntaggtcgggtatagcacgaaagtatttttcgttagcagtttcgggnnttaaacgagaacaaatgactanctgaaacatttaaaacatgccgccgatcaaaagcgtttaaatactatccggacgcggcgaaatactatgaaagacggggggtgcgcgaaggaaaagaag

SEQ ID NO: 1868 - DNA, 550 bp, Hordeum vulgare
  UNSURE (17): n stands for any base
tgcacacttttttgagncaagattgttatctaactgatcttgggttctacattattgtcatgccgatagacatcaaacaagttcacatcgcccatttcagcgtaatgcgattatggaaatggaccatggcctaaaactcagaatacacgcacccaacgcgcaagtgcagcattgtaaccaccacttcgaaattacatgtcccttctgcatggactactccaagcatttttacatgataagacacgtccattgggaattttatttcaggcggtggtggcaacgagctccatcataatcaatgttcgaagggtccggctgacagatcgtttctatcttgttggatcacccttaaggaggtcttccactgaggtcttgtattttgccatcaaatcctttctttgatcaagcagctgtcgtgtttcttccaaactttgcatttgtccttcaaccgtttttaagtgactggctggtcactactctaagtgcttggacaggattcactggtgtagagtgtagacccataagaattatgtcatctttcacaccgcaa

SEQ ID NO: 1869 - DNA, 1009 bp, Hordeum vulgare
  UNSURE (1),(2),(16),(20),(21),(24),(28),(29),(32),(33),(36),(37),(47),(48),(56),(72),(74),(154),(155),(493),(888): n stands for any base
nnaaaatcaaaaaacnaagnnttncaanntgnnggnncattatacgnntgttgggntcttacaaaaacccgngnttgcctggtttttatgttggggggtcccaaaaaaacaccgtccgtttttgtttttgttgtgtttggtgcccttttttcgnnttgggggggtgctcctctccttcttgttcttctcctttcctctctcttcccgtcctctcctctgccgctgttctttctctccttttttgttttttccccctccttcggggggggcggtccccccttttttttctcttttctctccccccccttttttcttttcctttggggggttccccctctccttccctccgcgtgttttttttttctttcccttccctcttcccctctcctctgctctcttcttcccctccttcccccctcttctttttctctccccccctccctccccccttcttctctcttttctgtctcttcgcctcccctcccgcccctcntccctctttccttcttttttcgtctcttcttccttctccgttctcttcttttccctttccttttttgttctctccttcttcttttctcttccctctttttttttcgttctcctcccgcgttgtcgtctccttttttttcctccccttttttttttcttctccttccctctctccctcctctcgtttttcctcgtccccccccttcttcctctcgttttcctttttctctttttctccccttccttttttttcctttctgtctcgtccccccttgtcttcctcttctttctctttctcctctttcctctccctttttccccctttccttttttttctctttcttcccgttccttccccttttttctttttctttttccttcctcttctttttcttnttcttccctcctttttccttttttctcctttcggtctttcggcgcgcgttctttcccgtcccccttttttccccctctcccctttttctctttgtccccctgccttccccctccgccgctc

SEQ ID NO: 1870 - DNA, 552 bp, Hordeum vulgare
caaataatgatttttacttacctcacttcacaaattaaatgtgggttgcacagtacatgtctaacacaaaaaagattatgggacttaaaaatcacttgaaagacgcaacttcgtcactgaaacgtgcaatgacgtcagcaatgctctctgtggataggtctgccttgtctcttaccctcaggacgacctttccagactctgcctcttttgcgcccacgactagaatatagttgaattgggctaactgagcctcccgcaccttcttttgaattgttctatcagtcatgtcaatgtcaacatgaaaaccagctgcgtgtatctgagcatgaacctcttttgcatatgctagtgaattggaagatacacagcaaacaatggcttgtcgggggcttaaccacaacggccatttaccattatagtgctccaaaagaatggcaaacatcctttcaactgatcctagtattgccctgtgtatcattacaggcctctcaagcttggcttcatcctctgcagaataagtcaacttgaagcgaagtggcagctgaaaatcga

SEQ ID NO: 1871 - DNA, 516 bp, Hordeum vulgare
atgaagtcgtcaggaaatgaagggcctgatgttccacatttgagccagatgcacctagatcaactgccatcgagatgcgaccattttgctctctttgccaggattcggattccaaaagtccactctgctgtttgattcgccttcaggctgctctggaaactatgatggcagagactgctgaggatggtcagaccccaagatcagttgcagagttcgcttccaacatactctcccatgtcggttccacaggctcgttgaagtcgccagctgttgaagttcttgaggataaactcagggcggaaagacggggtgcggccgcgctccgagaagaaatcgacgccttgaagaagcaggcagaaaaggccgacgcggtcattgccaaaacccaagaagagatggaggaagtcaggaagaagcaagccgagacagaccaggttcttcagcttctcctgcgcaggtctcagggtaaccccggttcttagtctctgttgaaactgtggttctactggagtatgt

SEQ ID NO: 1872 - DNA, 551 bp, Hordeum vulgare
cattttaacctcgcattttatttaacatatacacaagatacgaagtttttcacacaacaataaactcaaacaagttcgacatactccagtagaaccacagtttcaacagagactaagaaccggggttaccctgagacctgcgcaggagaagctgaagaacctggtctgtctcggcttgcttcttcctgacttcctccatctcttcttgggttttggcaatgaccgcgtcggccttttctgcctgcttcttcaaggcgtcgatttcttctcggagcgcggccgcaccccgtctttccgccctgagtttatcctcaagaacttcaacagctggcgacttcaacgagcctgtggaaccgacatgggagagtatgttggaagcgaactctgcaactgatcttggggtctgaccatcctcagcagtctctgccatcatagtttccagagcagcctgaaggcgaatcaaacagcagagtggacttttggaatccgaatcctggcaaagagagcaaaatggtcgcatctcgatggcagttgatctaggtgcatctggc

SEQ ID NO: 1873 - DNA, 424 bp, Hordeum vulgare
ctgcacctgcacccacatccgccattcgatttcctttgctcctatccatccgccacaagacaccacaagccccgccgcctccgtcgccgtcgtcgccgcccgatccagccgcccgccggcccgccagcccccacgcaccgggtcagggaacccgcctgcaaagagataatcgccatgagctcgctctgcccgttcgcgaaggccaccaccggcggcgtgtgccccatgaaatccgacaagaagcccgacaagagcggcggcgctgctgcgtgccccgtgacgggcaagactcatggcggcgaggacaaggagaccggcgccgaccgcgccgccgccggagaagagggcgcagaaggggaccctcgcctggtgcctgcaaagtgccccttcggctacgactccaacaccttcaagctcgggcccc

SEQ ID NO: 1874 - DNA, 328 bp, Hordeum vulgare
acgggaagtgtttgcattccaagcgcaacaacaaggagcttcagacaagtttcgccttcacccatgttgtttcgggtttgagagagaggaccgcagggcagctagagcctgagcatatgttggcggcagtgaagataactctcctaggatacgtacaacacggcctttgttcgcgtttgtgccgcggcagaattcaagtgattggaattacacacaagacaccatttctggagcacctccctcctcccttatgcaccacaacaacttccatattgcaacacaacaacgatgcggctgaacctcgttatggatagtgcacgctgggccc

SEQ ID NO: 1875 - DNA, 520 bp, Hordeum vulgare
gggacttcccccgtgtcaaacgtcttcagaaactgtgcctactactggacctttggagcctacattgcctactactgcaaccaccctctgtacacccccgtgagtgacctgcagatgaagattgggttcggcatcggggtcgtgtgccagatcgcaaacttctactgccacatcctgctgaggaacctcaggagcccgaccggcagcggcggctaccagatcccacggggcttcctgttcaacatcgtgacatgcgcaaactacaccaccgagatctaccaatggctcgggttcaacatcgccacccagaccgtggcgggttacgtcttccttgccgtggcggcggccatcatgaccaactgggcgcttggaaagcacagccgcctgaggaagctgttcgacgggaaggatgggcggcccaagtaccctcgccgatgggtgatccttcctccattcctgtgaagaagacactgtgcttgcaaggctggtatctagagattcaacatttattctgttccag

SEQ ID NO: 1876 - DNA, 546 bp, Hordeum vulgare
  UNSURE (41),(44),(45),(56),(57),(75): n stands for any base
ggaatgatggtaaagcatcggaatgggcaatatgcttgcantcnntcctacggttnncagaagcacggaacacgnggccgacacatatcagatgaaccatcttgaggttggacttgactatgacaacacgacgcgacaaaccccagagaatttttttcaacaataggataagaaaatacatccttcggataagaacatttgggctacataattgaggtttgacagctggtacagggcacgattagtaggaatgtttgcgtgaaatcgaatgatggctttcaacttttgaacactggaacagaataaatgttgaatctctagataccagccttgcaagcacagtgtcttcttcacaggaatggaggaaggatcacccatcggcgagggtacttgggccgcccatccttcccgtcgaacagcttcctcaggcggctgtgctttccaagcgcccagttggtcatgatggccgccgccacggcaaggaagacgtaacccgccacggtctgggtggcgatgttgaacccgagccattggtagatctcggtg

SEQ ID NO: 1877 - DNA, 527 bp, Hordeum vulgare
atcagatcagagacacttagcagagcagataaccaactcgagggagatgtcgtgctgcggaggcaactgcgggtgcggatccggctgcaagtgcggcaacggctgcggagggtgcaagatgtaccctgggatggacgagggggtgagcaccaccaccacctcctcccaggccctcgtcatgggcgtggcgccctccaagggcaacgggccctcgttcgaggccgccgccgccgagaacggcgggtgcaagtgcggccccaactgcacctgcaacccgtgcacctgcaagtgatcagtcgaatcaacacatggagacagcatggatggatggacggacctgacgaagaagcactacagtacgagtagtagtagccatccatgaatcgcgagtgtgtgtttcgtttttaattgccacctactagaataagacgggatctatcgtatcgtaatcgtatcgagctagtcaacggattatgtgtacgtaccccttgtggcttgtacggtgttttgtgttgtgttgtcatgtg

SEQ ID NO: 1878 - DNA, 557 bp, Hordeum vulgare
  UNSURE (535): n stands for any base
tcgcaaacacaataaaataattacttgttatacaaatatatcaataataatttcatcctaaattataatagacgggcgcagcaacgcgcgcctttcatgatctagtatgtagataagacgggaaaggcacaccaggacggaactaaagcggcaggagaagcacatgacaacacaacacaaaacaccgtacaagccacaaggggtacgtacacataatccgttgactagctcgatacgattacgatacgatagatcccgtcttattctagtaggtggcaattaaaaacgaaacacacactcgcgattcatggatggctactactactcgtactgtagtgcttcttcgtcaggtccgtccatccatccatgctgtctccatgtgttgattcgactgatcacttgcaggtgcacgggttgcaggtgcagttggggccgcacttgcacccgccgttctcggcggcggcggcctcgaacgagggcccgttgcccttggagggcgccacgcccatgacgagggcctgggaggaggtggtgngtggtgctcaccccctcgtcca

SEQ ID NO: 1879 - DNA, 489 bp, Hordeum vulgare
atacgatcagagacacagagcagagcagataaccaactcgagggagatgtcgtgctgcggaggcaactgcgggtgcggatccggctgcaagtgcggcaacggctgcggagggtgcaagatgtaccctgggatggacgagggggtgagcgccaccacctcctcctcccaggccctcgtcatgggcgtggcgccctccaagggcaacgggccctcgttcgaggccgccgccgccgagaacggcgggtgcaagtgcggccccaactgcacctgcaacccgtgcacctgcaagtgatcagtcgaatcaacacatggagacggcatggatggatggacggacctgacgaaggagcactacagtacgagtagtagtagccatccatgaatcgcgagtgtgtgtttcgtttttaattgccacctactagaataagacgggatctatcgtatcgtaatcgtatcgagctagtcaacggattatgtgtacgtacccct

SEQ ID NO: 1880 - DNA, 557 bp, Hordeum vulgare
  UNSURE (21),(29),(30),(100): n stands for any base
gcagatatgttttcttatgtngatttatnnctttaatctttatgatagaaacaagacacatattacgagataaaaaagaaaaagacagaaactccaaatntattattgtctacatacacaggagtatatatatgtagataagacggggaaggcacacgaggacggaactaaagcggcaggagaagcacatgacaacacaacacaaaacaccgtacaaggaacaaggggtacgtacacataatccgttgactagctcgatacgattacgatacgatagatcccgtcttattctagtaggtggcaattaaaaacgaaacacacactcgcgattcatggatggctactactactcgtactgtagtgctccttcgtcaggtccgtccatccatccatgccgtctccatgtgttgattcgactgatcacttgcaggtgcacgggttgcaggtgcagttggggccgcacttgcacccgccgttctcggcggcggcggcctcgaacgagggcccgttgcccttggagggcgccacgcccatgacgagggcctgggaggaggagg

SEQ ID NO: 1881 - DNA, 499 bp, Hordeum vulgare
gggcaaatatgttgctggcactgctaaagattgatggccaagcctggtggaggcgcaaatggctttccttgttgcgtaacagggaacttccggaggtaattgaggctctttgtaccctgccaggcgttggtccaaaagttgcagcctgcattgctctgttctctcttgataagaatcaggctattcctgttgacacacatgtctggaaggttgctacaaagtatatgttgcccgagctagctggcaagagcctgactccaaaactgagcattgttgtcgccgacgcatttgtaaccagatttggcgagtatgctggttgggcacagaatgttctttttattggccagctacctgctaaaaaacttgtggccgccgaagttaccagtgacaccacgaaacctaccaagaggaaacgtgggacaaagatggttgaaatacagacataggagagcatggatagtaaggaaaatgtcaaagaatgtctgagctatgttcagcg

SEQ ID NO: 1882 - DNA, 539 bp, Hordeum vulgare
  UNSURE (12),(21): n stands for any base
gtttttgggggnaactacatnatttacaacacaagtgctcagaattcctcactgccatttggctaacaatacaataataccctctacacatcccttctatgtaggatgtggtaggccagttatacaataaaatctgatgtggtaggcccccctctaaaactaagatcgggacgattactcatgatccgtcatcagaagatgttaataattcattgattaacaaagacaaaaaagaaccttccaacgagttcagaggattgccttgaatggctggaaacatatcccagcacttcctttcaacgggattttgggtaatacatgcgctgaacatagctcagacattctttgacattttccttactatccatgctctcctatgtctgtatttcaaccatctttgtcccacgtttcctcttggtaggtttcgtggtgtcactggtaacttcggcggccacaagttttttagcaggtagctggccaataaaaagaacattctgtgcccaaccagcatactcgccaaatctggttacaaatgcgtc

SEQ ID NO: 1883 - DNA, 399 bp, Hordeum vulgare
ggaagggtcacatcttcacttagatagtagcacagcggaaggcaattcttcactcgcaatggagctggatggagtacgagaactggaacacctctttcaaattcagtcgctggacctgattctcaaagatgagtgtgtacatatgcttgccttaagatggtctcaacatttctgtgaagactatagatctcgcaagtatagaggcatcctcttttctacccctgcggtcccattcaggctgatgcggttaccacctgtctaccaagttcttctagaaagatatgtcaagatgcattgccctgattgtggttcagtgcctgatgagccagctttatgtttgctttgtggcaagctatgctcacctagttggaaaccatgctgcagggccggtaatgccta

SEQ ID NO: 1884 - DNA, 280 bp, Hordeum vulgare
ttttttttttttttttttttttttttttttgacgccaaaagctaccagcttaattagcctacactgcttgcaaatagtttcccacggcgaacttcagaccaatgaatttgtacaatgtgaacagtacaaccaaccatccaatcacagcctaacagaacgaaaaacaaagacaaaagggacatcataggcaccactgtacattgtgcgcgagaacgaggtctgaagcagcgaagcatggctcgatagtctggcagaatccgcgacaccttaggaatggatg

SEQ ID NO: 1885 - DNA, 526 bp, Hordeum vulgare
attatcttgtatacagagggtatcaatattgccgaatagatggaagtacaggtggagatgatcgtgacgcatccattgatgcatttaacaaaccaggaagtgagaagtttgttttcttgctttcaaccagggctggtggacttggtatcaaccttgccactgctgatgttgtgattctttatgatagtgactggaatccacaagctgatcttcaagctcaagaccgtgcacataggataggtcaaaagaaagaagtccaagttttccgattttgcaccgagtataccattgaggaaaaagtgattgagagagcgtacaagaagcttgcattggatgctttggttattcaacaaggacgattgtcagggcagaaaactgtcaataaggatgacttattgcaaatggttagatttggtgcggaaatggtgttcagttcgaaggatagcacaataacagatgaggatgttgacagaattatagctaaaggagaagagacaaaagcagcgctggatgcaaaaatgaaaaa

SEQ ID NO: 1886 - DNA, 224 bp, Hordeum vulgare
tattcaatgttgaaaccgatcctgatgcacccactacaggtgtccccgcaacacaagcattaaacttacttggatagagatttaacctaaccgacgattcatcaagcatatactacactaagataagaggcttcaagcgctggaagaagccgagcccaaagcgtctcctgacaaggcaacaccggatggatcacccacgcctacgcctttcccttctttcccga

SEQ ID NO: 1887 - DNA, 518 bp, Hordeum vulgare
tgacaatgataatgatggccactctcctcgacgttttgcacaggcagaggaagctgaagaggacgacgaaattgagcggctctttaagggtggtaagaaaaagaagaagaatgaccgaccacgtgcagatattggtcttatcgttgaacagttcattgctgagtttgaagtagcctccgaagaagatgcaaacctaaatagacaacataaaccagccattaacaaactcatgaagcttccactcctcatagaagttctctcaaagaagaatctccagcaggaattccttgatcatgggatactcactcttctgaaaaactggcttgagcctctacctgatgggagcatgcccaatatgaatattcgatctgctgtactgaagttactatctgatttcccgattgatctcgagcaattcgacagaagagagcagctcaagaaaagtggcttgggaaaggttattatgtttttgtcaaaatctgacgaggagactacttccaacagaaaattagccaagg

SEQ ID NO: 1888 - DNA, 554 bp, Hordeum vulgare
tctgtttattggcgccatgtttcgattaaattgcattcaggcccttccaatacaagtagagatgtatgaaaagccagtcaaacttaaaacttacagcccaatcaggcgcccttctcaaacatgacaaacatttgtacagtaaaaggcaccatgctgtcatcgtccacaataacggtattatatatgagcatctggtaaataacccaaatcaccaagttttcggaagctcgcccaatgtaccctgccaggctaatctacattagccaagaaattccatttccaccgatcttgttgccctccgatggccatggtggaagagtgcttgatactgcttcagcagcacgctgctgagcgcacgccatcatgtccattgcaaggctgtcggggtgtctagcttacaagtacttgaccatcccacggccttcgacactaagctttgaagcctgaaggtttttcttctttggcgctttcagctgctgcagtttcttgttcatcttcagccgacgctggtcttgaacttgttgcttagcacgagcccgtatctggtcgggatc

SEQ ID NO: 1889 - DNA, 517 bp, Hordeum vulgare
tacaagtctatcgtaaatgatctggatggcattcaagatgctgagcagagtttgtctacttcaaatgtcacagctggctccaagacaagcacaagccctaaaagttctgttctgggaacgtatgttacttgtctttcaacgaaataccgtctttcttctttctgtgatgtagcctccaaatcttctgcccctgtaacaataagaaacagatttggtcctgttgattgtgatggcatccacatctcttcttgtggacatgctgtacatcaagaatgtcatgatcgatatttgttttccttgaaacaaagatatatcaggagactcggttttgaaggaggacatattgttgatcctgatctgggagagttgctgtgtccagtgtgtcgcagatttgcaaattccattcttccagcatcgcccgatttctctggtataactaggaaggcgatgccaattgctcaaaccacgcctactgaggctgctgcaagtatacataacttacagtcccctcgtgcac

SEQ ID NO: 1890 - DNA, 493 bp, Hordeum vulgare
acaatgtgaacagtacaaccaaccatccaatcacagcctaacagaacgaaaaataaagacaaaagggacatcataggcaccactgtacattgtgcgcgagaacgaggtctgaagcagcgaagcatggctcgatagtctggcagaatccgcgacaccttaggaatggatgcaattcgctatcactggaaagcatgaatatgaagctagacgacagttccagaaaatatgcacatcacatgatcctttgggcattgttcctcaaaacaatgcgcttaatcagatgtataaaagctgatagttgtttgccgcagaacttcagaagtccggtcaaggctatgagatgccaccagatatgtgagggctgcatatctttcttggctaagatataaaggctttcctctgtgcatttcatgatcctcctcaccgaaggcatcaaggtacagagatggccaaaatgcaagacgagccgatcgttgcaacaggattgttgttt

SEQ ID NO: 1891 - DNA, 464 bp, Hordeum vulgare
cggctggttcgggttcatctccgacgccatggaggtcgtgctcaagattctgaaggatggtctctcagcagttcatgtgccgtacgcatacgggtttgccatcattctgctcaccatcgtcgtgaaggctgcaacattgccgttaacgaagcagcaggtcgaatcaaccatggcgatgcagaatttgcagccacagctcaaggcaattcaggcgagatacgcaggcaatcaggaaagaatacagcttgagactgctcgtttgtacaagcaagctggagtcaatcctctagcaggatgtttgccaactttggcaacaattccagtctggattggactttaccaagccctttcaaatgtagcaaatgagggtttgttgacagaaggatttttctggattccatctttgggaggtcctacaacaattgctgctcgtcaaagtggtgctggcatttcatggctctttc

SEQ ID NO: 1892 - DNA, 550 bp, Hordeum vulgare
ggactatttgtacgatttgcatacacatgtactcccaatgttattaggttacagcaggagggataggaaaaatacacattgtacaaggcacgcaattcctgcctgatttacgagcccgccttacagaacagcacaagaaagtttatgtacctcttctctacatatcctctcctcggatggaacaggcttgcctgatccattaacctcgcgatcctaccgtaatgtactgcgctgaatgtacccaactattttcatcttacagctttccaataaacacctgtagtaagaccttgtctacccccatctgaagatctggcctcccatgcaggtgaccatcaaaattgtaatcgagaccatctacggcggctcaccggtcaactgaattaaccagtgttgacaaaaatcaagtccaattaggccgtcacgttactgcacaatgcgcttcctctttgaccttttgcccttctttccagaataagtagggagcttcttgtcgttgccggtagtgaatgtttcctctacgggtcctccctcctctgcagtatcatcg

SEQ ID NO: 1893 - DNA, 517 bp, Hordeum vulgare
gattttactcgtgcagcccaagcatgcagcattgatgattttaatgcatcaattgagagcataaggaatatatccactgaagctgctgactggatcattgcgagtaagccagagcattggtcagacgccatcttcagaggctgtcggtatgaccatttctcgtcgaacattgttgatgcgtttaataactggataccaacaaagagggaggggtcgatggtgctgatggtagactctctgaggacaaaaataatggagacaatagaagcgaggcgtgaagcctgcaagtcatgggaagggcctttaacaccttccattgaatacaaagtgcaggatgagatttccaaggccggcaagctgaccgtgctatgctcttctgagaccgtgtttgaagtgcggggcaacggtatttttgttgttaatctcgcgacttgggagtgcacctgccggaggtggcaactttctggcctcccctgcatgcatgttattgctgtgtgtaacagggttgggcggtcgt

SEQ ID NO: 1894 - DNA, 550 bp, Hordeum vulgare
atgtagcacatttattaatcactcatctctagctaaccaccactactaaagaaacctatccaagttaccagccttcgtatcatataaacaaacaacaacggtgtcaattcatgcatgtcttctacagtaattacccatcccccttctttggttctctccatctactgtacatacaacaggcaccaccatgagctctctctctacttcttccttcttttgccgggaagccttctctttctctcttcctattttcgctgggaagctctctctttcatcagccgcctctgggtgaacctgctatacatactgcagataaagaaattcctttgtctacagaaaagcagcttcacaggtggccttgttgtgccctacttgcttgcacctgctacagagccgtataagagtggttgtcttgttggggttaaaccgcttccttctcggtttatctgatgcccgtggcctgggaggcgggaccattgccgcagcgctaaaatcaaaggtgtccatgtcgggaattgggtagattgttcctgagtatgtctcacggtag

SEQ ID NO: 1895 - DNA, 938 bp, Hordeum vulgare
ggtcccccgggactgcagggaattcggcacgaggggagcttcagcctcgccgccagggacggcaaggtctgcctcgtccgcaccgatcgcgacgacgacacgcagcactggatcaaggacatgaagtacagcacaagggtcaaggatgaggaaggctaccctgccatggcgctcgtcaacaaggccagcggagaggctctcaagcactccctcggccagtcccaccctgtaaccagcctccttgcttcagctcattcatccattcattcatctttaattttgctatccgatgcatgcgtgcacggtggatcttagtacatggttttggcaaatttagacatatctctatatcagagcatctgcaagcacatcacatgccacacattccaaatgcccactttctctgcattcttctgcgtatgaaaaacagaattggcaaagcttgagtgaacaaaagcactttgagcttattggcggtgtgacatgtggtattctcagtgaataatcactactaggatttaatgattttttgtctggaatgatataaactagtccagcatgagttataattctccctgttcttcggaataatatttgcctagtactaggtgtcatgttcagcaaacgtttcgaattttgtcagtgtcaaaaacttgaacctgcaaacggtgtttcacattaccatccacgcaagaccataactataacaatacttccacgcgtgtcattttcagcaaattttggtagaaaaaaaaaatccaagtgtgccctgctgggactgggatctgttatggccctccacgattagtaacccctgcagtgcagctcctctagtatgggggaaattgctcaccttctgggtttgtttcttggatcctagggtcttctggaccaggtcaatccagaacctggggcacagttcggtccttttgacccaa

SEQ ID NO: 1896 - DNA, 554 bp, Hordeum vulgare
  UNSURE (10),(21),(29): n stands for any base
tttttggttncacaaactgtncacatggncatgtatatatatatgcataataacaagcactggtttgctcatgcatccatcacacataatctaggccaataaaaccaccattacaagttcatcaacatatatatgtatatataactcctcaaacaaaacagaaacaccgctcacatcgacgccatcctttttattccagaaacattcagtacttgcttattattaagaccgcgcgctgtttgaaccaacaaacttcagcatatgcatcgttcaccaggcaacgatcttccagcgctggttgtcgccctcagtccactcccacagaatgagggtggttccatcgcgcacaccgccatggtccttgtcgccatggagcgcatcaaagttcaagtagatgttgttcaccatcctgatgcagcggtagcctgccccaacatccctgctctcggtccaaaggaccgactcgtccagggtgtctggattgtacctggtcagaagaacctaggatccaagaaacaaaccagaaggtgagcaaattcaccatactagaggag

SEQ ID NO: 1897 - DNA, 564 bp, Hordeum vulgare
  UNSURE (42),(46),(48),(49),(59): n stands for any base
gtccccccgggcctgcagggaattcggcacgagggccacggncggncnnggcggcgggnatgggcgctcccctggcgactcatggcagccgacgtacagggtcttctgcaaggccggggaggagagcttcagcctcgccgccagggacggcaaggtctgcctcgtccgcaccgatcgcgacgacgacacgcagcactggatcaaggacatgaagtacagcacaagggtcaaggatgaggaaggctaccctgccatggcgctcgtcaacaaggccagcggagaggctctcaagcactccctcggccagtcccaccctgttcttctgaccaggtacaatccagataccctggacgagtcggtcctttggaccgagagcagggatgttggggcaggctaccgctgcatcaggatggtgaacaacatctacttgaactttgatgcgctccatggcgacaaggaccatggcggtgtgcgcgatggaaccaccctcattctgtgggagtggactgagggcgacaaccagcgctggaagatcgttgcctggtgaacgatgcatatgctgaa

SEQ ID NO: 1898 - DNA, 573 bp, Hordeum vulgare
  UNSURE (45),(46): n stands for any base
taataacacagcacttggggtttgctcatgcatccatacacattnnatctaggcacataaaacaccattacaagttcattaacatatatatgtatatattaactcctcaaacaaaacagaaacaccgctcacatcgacgccatcctttttattccagaaacattcagtacttgcttattattaagaccgcgcgctgtttgaaccaacaaacttcagcatatgcatcgttcaccaggcaacgatcttccagcgctggttgtcgccctcagtccactcccacagaatgagggtggttccatcgcgcacaccgccatggtccttgtcgccatggagcgcatcaaagttcaagtagatgttgttcaccatcctgatgcagcggtagcctgccccaacatccctgctctcggtccaaaggaccgactcgtccagggtatctggattgtacctggtcagaagaacagggtgggactggccgagggagtgcttgagagcctctccgctggccttgttgacgagcgccatggcagggtagccttcctcatccttgacccttgtgctgtacttcatgtcctt

SEQ ID NO: 1899 - DNA, 487 bp, Hordeum vulgare
cacagcagcacagccgagttgaccagcgcagatttgctccatctccatctccggctcccagatcgagacgccgccggcggcggcgatgggcgcgcacccctacgtgccggtgagcctggacctcccgggctacgtgccgctgcggctcacccagctcgagatcctggcggcatacctcggcacctccctcttcgtcgtcgccgccgtctggctcctctccgggagatgccgcaggctgtccggggccgaccgcctgctcatgtgctggtgggccttcaccggcctcacccacatactcatcgaggggcccttcgtctttacccccggtttcttcaccaagaccagccccaacttcttcgacgaagtctggaaggagtacagcaagggtgactccaggtacgtcgccagggacaccgccaccgtcaccgtcgaaggaatcacggccgtgctggaaggccctgcctcgctgctcgcggtctatgcgatc

SEQ ID NO: 1900 - DNA, 555 bp, Hordeum vulgare
gtactgcataccttggtttacgacaatggtcgtttgtaaagggtacaatgcaatacaagcaagcaaatttctggtggtaaaacaagaatttcagtgtgtcctggttgcagccaaaccctatctgccagttgcaggaattacttagtcttgaccttctcgctttggtgaaccgccgcgcagatcttgttccagctcctcctcgcgatcagcaacgggatcacaacccacgaactgtttgcgccgatgaaatatgcccagaagtagaacggactgatccagaagttgaagccgtccaagtaggcggtggtgaagtagacgatgcatccgtagagctgacccaggcacaccgcgaactggaggatatggctgtacgacttgcgcgacgcgatcgcatagaccgcgagcagcgaggcagggccttccagcacggccgtgattccttcgacggtgacggtggcggtgtccctggcgacgtacctggagtcacccttgctgtactccttccagacttcgtcgaagaagttggggctggtcttggtgaagaaaccgggggta

SEQ ID NO: 1901 - DNA, 512 bp, Hordeum vulgare
ctggttctgtggaggatgaacatgacataatcaccctgcagtacacagaggagggcttactgaccatcgatgagaacagggatgggcgtgcggctgcgtttggtgatgatattgccatcgagtgcctcgccaccgagttcaagagagaagtttttgtggtgcaagcacatggcactgatgcgatggttgatgaggataactgcgtgttcttcctcccgcacctccctagaggagaagtctgtgatgtgcccatctttctattcatgaagggaacagcatggtgtggtgctggtgcggaccattacgagccattgatcgccaccgtcctccagcatgttactccagacaaggcagctgttgtactttgaggaagggtggttgttgttgtagtctttagtcggcgatgcagtcgagccaattttgtcaccggagctagagtgccgagttgtggagcaacatctatgcccaagaggagagatggtctgtctaactgcgcatttgtatggcgtttt

SEQ ID NO: 1902 - DNA, 546 bp, Hordeum vulgare
caatcttcattggcattcatccgttattacaagtaccagttgtgcacatgtttgtgaacaaagctagtacaagaacatgggctacataggaaagctgtctagaagaaatacctcaccccaacgccaaaaaaatatcaatgaatcggttccattccgactgtccgagcatatgcttgctcctacgagcaggcaaccaacaaaaggagaatccctcacaaaaagaatcaaatggaaaatgccggccaacaatggcgcacaacaacaagaagctagaaccggtgtttctatcactcgctcaatctctagcagcagtcagaacctaccataccacgaacatacaacaacaaaaaacgccatacaaatgcgcagttagacagaccatctctcctcttgggcatagatgttgctccacaactcggcactctagctccggtgacaaaattggctcgactgcatcgccgactaaagactacaacaacaaccacccttcctcaaagtacaacagctgccttgtctggagtaacatgctggaggacggtggcgatc

SEQ ID NO: 1903 - DNA, 518 bp, Hordeum vulgare
gtcatcctgtggcctccacctgcggcttcttcttcggctccggcgccggctgctgcttcctccgagatgcttctactgttcggcatcaccgaacccgcacctccggctccagcggcagggggttcagcagggcgggattccggcgcggatcgagccccctcctcctacgctcctcgtcggcctctcctccgtctcgtcgttacttccgacaagcactcgctggcggcggcgtcgcagcagctgacagcaactactgcttgacggcaaaagacatacgatgtgttgtgatggacatcgagggcaccaccacccccatctccttcgtcgccgacgtgctcttcccctacgcgcgggccaacgcccgcgcccacctcgccgccacataccacaccaaacagacccaagaagacgtcgccctcctccgtgcccagatcctccaagacctggccgacggggtccctggcgccgtcgcactcccaccgtccgacgacgccgaccaggacaagaccatcgacgcc

SEQ ID NO: 1904 - DNA, 288 bp, Hordeum vulgare
ttagtaccggtttttgattaataccatatgtgtctgcttttaggaaacctgctgataacgagtcatggttttacaaaagggcgagacaattgtaccgactcttgtggttgtaacttgagctgtcaactgatctagcgtacacggtaaaaaagagagctttgatggttccttttgtaaataacacttgtctgcatatggcaggggtgagttcgttgtggcattcaggtggcgatttgagcaaacgacgtgatggtctggaagccgtgatcctcagggagcggcgcgttc

SEQ ID NO: 1905 - DNA, 528 bp, Hordeum vulgare
  UNSURE (3): n stands for any base
ggnaattctgcacgagggcgccttcgccgccgacgcgcccttcctcgtcgcgcacaagaaggtggccctctcccgccccaagcccggcgtcgagcgcctcgccgtctccctcgacctctacaaccagggatccgcaactgcatatgatgtggccattaatgacgactcttggcccaaggaagcatttgaacttgtctctggagaggtctcaaagactttggaaaggcttgaacctggtgccactgcttcgcacgcgtttgtattggagagcaaaacacagggaaggttccaagcttcacctgctgtcatcaagtaccgtgttgccacaaaggctgcacttcaggaggcctactcaactcccatccctgcccttgacattcttgctgaaaggcctccagtgaagaagtttgaatgggctaagaaacttgttgcgaagtacggagcactggtgtctgtcgtttccttcgttctgggcttcatctacctggtcgcgagcccatcgaaatcttctggctcaaagtctggcaa

SEQ ID NO: 1906 - DNA, 556 bp, Hordeum vulgare
  UNSURE (34): n stands for any base
taaccacaaattattagtggtcaactttgctgcntagtcgctccattacattacaggttcatggggtgttgtaacctcagagacttttttcatcggctatcaagggtctctctccatgcaaacggccagctacaaaaacggtgaaccatggatgatagatagatagatcagcgcctcttcttgccagactttgagccagaagatttcgatgggctcgcgaccaggtagatgaagcccagaacgaaggaaacgacagacaccagtgctccgtacttcgcaacaagtttcttagcccattcaaacttcttcactggaggcctttcagcaagaatgtcaagggcagggatgggagttgagtaggcctcctgaagtgcagcctttgtggcaacacggtacttgatgacagcaggtgaagcttggaaccttccctgtgttttgctctccaatacaaacgcgtgcgaagcagtggcaccaggttcaagcctttccaaagtctttgagacctctccagagacaagttcaaatgcttccttgggccaagagtcgtcattaatgg

SEQ ID NO: 1907 - DNA, 519 bp, Hordeum vulgare
gcccgctgcaagcactgatggcagtgcgttggccgtcaccctggtaggttggctacttgttctccagcttctcctcctgtcgccggcgcctaccgccgcgaggagggcgacgagcgtcaaccagacgcccaacttcctctccagaaagccgcctaggtcgggcaccaacgccctgctcaaaaaggcgcgccgtcgcaaccgcaacacggacctgctgggcagcgccgcggcggacgacgccggctacgtcgtcctctacaacgtctccatcggcgccacggaggcgcagccgaacgacgtctccggcgtggtggacgtcctcgatgatttcgtctggacaacgcagtgcctggccgcgccggtccgggtccaatgcgccagccagacgtgccggagcctcctggccaacgacaccacggacgcctgcggcggcaaccccagcggcgacgatacatgcagctacgtcaacgtgtacgcgccggggagcaacaccaccggctttctcgccaacgagacggt

SEQ ID NO: 1908 - DNA, 472 bp, Hordeum vulgare
ggggcctcgacgccgacgacatccgccacccgctcgacaagcagaacaccttgctgctcaaagcaattccagggctcaatgatataggcaaggctttgctagggccggtttccgagcaagttatggttcttcaaaacattggatcgtcggttctcgtctctgaaaaccagttgcctgaacttcaccagctcatggtcgaagccgcgaagatcttgaacacggaggcgcccgacttctacatacggcagaatcccgtccctaacgcttacaccctagcgataaacgggaaaaggccgttcgtcgtcgtccacacgagcctcgtggagctgctcaccagaaaggaattgcaggctgttttggcacatgagctgggtcacctcaagtgcgatcatggcgtctggctcacctttgccaacatactaacaatgggggcatatactgtccctggtttcggtatggttgctgggttcct

SEQ ID NO: 1909 - DNA, 518 bp, Hordeum vulgare
gcggcaatggcgatggcgatgcgggcggcagcggccttcttctccccctccgtctccgtctccccatccacctccccgagcccgaagcagcgctccttcttctccacccgccgtatccgccatcaccgtcgcctccgcgccttcccagccaccgagctgaccctcgaggagctcaacccctccgtcgccctgctcaggaagaccgcggaggccgtcggcgatttcaggaagacgcccatctacatcgtcgggacggactgcaatgccaagcgcaacatcgccaagctgctcgccaactccatcatttaccgctacctctgcagcgaggacctgctcgaggacgtcctcggcggcaaggacgccctcgccgcgttccgggagtccgacgagaagggctacctcgaagtcgagaccgaggggctgaagcagctcacgtccatgggcagcctggtgctctgctgcggcgatggcgccgtcatgaactccaccaacctggggctgttgaggcatggagtctc

SEQ ID NO: 1910 - DNA, 545 bp, Hordeum vulgare
  UNSURE (22): n stands for any base
gatgaatggtgctcctcttttntttcttctactgggaaaaatatctcctgattaatgttcggccattgagccatgtacattttacaactggccgcatgaataacttgcagcgaggagtactgtgttactataatgtcgtgaaagactcatttacacgacacggcgaatgccttcaagccttcatacgcacacactatgtatatggaatgtcgcaaaaatattgaaatcaagcgaccgaacttgattcctcggacctcagtccgtgctcgaatcattcaggcttcccagcagcttccatcattgcctttgcttggatcagcttctcaatccgactcacaatctcaacgaccatgtcctccaggctcaaagagtcgatgctgctgtagcttagctgagaagccacattctgtagtgaaacagtaacatcagaaactgcatagcgctccttcagatcatcataacgctgacggagctttgccattgcctgagaaaaggaatcagggtctgaaatagctgccgcccccttgctcttcaacatgtcattc

SEQ ID NO: 1911 - DNA, 526 bp, Hordeum vulgare
ggcacgagggtttatgcactctggaacgttcctcatctgttgccagcttttacacttaagggtggtgaagtttcacacttcattcttggtggcgctgatcttatgtttcctggtatcagcgtacccccagaaggattaccttctttccaagctggccagccatggtcagttaaagtccctggtaaccatgctccaattgctgttgggacaacaactgtgagcaatactgaagcactaaaggcaggattacgtggcaaggctttgcggattgcacattactataaagatttgttatgggcttctgcggatggtcgttatgtcccaaatgaaggattttatgatgacatggttattgaagatcctaattttgcttcggcttctcaacatattgactcttccgaagacccttcagaagcaaagcaagacaaagcagctgttgatgtgtcggagtgtcgtactgaagatcttgccattaacagtgaaaccatagaggatctaacagctggtgtgagcgagctaaatttgc

SEQ ID NO: 1912 - DNA, 544 bp, Hordeum vulgare
attacttataacggtaaacagaaaggggtctgttttgatgtcacaattagttcacgaatacaaaactcaaggccacaccaaaagcctcactatctaagcaaacaccatattgttcagtgggtagtgacaacaatcgcgagtagcgcattgagagaacatttcacattttcgcaacaagcctgaaccagaaatcaacaatgttatgttggcactcctaggagtcaacaccccctcctacttctttgttttgtcataaacctcaatatatctcttgggaacaccatgatggtcaacgaggtgctttgcaaggttttcaatgactccgccttgaatcaagacctcatgttgcccctttttaccgggaagctcagctgtggtggtgctgcaagcaaatttcttttgtagttcagaagccaaggagtcggcatccagcaaaaagcattccaatccagagactcgggtcatcttcttgttcccttgtcttctttctgtcatgatttgaacagttcgtatggcacccttgcgaatgaccacctcatttcct

SEQ ID NO: 1913 - DNA, 438 bp, Hordeum vulgare
gggacgagggcggaggagctcaacgcgcgcaacctggtgtacctcgtctccaagcggatccgcatgcaggggttcgtcgagccggaccacaagcacctctacccggagtacagggcgtgggtgctgccgcacatcaaggacgggaaggtggtgtacgtggaggacgtcgtggagggactcgaggcggcgcccggagcgctcatcggactcttccacggacgcaacgtcggcaagcaggttgtcaagctcgccaaccctcagtgactcacacatcgcatccgcatgcagtgtccttgacaagtcaccaaataaaacgaatggcgagatacatgtgcatgcatggcgctgggaagctatcatgaggagtccttgtttacgttgtattatccttcgttaagcgtcattcacgtgttttgaattatttgtttcttcaaaaaa

SEQ ID NO: 1914 - DNA, 419 bp, Hordeum vulgare
gtacaaataatttaaaacacgtgaatgacgcttaacgaaggataatacaacgtaaacaaggactcctcatgatagcttcccagcgccatgcatgcacatgtatctcgccattcgttttatttggtgacttgtcaaggacactgcatgcggatgcgatgtgtgagtcactgagggttggcgagcttgacaacctgcttgccgacgttgcgtccgtggaagagtccgatgagcgctccgggcgccgcctcgagtccctccacgacgtcctccacgtacaccaccttcccgtccttgatgtgcggcagcacccacgccctgtactccgggtagaggtgcttgtggtccggctcgacgaacccctgcatgcggatccgcttggagacgaggtacaccaggttgcgcgcgttgagctcctccgc

SEQ ID NO: 1915 - DNA, 450 bp, Hordeum vulgare
  UNSURE (404): n stands for any base
gagagattcccgccgagattccgggagagacccccgccgcgatgccgagaaggtggcaggtctggggccggcccgacggcagccatgtctggatccccgccccggaccccgacgtgccaccgccgcccgccgcggccccgcctcttcctgcgccggggcgcgccgcggggatagccgccgcttcattcgaggacgcgccggccaaaggccaggacgctgctgacggctgccgcgtagagtccatggccgaccttctcgtccaggcgcggagcaagctgctcgaaggtgatgggatggtcggagcaaccggcgacgcaggaaaaggtgagctgttctgcactgggtcggggagaccagtgtctctaagcgagagggctataaggagggccagggtgttggtcggngaggaggtggagaaggctggcattaagagaaaagcatcatttggcg

SEQ ID NO: 1916 - DNA, 369 bp, Hordeum vulgare
ttttttttttttttttttttttttttttttgccgcaccgcatgatcatgtttaatcagatggcagtgcaggcagatgatgtctgcacacatcagtcggcagaacacaagcgttttccttataaaaaggttcaaggccgggagattacggaggttaggatccagtcgttatgggcgttgatctcgacgtttactataacctgtacagaggagatcaagcctaacttaaccggatcagcatacaaactcacaagcacgctatacaccctacaatacatatttcaacaactaccaatgagcatccagtgaggaaaaaaagtctgcagaacttccaccactttcttacgtttacttcgaaaagcagcagcatc

SEQ ID NO: 1917 - DNA, 518 bp, Hordeum vulgare
cctcgtgccgaatcggcacgaggtgaagatgaggagagcttccatgaggaggaggatgatggtgagatgggggagcttgagcagcagtatcgcaccctccaggccaatcagcaaagcattcttcaaaccttgaaacaacacagggacgacgatgtctcgagaggccaggcagtcaaaaaccaaaaggcgctatgggataagacactggaaatgagattcttgctgcaaaaggcgttctccacttcaaacaagcttcccagggatccatccaagtcaaggttctgcagtcacgatcaggagatagagcaagcatatgttgatctgttggactcatcgaaacagactctcggttgcatgctggagctgcaggaggctttactggagcggaaccaggctgcaaagggtgtgaatgatacattgcctgactcaaatggagaggatgatgagtggttgcaagtacagaaggtgcagacaaggataaccccgttcagaaatactgagatagataaatggcagag

SEQ ID NO: 1918 - DNA, 554 bp, Hordeum vulgare
  UNSURE (40),(41): n stands for any base
gaggcatcttacttaatacgatcgcaactgatattcatannacactcatcttctacataggtcatgcatgcgtgggtacaagttttgtagtgttactgcagtttacatattagcatccatcacgcgaaaaatagcttgaacaacattttggacacctcctaaaatcagaccgcggctgacttctgcaggttgcccattccaaacaaattctcgaacaatttcgaagccattggaggaaccgtcataggcaccggggccatgaaattagcaatcttctcgtgaacactgtaccttatctttctgctttttgaagcgcggcgatcaacgagttttcttttcttattctgcttcttcctcagagcataaaatgcagactcagatgctcctcctgtatcacacgactcgagaaactccttgagaagttgatgataaaattcagagtcatcaataagttcaggatcaccttccacatccttcccctccacggtagtagcagactctgctgcactctgcaaaatgaatgagaagagacaaattattcactataactagga

SEQ ID NO: 1919 - DNA, 518 bp, Hordeum vulgare
taaactttagtcgagatcagcttggcaatattgcttggtcctatgctgttcttgggcaactggaccgacaattcttctcacacatctggaacactctgagtcaacacgaagagcagagagtctctgatcaatatagggaagatataatgtttgcatcacaggtatatcttgcaaatcagtctttgaagcttgaatatccacatctcaatatgggcttaagagatgatctggaagagaaaataacaaaagtggtgaagagcaaacggttcaatcagaagacgacctccttgtttcagaaggatgtcggacgtcttttatatagtaccggacatgaatgggttagagaatatacggttgatggttacactgtcgatgcagtgttagttgatgagaagcttgcatttgagatagacgggacgacacacttctcacggaatttaggcacaccattaggccacacggcatttaaaaggcgttacatttccactgctggatggaagttagtttccttgtctcac

SEQ ID NO: 1920 - DNA, 543 bp, Hordeum vulgare
tgatcatatatgtgttttagcacttaaacagttccccaaaattgagcatatgatacataatagttcagggtatacatatatttcacatgccttcccaaacaaaacagaaacataactatatctcatcacaatggcttctgacacgctaagctttcaagctacatgttgcgtccaataagcaccgcacccagcaaagcccaaagctgaatccaccacaaattgcttggaattccaggggtgttcttcgtgttggcagagctcatgatgtcaaatctccaacggttgcacttattctgcatcaatgcctagaattctcctcagatactccatttgctcagtctcgccttgaagctcctcccactcttggtgagacaaggaaactaacttccatccagcagtggaaatgtaacgccttttaaatgccgtgtggcctaatggtgtgcctaaattccgtgagaagtgtgtcgtcccgtctatctcaaatgcaagcttctcatcaactaacactgcatcgacagtgtaaccatcaaccgtatattctct

SEQ ID NO: 1921 - DNA, 518 bp, Hordeum vulgare
cgacgacgacgccgcccagcttcttccccgccggttcttcgtcttcgtcgcgctccggctctcctccgcccccgcgtcgcagctgcggtggttgggcgcatgcgtcacattgaaatttcccggcggcgatggttgccaattgttgttgttgttcaacacaactagttgtggaagattgtgtggcttcagcagaccagaaattatatttagtcactggtgaccatgacaaactctagtgaggttcctttttatcactcgttgcccgtacaaggagctgaaagcagtctcaaggatcagatccactccaaggttatgggcacgataggcaatgtcatcaactcaattgatccaaagtcgttgcctcagcaagcatgggaaacagctggaaatgccgttaactcccttgagtcaaagttatccgggcaaaagccgtttgattttgatggtggaaatgatttccttgatggatatgaatgccctgatgactattgggacccggaactgcagagggcagaaaa

SEQ ID NO: 1922 - DNA, 549 bp, Hordeum vulgare
taaatactatttttattgataaattacaagaaagcattaactttacagatttacattctaggacaacagtttgtagctattcatctggcatttgattcgcacctatggagcaaaccctccccaccaaaatgacagaagcattttgagaatcaacacaacttcttttgccgagagaatcaacacaactagctacagtcggaatcaaatcaaatatgtacagattgtgattatttttcatcgtgctaagtataggtcatccaacgctttgtacagaaacttagcagcgtttggttgctccaggttccccataagtatatcactggttgtcagatacggatcgccatagaaccgcaggttggcgtccatcctagtggaaacaatgttcccttctagtgaaaccccgataaatgcgcctttgctgcaactatatgtatagcaaactccggagcctttattaccagctctcacatcagcttctaatactctaccaacaggtcctgctgcggcacttaaacctgcaccgattgaaaaatgcattcggctgctgaa

SEQ ID NO: 1923 - DNA, 518 bp, Hordeum vulgare
cataagcgcagcacctgcgcgtcgcggaatccgacaatcctcccgagttcgaatcagagattccccacctctctcgcacgctgtccctccgagaggaggacgacggaggcgcggctaccggagctgactgatcggcggctctagtacggccaggatgcagccgaatcccgccgaggccatggaggtctccgcgccgccagagggcgaggcgcccaaagatgcggggccgtggctagggttctgggaggtgtcgcggcggcggttgacccccgacgaccccttcttcgccgccggcgacatggagcgcgagctactcgcgaagcacgttgctctggatctctcggatgatgacaggtaccaacttgagaagatggatgtggcgagcgtcagcacggtgtgttgtcctattgctggttgtggtgcccatctagattgtttggaggactttgaagaccactacagcactcggcatactgcttcttgctctgtatgttcaagagtgtacccaacatcaaggc

SEQ ID NO: 1924 - DNA, 552 bp, Hordeum vulgare
  UNSURE (23): n stands for any base
gggcacgccaaaaaaacaacgantatgataaaaatagtggaaactttaaacgtccaagtacaatgggaaatccgtattcgagattgataatctgctgaagaattgtcaatttgcttctggctgagaggcctgcttgttctgcctaatagaccttgggacaaaagtaagaccacgagcacgacgatggccaaaggttacgctcgagggcaccgaatctgcagtactcagccgtgatacagccgaggagagttcatcaatcttctgttccacctccatgtcgctctccttggcctccttctggtgattttcattttctctcggctccttgcggtcatgttcattttctttcgactccttgccatcatgttcattttctttcggctccttatgatcgccttgcctcggtcgatatctcgatttcgattgccttgggttctttccatcaacgtccatgacagtatcccttgtctcttcccccttataagcagtttgccttcgatgatacttctgacggtgccgctgggaaggttgtgcccttttgaagaattcaaa

SEQ ID NO: 1925 - DNA, 378 bp, Hordeum vulgare
cgtagtacctgcgctctacttggtggtgggagtgttccgcagccgcaggaggtcggccggcgaacaacggtttcctccggggccatgggcgctgccggtgatcggccaccttcaccacctcgccggctcgtcggtcccgccgcaccacgccatgcgggacctagctcggcgctacggccctctcatgctgctcaagttctgccagctccccgtgctggtggccacctccccggacgcggcgcgcgagatcatgaagacccacgacgtggctttcgcgtcgcggcccctcagcccgaccatgcagctcttcctgcgtggatcggagggcctcgtcttcgcgccctacggcgacggatggcggcagctccgcaagatctg

SEQ ID NO: 1926 - DNA, 378 bp, Hordeum vulgare
tttttttttttttttgggagccaagacatttatttaaaatcatgaatttataacccagcaggcaacagctcacaagatggtcaccacaaacacaagaaactcttggtgctaatacggccgggcacgtttactctgtgggaacaggaacaggaacatgagggacagcgaacaccactagctcggcccgccggcgcgtggtgagcccggcctcctcagtcatgtccagctcctcggggaccatcccgtccggcagcttccagtcgaaatggaacagcagggccgcgagcgcgagctcgaggtgcacgaggccgaaggacacaccagggcatatcctcctgccggcgccgaacggcaggaactcgaaatccacccccttga

SEQ ID NO: 1927 - DNA, 519 bp, Hordeum vulgare
gtgtgttctgatgaaggacttcctgcatgcacttgcaacccggctgaagaagaacacagctgcctacgacaactatagtcggatttttgtgcctcagggcgaacccctttcctctgagcatggagagcctttgagagtgaatgtacttttcaagcatattcagaaaatgttgtctggcagctcagctgttatagcagagactggggactcatggtttaactgccagaagctgaaactgccggaaggctgtgggtatgaatttcagatgcaatatggatcaattggttggtcagtgggtgcaactctgggatatgcgcaggctgccaaggataagcgagtcatttccttcattggagatggcagctttcaggtgacggcgcaagaagtgtcgacgatgctccggtggggacagaacaacataatcttcctgataaacaacggtgggtacaccatcgaggtggagatccatgacggcccttataacatcatcaagaattggaactacactggcgtggtgga

SEQ ID NO: 1928 - DNA, 536 bp, Hordeum vulgare
ttagttttattgaagtaatatacaagtacaggtgaactgagaccatctatgtacagtaaccatgagcacgtgcaacaacagtggactcaaatggatgatttattcagagatcagtaacatctattcagaacttgaggatcttgtcgagacctgatgtgttcactggggatttggtgggcggctattcgcagcggaaaccctagaaccccactcaagaagctccttactagtatcatccttgtgcacaattacctctataaagcacaggctgtccttgttaggtcctagggatgcctcaattgccttcttcagttcctcctctgttcggaccttggctgtatagcacttgccctcgccattatggaatgcctccaccacgccagtgtagttccaattcttgatgatgttataagggccgtcatggatctccacctcgatggtgtacccaccgttgtttatcaggaagattatgttgttctgtccccaccggagcatcgtcgacacttcttgcgccgtcacctgaaagctgccatctc

SEQ ID NO: 1929 - DNA, 1307 bp, Hordeum vulgare
  UNSURE (1),(2),(7),(18)..(20),(23)..(27),(29),(30),(32)..(34),(37)..(39),(41)..(44),(46)..(48),(50)..(53),(55)..(57),(60)..(62),(67)..(73),(76),(78),(83),(84),(86)..(91),(93),(96),(115)..(119),(136)..(138),(156),(177),(785),(808),(888),(905),(912),(951): n stands for any base
nnccccnttggggcaaannntgnnnnncnnannntgnnngnnnncnnnannnncnnnttnnngggcnnnnnnncgnancccanngnnnnnngnctncccttttttgacggacaannnnnccagagaaaggcaccannnctccatacacaaacccgnggtgaggggggatcttttttnagcgccggggggttccattgtcgtgccatgtgccctggacccagaattcttggacacatggactcccttctcctgagaccctgactttgtcgccaattgtttaaatctgctagctcacctttaacggggggggggggggcctactaattttttcttttttctactattcctctctttcttctatataaaataaacaattagtacttctctttcattctttttcttcttttatttttcatctcatcttctcccttcttttttcttctttctccttcttttccttcattatttccatttaacccaatatccctccatctcatccttcttatatattacactttatttccctctattcttccttcttcatacataaatctttcatcccccctctttttttcaccacctatctcccttttcaaacaattttatttatcattctcttatttaattcttttctttatctcttcatttccttccctcttcaacccctctattcattatcctccctttcttatttttttctttctccttcattcctttttatcccattctctttttaactccaaccctcacttcacttctcactatcctccctaataattttgttnactttctcacccactccatatcncatcccttatattacaccctccatctaatcctacacctttctctctcctattcccctcccacacattactctcatcaaanttatcattttctacccnctacttnttccctttcttatcctccttccctcttattccaacctanttcctcatctccactcaacccatcatcatacaatcctctctaacttttccactcaattaattccttttctattaccatttcccataacattcttatataattctctcccatcatcctatcctctaccaccaaattacggcacactctatttcgccatcgagaacccacagcgcacaactacgacgttatgtagcacgccttcattccgatatcgtatctcacttaacttaggctaagtcttttcacgctcctcgcacttccgcgcggttctacatggtcatgatgcgccctagttctttccaccgctctatctcgcacagaatctcgataaactctccacccactcatctctacct

SEQ ID NO: 1930 - DNA, 510 bp, Hordeum vulgare
  UNSURE (2),(23),(48): n stands for any base
gnacttaactttgataacctggnagttgtcaaatgacactccacaggnaaggatcacaaacaattgtgcatacccaagtcttgatgattttagaccctattagaaggaaatatacacatcagagcaggccattactacaactagagtttcacacatccatgtgctgatgagacgtgtcttctcattgcatcctctcctttcgaagcctctcaagctccttcaccatctgccagtgctccagggaaaggctcttctcaccaaagcttgaggctgttatctgagccattgttagccacctgctaagttcagtgcaacccaagctcctgtcgttgcgcatggcactgaccatttcatcttggatcgtctggtaaatctcaggttcagatgactgaggaagagacctcactgtggccaagtaccatctccagctctcaagttcctcagaagttgcattcacctcagaaacagtggatggacgaaaaggcacaaccaagtctgaaggcaggatgt

SEQ ID NO: 1931 - DNA, 430 bp, Hordeum vulgare
ccgtgggaaggttgctttggaggtagctgaggcacaacatctgatggaaggactagactggccaggtgcaatcaaggatattcaggcctcagttaagtggctgaaggaaaatggatcacccaaggttggtgttactggttattgcatgggaggtgctttggcaattgcaagtggagttttggtcccggaggttgatgctgttgttgctttctatgggacgccatcttcggagcttgctgatacttccaaggctcaggctccaatccaggctcattttggggagcttgacagttttgttggatttgcagatgttaccgcggccaagtcgttggaggagaagctcaaggcttctggagtggcacatgaagtccacatataccctggatgctcccacgccttcatgaacgcatcgcctgaggccctcgagagg

SEQ ID NO: 1932 - DNA, 558 bp, Hordeum vulgare
  UNSURE (52): n stands for any base
gtgttcagaagtgtttactttcccttcccttggagatattccatccaacatngaatctaaccacaaccacaacacaacacaaaatcacgacgagttggcatagtactgataacacaaccacactagcctaggttggatactgacatattgcacccagacattttattcttctgagctgactgacagacaccatatacatcattcagagaaccatatggatggtaattgctcatgcagatcccaggaaacggcccatccaagtggagaagcgggaccatgccaggtcaatggctccctgattctcatcagtcaaacccatgcccttcctcctctcgagggcctcaggcgatgcgttcatgaaggcgtgggagcatccagggtatatgtggacttcatgtgccactccagaagccttgagcttctcctccaacgacttggccgcggtaacatctgcaaatccaacaaaactgtcaagctccccaaaatgagcctggattggagcctgagccttggaagtatcagcaagctccgaagatggcgtcccatagaaagcaacaa

SEQ ID NO: 1933 - DNA, 524 bp, Hordeum vulgare
cacggccgacgcgctccagaagaccatcgctgacgccgggtacaggatggtccccaacgccaagggcgtcgaggtgctcgccaagaagtacaggatcaggctgagtgggatcgacgcgccggagagcgcgatgccgtatgggaaggaggccaaggaggcgctgctgaagctggtggagggcaagtgcctgacggtgcacgtctacaacaccgaccgctacggcaggtccgtcggggatctccacgtcggcggggtcttcgtgcaggagcaaatgctgaagaaaggattcgcgtggcactacaccgcctacgacaaacgcccggagcttgccaagtggcagagccaggcgcaggccgcccggaaaggcctgtgggcgtcgtccaagccgcaggagccgtgggagtacaggaaggccaagcgcaacggcaacgcgtgatcatggacatagtatatatgtcgataaacctccgttgtttgtatgtgttgtgacgacagtggacagctgattgattcattcgtagcct

SEQ ID NO: 1934 - DNA, 551 bp, Hordeum vulgare
gagttgtacagcacaattacacaatatacataccaggtacagcaacaacagaacacaaacacgtaacccaaccaatctcaatgcgtgcccctactctgcttcacgaccccgcgctagcttttagctagtcttttcactacacctagctcgtaaaaagtacggtggcgcgagtgctgctctgggctacggatctgcagtgcggcaggctacgaatgaatcaatcagctgtccactgtcgtcacaacacatacaaacaacggaggtttatcgacatatatactatgtccatgatcacgcgttgccgttgcgcttggccttcctgtactcccacggctcctgcggcttggacgacgcccacaggcctttccgggcggcctgcgcctggctctgccacttggcaagctccgggcgtttgtcgtaggcggtgtagtgccacgcgaatcctttcttcagcatttgctcctgcacgaagaccccgccgacgtggagatccccgacggacctgccgtagcggtcggtgttgtagacgtgcaccgtcaggcacttgccct

SEQ ID NO: 1935 - DNA, 101 bp, Hordeum vulgare
cggcctggcggcttccaccgcgtacgcctctcgccccctcgcctccacgctgctcccaaccacccgctccggcgctcgcgcttctcccctctgcgcgccgc

SEQ ID NO: 1936 - DNA, 556 bp, Hordeum vulgare
taaatatcatggcaacctagcaaatatgccccgtacatttcacttcgatttctttggactgcggtatagtacaacatgaccaaaatggaaaagaaaatgaatttctattcaacatatacaaccttttcattcactctgttcagcggatgcaactccagcagcagcgagttgctcaccacccactttctccagttcaattccactaccctcatcatctgggatcaccaccgtcttcacttgcgcgacaatgaccgtaatgtcatccatcttaccacctactagcttagctccaagtagcttcttccaccaaggaacatcaaaacccctactccgggcctccatcgagtagggtgaatcgaatgttacatccactgaatgttttctcgcgagctccgctaaagcttttgcagcttcatctgtgcctggagactcattaatgacagcaaggatctcttgatcaaatatattgtcgaagaatccatctgagccactgactatcatatcaccctccataagatttacagtgcaaaccagtgcatcttgagatgtttgacca

SEQ ID NO: 1937 - DNA, 517 bp, Hordeum vulgare
ttatcttgagaatttgctcatcggcaacaccaatttctctggtgcaattccaagttccatcggcaatctcaaatcattgaagaagttaggccttggtgcgcaaggttttgtcggtgatcttccctcatcaataagtgagctcaaattcttgagttcattgcaggtctctgggttagaagtagtaggatctattccaccatggatcaaaaacttgactttcttggaggttcttgagttgtccctttgtggcttgcatggaccagtaccttcttccatatgtgagttatcgaagctgagaatattaacactttacatgtgtaacttttcaggggaaatacctccatgtgtttttcacttaactcaactaggcatcctacaacttcagtcgaataattttagtggtgaagtggaacttaactcactgtggagattaccaaacctgtccgacttaaagctctcaaacaacaaattaaatgtaatagacggagaagatgtttcttcattcgtgtctttccca

SEQ ID NO: 1938 - DNA, 536 bp, Hordeum vulgare
atgtacttttcatgatacaacatatcacaccatttctcctcaagttctctttctaagtgatgttgtcaaccttgatgcagatggcaacagtaatacaacattgactactactctccgcacaaaagaaaacattaaggactagtttaccaatggtgtagcccgtatgttttcatactgctatagtgatctctacacctaagatcccactggtaccaaatgaaaagagagcaccatgtcaacttctctttctaagtggaagaaccaatgtccctaaaactgcaactgcaaacccaataccaaatcccaatccagcaaagaggaataacacaacgtctgcagggttttccttccaaggatgaacggtggtttatggtgttgtctcattgctgcattttttggataatggaggcccacataacccatcgttcctcagaaacgagctgttagaaaatagctgaaaatgaggtgatcctggtattcttccctccagcttgttgttggacaagtttagtgtcccaaggaagtccaaagatgct

SEQ ID NO: 1939 - DNA, 445 bp, Hordeum vulgare
  UNSURE (422): n stands for any base
atgctcctccctagcctcctccgccgcgcccacctgctgcggccgtgccactctccccgccgccacctctcccgcctcctagacctctacggtttcgtgccgccggcttccctgacccccaccgcaaaagagatctcccacgggacaggcgccgccgccggccagaagcgtcggaccaagaagcccccctaccggccgccgtcttcgctggaccgcggagaccgcccggcctcccactccgacctccccttcgatttccgcttcagctacacggagagctccctggacgccaagcccatcgggctccgcgagcccaagtattccccgttcggccccggtcggctcgaccgcccctggaccggcctgtgcgcgcccgccgtcgacaccacgctccggagtgtcgacgccgaggaccccgcccncgccgccgagaaggacctggagg

SEQ ID NO: 1940 - DNA, 417 bp, Hordeum vulgare
ttttttttttttttttgaatctcaactatagccaaactgtggaagtgaacaaacttgtacaatcaccaaaaattagccatggagaatttcaaaggacagaaacagggctactgattttgattgtgatagaacataatcatcacaggtaaagaatggacaagctggtggtgttggatgacatgccaattttctgaacacctggtggcagttcatccatcgtgtgatatgtgtcctctggatatgtcagattgatctaaggatattatatcctggaaatgtcctacttatcatctggcacttcatcagagctactgatctcggaagactcgtcagaagacgaccagtcacttgatgtttcttctttttcaccatgctcatcctctcctgctgcactctcacttgatgcttcttcctgtt

SEQ ID NO: 1941 - DNA, 526 bp, Hordeum vulgare
ggcacgagggattcgaaacacattttggtggatgtcttcaagcacagaaggcaactttacaccattgatgtatatggtacggtcgaggtgtgggcagagcctccccgttcatggccagatgaggatttcccccaggtggaaccgcatatgcacaacctcgtccactaccagcaccagaagttcaattgcctggtggagactccatccggcgacctcataagggtcaagcgccagtcgcagaacatgtttgcgctgtgggtcctcgacagggggacctctaccttcgagatgaccagcgacattggggaattcgcgctgtttgtcagccactacagctcgttctgttttccggccaaggaccatccgtacctgaaggcaaactgcgtctacttcatcgacagctacaacaacctgtgcgcgttcaacctcgagcacgggaccaaggagctcgtagaagccctcgaaaccgctgcccccacccgcagccagcaagacgtttacgggcgccacccacgagcagaaccat

SEQ ID NO: 1942 - DNA, 552 bp, Hordeum vulgare
gcacgaccggctggtccaattaaacttcagcgagatggtattgtcacaaaagcgccaggaatacgaccggctgtccaactcaaacttcagccagatggttttgtcgtaaaagtaccaggaatacgtccaataccagtactagttactagggaattcagaggtttaagtttggggatctgctattacataccagtgttctaggatataggtacacggcaattccagcttcgcacgcattcagctatttcagcgaagggtataaccataggaatggttctgctcgtgggtggcgcccgtaaacgtcttgctggctgcgggtgggggcagcggtttcgagggcttctacgagctccttggtcccgtgctcgaggttgaacgcgcacaggttgttgtagctgtcgatgaagtagacgcagtttgccttcaggtacggatggtccttggccggaaaacagaacgagctgtagtggctgacaaacagcgcgaattccccaatgtcgctggtcatctcgaaggtagaggtccccctgtcgaggacccacagcgcaaaca

SEQ ID NO: 1943 - DNA, 519 bp, Hordeum vulgare
cttggattcaggcttcttctatgtgctggatcatgggataagccaggaattcatggatgaggtttttgccgaaagcaagaagttctttgaacttccgaacagtgagaaaatgaagcttctccgaaatgagaagaatcgagggtatacacctatgctagatgagattcttgatccagaaaaccaagtgaatggtgactacaaggaagggtattatattggtgttgaggtacctacagatgacccacaatcaaataggccattttatggtccaaaccagtggccttctgaagaagtattgcccaaatggagggaggtgatggagcaatatcacagggaagcattgagagtggccaaatcagttgcaaggatcattgctcttgctttgaacctagatgcagatttctttgatagacctgaaatgcttggcgattccatagccacattaaggctcctgcactatgaaggtggacaaaaaacaggtcatgccttcgtgtcaaatgatatttatccagcatgaat

SEQ ID NO: 1944 - DNA, 543 bp, Hordeum vulgare
ttggactgtccttagaagaaggcaccttgttatgtccacatgaacgatgatgacttctcacagctatggttacactgatattagcacattagtagtacaacattgccatcctccgtcctaagggcattcttattgccacccgcaacattacacgtcatactagtagatgggaaggcaagaaagtgaacagggcaaaaaatagagctgcttctttcaggctttgccgttgccgtaagtgctcagatctgcatgcgtgtccttgtagcgctgggataggtacgccgagcaagtgattggggggaactttggaggattcgtctcagatttgcaggttggcaggcactcgactacgcagtcgtggcttggctccacgaaaaaggcaatggaatagcgctctcgtccatccaggaccactcgatgtaaagttgacctgaaaagggagttactccagcgttcgagcatatcaccaagattgacaataaagccgcctttaacaggagctacatattcccatacttgaggctgagcattcctgtccttgca

SEQ ID NO: 1945 - DNA, 143 bp, Hordeum vulgare
  UNSURE (13),(15),(16),(23),(29),(43),(46),(49),(52),(58),(61),(70),(73),(79),(88),(91),(103),(115),(124),(142): n stands for any base
ggggacctagcangnngcaattntccggncaccccgagggagnagnagnagnaggagnagnagtagcagnagnagtagnagcagtagnagnagcagcagcagnagcagcagaagnagcagtagnagtagtagcagcagaagna

SEQ ID NO: 1946 - DNA, 533 bp, Hordeum vulgare
ttttatatagatgtcgtggtaagatctcaactgttcccttttctcatttaaaaaagtttatcaaaattgtaagccgaaaagcgcaaaaattggcaaaaaagcaagtcactgatatttacaggttacaggatcaaatatcttgagcgattatcatgaagcctgcgctgacttcccggtgctgcgccctctgaacccaaccacgctcagcttacttcccaccttattcacagcatcccccttcccgccctccggtctggctctgctgctcttcccgaccttcgcgccgcccttgctgctaccagctctcaccggcttggcctttccggcctctgcaggcctggccttcggcgggttcttagacggcgagtgcttcctggacgaagatggctggctctttgtcgacgagcgctttctcgtctaagttgtgtccttgatggcgacctttggcggccttctcgacattgtgaccccccttttgttacccttttggctagcaaccctcggagcatctgaactccttgccgaccttgcag

SEQ ID NO: 1947 - DNA, 522 bp, Hordeum vulgare
  UNSURE (23),(46): n stands for any base
gcacggggcgagctcgctcgggnacagttggcgactacggacccanagccagaggtccttgtccgggaattatttaggccgcccttcctcccagttccacgccttcttagccccgccccgccccgcctgccttccctgcttcctctcctcggatctccggctcaaatccgtctcccgaatccccactttccagcttctcggaggtccccggaggccatgggcagcttcgccaagctggccaagaggtgcgtggagacggaggcgccggtcatggtgaagatacaagagctgcttcgaggggccacggatgtgatgtcgcttgcgcagggagttgtttattggcaacctcctgagacagccctgaacaaggtcaaggaagttgtatgggaaccagcaaccagtaaatatggtgctgatgatggccttcccgagcttcgagaagcacttctcgagaagcttcgcagggagaataagctaaccaagtcgtcagttatggtgactgctggtgcaaatcaggctttt

SEQ ID NO: 1948 - DNA, 552 bp, Hordeum vulgare
gacaccgggcctggaatggctgtttattttcgccccaattctcagtacaccaattgccatccccacaggcacctccagcaagggctattctgtagtatgatacaagcacttgcacattacggtgcttttcctcctctgaatgaactaaatcccagcaggatcatatcgtcgctaaaaatcgggctcgtgtggtctgaatgtagaaatgtactcttacatacaatgggccgttgttactgtaccattccatcggtcaccagctcttgcagccccttccttagcctctcggcggcgagcctcgtgccttcctccttcagtcctccgaaggaaacgcggatgtatccggggcctccgctggcgctcccggggatcaccgcgacgccgtgcttggtcgcgagccatctgacaacctcaaaatcgtctttacagttatctggtagcttagcccagaggtagatggcaccctccccacccttgacagcatcctcgccaaggggagacattgcctccacaagcagcttccggtttatcacgagatcttgcaccctttcc

SEQ ID NO: 1949 - DNA, 924 bp, Hordeum vulgare
  UNSURE (1),(14),(17),(19),(21),(23)..(25),(32),(33),(39)..(42),(49),(50),(55),(56),(59),(63),(70),(77),(78),(80),(82),(85),(87),(88),(90),(91),(93),(94),(97),(98),(103),(104),(112),(117),(119)..(121),(139),(145),(179),(794)..(796),(798): n stands for any base
ngtttatactcccnccncngngnnncctaggnncagagnnnnaatattnncgggnnccnacgnaggaggnccttttnncnanacntnntnntnncgnnctttnnaagaggtnttagngnnntatgggtttttgggattnccattnaaattttttgggaaaaggccaaacccaaaaaganccaggccgggaaaaagaaaattcttttttttggggccacccccaacctggggccaccctttctttggccggggaaaaaaaagggacctatttttgggggtgggaaaccaaaaaacccctttttcaaaaaacccctttttttggagattttcccaaacccaaaaatttttagaaacccttttacccaaatttttttttcccaaaaaaaaaaaaacccctttttcacaaaaaaaccctttttttggggggggttttttcccaaaaaaaaaaaacctctttaaaaaacccttttttggagggttccccaaaaaaaaaatttttgggcccccggggcccccctcccccccgggggggggggggggggaaccccccccaaaaaaaacaccccggggggggggggggtgtgcccaaaaaaaaaaaaagtggcaccccccctttttttagggggggggggggcgggggtttaccaaaaaaaaaaatttttgggggggggaggccccctttttttttttttttaagagggggggggggggggggtcccccccccccccccaccccggggggaggggagagggtttttaaaccccccccccccccccccctttttttttttttnnncnaaaaaaaaaaagaagagggggggggtggttttttttttttttccccacaaacaaaaaaacccccccccccctcgcggggggggagttaaaaaaaattttatggagggggggggtggtccgcgccct

SEQ ID NO: 1950 - DNA, 553 bp, Hordeum vulgare
ctgatgaaaaaattgatacattttcagtaagccattacaagtaaagcctactcaggtttacatacaaatattcaagcccaaagtttcagagagattgtctgttcataaaacatttgatgcaaaacaggatgcagagaaaatggtaagcagccgagcagattatggacaattttgaaaatacagaattctcgagcgagcaatcagtacgaaataagtttatgcgactaagatgggccattaacttaatatctacacaaccagcttcagtaagcccaaagtaatggttcttgaagcaagaaaccagacgatgatctttacaggatctataacttcagatcttcgatgtacatttctgagcctcatgaaacagtgaacttcggaaatgcatccaagctgtttgctaggaagccgctgagacctaaactgtcagttccactcaaaagcctggagtcaaatgccccaagctctggctcaccggtggattcaggcattggcacatctggatttgcattatcagtattgcccaagcctgatatctgagggcttgactcct

SEQ ID NO: 1951 - DNA, 418 bp, Hordeum vulgare
agcttcaccacttcacacacacacacacacacatggattcctcgccgtctgacctaaccctagactacacgcccaacggcaacggcacggcggctgccagcggcggctacccgaagcaggcgtcgccggttgtggaccaccgccatcatcttacgccggagcaggccacaacgcagaagctgcaggagttcctggcccgcctcgacgacgagcggctcaagatcgacgccttcaagcgcgagctcccgctctgcatgcagctgctcaaccaagctatggaggcgtacaggcagcagctggaagcgtgccagatggggagccatggcgctgcggcggcgagggcgccgctggtgctcgaggaattcataccgctgaagaacatcgggatcgacgaggcggagaaggcggccgggaacgc

SEQ ID NO: 1952 - DNA, 424 bp, Hordeum vulgare
tttttttttttttttttttttttacaaaaactaggcatttttccatcatggcatatttaccaaattatttgctagcacaaaaacaaaagcccaaaaggaaggggaagaaaaaaagaagaagagaaaagccctcacaaatccatccgtatatccatcacatcacggatgagataatctcaggctcccgctgctccactcaagcccagagaccggcttccgctctccgcgccaaaaaatcactttccgaacagaaaacaatctcgttataccaacttcttaataattaagctaccggacgtaagtacgatcattaggggctaactaattggtgcgcgctactcaatttgatccgttaatcagtagttgatctgctcggcgtcgccgttcgccgccatgccgtggtcgtcgttgtcgtcgtcgtcct

SEQ ID NO: 1953 - DNA, 517 bp, Hordeum vulgare
  UNSURE (5): n stands for any base
tcggnaatgcggttattgatgattaccatgatttcgttggaacgttcgagtattggtggacgcacgggctgatctctgatgacacctatcagaagctgcagctggcttgtgagttcgattcagctgagcacgaatccgaggcatgcaacaagattaataatgttgctgaagctgaggaaggcctgattgacgcatacagcatctacacacctacctgtaagaagacctcacttcataggcgaaggctaatcaagggccgcaggccctggttgccaagaggatacgatccctgcaccgaacagtactcaacaaagtactacaatctaccagaagtgcagaaagcttttcgtgccaatgttacgggaataccgtattcctggaccgcctgcagtgatgtcttgtctgaccattggaaagattcaccgaggtccatgcttcctatttaccgcgaactgattgcagctggcataagaatatgggtcttcagtggtgatgccgattccgtagtacccctcac

SEQ ID NO: 1954 - DNA, 551 bp, Hordeum vulgare
atcaggtggccagctgttaacagatacagtgcatggtccattttatagtgtccatatggaattattattcaaattacactgccaccccagagctcatgaaaactaaaaacaaagctctaattgtcccacttcagtgggattctgttcccatttctcaagctgaaatcaaatggacagagaaaatctgctcaactgaaaatctggtaactggacttgaaattgtacaacatgatttcatgggctgatcttccattttaagtggaagaaaattctaaaacgactgaatgctatgtgcaggccgaggcatgggtttatcttgcaagaaatgctcaaaaagcttcaaggcttgttgtggacgatgaaggggaacctcatgccctgcgcctcgtattgtcaccaacgtcaaacctttgtacacttggcaccaaccagcaacctcttcctcatcataccacggataccaattagtaacggtcggaagatatagtgcatcaatggagtatcttgtagcagtgaggggtactacggaatcggcatcaccactgaagacc

SEQ ID NO: 1955 - DNA, 520 bp, Hordeum vulgare
  UNSURE (17): n stands for any base
gtggaggatgccagggngaaagcagaggcgtgtcggctctggctggatttcggaggtgggggacgaggagaggaggattgagttgctggtcagcaggctcaatgaagtggaccttagttcgggtgattggaggcttactaggatgatgaaacaagctgacctaatatataatgaagataatttattacaaatactcaaagggctcgaggcaaaaggaaactggaggcaggctgttgctgttactgagtgggtgtacaatgagaacagctacaagcatcgaagaagcaggtttgtgtacacgaagttactgtcaatccttgggaaagcatggatgccaactgaagcactgcggattttcaccatcatgaggggagatgctcaaatataccctgatatggctgcgtaccatagtattgctgttacacttggtagagctggccttctcaatgagctaattaagataatcgattatatgagacagaagccttcaaaaagggtaatgatgatgcgacgcaaagat

SEQ ID NO: 1956 - DNA, 543 bp, Hordeum vulgare
  UNSURE (13): n stands for any base
gcaatagtttgtngcaaaacaaggagcatgtgtgcaaataaatactcacaggttggtttactcttctacagaacttcggtgggatcacaacaaccagaagcaacctaagcctgtgggactccataattcccgcattaacaaggccagttctaattgatgtgagaattttacactaataacatcaaacaacatactcaggtgcttcattcatttatcccctcatagttgctctacttcccttcttcggagcaaatatgtcatcaacacactcctgctcccatgattcaagaatttctgatgctgtcggcatcttttcatatgaactacagttaccaaatgagttcatggaatcaagcactttgtcgatcgcagatacttgtgtgccccaatgcgcaagattacgatgttcgtcttctgaatgcggaccacgcagtacaatgtccccacccgagccagctttgacatctgatacagggataccagtactggaatcagagaattcatgactacccaatgagtccttgcaagagagctcatcatgtt

SEQ ID NO: 1957 - DNA, 550 bp, Hordeum vulgare
gtcctcccgggtctgcaggcaattcggcacgagggagagagagagagagcccatttcctggttcgtgcgtctggccttggaatagatggaacggacagtgttctcggccagaaattggtgctgatgtacttgaagtgtggggacttggggagtgcaaggagggtgttcgacgaaatgcctcaagtgagcgatgtgcgtgtttggaccgctctgatgagcggttatgccaaggccggtgatttacgagaaggtgtgctgctgtttaggaagatgcactgctgcggggttcgaccggacgcgtacaccatttcctgcgtcttgaagtgcattgctggtctaggcagtatcgcggatggcgaggtagttcatgggtaccttgtgaagttgggttttggctcgcagtgtgcagttggaaatgcattgatggctctgtactcaaggtgtggctgtaacgaggatgctttgcgggtctttgaaggaatgcctcagcgggatgctatttcttggaattctgtgatcagtggatgctttgcaaatggatggcacggca

SEQ ID NO: 1958 - DNA, 540 bp, Hordeum vulgare
cccatacgttttgattgtgatcagagatttacatgctcgtatttctagcaacagctatgaacatactgcagctggcaagccgattcactaattactatcacatagcactggtgctgttaccagtaacctctgcaagagcacctgccttgttcaaaatgatggaacctgttggaatccctcaatatgatctccctgctgcacatcttggatatgaacttggcggcctcgtggcagtgagtgcaaaccctcgagttctttgtcacgcggatcgggcgcccttccgacagattcaacaccccaaaggcgacggcgagcttcgagctgtgaccgcatagtgattcgccgtttactgcgtcatcagcgcccatcagagcatatctcttcttcgggtcatggccttcttcctgcattcttctggcaacttcatccaggaactccgcgatcctcgccccttgtggatgattccggttgcccgcgacgaagacctgaaccctacccctggcctcaatccagctgcagccagttttctcccggagccct

SEQ ID NO: 1959 - DNA, 541 bp, Hordeum vulgare
ggtctgcaggcaattcggcacgaggagatgacccgccgctacatgaccgacatgatcacctacgccgacaccgacgtcgtcatcgtcggcgccgggtccgcggggctgtcctgcgcgtacgagctctccaaggacccctccatcagcatcgccatcatcgagcagtccgtgtcccccggcggcggcgcgtggctcggcggccagctcttctccgccatggtcgtgcgcaagccggcgcacctcttcctcgacgagctcaacatcgagtacgacgagcaggaggactacgtcgtcatcaagcacgccgcgctcttcacctccaccatcatgagccgcctcctcgcgcgccccaacgtcaagctcttcaacgccgtcgccgtggaggacctcatcgtcaaggagaaccgcgtcgccggagtcgtcaccaactgggcgctcgtctccatgaaccacgacacacagtcctgcatggaccccaacgtcatggaggccaaggtcgtggtgagctcctgcggccacgacgggcccttcggtgccaccg

SEQ ID NO: 1960 - DNA, 517 bp, Hordeum vulgare
aggccccttgttctagccgcttttgaccttctcctctacttgtgggtctggactatatacagaggagaggagatttgcctgcgatggcgtcttctcgggggttgactatggagaggataagagaattgcctgcgatgtcgtgggaggagggtcgggggttggactttctcgagagcctgggcccggacaactccgccaccgtcttcagcctgctcgacgaccccgccgacctcgcccgcgccaccgccgtctcccgctcatggcgccgattcgttattgcaaatcagttcagcaagctcctgtgcctgcgggtttatccggaggtttccaacttcacccgtgttgagttgggcagcttcagcaatgcacaccaaaatgctggatcaagtgattgtgccgggttggagaagctcgggagcgatcacagggtgtatatgcatcttagccatggtcttctctcgccgtacaaccccaaggattgcatcaatcactgcgtaggtgcatccagcactgatca

SEQ ID NO: 1961 - DNA, 1453 bp, Hordeum vulgare
  UNSURE (1)..(6),(25),(32),(35),(36),(38)..(41),(45),(47),(51),(52),(60),(68),(69),(79)..(81),(86)..(91),(116),(807),(1271),(1453): n stands for any base
nnnnnnttggggaaaaccctgtccncacaaantgnngnnnncccncnaaannacgttgtntccgcatnnctatggccgnnncgccnnnnnnctccatcacgttgatagcgcgcctnaacatgaagagggtgtaggtttttcatcttaacacattatcactaccttaggcgtatctatccttctcctgcgggtgcccatcacccttcgtaccgtcaggtttataacttacttatccctctgacccgcattcaccctcttccgcctgcaccaacacacgtaacctccacataatcagccattttcggccccgcgccccgttcacccgctggtgcgggggacactcgtctaacccaactacttatctacctaacaccctcttcgctgagtatccttcgacctcgtcctcacgactctcctcacctcgtaactcacatccctctgcattaacaccatcatctcacttatttcacactctaactaaccataataacacctattatccacaccctaacccatccatttctcttcttttcctattctttcccactctaatcccgcatttagccccccttatcataactcacgccatacctacatacataacactctatatttactcctcgtcagtatttccgcgcaccccacgacatatcttccaaaccaggactttaacccccaacctttactaccccgtccttcttcagtaaccgttccactcccatgttttttgctccgccatacgctcacatcttctctgtccccaactctatcttgcgataccctttttcaatccaccctacatacccnttaccgtatcttttatatacatcttgtaaaacttaataagccttcgcacgtaccatacaactctttttattttcgcgcccgcccatccatttatgcaccacctttctctctcacttccagtattcactacacccacaattccctcacccacacgttattacatctatacatcctcccacctcacactacgcgcattactcacccacatctttttttcacctactcgattcgcctactcattccacttatacacaccacccacacacaatgacttccctacacacgccactcctgtctcccctctccgcgttcgcgtgtgtatagtgcaaatctacagacactacctcctacacgtacgatttgccaagacgtggttccccgccaccagtttcatacttattccacactcatacacttacaccgcttacaccctgccactatctcaatgttgacgcctcaaatcntttaacccgcagttacgtatattcaccattaatatgtcacattccgctaacataccgctcttcgactctcacacatatcgcacacgcacatcccaatatttatatctatatcacctccctccttttctactctgtactccccaccctccaccctactcgcgcgttacacttacaccccaccn

SEQ ID NO: 1962 - DNA, 519 bp, Hordeum vulgare
ttagattcagagaatacagaaaatatcagagtgcatgcttttgggatacaccagccatggatacaggttcagctgagaaaataactaccaagcaagcaaataaagcaagaaaaagtatggcaactattcgtacatgatagtcactctagatttatagaagcatttttcaaaaggctccaacttctgaaggctcgcttacagaaagtctatcatggtcctttgttctgagaccctgcagcatttccgctcctactcccgaaggataaacatgagtacacaggcatagaatcgccatgcgtgctatcgcttggcaccagtatatgtttggcgccaggagtgagcttcaccggtcctgatctcttctgcacactgcgacaactagacgaagcattgcaattgtcaggaacagctctcgtcgtttggttctctgtatttctggacggaagggctgtatctcttgtgctgttggaaacttcttgaactacccggcctggatggctgagcgtataactcacagag

SEQ ID NO: 1963 - DNA, 516 bp, Hordeum vulgare
ctggtgcttcagatgcgtaagtttgtgatgggagcaggatgggtgccaaagaaacttgatgtttatattgatgtgccggatataatcgatatctcgcacatgcgcagccatggtgtacagcctggggaagagctactgcccgaaggagcttcttgtggcaacaaagcggaatctgctcgtcctgttgccgacgaggatattgtatcccagcttgcaaacatggggttcaattactttgcctgtcagaaagctgctattaatacatcaaatgcaggacttgaggaggcaatgaattggctcctcttacacacggaggatccagatattaatgacccgatatctcaagatccaatgcctgcagaagacactattgatgaagcaagtcttcaaactcttgtttcctttggctttccagaagatgtttcccgaatggccttgaaagcttctggtggaaatattgagagagccacggagtgggttttcagccaccctgaagcatctaactctgtatctgct

SEQ ID NO: 1964 - DNA, 477 bp, Hordeum vulgare
gcataaacgtaactgaagttgccaatgcataacgtctgaaccaacaaagcagtatcccgcatgatcagcctagaaaccagcacgtcaggatgcggcgaaatggtcgcttcaagtcagatttgcaccaagagtccttcgaccatccgccatgctcccggatgatatgtgtgcatgaactatgacttcaaaccttctgctttaactgcttatctctctttaagaaatagaggtatcccatgtccttgggcaggtcaacagatgcagccaccttattgtcgttgaagattgtccacctcccatctttgaggatatgggcgacatagtgcccacagtgtgtagaggttcccatgtggctcacaaatgccgtcagcttgtatctgccacttccatctgatatgtgcgagttgtcatcttttacagtgcttgttgaagaatcagcagatacagagttagatgcttcagggtggctgaaaaccc

SEQ ID NO: 1965 - DNA, 550 bp, Hordeum vulgare
gtcccccgggctgcaggcgcccttgctccccgtcctcctcctcctcgctctgctctcgccggccgcccgcggctcggagtcgccgcagtacgcgacggtgcacgtggagtcggacttcgaggtgcggcactaccgcgacaccgtttggatgtccgccccctccgacgacatctctttccacgtcgccaccaagctcggcttccacaggttgttccaatacctgatgggcgcaaacctcaactcctccaggatcagaatgacgacccctatcctaacaagcatcgtcccaggcgcggggcctctgcactcttcggcctactttgtccggctctatttaccagtagagttccaagcttcccctcctgtccctctccccgaactgaacttacatccagataggtggccaggccactgcgtcgccgtcaggagcttctcaggctacgcacgcgaccacaatgtcgtcgaggaagctgagaaactcgccgtgagcttgagccgctcaccgtgggggaactccacaaaccaccctagcaagagcgcctactcgatc

SEQ ID NO: 1966 - DNA, 559 bp, Hordeum vulgare
  UNSURE (46): n stands for any base
ttccattgtgtcctttcatactacaggcataccagataacaatggntacatatatacaagcttacacggtaccgcattttcacttggttttatggtgatggcatagcatggagcatttttaataagcctccacaccagcagatctgcagtcgacgttgaaccacacctcgttgacacggccgatgatgcggaatgggctgttgtactgtgcgatcgagtaggcgctcttgctagggtggtttgtggagttcccccacggtgagcggctcaagctcacggcgagtttctcagcttcctcgacgacattgtggtcgcgtgcgtagcctgagaagctcctgacggcgacgcagtggcctggccacctatctggatgtaagttcagttcggggagagggacaggaggggaagcttggaactctactggtaaatagagccggacaaagtaggccgaagagtgcagaggccccgcgcctgggacgatgcttgttaggataggggtcgtcattctgatcctggaggagttgaggtttgcgcccatcaggtattggaacaacctgtg

SEQ ID NO: 1967 - DNA, 244 bp, Hordeum vulgare
ttttttttttttttttttttttttttcgagaaaataaatcacattaccacatgaatatggagcaaaactgacggctctcgccggcagcaatacaaaagaaaaatcaagttatttatgtacaagaagttcaccattttcattattccgctatgtttccgttctttgaaagtacatagacctcaatcatcttgtacccacaacttcggcttctcccctgggcagcaaattaccaaatgtcgttgtt

SEQ ID NO: 1968 - DNA, 266 bp, Hordeum vulgare
atccttaaatagtcattcttgggccctttctgctcgataaacactgttttcctcattgctccagaccaaggaggtttgcatcggacagagagttgtagctaccgcctgcgtgtgatccagaagctaacggaatccaactttttgtgctagaatctctctgagtcagttggatgcagattacaagtctgctgtttcagttgtctgttccttaggaactaggaagtgacaaatttagactgctgtcttgaggattttgggttcatcgg

SEQ ID NO: 1969 - DNA, 517 bp, Hordeum vulgare
aggagatgggggagcgtggtattaatcctgacgaatacacttatgtcttactcattgagtcctgcttcagggttgataatgtggatgacgctgttggttacttcagcaagatgtttgatgttggtctcaggcccaatgccaatgcctttaacaaagtcataagtggcttggtgaaggttgataggattgatgaggcacaggggttctttgatctgatgaccgaaaaggaggtcaagccaaatattgctagctgcgaatcgctgttgagagcatacatcaatgttgcaaggttggatgatgcaattaagatggctaagggtattcttctggatgagagtatcgtgtttactgatgaattgaaggcacttctagagggggcactggagaaagaggggagaaatggggatatgacaaagttgtatgaggatgttgagacggagaaagcagaggcggcagcacgtgcagctgaagagaaggctagagcagaggctcttgctaaagaagaagaggagaagaa

SEQ ID NO: 1970 - DNA, 543 bp, Hordeum vulgare
aatttattctagtctgtgatacttgtgacataataaattcagtgattgcaggggcatagaaatctgtactatctcctacataagagatgttgtacaaaaaggttcccgcatacaatcactgggagctctcataacatgtaaattccattgtcagaacataagctcttctaatcatgtgctactggaatggaactaatcattaactaaggcacaaagaacctcaagatgatgaagctatgacctgcaacgatgcatcaccagactctttcttctggtcatcaccttcattctgttctgcagcaccaacagtgtcggtgtgggattcaacaacctgtgcctcctcaacactcatttcttgagatgattcaacattttctgctccactcttgcgacccagtactgcatcaatagctgctcgacttgctctggcagcagattcctccttggccttagcctcagccttcttcttctcctcttcttctttagcaagagcctctgctctagccttctcttcagctgcacgtgctgccgcctctgctttct

SEQ ID NO: 1971 - DNA, 552 bp, Hordeum vulgare
gtccccccgggcctgcagggaattcggcacgagggcagcctgtgcctggtcacatttacagttctggcggccccaatctcagccgcaagtttcagtcccggaaaggatccgctcaagtttgtgctggctgctgggattgggaccctgctcctcgtatctcttgtggttctcaggatttacctgggttggagctacgttggcgacaggctattgtcggcagttgtgccttatgaggaaaccggatggtacgatggccaaatgtgggtcaagccagcagaggtgctggctcgcgacaggttattgggatcttacaaggtaaagccggtgatcaacctgctcaaacagacactggtgggcacaggtgcgctgctcgtcggggcggtcgtactcttcgccttcgccgtccccgtcgaggaattcgtccactccttcaatggagccccctctaccgcctcctctaagccgatcatgaggagagaggagctcctgaagctgcctgctgaggtgaggcaagacgacgacctcgctgcggctgctgcggaggccgccaat

SEQ ID NO: 1972 - DNA, 553 bp, Hordeum vulgare
tttaagttgttattatgaggcaatttattcagaatcacaacatcgatcttcccaaaatttcattccgataagatacatttgcttaacttgtgcatatcatatcaatgtggcaaactgcatataccagaatacgtatgtattactatttgctttaatcagtcgagcaggtcgtctgaggtgcagtactgaccgccggcgagcgcccggtagtagcggtccctgcagtaaaccgggcgtccattggcggcctccgcagcagccgcagcgaggtcgtcgtcttgcctcacctcagcaggcagcttcaggagctcctctctcctcatgatcggcttagaggaggcggtagagggggctccattgaaggagtggacgaattcctcgacggggacggcgaaggcgaagagtacgaccgccccgacgagcagcgcacctgtgcccaccagtgtctgtttgagcaggttgatcaccggctttaccttgtaagatcccaataacctgtcgcgagccagcacctctgctggcttgacccacatttggccatcgtaccatccgg

SEQ ID NO: 1973 - DNA, 307 bp, Hordeum vulgare
  UNSURE (15): n stands for any base
aaggccgtgtcttgncagtgagtgacatcctaaaatagatacctgagctgaaagttctggtgatcaagtcaaatgtttctgacaaaattgcactcagcatagcacacctggaaagtgctcctggtttatttctgtcagataaagagaaggtgttttcagaagctgaggaaatgtcaaagaggtaccgggagcaacttccagttgtctctctttttttttaattagattatgaccttccaggggggactattccggggggtaatgaagcgatcctccatgcaaactggaaatggttcaaatttctgag

SEQ ID NO: 1974 - DNA, 495 bp, Hordeum vulgare
tttaggtcgtccatgaaggtcccacttgatatgtttgcaactacagtagcttgcttgcatgcattctcttgttcgacagggaccaaattctccttacaatatccagtgcatgaaataaacatcagctgcaactatgttctactcattttcgtcagcaaatttggcatgcctcagaaatttgaaccatttccagtttgcataaagcatcgcttcattatcaaacggaatagtcccccctggaaggtcataatctaatttagtgttccgagagacaactggaagttgctcccggtacctctttgacatttcctcagcttctgaaaacaccttctctttatctgacagaaataaaccaggagcactttccaggtctgctatgctgagtgcaattttgtcagaaacatttgacttgatcaccagaactttcagctcatcatctacttttaggatgtcacttactgacaagacacggccttgactaatgttggagatgtg

SEQ ID NO: 1975 - DNA, 495 bp, Hordeum vulgare
ggcgatctctcgtcttccgaagccacagtcctctcgctctcgcgcccccgccacagtttgtagcacggctggcagcagcagggtgcctcgcctcgccgggagctggaaacaagcactgtatgatcttttttcgccactgagctgtgcctccaacgtgtttgcgtgaatgcgcaggcggacgcgcttgctttcttccacgcactagatcttgtgaatttcccgtctccatctgatttcgagattcgccgctgaccatggctgacgcctccgccggcggctccctggacgactacccaaccatcgacccaacctcttttgacgtggtcctctgcggcaccggcctcccagagtccatcctcgccgctgcctgcgcggccgccggagagaccgtcctccacgtcgaccccaaccctttctacggctccttctactcctccatgccgctcccttccgtcccctccttcctctcccccgactcctccaccccctgcccat

SEQ ID NO: 1976 - DNA, 342 bp, Hordeum vulgare
agtttaaactcaatttcacttatctgtttcactcatacaaagaatgagtgcaacaaatgaaaggcgccacatgtagcttgtgcagtaacaacaagtactgcaacaagccatacaaccatcgatgctgtctatagtcccactcgctgagcagatcagccaggttggtgcgatgtatctaaaatgcctccatgtatcttctgcgagaatttgtccagaaaaacactaacccttgaacgatccaaactgggaattaccggagcaagtgaacctcataagaaagccatgttgcaccatctatcatcgtacattgtcctctgcaaacatgtttctactctgcaagat

SEQ ID NO: 1977 - DNA, 1007 bp, Hordeum vulgare
  UNSURE (1),(63),(892)..(896),(966),(967),(1005): n stands for any base
ntgggcaggacgacccctgtattcccgggtctgcaggcaattcggtacgggggcactcttaancgacaaagaatgttgctaccagcaccttagcttgaatggagggtgagaagaactcgtccggggacctgatgtccagcagcaagctggtcgcggaggccgccaggacagcctacgagaagaagagcgtcgagggcatcgacaaggaaaaggtagccgccgcctccgccgatatcctggactccgccgccaagtacggcaagctagaggacaagccggtgggccagtacctcgagaaggccgaggagtacctgaaacagtacagctccggcggtgcagagaagactgatgcacctgctgccgctgacgcaccgaagccggatgcacccaaggagccagcgcctgcgcctgcacctgcacccgccgtggaggaagagaaatcgtccgacgggttcggtctcgacgacgtcatgaagggggctgcatcgctgtcagggaagaagggtgacggggaggagaaggagagcggcggcggcggcttcatgaagatggctcaggggttcatgaagtagaagtcgggtttctgcttctactacatgcatgtagctcttgctaagttcgtgcgctgcgttccttttgtattttattactgaataaaataataacgtcgtggttgcgcttaattatattattagctgctgatatttggttctgtaaagtttcttaagttatggatgtctgtatgatgatcaataatccggttgtgctagctagaggcatcctgcttgcaggatctcgggtgtaatctactccctccctttcctaatataaggctttttaagacgtttcaattaaaagactattatacggatgtataaaaaaaaaaaaaatnnnnntctcctcggggggggggcccgggcacccatttgccctttatgggggctttttcacaaaaaaattcacggnntcatattttatatgcagactctcgcgcgttgtactctntt

SEQ ID NO: 1978 - DNA, 550 bp, Hordeum vulgare
  UNSURE (18): n stands for any base
tacatgccgtatatagtncttttagtgaaacgtctaaaaagacttatatttagaaagggagggagtagattacaaccgagatcctgcaagcaggatgcctctagctagcacaaccggattattgatcatcatacagacatccataacttaagaaactttacagaaccaaatatcagcagctaataatataattaagcgcaaccacgacgttattattttatacagtaataaaatacaaaaggaacgcagcgcacgaacttagcaagagctacatgcatgtagtagaagcagaaacccgacttctacttcatgaacccctgagccatcttcatgaagccgccgccgccgctctccttctcctccccgtcacccttcttccctgacagcgatgcagcccccttcatgacgtcgtcgagaccgaacccgtcggacgatttctcttcctccacggcgggtgcaggtgcaggcgcaggcgctggctccttgggtgcatccggcttcggtgcgtcagcggcagcaggtgcatcagtcttctctgcaccgccggagc

SEQ ID NO: 1979 - DNA, 542 bp, Hordeum vulgare
  UNSURE (4): n stands for any base
gggnctgcaggcaattcggtacgaggtgtatagctgctggggcacctctgtttccccaaagtcccagcgccgccgccgccgccgccgccgccgcagcgcgtcatcctccccttcctccgcgtgtcatgttcgcgcacagctctctcgcgaggtttagccggctcgcccgaaggcccccgctcgtcgccggctccccgctccgctacctccagttgcagggatcagttggtcgaaataatttgtcctcctctgtcatggaacgggcgcaggaagcttcaagtaacacggcgaaacacaggaaaacaaattcacctctgcagagatggaggccagtctcaacacaagcaatcccccaaaaagatcaccttggcgagacatccaattccggaaggaagcaaatggcggggacttccattagtgatagtgagaatttggtgtttgatgaaacaactaatgctggaattgaagtaaccaccaataatactttctcgtcagaaagtaattccacctttggttccagtgcaactaaagtagttatagaa

SEQ ID NO: 1980 - DNA, 552 bp, Hordeum vulgare
gggaagtggcaagcaacagttcagattcagaaataacagggaccactaagccatacaaaccgtggccagggatgccaccactcattagcgtgcagaatgcccacagccacagcccacaagcaaagccacacgccaaaactacagattccatgacggcaagaaagaccgcgcgtatcgatcttaagggcataagatactgcgtcaagattgaatactgcattctgttgaaacacacggagctcactccgtttgagccacctcaggcaaggagatcgagcaacagcaatggtagtatccaccctcgtcgaacttgaacctctgtgacaggtgcaccgccggtactgggtactcgccccaatcctgttccccgtattgcctgaatatactccgagcatcgaaataatcgtttcttccgttcgatttcttgctcttcctgtggcgcacattcattatggttgcatgcaacctcaattcttgtctggcatccctttcaagaactaggcctgacttgacgaaggcttcagttattaccttgcaagctcgaacaaggcg

SEQ ID NO: 1981 - DNA, 519 bp, Hordeum vulgare
ctaccgacccatcctcatcgtctccaacctcggcgaaaccctagcccaccggaagccggagcaagccgagatgtctcgcacgggaccgatcgctcaggactgggagccggtggtcgtgcgcaagaagctgcccaacgccgccgccaagaaggatgagaaggccgtcaacgccgcccgccgcgccggcgtcgacatcgacatcgccaagaaacataatgctgggaccaacaaagctgctcatagcaccacatcgctcaatacaaagaggcttgatgatgatacagagaatcttgctcatgagcgtgtgccgtcagacctgaagaagagcattatgcaggctagaacagacaagaagctcacacaggcacagcttgcacagctgatcaatgagaagccacaagtcatccaggagtacgagtcaggcaaagctatcccaaaccaacagatcatcggcaagctggaaagggctcttggcacaaagctgcgaggcaagaagtgaagcggcttgcatctgacagg

SEQ ID NO: 1982 - DNA, 555 bp, Hordeum vulgare
ggctatatgcgagactttggtacagagacagtaatggttcaggcattcagacagttcacattggccaagacacactgacaaaacgaaacccacatacagagttgttcacagaagctaataattacattcacccaaacctgagcaaaataccaaactccagggttttcttaagtcgcatgatttagtggacaggctttatttagcggtaaacttgcccagccaagctctcttgaaagcctcgactcctgtcagatgcaagccgcttcacttcttgcctcgcagctttgtgccaagagccctttccagcttgccgatgatctgttggtttgggatagctttgcctgactcgtactcctggatgacttgtggcttctcattgatcagctgtgcaagctgtgcctgtgtgagcttcttgtctgttctagcctgcataatgctcttcttcaggtctgacggcacacgctcatgagcaagattctctgtatcatcatcaagcctctttgtattgagcgatgtggtgctatgagcagctttgttggtcccagcattatgttt

SEQ ID NO: 1983 - DNA, 418 bp, Hordeum vulgare
  UNSURE (413): n stands for any base
gtgcacgcaccatgcctacctcctctgctccccgcctcctcttcctctgcttcttcactctgctcgcccactcccatttctccgttgccaggccgcaccgcctcggcctctcggccgaggacgtcgccacggtcgaggcggcgctgccggctcgccacctcgccaaggccaagaccaccttcttcgaggtcaaccggccgctgcacccgccgcgggggagctcggggccctgctccacgctcctcctctcccagtccttcgcgctcaccctcaacaagccgccggtcaccgccgcctactcgccgccgtcctgcctgagcggcgcgggggacgtctcgctggctgtcctcgagtggcgcgccgactgccacggcgtccagtacgaccgcatcttcggcgtctggctcggcggngcgga

SEQ ID NO: 1984 - DNA, 431 bp, Hordeum vulgare
ttttttttttttttttttaagttgaatcctcatactcatctcaaatataaaaaggatatgaggggtcatcgatccgttcggtcagtccaccgcgtataacacgaccccaaccccagaccatctttttttcctcttcttctttaccaatcacatgtaagtgatctaacatatgaaaaaaaccaaaaaatacgaatgactaaatagaaaacatgagtgaccaaacacgttatatagggggggcatatttgctatgtccggccgatgctatgctataaggacaggagacgaccgatcataacgcaaagactacagtagtacgaaactattagggcccacttctgttcccattacagtttacaccaggcctcttctcagcctgttatcccggccaactactcgagcgcgccacgttggcgagcgccggccgacag

SEQ ID NO: 1985 - DNA, 524 bp, Hordeum vulgare
ggcacgaggcggattcgctgccgagtaggacgagggagggaagagcccctgacgatgtcggtgccggaggcggggcaatcggcggggagggatgagcaggagatggacgattacgagcagcaccagaccagagtgctcatggcgctgatgcagggcttatgcgctgcgaggtaccgcaaggccgacaacaccccctgcctcgtcgaccagggcctctacttgggttctgttggagcagcactgaacaacgaggctctgaagagcttgaacatcacccacatcttggttgttgccagatcactgaatcctgcctttccagcagaatttacgtacaagaagatcgaggtacttgacagcccagacactgatttgggaaagcatttcagtgaatgctttactttcatagatgagggtatctgcactggtggcaatgtgttggttcactgctttgcaggtcggtcgcggagtgtcacagttgttcttgcatatcttatgaagaagcatcagatgaacctgcaaagtgc

SEQ ID NO: 1986 - DNA, 466 bp, Hordeum vulgare
  UNSURE (30): n stands for any base
aggccctaaagatttgaattacacttgtangtcaatacagaggttgggatccaatgaattttgggcaaaaaactatgaaaaaatagccagccgtaatactaagttgttgttacttggaaaactaggctattgatatgaaaaagtagggcatatgtctcttccttcagatacaaatcaaacttacatactgctgtcgtaaacaagagatatttatattttaccttgcagagacttctcgaagttcaccagctgggacataaagcccgcattgggtgctatttgaggtcgtttgcttctaactagtgacatggcactttgcaggttcatctgatgcttcttcataagatatgcaagaacaactgtgacactccgcgaccgacctgcaaagcagtgaaccaacacattgccaccagtgcagataccctcatctatgaaagtaaagcattcactgaaatgctttcccaaa

SEQ ID NO: 1987 - DNA, 310 bp, Hordeum vulgare
gctcaggggttcatgaagtagaagtcgggtttctgcttctactacatgcatgtagctcttgctaagttcgtgcgctgcgttccttttttgtattttattactgtataaaataataacgtcgtggttgcgcttaactatattattagctgctgatatttggttctgtaaagtttcttaagttatggatgtctgggtgatgatcaataatccggttgtgctagctagaggcatcctgcttgcaggatctcggttgtaatctactccctccctttctaaatataagtctttttagacgtttcactaaaaaaaa

SEQ ID NO: 1988 - DNA, 325 bp, Hordeum vulgare
  UNSURE (29),(55): n stands for any base
gtgaacgtctaaaaagacttatatttagnaaagggagggagtagattacaatccngtatcctgcatgcaggatgcgctctagctagcacaaccggattattgatcatcatacagacatccataacttaagaaactttacagaaccaaatatcagcagctaataatatagttaagcgcaaccacgacgttattattttatacagtaataaaatacaaaaaaggaacgcagcgcacgaacttagcaagagctacatgcatgtagtagaagcagaaacccgacttctacttcatgaacccctgagccatcttcatgaagccgccgccg

SEQ ID NO: 1989 - DNA, 542 bp, Hordeum vulgare
  UNSURE (53): n stands for any base
gtcccccggctgcaggattcggcacgagggcgtataaattcacgcacttcggnaggctcatgtcagggaagccccgcaaccagactttgtttgccagcctattgcttcaatgttcttggaaccacaagaaccacaaccgaatccggaagggttcacaaaagaacctttccaagaaccagagctaccactttccaggatgctcattgaggattctggtagttccaaggatttgaagaatctcttcggttcagcaattggccaaccaatgttagcgcctcccagcaattttgggccaatgcgaaattcaggtactgtgacgataaaggcgagctttaaggaagacattgtaaggttccgcttcccgtgttctagcagcgttatggcattgaaagatgaggttgccaaaaggctgaggatggatgctggcatgtttgatatcaagtaccttgacgatgatcacgagtgggtgaagttggcttgcaatgcggacttggaagaatgcatagaaatctcccggcattctggtacccatgttatcaggc

SEQ ID NO: 1990 - DNA, 544 bp, Hordeum vulgare
  UNSURE (38): n stands for any base
cagcaagtgaataaaaggaactaacgttcaaaactgtntcaatttcggcacaacaaaagtgtcatattacaacaacttcagttcttaactgtacccccaggacttcctgcaccacgtgctaaatatgtacatcatcgacaacacgcgcatcttgcaacgttacacatattcttacaagaaaaaaaattggtgcttcagtcgaacacagtaaagctgctaatgctatctagcaacacgactagcttaacaacatgtaaaaactgacctcctggaacaacttgtacatacccattgaaaaaaaaaagttaaaaatgttgatctgggtatcaaccggagcttccacaagaactaccaatgtgggccgcgacatcgctaaccaatagcctgataacatgggtaccagaatgccgggagatttctatgcattcttccaagtccgcattgcaagccaacttcacccactcgtgatcatcgtcaaggtacttgatatcaaacatgccagcatccatcctcagccttttggcaacctcatctttcaatgcca

SEQ ID NO: 1991 - DNA, 517 bp, Hordeum vulgare
gaccgaccgcctcctccgcttcctgcgcctcgccctttttctcgcctactactgacgactgcaccactactactgactgaacccgcttcggcccttcccttccctaccccggccaccggcggcgccaggaccgagggagcaagggctagggttccggtctgctcctccgccgccgcccccgactccgtcctgctctgttctccgccttgatcgtgctggtgatttctctctggggtggattggattagaggatggttctcaagaagctgcttcaactctttggagttggcaagaaaaagaagaagaattccaacaagaaaggcaagtccatcgaccctctttggcaaggtgctagtgctgctccacaccccactgcaaatgtccttgcaagtaacattcttttggatccctgttcaagtggggctggcaatgtgctatcactgcaaaaacatgagcctgaatgttcaagtaatatctcatcaacgataaaggcagtagatggatctgaagatgagga

SEQ ID NO: 1992 - DNA, 550 bp, Hordeum vulgare
taatgcagcaggttctaccacatggcaggcaccaagcatatataaaaccacaaagtggggtagacatataacgtggcgaaatttcatcttccagaaacggcaagtgctaaactacaaccaattcatctacagttataccaccaccccagagtgcccccataacgtgtgggttgtgatttacacaccctttttcttccgagttacagtactccataagtaggtgaatttggcaatggtcaggactggcccaagaaccctagctggttgacgcgatctcatccgcagctggcgtgtctcccttcagttccagtgcttgagctctgttcttaaccagctcctttgcgagaagttcggtgtgtgcatcgagagacttcttgaaaccggcaaagcacttgtcgcaggcgtacttggcgctatccctgaccgatgatccgacgacaatgcccgacgcgtatgcgctgcatgcgtccaggatggctcgctcccgctcgtggaaatggtgcacgacaagggtctcaaaatgcttaggaggcttacgaagtgaatacag

SEQ ID NO: 1993 - DNA, 519 bp, Hordeum vulgare
ctccacctccgagccgacgcctccctcgccgccggcgtctccgtaaccgtgactcaccatgtcggggatgaaggacgccaatgctgctgggcatgataacgttggaaattctgaacctatggaccaaagtggagataatgccatgccctcggctcagcaacaggaacaagtaatcaaaaagaagtttggaggactaattcctaaaaagccaccgctcatctcaaaggaccatgagcgggcctattttgattctgctgattgggctctcggaaagtctggacagcaaggtgttgcaaaacccaaaggaccgctcgaggcactcaggccaaagttgcagcccacgcgacaacagcaacaacgttcaaggagctccatctacagctcatcagaaaacgaggatggagatggcgctgggtcggaggacatgaatatcaactgatcaagagcgtggaacctcctgttctggtcgcgaaggaaggggcctcgtcgtctgaagaagcagcttgctttcgttgtctg

SEQ ID NO: 1994 - DNA, 543 bp, Hordeum vulgare
  UNSURE (9): n stands for any base
atatccttnacaaattggacatggtccagtctatagtactagtaacatttgggcacatagcaaggtggctattcgatgaattacaaacccgcagtcctttgaaattacaacgtctcttttcttcttatctatggacgcaacgcaacagacacaagcatacatcccttcccggcggtccacagacaacgaaagcaagctgcttcttcagacgacgaggccccttccttcgcgaccagaacaggaggttccacgctcttgatcagttgatattcatgtcctccgacccagcgccatctccatcctcgttttctgatgagctgtagatggagctccttgaacgttgttgctgttgtcgcgtgggctgcaactttggcctgagtgcctcgagcggtcctttgggttttgcaacaccttgctgtccagactttccgagagcccaatcagcagaatcaaaataggcccgctcatggtcctttgagatgagcggtggctttttaggaattagtcctccaaacttctttttgattacttgttcctgttgct

SEQ ID NO: 1995 - DNA, 519 bp, Hordeum vulgare
tggtgttcgaggactcggcggcttccgcggccaccgtcgaggcagaggcgagggttgcggccggggggaggagcgtcttcgctgtcgaatgtgttccgctctgggggtttacatcaatttgcggccgccggccggagatggaggatgcggtcgttgctgtaccgcgattcttcggcctgccgctctggatgctcacgggcaacaatatggtcgatggactggatcccatctccttccgcctcccctcacacttttttggtgtatatgatggtcacggcggtgcacaggtagcagattactgtcgggatcggctccatgcagcactggtggaggagctgagcaggatagaagggtccgtgtctggtgctaacctgggagctgtggagttcaagaagcagtgggagaaagcgtttgtggattgcttctcaagggtggatgatgaggtagccggtaaggtgagcaggggaggagggggaaacgtgggcacaagcagtgtcactgcgacggccatggcagatc

SEQ ID NO: 1996 - DNA, 549 bp, Hordeum vulgare
aaaccctgtacggaatttcgtaatctgtactgtatacaggaatacagcccttggcagcccaaatggtgaaaaaggaagaaaataacgaactgggctaagtaatgtactaacacaacagtctaaactggtcgaatttggattctccaaatctatatagattcctaggaatttgtcacacaggctgtccatcaagcaagatgatttaagttttgctcttgaacttcctctgcgccttgaggtctaccacaataaccgtgatgttgtccttgctccccttctggagagcaagcttcgacaagcattcagcagctgcttgagccgctggatctggggagtcaccgctacgttgggcagatgacaagtttaccccattctttttatgccataagagtattcgcttgcgggcaacatcgcatacctcttcatttgacaatacatcccagaggccatcactagcaagaataagacactcatcatcctttgctcgaggaacaattgtgacctccgggacaggaattatccatggtttcagatatctgtcaccaattg

SEQ ID NO: 1997 - DNA, 518 bp, Hordeum vulgare
gacatttgttccccttgggttatatgtcattcttaagtacttctcagcacctgctggactcgtgcaattgtggtgcctgtatgggtactctttattcatcttcattccagcatcgcttctgtcaattgtgccaatagaaatattcagatgggttattgctggtgtcgctgggtttatgtctgctaccttcgttgctgtcaatctccgtgcccacatcttaaactccggggagcggtggtttctgatcgttgcagggatattcttgttgcagttggggttggctgttttgctgaaactttatttctttacgataactgtatagggaaatggtgtctcttcttgtattagtcagaaatgagcatgcagttctccatgtcgagtcgattcattgatgtaattttccaggcatacatcccaccttacatgtgacactcaggaacgaacacatactacttcattagcctctgaaatcacagaaatggcaaaatatccttcggttgttacggggttaaacagtg

SEQ ID NO: 1998 - DNA, 552 bp, Hordeum vulgare
tctattatgatttaattactaatctaagtgaatggaacagaaagtaaaccacaaaaaacactgtttaaccccgtaacaaccgaaggatattttgccatttctgtgatttcagaggctaatgaagtagtatgtgttcgttcctgagtgtcacatgtaaggtgggatgtatgcctggaaaattacatcaatgaatcgactcgacatggagaactgcatgctcatttctgactaatacaagaagagacaccatttccctatacagttatcgtaaagaaataaagtttcagcaaaacagccaaccccaactgcaacaagaatatccctgcaacgatcagaaaccaccgctccccggagtttaagatgtgggcacggagattgacagcaacgaaggtagcagacataaacccagcgacaccagcaataacccatctgaatatttctattggcacaattgacagaagcgatgctggaatgaagatgaataaagagtacccatacaggcaccacaattgcacgagtccagcaggtgctgagaagtacttaagaatgaca

SEQ ID NO: 1999 - DNA, 360 bp, Hordeum vulgare
  UNSURE (27),(40)..(49),(51),(55),(66)..(94),(96),(97),(105)..(113),(118)..(120),(124)..(139),(147)..(253),(276),(304),(306),(341): n stands for any base
agcgcgccagggccaggggtcgccaantgggggcccaccnnnnnnnnnntntttnggggcccaaannnnnnnnnnnnnnnnnnnnnnnnnnnnngnnaatttttnnnnnnnnnggggnnncccnnnnnnnnnnnnnnnnaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttcttttttttttttttttntttttttttttttttttttttttttttntnttttttttttttttttttttttttttttttttttnttttttttcttttaaaaaa

SEQ ID NO: 2000 - DNA, 546 bp, Hordeum vulgare
ataaaaactggcaacagatggagtaaaagtgaagcaaccatcaggtagttcaatcgttacacaagttatagcagtagcaaaacaagctgctaggataatagttttggtgtttccataccctctcataaagagtaaacagccacaacttgataacacaaagttttaaccaggttgcactgccgcaatcttggcagcaaattactgtgggtatgcgtagcctcacaaaaatggaaaatccccaggcaaaatggtgttgcgttgccgctgccactaagcttacacggtcaagagcttgatgacagatgcattcccgatgcggtgaagggccacaatggactcaccagcgttgcaaagccccgtctccttggcgctcttcacggcaaacctcagtgcctcttccgtggcttcgctgtcaaacgccttcgcagtgccagcactcagcattgggatcacgcccctcacgataaggctttgcctggcaggcccctcgtcgctgcagatccaatcaaactcgactgtcttgagctcaggaaccacgacagacag

SEQ ID NO: 2001 - DNA, 546 bp, Hordeum vulgare
gtcccccggctgcaggattcggcaccgggggagttttaactgatgcatgctgggctctttcctatctctctgatggcaccaatgacaagatccaatctgtgattgatgctggtgtctgtccccgacttgtggagcttctcctccatccatcaccttcagtgcttatacctgcactacgaactgttggaaatattgtcacaggagatgactcacaaactcagtgcatcattgatcatcaagctcttgggtgtctcctcagtctgttgacagaaaatcacaagaaaagcattaagaaagaggcctgctggactgtttcaaatatcactgctggtaacaaagatcagatacaggctgtgattactgctggaattatttttcctttggtgcatctgctgcaaacggctgagtttgatatcaagaaggaggctgcttgggccatctcgaatgctacctccggtggttcccatgaccaaataaagtatttggttagcgagggctgcatcaagccactgtgtgacctcctcctttgcccagatccaagaatcg

SEQ ID NO: 2002 - DNA, 554 bp, Hordeum vulgare
aacctgcaactccacttcattcctgaagaaccgacataccaaatcattcaagaaattgtcacctaaatgcctcgcagagttgcagaagctcaactcaggctatacagtagcaaaatagtgcacaccatactaaagatgcaacccctacatagtagcctgatagaaaaaaacccagactcctcaagttcgacgattatactcctcttacaatcgctgtgatatttgatacccaggaccagttgctttcttgaaatcttcagcttattggacccaccacaaccatgaccttacccccacacaccgactacaccaaatggtgacaactccagagacaagggaattgccaccattggtcaaatctgtattcagcccaagttcagatcagggttgccaccttggccaaagtcaaaggcaacacctgtgggagcttccatagttgtccccatcgcatcatcttcctcctccatccagtaagcctcaagaatcttcacagccttctcatagatttcattgttatcatggctctgcaggttctcaatcttttccaggccttc

SEQ ID NO: 2003 - DNA, 399 bp, Hordeum vulgare
  UNSURE (371): n stands for any base
ggcgaagcgatcactctcccaggacagcggcggctcctcaggctcagggtccttcacgctcgacctcgcggacgcctcgcggtaccaagcgccggcgccgccggcgccccataaccccttggcgggcgccgccgaccacgacgacgaggcgatcatgcgggctatgatggcggtcatgtcttcgtcctcggcctccccgtcctcctcggcatcctcccatccgcagcccttctgccgggaccgggacagcagcatgcagcaacagccaacagccatggcgccgcagctgcgtggaggaggaccaagtggccacgtgatggtcaagagcagcctctccatgtcgccggagagaagcagcagcggcgggcggngacagcagcaggaggatccgacgagggc

SEQ ID NO: 2004 - DNA, 378 bp, Hordeum vulgare
tttttttttttttttgcggggaacgttcaaccacctaacctagccttccgtatggcaacgatttgctcctgggatcgggacacatatccttcctcttggtgcgtgctacgcagtgggcacgagcggaggaggagaagcggtcgcgtcgttaactgccttggtcatggcctcatggaacaatgcctggttccagtcgtcgtccatgatccggagcttgatgctggcgatggccttgagcagcacctgcggggagtaagtgtcggcgtcgacggacatgacgctgacctgctccatccaccggaggcactccaggatgcggagcaccagctccaccacgtcgcactccaccatcaccatcaccgtcaggttcacaacctc

SEQ ID NO: 2005 - DNA, 440 bp, Hordeum vulgare
cgggtggcgacgaaacctagccgtcgaccctaccctcccgcctccttcctcccccctcaccgtcgaccgaggagacctccgacgcagctcacgtggtcgtcaaggtcggcgctggcgaggatctggctgctcccggccagagggctcaggatgccgaggcggcggccttggatggtgcggcggcgctgtcttctacagcaagcggtgtcgcaggtggtgccactccgtttcctcggcgatagggcgacaagggaccgggagctgtcgccggttgcattgagcgctgcgccctcctcgcttgcggtcggatctgaaggcggcctccctcccacaagatgcactttgccccgccagatctggtcgtcggatctgttgttgggttgcgtggagttgcggaccgaattggtagattggaccgtttctctagccatgactgcgac

SEQ ID NO: 2006 - DNA, 448 bp, Hordeum vulgare
cacaggaatttgtactgaacaacaaacagcgagaaaatggagcatccataactcgaatcagatcagcccgcatgaatcagctctgtgaccctgttatcgcatcttgttgctgccaacaatagagagaatccttatcccctccccgcccacggcaaggacgcgagcaagcaagcacaaatcagccaatgaacaattcaaaagaattgcggacgaacactctaattcaaacacaaagaaccatgctccaaatccctcgccgatgatgctgcataggcgaccaccaccgcacaatacttgtgcactctcccaccttgcccaagcgacaccttcaagaaggagacgtcggacgctgcgtcatcccgtctagtctcaggaagacaagggatttctcctaggaaaggagtgggagggagagtgcatgaacctcgacgacgcctcagagggagag

SEQ ID NO: 2007 - DNA, 551 bp, Hordeum vulgare
gtacccccgggcctgcagggaattcggcacgaggggcgttcttcttcgtcgtgggatcctaaaagtagtctggcatgaagctgtgacatgctcatgtatgtgccctgcaccaacagcagctacactcctaaggggatgaaatcgaacaaaagagcagagatggaaacatggagtgtacatttccagctataaaggatccagctcagttggtggtttcacatgcaaagtcgagtaaggatgttctaaagcacccagaagaagtagaggacaggacaggaggagggaacaagaagcttcgtttatcattgatgttatatgtgatcaacaaaaacttgtgcttctcatccaatttttgtcaaactatgttgatgtgtggttatgcacttgtcgggcccttttgctgtgcacctgtactttagaactattttgttgtgtacttgttgggccttgaatctttatgtgtagaggagtcgatggatgatgtattgtaattcatgtgatgtgttactgaaatgaaatatatacaagtaatttataatcttttattctaa

SEQ ID NO: 2008 - DNA, 517 bp, Hordeum vulgare
gcataaaagattattaaattactttgtatattatttcatttagtaacacatcacatgaattacaatacatcatccatcgactcctctacacataaagattcaaggcccaacaagtacacaacaaaatagttctaaagtacaggtgcacagcaaaagggcccgacaagtgcataaccacacatcaacatagtttgacaaaaattggatgagaagcacaagtttttgttgatcacatataacatcaatgataaacgaagcttcttgttccctcctcctgtcctgtcctctacttcttctgggtgctttagaacatccttactcgactttgcatgtgaaaccaccaactgagctggatcctttatagctggaaatgtacactccatgtttccatctctgctcttttgttcgatttcatccccttaggagtgtagctgctgttggtgcagggcacatacatgagcatgtcacagcttcatgccagactactttttaggatcccacgacgaagaagaacgcc

SEQ ID NO: 2009 - DNA, 552 bp, Hordeum vulgare
  UNSURE (20): n stands for any base
gtctccccgggcctgcaggnaattcggcacgaggccgggccgctcccatctccacggcggtcgcggccttccgccgcactgcccctctcctctccgcggacaagccggcggcggcagcgacgagtgtggaggatgtcatgcccatagccacggggttggagcgcgaggagctcgaggcggagctccaggggaagaagcgcttcgacatggatccccctgtcggtcccttcggtaccaaggaggcgccagctgtcattgagtcctattttgacaagagaatagtaggttgccctggtgatgaaggagaggatgagcatgatctcgtatggttctggttgaaaaaagatgagccgcatgaatgcccagtctgctcacaatactttgtgcttaaggtcattggtgatggtggaaatccagatgggcatgatgatgatgatgacggtcatcaccactaaggatgcctcgtggttctgaaaataagaaatttgtgaggcatatgatttcgcttacgcgttctaagcaccagactgctccacggcatccttgtttatg

SEQ ID NO: 2010 - DNA, 550 bp, Hordeum vulgare
gtgctcacgaactcttaaagtgttaatttaacagaaatttttcaaactgcacaacacaaattcttgcatgattgaatcggtcaggtccatcacacccgatggacactcggtagcaaaagtaaaagttctctgcagccatctcttatttgatgatgctccataagacatgcactggacaaatctgaaaaaagttttgtttccacgaaaaaacctaaggcgaaaactaccacctgcttgatggccaaatgtatattcataaacaaggatgccgtggagcagtctggtgcttagaacgcgtaagcgaaatcatatgcctcacaaatttcttattttcagaaccacgaggcatccttagtggtgatgaccgtcatcatcatcatcatgcccatctggatttccaccatcaccaatgaccttaagcacaaagtattgtgagcagactgggcattcatgcggctcatcttttttcaaccagaaccatacgagatcatgctcatcctctccttcatcaccagggcaacctactattctcttgtcaaaataggactca

SEQ ID NO: 2011 - DNA, 486 bp, Hordeum vulgare
  UNSURE (6),(16): n stands for any base
actatnggaattaggngcctaacatgtctaatagatcactgtcagagggtcaaagtaaattgcttttctggtctcataatgtggcttcagattcggtacaaaggcaactcggaaatgtgaatttgtggttaattgactcagattcatcttgtagtgccgttgtttgtagccaaaagcagaagtagcctctgttatcttacgcatgtttcttttaacattgacctccattaacggatcctgaggtaatatcaagtatttgaggcttggacctgctccagcacttacccaagaaatattgatagcctttatcgatggatgcatctgccatttctttattatctttgtggccttcaatcctccagaaccctgcaattactttagatgttgataactgctggtctttggagtcaatattctgtacttaaggggtcttaaagtgtggatcgttctgaatgcttggtaaggttgaagttagctatgctagtc

SEQ ID NO: 2012 - DNA, 541 bp, Hordeum vulgare
acggatttatataaacacacaaattttgttacatttacattctagtccggctctagaggtataactaatacctaatctaaattgtcactgacacccgttcaccgtgtccggccatgaactccgaaagatgaagcttcgccttgacactctccagctcgaccaccgtaacctcctcctccggagacctggcaaccacaggtgtccaccctcacattgccgccaagcgattaatcaaccgactttgttcagcccaccaaacttggcatcgacgggaggggaggagcggtggccttcctgggtgagagtgttgacaacctcccgtgcactactctttgtcactgtcggcggcaccgcgaacgtgtcagcttcgttgggcacgactttggtgttgtcgttctcctcgttatcggtctcgccaaacgaggacacaccctcctcctctgtcgcccgttaccggtaggactccaggagtgccacttgctccaccctgccgacaacgagctactcctccgcctgcacgtgctcctggaggaggtggtgg

SEQ ID NO: 2013 - DNA, 1092 bp, Hordeum vulgare
  UNSURE (1)..(6),(15),(17),(18),(21),(23),(24),(26),(29),(33),(36),(42),(59),(60),(1031): n stands for any base
nnnnnnttgggaagncnntgncnncncangtgncgngccctncagtacgattgaatcgnnctaccgcgaaactcttaagttggttgatgaatgcgggcacatgttgtcgccaggcgaatgaacctctatctacattcctacaatacatagcgtattgtacacatggaggggggtgtctgtccttaccgccactgggacagtgcttgaaagacgagtcattgaacttgttgccgaaatgccatccaccgggcatgtcctgatagcccccccttggggggggggggccctatacctttctcgcgctttacacgttgttttgttgttcacccaccttgtgtcagcgtccttccccccacgcggattagggttcgcccactccagcgtatctcccccgtccccaccccctgcgctcttccttcgtttcccatttcctcggatcgtcgccttacccggcctcacctatccgaatttatccgcccccccccttctccacaccaatatatattgtccgctctttgtttcacctgtgaccggtcgtccccctcccatgtccccccacccagataccactgacccctatatccctagtccgcccatgcgtcccgcccgccctctgtcctcccttgtcccctttccgcccccctccaatccccacccccccatcctcgatctcgcccgacgcccaccactctcgggcgcttccacaaatcccctcccgctaccgtccaccactccgtttcttctccgttcccgcgttcttcgcgcccttcctctttatcgtctggatggtcctcccccccttccccttgctgactgttttcgccccgccggtggtcccgcgtgataatccaccgactcgactatccgccgcctataccgccctactacaaccacattaatcctgatgggttcccactctcccgtacttcttccccactagtcaccgtcgctgctcgcctctccgctaccttaccgccgcgcatctagttttttctccccccccgcccccatatcgtaccataccccccatntagtccccccctttcccattatccctcttcttctttatccctctcttcttcccgccccctt

SEQ ID NO: 2014 - DNA, 555 bp, Hordeum vulgare
tatatggagtaaagagttttgcacacaagcctttgatatcttgggtgtacattttacattgccaacaaactgcacaaatagtgccacccactacggaaataaacatcatttatttagtttaccgtacaactgcgccttttattttgctacaaaaacaaataatgatacactactccagttctagcttttcagccgcatagaaaataggaacaaggggaataacaaatcatgagcttataaagagtgcaatcgattgtgccatcatcaaagcgggccttttgtacagccatatgcacagtaataggggccgattaaaagatcgtcacgacgctgtcatggaccctgttcttctggttctgggcaacgcattcggagatccacatcaagttccttatctcctgctctcgtagcctcatgtacgcaaagaaaacagcatagtggaactgctgttcgaatgacaggcgcagcctctttacttcctcctcatagaaggccttgtccaacatctgactttccccatatgatatctttgcaaaaatagactggtatgggggg

SEQ ID NO: 2015 - DNA, 517 bp, Hordeum vulgare
  UNSURE (507): n stands for any base
gttgtataggcgcagatatattggaatccgctattcatccggtttcagagcccacacggtacagcaggcaacatacgggtcgcaaaatgcgcaagtctcagtctggtaagttcactgcatttctgagttctgagagattgctgtgtcattgatttttttaatggttttattttacagcaatgtccactccagttagtaggcagacaactatgaggagtatccgttcacagtctcctacagttcgtgaaacacaccatcgatcacggtccatgtcgccttctcgaaaagcacgagctaaatcaccgtcaccccaagtcatgaacttgaatccaaaagaaacaagagcaggttcgccaataccaactcctcccaaccccctcgcgcgatctgctacggtcgcaagaagaccacctctggatccaaagcattttagacaaacctcgatgcaggtgcagtcggactatgaaaaccagaaagagcgggagaaaagaccgagcaaaggccggngcttcctcaa

SEQ ID NO: 2016 - DNA, 538 bp, Hordeum vulgare
tatgctatctgaacttgtatttagttgctatgtatatgtgcttgcgcaactggtggtgtttctgtctgcaatgtactatctataaacacatgggaatgacacacaggcaagcaaaaggtgttgagctgacaactccaacatcacatgtatgaaggattgagattcggtcaacatggagcttgattttttaacaatttgcagcaatcagtactcatccaagtagttgtacagcgactcgtcgttcctccaccggcgcctcgtgagcaacgacttgaggaagccccggcctttgctcggtcttttctcccgctctttctggttttcatagtccgactgcacctgcatcgaggtttgtctaaaatgctttggatccagaggtggtcttcttgcgaccgtagcagatcgcgcgagggggttgggaggagttggtattggcgaacctgctcttgtttcttttggattcaagttcatgacttggggtgacggtgatttagctcgtgcttttcgagaaggcgacatggaccgtgatcgatggtgt

SEQ ID NO: 2017 - DNA, 518 bp, Hordeum vulgare
gccacgcaatccgataagatggagaggaagtccaccatcctcatgaaccggtatgagcttggccgtatgctcgggcagggcaccttcgccaaggtgtaccatgcgcggagccttgccaccaaccagagcgtcgccatcaaggtcattgacaaggagaaggtgttgcgtgtcggcatgattgaccagatcaagcgggagatctccatcatgcgcctcgttcgccatccaaacatcgtccagctgcacgaggtcatggccagcaagagcaagatatactttgcgatggagtatgtccggggcggcgagctctttgccagggtagccaagggtcggctcaaggaagatgctgcaaggaagtactttcaacaattgataggggctgtggacttctgccacagccgtgatgtctatcaccgggacctcaagccggagaaccttctcgtggatgagcatggaaacctcaaggtgtccgacttcgggttgagtgccctcaaagagtgtcagaagcaagatggcct

SEQ ID NO: 2018 - DNA, 560 bp, Hordeum vulgare
tacctataatagccttacggtctcttatctgcaggatgataggtatggcttcgtcccacagcaacactgtaagagtgttactgtgaccttttgtgcttctagtggtgaacagaacaggagatccatatactacaattgctaccacaaaagggaaactgcaaaaaagattaacaaagagccctaaagcatgatgctcaagtgagcaaagtctcagcagaaagagagaggagaatagattgtaattgcatctcggaagatatcacacttaaatgacattccttttggtcgacttggaggacggagttggaggtactgactccgatactaatggaagcttttcctctgacggaccgttccagcagatgtccttgagagaaggccgtaggccctttttgcagaaccgttcgtactccaatgtgtctcctgccgacttcttcacctcaacaacatagaaggatggagtcacttcaaagatctccgcatcaatcgcaagctgcccctttctcccttctttggatccctgcagcgtcacaagtccgtcctgcttcttcaccttgaag

SEQ ID NO: 2019 - DNA, 519 bp, Hordeum vulgare
ggagaaagcgtcagcaatggctggaatgatgagagaaatggggacagagaaagtggaggtggcgatcccacgtttaatgttgaggaggccgagcagttcctctgctccatgcttggagatcgttctgagctcagcatgggtgtggtcagagacgtgctgggtcagtctggatatgatgttgagcaggctctggacgcattgcttgatatctccggtatgggatggtgcattcccaatgacgaaatgaatggctcatcctctccaaatatcttcccaggaaatggattatttgaagaagaatctgctgcaagtattcaaaagagtccatgccagttcccagaagaaatacctggtatgtcatacaatcactccgaaaggcaacatgaattcttctggggggaacaacagagcagctacatgaaggctgtttgcgaggtgcaacactcggaaacaccgtctccaagatcagcggtggtggattccaagatgccacagcgagtcttggagtcgctgttcaaa

SEQ ID NO: 2020 - DNA, 542 bp, Hordeum vulgare
ttacattgcacaaactagatggttgtatcttacagcgagacatggtggtaaagttacactgtcggctgttccttccacccttacataaaacaattagacaggcacatagcttcaagagtacaatacaaggttagcagcctagaatgatggtgacatcagacggcgcctatctcctctttgctattcccaagctgttgtcagaaactacctcgtactacaccagaacctaggtcacctatccataattacatacaggacatgtaagtacagatagatacaggagagatacatagattagaacggcggttaaatctatgtcagactccaccaaaaagagacgaggcgaggctttgacttagtcagaatcgctgtcatgctccaggaagcggtattctcttggcccgcctagtcgtagtactatagttccggagtttccttcgtgccactcgatgccttccttctccacaagctcgataaccgatcgttttatctttcctttccctgtaccttcaacaccacaaccagtaattactctaaggagg

SEQ ID NO: 2021 - DNA, 458 bp, Hordeum vulgare
ctccaaactctccttccctccacagccacaaaagccgtccctggagctcgccagccaagagacctcacctcacctagctccaaggcaccaggcgcaccatgggttgctcgggctctaaggaagtggcggtggcagaggttgcctaccgccctccggccaccagcgtctccctgttcgacatcagcgctgtcgaggagccgtggctcatcgctaagcagaacgccgccgccgccaacggcgacgtcaaggcagaccagagtgatgacgaatacgaagacgacgatgaagaggaggatgcggaggaagagcaggacactcagaagcccaccaccggcgtggcgctccctatcctcgacaagctcgacggctacgagctcgcgccggcgtcgtggtccgaggtgagcaaggcccttgaagacatcaagcctacgctcgactccaagcaaacggcggacccc

SEQ ID NO: 2022 - DNA, 335 bp, Hordeum vulgare
ttttttttttttttttttttttgcaaggccgactgagacttgattaaatttcgattgagttttaaaaaacccggtttacagaagagattactcaatcaattaccctgactgccaaagctacacaacacacgccgaagttttccttttcggttcaacacacaataccctgttcttattaaactgtactgtattctatatactacagagaacatgctttgatttatgctcgaacgcggaaggcaacggcatgttttgtgtacgtatgcacagatacatggatgaaggttcggagctccatcagtggcagatggggcacatcatcaagccgttctcgt

SEQ ID NO: 2023 - DNA, 471 bp, Hordeum vulgare
tcccccccgccggcctgctcccgctccaggtcctccaaaaggctcacgctccgcccgcccgccgcctccgctgaccccgccggggaggccaagtcgccagggttgctggagaagtaccctgcaatcaccaccggcttcttcttcttcatgtggtacttcctgaacgtgatattcaacatcctcaacaagaagatctacaactacttcccctacccatactttgtctccgtgatccatctacttgtgggggtcgtgtactgcctcctcagctgggccgttggtctcccgaagcgcgcgccgatcaatggaacgctcctgaagctgctctttccggtggcactgtgccatgctcttggtcatgtcacaagcaacgtgtcctttgctactgttgcagtctcgtttgcccacactattaaagctttggagcccttcttcaatgcagctgctacccagtttgtccttggacagaca

SEQ ID NO: 2024 - DNA, 540 bp, Hordeum vulgare
tttattactgcacatctgagctctctcatctgatggaaacaacgggtcttacatctcaatgtagctgttcgacctcacaagggaacactttagcagataactgaaaaacaaaaaacaaataacgaagaagcgattcgtccatgtcatctccggggcaatgcagcaccggaaaccatcagaccatattcacagcagtcacctcatcacgcagccttcgcccttttctcttcctcgatcttagctttgatgtacgagtagatggcaacaccagctattgcaacgcaagttccgattccagtctgtgtggtaattttgttgccaaaaatgatgatagagaaaccaatgacgaaaacccttttcaacacattgccaacagcatgtgtcagaggggccacccgctccaaagtgtttgtagcaatctgattatagagatggtagaacaatcccaccaggaaaagatctgatacaaattttgtcagacctacttttgcaattgcatcgtttaatccatactgcattagttgtggtccttcaataata

SEQ ID NO: 2025 - DNA, 518 bp, Hordeum vulgare
cctcgtgccgaattcggcacgaggcgtgaactctacacaggcatagcgatggagcaactggaacgaaaacatcgtcagcagaatagcctgtattacactggattcaggacccagaaatgcggagcaacaccgtacttctccctggaggcattgctaggcgatatcagcgacgggacacggaagctgaagagctacaccgacgacaaagacgaccatggcagtggcaccaaagacagcatgtccatgaagctggagagggatctcggatgcgtggacccgtcgatcaacagcgcgtgggacatggggtggcaggactggatctgcatggacgaaacggagtgctgggtaagggacgccggggagggcgttctgtccttgctcattgaggaggttgctttggaaatgctggtaaactgaccagagaaagacgggaagtaggaggggttcttgccctgtcgtggagatttagctctattctgtacatcattggcacagctcgtgctttcggttgcattcta

SEQ ID NO: 2026 - DNA, 559 bp, Hordeum vulgare
  UNSURE (18),(28),(29),(42),(43): n stands for any base
taaacctacttcctatgnagggagaatnncttgctattttanngcttatcatgccttacaaagttatgcacagattacgatagtttcttaaccaaggcaaaatccccatcaggagaacacacgtacatagaatgcaaccgaaagcacgagctgtgccaatgatgtacagaatagagctaaatctccacgacagggcaagaacccctcctacttcccgtctttctctggtcagtttaccagcatttccaaagcaacctcctcaatgagcaaggacagaacgccctccccggcgtcccttacccagcactccgtttcgtccatgcagatccagtcctgccaccccatgtcccacgcgctgttgatcgacgggtccacgcatccgagatccctctccagcttcatggacatgctgtctttggtgccactgccatggtcgtctttgtcgtcggtgtagctcttcagcttccgtgtcccgtcgctgatatcgcctagcaatgcctccagggagaagtacggtgttgctccgcatttctgggtcctgaatccagtgtaatacagg

SEQ ID NO: 2027 - DNA, 544 bp, Hordeum vulgare
ggtctgcagggaattcggcacgagggccatgtcgaagctctggagaccgggtcggagaagcctagcgcctcgctcgtcgacgatgaggagggcggcgtcctcttcctcccgaccaacaccagcgcttcctcctcgtcctccgggtttgggtacgcgtccttggagaggctgaggcagcggctgccggtgtacaagtaccgcaaggccatcctctacctggtggagcggcatggtacgaccatcatcgtcggcgagacgggtagcggcaagtccacgcagatccctcagtatcttaaggaggctggttgggctgagggtggtcgacttataggttgcacccagccaagacgattggctgtgcagacggttgcatcaagagtagctgaagaagttggtgtgaaacttggagaagaagtaggatatacaataagatttgaggatgaaacaaacccgggcatgaccatgataaaatttctcacagatggggtactgattagagaaatgatggaagatcctcttctgagcaaatatagtgtcattatga

SEQ ID NO: 2028 - DNA, 538 bp, Hordeum vulgare
tttatttgcctatggtctactgcgtctgagatcaaaatactggtgtagttaattaacttcacaataaaatcaagaatgtaactcagctaccactcgtcaagtcttcaaatgatttttctggaataaattttcaaatgataaaaaatatcatctgtgtttatgtctttgcaaaccccatatagccaagggcgcttgatactagtatgagcaatgcagcatagataacagggacacaaaatatactcctatcgctaaacaacaggatagcaccttaagtccaaattatatacagacacgttggcttccgttagtttggaaaaaactgtgcctctacaagatggaagattctttctttgcctccaaatgtgtactgatggaaatggtgagaccccagccgaccttggtatactagccaaaagagcaaaaggcaaaacgagtactcttaccattaatgcaacagtgcaccgtcacagttaagttagtgcggggctggattgggtgttcggaactgatagaaatgaggtgcagcttcagtaag

SEQ ID NO: 2029 - DNA, 1357 bp, Hordeum vulgare
  UNSURE (1)..(7),(14)..(17),(22)..(24),(26),(29)..(31),(34),(35),(37)..(39),(41),(45),(47),(50)..(52),(55),(57),(60)..(62),(64)..(66),(74),(77)..(90),(98),(100)..(102),(106)..(110),(129),(138),(169),(292),(525),(578),(1042),(1084),(1270): n stands for any base
nnnnnnnttgaccnnnnaagtnnncnaannntgnngnnncnttantncgnnntgntnggnnncnnnacaaaccnacnnnnnnnnnnnnnngttttttngnnngcgnnnnncccccgaaaagaccggccncccccccgncccggccccgccggggggggggccttttctncccgccgcgggggggtgccttccttcttcctttcttccttgtttccctccgccccttttctcgccttcctcttttctttttttcccgttctcttcctgtttccccttccgtccttcgctgtcntccttctcttgcggggggggggggggccttcccttctttctttcccccctctgtccctttcctttcgtctccccctctttccgtccgtcctccttccctccctcccttccccgtctctcttgtcttcccccctttttgcgttttgttccctccgccgcgtctttgtgtttcttcgtttcccttcttttttcgtcctttctttcttccccgtccttcccctcttttttttttcntctccttccccgccctttccttcccttccttccccttccgcgtggcttgtttntttttctcctccttctccgccgcgccccgttgcttcgcttgttgtccttttcctttctcttccttttccttttccttctctgttcgttctctcttcctttctcttttcgtttttccctccccccccttttttccctccttttcccgttttttcccgccccacccgccctgccgcgccgttccttctcttcctctccccttctcctcccctttctctttcccgcctctttgtttcgccttttcccctttcccccctttcccttctcgcctttccccctccctctttttttctctcttgccccccgttttttttccctcgtctcttgtgtctcgtttttccctgttctctcgtccccgtcttttcttctcgccgctccccctttgttttctccctctgtcccgtgtgctctccgcctgcgcctcctccgtaatccgcctcttttctcgccattcagattaccatantatcaccatctaccaccttacttttcgcccatgatcacgatntgattgacgccattgtttctatctttacacacctttttcacttccaccctgtcttaccaatttgctcttgtgtatacatttatcctccccgttctttcgttttcagccacatttctccgatccttgtcaccattgttctcattacccttcattttgttttgttttaccacccgccatatttttttnaactatctcagcgcctctctcctctaatctattgacactagccgcggaagattataccccgactccacaagctcgccatatatcgcg

SEQ ID NO: 2030 - DNA, 552 bp, Hordeum vulgare
gctacaaaaggaagacacattactatgtcggccgaatctacaggtacggagtagtatgttcggctccaagatttcatggagaagtcatgcatcaggatcagatctatactaatagtaggagtactacacaacgggtttactgtttgctcctcttgtttggggagagcataagccggctaaaatggtaatctcgcttgaataggcagatgcgggataagctgtagaagcatctgttgacatagaattctcggcgtcacagtgaaggatgtcgagcttcacccggtcaccatatcttgttcttgacccaaaagagcatcagtactatcccaatcacaatggccacaggggcatacttccgaattaaggcctggcgattgagatcctttgccttgtctgcatacattctcgtatcagaggtcaacctactagacatttgactcacctgatctagtttttcacccacaccaagaacttcttgaacattgcgagtcataatctggtgcacctcgtagagctcatcattcaacttggcaaggttcctttgggttctgg

SEQ ID NO: 2031 - DNA, 521 bp, Hordeum vulgare
gggttcacttctgaagtgatccctgtgaactccagggtggtggtggatagaaatgtggtgaccagccagggtccaggaacagcaatcgagtttgctcttgctttggtggagcagctatatgacaaggagaagatggaggaggttgctggacctttgtatgtccgccctcaacatggagccgagtataccatcgaagagcttaattcgattgaatggaaatgcagtggtacacctcagattcttgtgccagttgctaatggttcagaggaaattgaagctcttaatttaatagatgtcctgcgtagagcaggcgcaaatgttacagttgcgtcagttgaggataccctgcaaatcgtgacccggcgtcacaagtttaatctgatagctgacatgatgttggacgaagctgctaaaatggaatttgatctgattgtcatgccgggcggtctgtcaggtgctcaaaagtttgcttgtacagacaaacttgttgatttactgaaaaagcaggcaggatctggtaa

SEQ ID NO: 2032 - DNA, 545 bp, Hordeum vulgare
tagtgtgtcgcaaaggtaaaaaccatcccttggtgtttttatctgtgcccttggtagatccttacacagatgtactacggccacaagtacataggtgttaactacagacaactgcaatgcaccgcaaaacagcaacgttttagtatacaggctatgatacatataccacgacatcaacgataagggcgaggcgaacagattatcttgaccaaacagcttattaacaattgatgaaagtgtgacttactgcagtttctcagtttttcctcgacgaagctaagatgataactccatttgcgcatggaaagtatgttgtacattcactgtaaacatgtttacggtatgcttctgtagttccagtaaatgcacacacagttcttacgagcgcaggcatgatgtacacagagttttggttatccacacagtttgcactttgcactgcacacagcaccaactcagtttgttatcacatgaaaacaaactccttcgctataccgaccgctttctctcgaccaaatagcttctcaacaatagccagggcgaac

SEQ ID NO: 2033 - DNA, 519 bp, Hordeum vulgare
aatccaatcatcccttgcttggatccatccccaccaaataccgtcgatctctattcatcacctctcctattctattcgctccccaaagtcttcgtctggtcttcctccacctcgacgcagacatggccgccgccgccgcgtcggatctggagagcaaggccaaggaggccttcgtcgacgacgacttcgagctagccgccgagctctacacccaggccatcgaggctggcccagccaccgcggagctctacgccgaccgagcccaggctcacatcaagctgggcagttacactgaggctgtagctgatgccaacaaagcaattgaacttgatccctcgatgcacaaagcgtaccttcggaagggttctgcttgcatcaagctggaggaataccaaactgcaaaggctgctcttgaagttggttcttcctatgcatctggtgactcaaggtttactcgtcttatgaaggagtgtgatgatcgtattgctgaggaggctagccaggcgccagtaaagaatg

SEQ ID NO: 2034 - DNA, 566 bp, Hordeum vulgare
  UNSURE (33),(35)..(37),(55): n stands for any base
aaaagcacagttatttcagtaccaaaaaatagncnnnccgttccacaagttgatnagtcttgccaccagttacaacggacgttttgcacttccataccacagatgcacaggtatgggcttactccattaccaactgtagctcgcaaaactaggataagtacttaaaagctaacctgccacgcaaacagcttacaaatacggaaacagaatgaagacacacataatccgaccaacattgatttgcaagtctgcagccatgttaacacttacgaccaggatttacaacatggatgatctggtttcattaatactcccacttcttgagctccattccatcaggagggcttccttcaaccgtctttttcccgacatctttccagttggttgagagaacggttccattagactccacaaaggacttcatcattgctctacgcatatcttcatcagcatcactgtaaatttcacggaaaaacttgttcaatgcagcatcaccgtcaagtttctcatccttctcctgttttttcacttcagcctcaagcttatcccagtcctttttggatttt

SEQ ID NO: 2035 - DNA, 394 bp, Hordeum vulgare
gaggttaggatggtgaacttggtggaggcgcagaagccgctgctgcacttcctgatcaagagggccgggcttcggcagcacactgtggacgtggatggcgccggcacggtgctcaccttctgggtgcccaaggacaagctccccagggacaagtccaccgtgtgtgagatcacgcccgaagcggcggcggagaccaataaggcgccacccgccaacgccaagaagcatagccacaccaaagctaaggcctcgcggccttctgtcgtcctcgtgcacggcttcgcggccgaaggcattgttacgtggcagttccaggctggtgtgctggcgaggcactacgacgtgtacatcccggacctgctctacttcggcggctccacgtcgccgtcgacgg

SEQ ID NO: 2036 - DNA, 361 bp, Hordeum vulgare
tttttttttttttttttttttacctgaaaaatagaaatagacaaattgggtggtggtgactccatagtattatgaatcacactcacaaatattgtacacggccaaacaatcaaactgcaacaaatgggaccccggtcctctgtgaacaaatcaagcactctacggagcggtcgacctactaatttgtcactccttggaagcttcagcactgacgtatgccaggaactccaggagacgccggttgtagacgcagggcctctccaggtgcacgagatgcccggccttgtctatgctctgcaacatcgtctcctcgccgagctgctctttcattgtcttggcaagctctatgttgaaaatgttg

SEQ ID NO: 2037 - DNA, 380 bp, Hordeum vulgare
cgagggccagcagggagggatggcgaacgggaatggcgtggctccgccgccgtcgcgcacagccggccggccgtcgggcccggctgcgtactctgacaggcggctgcgcctcaatccgaatacggagcacaagccgcaggactactccgacgtgcgcggcgagtacgcgccagccgtgtacagcgccctggagcggcacctcccgcctagcctcctcgaggccgaccgtgatgtcaagctgcacttcatgcgggacatactcgcgcgatattggccccatggcgagcgaaacaaggttcataggcacaaagaatacaggcagaagatagtccacctctataagccacttcatcaagaattatacagcatgcatcctgcag

SEQ ID NO: 2038 - DNA, 425 bp, Hordeum vulgare
catgtggccttttttttttttttttgaggccagtacaactgaaacactataaaagtataacccatggcttatgtggcaatacagcagggaagtttacatttactccataagatgcaatgacattgataaatataccagctggaaattggacaacaactacactagatgttttccaaatgatcaaaggatgtttataacatgatacaggattgtataaaatacatgcagtaaatatgaattaaatcattgcccctccacgcctaagaaatgccaacttggtcgctttgacacactggatctgtctttctctcttttcacgctggcactcaccgcaccagctagaaaaatccatctggtatttcttcatctccctgaacacggagcttctgcaccacaaaagcagattcattctgagccctgatgat

SEQ ID NO: 2039 - DNA, 543 bp, Hordeum vulgare
  UNSURE (12): n stands for any base
gggactgcaggnaattcggcacgagggcttcctcactagtatggctacattgggtgtccatcctggttgggctttcgatggatctgttgcccgaagatgtatccgagcctgcaaccgccggcagcgcgcctctaggtgccggatctgggctagcaattgctctccttcactatcctcccttccagcgcagggaccggcgagtcgcagccggcacgctcccccttccctcttctatgcgtcaagatcaacggtgggctcgccatcgcatgcactctgcctacctccccttcctaatctccctaccagtgcacagatctctacactgcagcccacctcccgggcgacgccatcgtccggccattgctttggtctctcgggtagggtacccccggcttggcgctgcactcgcaaatctcggcccccgcttgtggccaaaacaagctgccctcctcccttgttgtccagtcccccaaacttccactgcgtcaacacgcgggatgcggttcgcacattgctgtgcagttgacgccttcgtgcaattca

SEQ ID NO: 2040 - DNA, 547 bp, Hordeum vulgare
  UNSURE (66): n stands for any base
tgtagtgcactgcaaatttaattaaattacacaaacaacctggaattttcttactaagaagctcgntcgccagtggaaagcacatcacccaccaataactcgttgccgtggatgaactgcaccggaaagctaaccgagctacatgcaaggtaaagatgtactgcatgcccggctagatctcatgggagatccacctcaagcatcatgagccacctcaaaggaactctactgaattgtaacccggttaataatttttatacaaacaagcacctccaaatttacacatatcactctttaacacaagcagtacacacaagagacaccgagacctgcatccagaaaccaaccaaacttgatccacgatcgagtcaaactcaagtgaggaacctatctgcattaaatttacaattgcttccttttactgcatgtgacaacattctgaactgcacgccatcagcacgtgaccaactgtgtgaattgcacgaaggcgtcaactgcacagcaatgtgcgaaccgcatcccgcgtgttgacgcagtggaagtttgg

SEQ ID NO: 2041 - DNA, 515 bp, Hordeum vulgare
ttttgatttgagaatccaatccactcgtcttcctccggtccggcctttcgcctctccacatcgtcgacgagaaccgcaacggccgctcgccgccgttaagtacaggctcctactttatgcgccttggttgcgtgcgtatccactggcagtttcctcctaaggggatctgtttatcgcgatcagtgccgagttaagatcgagaggtaggaggagcttttgcgggagtggggatggcttccggcgggaacccgcagttccggtacacccagcctccatcgaaggtgatacacgtgaggaacctgccgtgggagtgcacggacgaggagctgaccgagctggggagcctcttcggcaaggtcgtcaacaccaagtgcaacgtcggcgccaacaggaaccaggcgttcatcgaattcgctgaccaaaatcaggcaattgctatgatatcatattatgcatcatcagccgagccagcacaggtaagaggcaaaaatgtgtaccttcagtactccaataga

SEQ ID NO: 2042 - DNA, 559 bp, Hordeum vulgare
gtgtagtaataatattaattaaaatctttatctacatatatcaaatatgtcatagtatttatttgaattgttgtcttatttgatatgtggatgttacttcaaaaattcacaacaaatttctgcaacaacgcgttgggcgtcatctagtgtgcaccaaaactgagcacacaactacgaagtcaggagccacaataaaatggtcgccggcaagtactcgcacatgcgtttcttacatacacataagctagctagcgattaaacggatgaagcggcctaccaaatcgaggatactgacctccctgcccctggaaggccatcatctgcggcccggcaccaggaggaaactgctggttgccatataccggaaactgcggcattgattgcatatgaccttgaggaaatggcgggcctctgtaacctggaccttgcatcatttgaggacctggaggtagctgctgccttccatggccagggaatgacatcgcttgatgattgggcatctgttgatttccttggactgaatgctgtgccatttgagcttgatttgagccttgctgga

SEQ ID NO: 2043 - DNA, 935 bp, Hordeum vulgare
  UNSURE (1),(51),(53),(55): n stands for any base
ntgtcaaacttaacctagtacccccgtgtctgcagcattcggcacgtgggnananactagtctcgagtttttttttttttttttttttttaaaaaataacaaggaaacctgggtttgaagtttcaagttgcctttttccacgtccagaacacaagttttaacatgctttgcaaagggtaaatgttcccctgccgaaggccacattaatttccccgacgaagtcctttccccagatgcggttccttgctaaacccctaaattttgataagggaaagagccctggtccctcagttttttaaatttttatgcagctttgggccacagggcacccaaatgagggggaaacccccccaaagatagcgggctttttgatttttgtaaaacatcgagcttcccctaaaacaaattttgcccagaatgttttcctttttacgggctccaagcctaagctgacaatttccccgtttgttttgttaaaaaaggctcgagcatgtcctcctcataattttaaaaataataatggaattcgatatccccctccttttcctcctttttttaagaaactggacctgctcctttggttatatgccttccactttaaaaatactgttttccaaagagttttttttcctttggggcagaaagagctgactttggcataagcttaccacgctgtagcgccaattaagtttaaaaacgttttttccaggccttaaagttctttacagaaacagttttcccatggggtataaggacctcctcagctggttcttcagtttccccaggttcctcatcttccgctttttgacctatttttaagttaacattctttagccgagggggaaggagttttacctcgcctacccaaatttcagtcgcctttggccagcttttttttcaggatggaggggccgtggttaaaccccgccactttt

SEQ ID NO: 2044 - DNA, 533 bp, Hordeum vulgare
  UNSURE (10): n stands for any base
taaacttggnattgaagttcaagttgacattatccacgtacagaacacaagttataacatgctctgcaaagtgtaaatgttcacctgacgaaagccacaataaattacacgacgaagtacattacacagatgcagttccatgctcaacgcctcaactttgatcagtgagagagcactggtacctcagctttttagatatttatgcagctatgtgccacaaggcaaccaaatgatggggaaacacacacaaagatagcgagctctatgatatatgtcaaacatcgagcttcccctaaaacagattttgcgcagcatgttttcccttttacaggctccaagcctaagctgacgatttccccgtctgttctgctaaaaaatgctcgagcatgtcctcctcatcatcttcaaaatcatcatcgaattcgatatcctcctcctcttcctcctcttcttcagcaactgtacctgctcctttcgttatatgccttccactttcaaaatactgtcttccagagagtttcttttcctttggg

SEQ ID NO: 2045 - DNA, 525 bp, Hordeum vulgare
caaacaagctctttgccagacctctcccagggcgacgtcttcgccttcccgcgaggcctcgtgcacttccagaagaacaacggcgacaagcccgccgccgtcatctccgccttcaacagccagctccccggcacgcagtccatcgccatgacgctcttcggggcctccccggaggtacctgacgacgtgctcgccaaggccttccagatcggcacagtggaggttgacaagatcaaggccaagtttgccccaaagaagtgaaaggctagacgcgaacaagattcagacttttgtaaagtaccattctcagtggttcgtttattgatttgttggtcttccaataactgcgttaagcatgtcatgctaatgcagtcgtgtcgtgcattcttggcgacccgactggcgacctgtgtaagtggcctcaagaaccagaagtatgtaatgctaagtttgactgttggggagggaactggaggggagaagagaatataatttgtccaacgagttagtgtattctactcgaat

SEQ ID NO: 2046 - DNA, 549 bp, Hordeum vulgare
gacaatgagggatggtattaattcgagtagaatcactaactcgttggacaaatatattctcttctcccctccagttccctccccaacagtcaaacttagcattcatacttctggttcttgaggccacttacacaggtcgccagtcgggtcgccaagaatgcacgacacgactgcattagcatgacatgcttaacgcagttattggaagaccaacaaatcaataaacgaaccactgagaatggtactttacaaaagtctgaatcttgttcgcgtctagcctttcacttctttggggcaaacttggccttgatcttgtcaacctccactgtgccgatctggaaggccttggcgagcacgtcgtcaggtacctccggggaggccccgaagagcgtcatggcgatggactgcgtgccggggagctggctgttgaaggcggagatgacggcggcgggcttgtcgccgttgttcttctggaagtgcacgaggcctcgcgggaaggcgaagacgtcgccctgggagatggtcttggcaaagagcttgtttgcctcg

SEQ ID NO: 2047 - DNA, 1515 bp, Hordeum vulgare
  UNSURE (14)..(16),(22),(23),(34),(40),(41),(45),(49),(662),(675),(728),(841)..(866),(874),(883),(888)..(899),(901)..(903),(906),(917),(924),(926),(929),(930),(933)..(936),(938),(940),(945),(947),(949),(950),(953)..(958),(960),(961),(964),(965),(970)..(972),(980),(981),(987),(988),(990)..(992),(995)..(997),(1004),(1005),(1008)..(1011),(1013),(1016),(1017),(1023),(1025),(1027),(1029),(1031),(1033),(1036)..(1039),(1041),(1042),(1044),(1046)..(1048),(1052),(1054)..(1056),(1060)..(1065),(1068),(1070),(1073)..(1075),(1080)..(1082),(1084)..(1086),(1088)..(1091),(1093),(1094),(1098)..(1103),(1105),(1107)..(1110),(1112),(1113),(1115)..(1118),(1120),(1121),(1123)..(1127),(1130)..(1135),(1138),(1140),(1141),(1143),(1145),(1148)..(1153),(1156)..(1159),(1162),(1167)..(1171),(1173),(1177)..(1181),(1184)..(1186),(1188),(1190)..(1194),(1196),(1197),(1199)..(1203),(1207)..(1211),(1213)..(1215),(1217)..(1224),(1226)..(1229),(1231)..(1234),(1236)..(1245),(1247),(1248),(1251)..(1258),(1260)..(1262),(1264)..(1266),(1268)..(1272),(1274)..(1277),(1280),(1282)..(1289),(1291),(1294)..(1296),(1299)..(1306),(1308)..(1312),(1316)..(1320),(1324)..(1327),(1329)..(1331),(1335)..(1345),(1347)..(1352),(1355),(1356),(1358),(1359),(1361)..(1363),(1365),(1367),(1369)..(1373),(1375),(1377)..(1379),(1381)..(1387),(1389),(1392)..(1398),(1403),(1405),(1406),(1413)..(1417),(1420)..(1422),(1424)..(1428),(1430),(1432)..(1436),(1438)..(1440),(1442),(1443),(1445),(1449),(1450),(1452),(1453),(1454),(1457),(1459),(1460),(1465),(1467)..(1470),(1472),(1474)..(1477),(1480),(1481),(1487),(1501),(1511),(1513): n stands for any base
tttttttttttttnnntttttnnttttttttttntctttnntttntccntttttatccttacttcatttgggtatgggctaggttatcacgcgataatgtaggtcttgtcctccgaccccggcccctcccctcttttgtctccatactctttatcccccctccgatttgctccctgcttctccccacgcgccaagtttgcacttctcagcttcccaggccgcggacatgtacctgtctcactcttttcatcgcgagtgttccagttagcttatacctagacacacttagacgtgcaccacccatcgcgccggcccctccgtgtggcgccgtctctgttgccgccggacgtaattcctatctagttatgtctcgttgttggtaggggttatattactcatctgtttcgcgccccacgccagtccctatcctatcacagctccttttatatatctttttactctcgcgtagtgttgtgtgtttggttaagggggcgtagcgggtggcgggatatcgcccccccatcgtctctccctacctcacaccccccggtcccctcgcgccttccctccggctccccggttcatggtgctcgtctatgtctccctttcctcccctattcctcaccttggtgtccatttctctccctaccatatcccccccncccctcccgtttnatgtctctactgcatatgggagcctttattagcgcgtatcgggggacgggcgncgagcccttcctgctctcagccgcggggcgcgcacgccgcgccggggtgcccagcgcgcgcgagtagcgttccttattatttcacatcccccctattcccccccgaacttttnnnnnnnnnnnnnnnnnnnnnnnnnnccgagaanccggggatnagagnnnnnnnnnnnnannntcngacttgaaggngcgtgtntnccnnggnnnntncntcgcntncnngannnnnnannttnnaggtnnntttcttannctgggnnannnctnnnctcaggnnctnnnnanggnntttgcnantncntnancgnnnntnnangnnnacgnannnttannnnnncancntannnggccnnntnnngnnnntnncaannnnnncntnnnngnncnnnntnncnnnnncgnnnnnnttncnnancnggnnnnnnatnnnnccncagcnnnnncnttcnnnnntcnnnangnnnnngnngnnnnngaannnnncnnntnnnnnnnnannnntnnnncnnnnnnnnnncnntgnnnnnnnncnnnannngnnnnncnnnnatngnnnnnnnncnttnnncgnnnnnnnntnnnnnggannnnnatcnnnnannncctnnnnnnnnnnnannnnnnggnntnncnnntngnannnnncnannngnnnnnnngntcnnnnnnntcaangnntttttgnnnnnctnnngnnnnnangnnnnncnnntnnangggnncnnnagntnnccgtnannnntncnnnnggnnaaaatnttttttttcttaantttttttggntnaa

SEQ ID NO: 2048 - DNA, 543 bp, Hordeum vulgare
  UNSURE (11): n stands for any base
tcatatatgancattaccaaaaaaaaaagatgaaatggaagttttctacaacgtttcttacaaacgattcccagccccaaaattccatatgacagctgtggactcttccacataattttcatacatcagctcgggaagggcaagcgtagaaaaaccgcagggcacttcaatctcctaggctcaaaccgttgcagctacaactgggtagagttttcagctaaaagctagggatcccctcctcattgtgctaccgggcttgaatattcaggtccattctctgaagaggttatgctggaggaacctgctgatgtcacgttgctgtttgaactattccttggttggagttccgtctctctctgcctctctggggctgccggcgctgccccctcatcagctagtctcttcagaatgttcataattgtcggaacaaattttgtcgacagcgaaaggagagctggaagctgtgtaacattcaagaaatccatttcggaattcgttggcaatgtctagttgtacccacatggctttcccgactaggaaaac

SEQ ID NO: 2049 - DNA, 512 bp, Hordeum vulgare
gatggcacttatgcccacagagtgctgctaccgaggccatttcgactccatcatttactcctggatcattatcatccaccctaaacctcagatcactcattctgtcaggcgattttttcttagctgcagttgttgcatgtacccttaccaaactggtattaaggctggaggaggtgcaaccatcgaaggttgaagcaaacaaggcttgtactggggccttgctggtcattacgtccattcttcagctggggctatcctcctaccttccccaaccaattgataatgattcatatgacaggattgtgctttgtgtgaagttgctttgcaatattggtgatgatgtgaggaggatttggttgcaatcatgtagacagagttttgccaagatgcttgctgagaagcaattcagggatacagaagagatgagggccaaggcacagatctctcatggccagccagatgatcttattgacttctaccacctgaaaagcagaaagggcatgagtcagctt

SEQ ID NO: 2050 - DNA, 552 bp, Hordeum vulgare
tatattaggtattgtttctcaagaacaaaacacgcaacaatattatatggagggaggtcggtaataaagcatcacaattgatgtacctgtatgggtcaacaatagaaacttcacccatttatcaagaaagacctatcgtgaaaaggaagtgtcaagatcgtttttcagcccctaagattagcttccctatgatcctcttcttttctcatcattttctttgatcttttgtacaaaaaaaattcttgtattcaagccactgtgcctgtagtatgacactcgcaagtggatctcttgaaggaaacatgtcataccatccggtgtttgtgagcaggtaacatcaaaattaactgcctcccttctgcttgagggtaatcttatctcccaagctgagcgcgattccttgtgtcttgctccttattctgatgtaaccactaagcttgccatcgatttgcttctcaatgctgatgttcaccaaagcatcttctccgaacacactcttggcataaagattagcagcaatgtaaccgcattccccgtcaagcgcagactgtg

SEQ ID NO: 2051 - DNA, 439 bp, Hordeum vulgare
cccgctcatctccaccccaaccctcgtctctctccctctccctctccctctctcgcctctctctgcgcgcaagccacggcgtctaacggcggcggcaacagcaactcaccctactcgccggatgtccgcccgtcgagcccgctcccggccaccaactcatcccctccccagtccgctcgccgcgccggcgggcgcctccgccgcggccccacctcgtctccctccctcggcgggttcgagacgccgccgccaccgggccgccgtattccgtccggtgctggtgccggccggcaacgccaaaactggactggacggtttccgccaactccgtccactcccatgtccaccgacgacgtcccgccgtcctccgaagctggggaggaggacacgcccgagaccgacggcggcggcgtcggcgccgatgccaccccggtattcg

SEQ ID NO: 2052 - DNA, 367 bp, Hordeum vulgare
gtcttaatgtaacacaacaatcccaagagcaacttaagaaatctaaggcacaggatagacctccatctagaagtcagggccattaaaagaccaaacaggttagcacccagctctacaagagaagagacgggagcatggtaggttcagttgatgctggctacaacgtcgctacaagagaagagacgggagcatggtaggttcagttgatgctggctacaacgtcgccatgggcaaacacatcaggtcctcttgaaactgtctccgtggacaaatacggagccctcactctgcagagtgccaagagcaacacggagatcatgctgatgaacttccatggagctctgcttcctcacttcttccagcaact

SEQ ID NO: 2053 - DNA, 498 bp, Hordeum vulgare
gctcgccactccaactccaactctccctctctctctcgttcgcttcctcggcaacaggacgaacaactctggtacgaactacatcccctccttcccttgcgacgccttctcttcaaatcgtgccgccgcctcgtgaatgtccaccgacaatgccgtgttccggccggggctcgcttcttggcggctgcgtccatcgttctgacgagattgagtagccctactcccgattcagccgtctgcctcttcctgcctgtttgagcgcacactcaaatgggtatcttcagtggaacgcctcctccgagctgcccatcagctccgcattgcgcggaatgggctaaagtctatctgaagtactgcctgtgcagcacaaaggatggtgttgccttgggtcttggactggctagtgtcctcagttggggtatcgccgaggtgccgcagatcatcacaaattacaaacagaagtcaacagaaggcctttctattgcctttctgatgacc

SEQ ID NO: 2054 - DNA, 547 bp, Hordeum vulgare
gtatgcagaacctatttagagtagggtggagactggatgcgtatgagattctgagcatccgacgacaatggccagatcatacacaagacgtcaccgcttcaaaaatagagataccatgaagaaccacaaatcaccatacgatgtacagatatagcatgaccccgagtacgcattttttgtattctaacacagcagactgctgcatctatccttaacaaatttcatcccttaaccatgcggcgccacagctcattcaccgcaaattaagcgtgtgaccttgtctctgcagttctgcacggggagtggctattgtgcagctttccaagaaaaacgcacaatccccatgcaggtgtagctccatatctaacttcgttccctgtgcatcaggctttatccaaattgtctagttcatcacgcgcactttgcttccggtaatgaaaataaaggaactccctacatatgtcgtattccccaccaaagcaaaggtaaacattagcggactgagcccctcggcatggcctctttgcatatttaagaagatctgggg

SEQ ID NO: 2055 - DNA, 549 bp, Hordeum vulgare
gtcctaccgggactgcaggaattcggtacgaggctaaggtgcggcgcctcatactgtaaccccccacccacaaccgccgctacactcacaagctaacctcaccatttgagcaagcatatgagcagcaaaagcttgggcaagaactccaagatcatgagtggccgtgaaagaaaagaagttaatagcaacgcaaagcattttgttgatttcacggaggcagaggaagatcttgttttcagaatgcacagacttgtcgggaacaggtgggaacttatagctggaagaatccccggaagaacagcagaagaagtagagatgttctgggcaaaaaagcaccaggaccaatgaaagggaaagcaggatgcatccagtaaaactagattgacatatagggtgctttttcctgtccatcaaaaacctgtgttgatcttactcgtcctatcttctcacccatgctaaaagctgttaggaataagcaacttgtattcccatgaggccataggccgatatatatacatgtacaggtgatgggctatatgcaggaaaaca

SEQ ID NO: 2056 - DNA, 532 bp, Hordeum vulgare
  UNSURE (33): n stands for any base
ttcccatatataaggggtgttttcctgcatatnagccatcacctgtacatgtatatatatcggcctatggcctatgggaatacaagttgcttattcctaacagcttttagcatgggtgagaagataggacgagtaagatcaacacaggtttttgatggacaggaaaaagcaccctatatgtcaatctagttttactggatgcatcctgctttccctttcattggtcctggtgcttttttgcccagaacatctctacttcttctgctgttcttccggggattcttccagctataagttcccacctgttcccgacaagtctgtgcattctgaaaacaagatcttcctctgcctccgtgaaatcaacaaaatgctttgcgttgctattaacttcttttctttcacggccactcatgatcttggagttcttgcccaagcttttgctgctcatatgcttgctcaaatggtgaggttagcttgtgagtgtagcggcggttgtgggtggggggttacagtatgaggcgccgcaccttag

SEQ ID NO: 2057 - DNA, 535 bp, Hordeum vulgare
ggtctgcagggaattcggcacgaggcctcgtgccgaattcggcacgagggaagaaatttacccgaaggaaagcattttgttcagcttcggtctggccttccatcacataccaatatatttgaatcggagttggttgaagttgacctagaagagcaacctcagattcatgttggtcctcttaaatataaaactgaagagcggcatcacaaacaggaactgaccccagccccagttttacctcttattgttggagtttctgttgttacagtcgtgatcagtatgccaaggttgaaggacttgtaccagagcgctgtaggaatgacttccctaagttcaggaaacacaccgagcagaaaggaaccacggaagacaatattgagaaagagagcctgaaacatatgatcctgattaggcgtggaaaattgaacttacaggttgagtacgtcagtattagaaagtagctgttacttcccaatgtaattttgcagatgacgaagctaacagttaatattttgtaccattgttgactaatatt

SEQ ID NO: 2058 - DNA, 531 bp, Hordeum vulgare
taatttgtacctacattggtaccaaaatattagtcacaatggtacaaaatattaactgttagcttcgtatctgcaaaatacattgggaagtaacagctactttctaatactgacgtactcaacctgtaagttcaattttccacgcctaatcaggatcatatgtttcaggctctctttctcaatattgtcttccgtggttcctttctgctcggtgtgtttcctgaacttagggaagtcattcctacagcgctctggtacaagtccttcaaccttggcatactgatcacgactgtaacaacagaaactccaacaataagaggtaaaactggggctggggtcagttcctgtttgtgatgccgctcttcagttttatatttaagaggaccaacatgaatctgaggttgctcttctaggtcaacttcaaccaactccgattcaaatatattggtatgtgatggaaggccagaccgaagctgaacaaaatgctttccttcgggtaaatttcttcctcgtgccgaattcggcacgagg

SEQ ID NO: 2059 - DNA, 518 bp, Hordeum vulgare
ggtggcagaagtcgatttccttggaaaccttcaacatccacacctagtgaaattggttggttactgcattgaagatgaccaacggttgctagtatacgaatttatgccccgcggaagtttggagaaccatcttttcaggaggtcatttccgctcccatgggctatcagaatgaaaattgcacttggtgctgcaaaaggccttgcatttcttcacgaagaagctgaaaggccagtgatatatcgggatttcaaaacttcaaatattcttttggatgcggaatacaatgcaaaactctctgattttggacttgcaaaagatggccctgagggtgataagacacatgtatccactcgggtcatgggaacatacggatatgcagctcctgagtatgtcatgacaggtcacctgacatcaaagagcgatgtatacagttttggagtggtgctcctagagatgatgtcaggcagaaggtcgatggacaagaacaggccaaacggggagcacaatctggttgaat

SEQ ID NO: 2060 - DNA, 536 bp, Hordeum vulgare
acaaaaccctgtctgattcccccctcccaagtaaggttgccagagtaatagatacagaagcagctaaaagctaagcaacgagaagaaatcttcactgcggaattctaatcatccttgatggcatctgctgatctgcctatccacggcgacggaggccacagccagtgcacgcaccatttatccatcagtgctggacgaaaacccaacctttgaaccagtcatggtgaaccggtgagtcttaggactgtttgccgttgggccttggagactggcggtatggagaagcgtgcggaccgtaggagaggctcctcattggctgcacgccgttccgtgcaaaggtgctctgtgccttcatgctctggctaccatttgggttgttgaggcttgcggcacgttcttgacgcatggactggaagaagtaggaggagctagccatgtctttcaggtttggaagaggcttcaggacttcaaccacttggctcatgagaggcctagccttaggatcccggctaaggcaagcatgtgccagctgagcc

SEQ ID NO: 2061 - DNA, 544 bp, Hordeum vulgare
  UNSURE (16),(56): n stands for any base
gtcccccggctgcagnattcggcacgggctgcgccctgttctcgccaacctccagnagatcctcctcggcaccaagctcgccgtcctcttcgtcgccgtgccgctcgccgtcgtcgcgcagtgcttccacttcggccaggtatgggtgtttgcgcttagtctgatcggcctcattcctctggctgagcgagtcagcttcctgacagagcagattgccctctacactggccccacaattggcggtctcctgaacgcgacgtgcggcaacgccacggagctgatcatcgccatgttcgcgctggtgcaagggaagatcgaggtggtgaaatgctcgctgctcggctccgtgctctccaacctgcttctcgtccttggcacctcgctcttctgtggcggtatcaagaacctcggggccaaccagccctacgaccggaaacaagcggacgtgagcacgggtctgcttacccttggcgtgctctgccagtctctgccgctgctgctgcgttacgccgtcagctccggggaacacgctgtcgccactgac

SEQ ID NO: 2062 - DNA, 453 bp, Hordeum vulgare
cctgtaacaacccatctagtggcgatgtgtacacatggacttcccgcatatgagctaaccttattgcatgccgaacagtctatacaatacaagaagcactaaacctagctagcagtacggttcaagaaaataaagaaaaaatctggtacaattgcatgcttttctcgcaacagtaatcagttatgcacatatatgatagacacaatttggttgtttcaggctcgaacacttcgttctcaatcttgcacacattgtagttggttgaggcacccctcttagtaatcagttatgcgacctggacaatcatgggacccattgggacataaagaaaaagtgccgttgccgttcgcgtgatgttctgtttgtctcgtaacaaagaagcaagcgccgataacaatgtagcataggaggaggaggactcccttgaggtaatgtgacgttccatcctggagg

SEQ ID NO: 2063 - DNA, 986 bp, Hordeum vulgare
  UNSURE (1): n stands for any base
nttgcagcctgagctatgtgccccaatggggggccctcaaaacgtgggcgaggcggccgcggcatcgggctaccctttttaccctacggccgcggcggcgtaagcgacgatgcggcggcgaggtactcttcctatgagatcgacctcatcgcggcgcgctacgctggcgacccgtcgccctacccctacccctacccctccgcctccggcgaattcgacacgcatgtcggcgcgaggcgccccgcagatgttctctatcatcgacctattatgggaagccatagtactattgggcagagtgatgatttttattctccaaacactatggccaaacgccctaggcttgaaagcagccttcctatttatccacaacgacctggggaaaaggaatgtgctttctatatgaggaccagaacatgtaagtatgaagaaacctgcaaatttgaccatccacaatgggttccaaagggtgggattccaaaatggaaagagggtcaaaaggccgaggaatcctatcccgaacgaccagggaaaccagattgtcctttttttgtaaagactggtatgtgtaagtttgggtctgaatgcaagttcaaccatccaaagaaaaaggatgatggaacagtggctggctcaggcgataaagagtctctactttctggtaattctaccttaccggtgaaaccttctgagccttgtccggggtctcttatttctggtaattctaccttaccggggaagccttttaagccttgtccgcactatgcaaaaggcaaatgcaaattaggaacaaattgtaagttcagtcatgcaaagggatatgggggcccctttaaagtggtgaaaatgaatctgaaaatcagcaacttgttgaagcaacagggcccaatggttgcagggcatggattagttttcaacaaagaaggtggcagccattgccttctgggcataactcaagagccatggcctataccgaccgggggagg

SEQ ID NO: 2064 - DNA, 545 bp, Hordeum vulgare
gaaattgaactgatagtttaaaatatataaaattaggagagagaattagacgtctatatataaatgttctgctgcaaaactggaggtgtatgaaggaatcattttagaccattgtctatataaacatatagacatccaaatatacacattctgttggagatgctctgatgacagaaacagactcgaaatggggatggggaacttgagcgggtctaattttccaggacataactcagtcctaccaccttcttaccgtctccctgcttcgaaacattggcaatgacctccccaagaggcggatggtcaaacttgcactggacgccaaacttgcatgcgcccgtcttcatgtaataggcgcaggcctcagcatcctctctccttggaaagccagcaacagtaagcatcacaggttgctgagatgactcccgctttgcaatggaaccaggtgcagaccgatcaactggatggtgaaacttgcatctttcagaaaatttacaaaatcctgtcttcttatagaaatcacaaacagtttctccaggcctctg

SEQ ID NO: 2065 - DNA, 557 bp, Hordeum vulgare
  UNSURE (25),(29),(34),(38),(52),(63),(82): n stands for any base
gtacccccgggcctggcaggaattncggncacgnaggnaaaaactttttagncaaaagaaggnaaatataaaaaagcttggntaagcaatagaaataacaatgatccattttgcatagtacatacccctggatcatacatacatagcatatttgggattgaagacgacacgtttactctttaggttggtgcacaagcgagtatataatccatttgagtaatcgatctactgtctcactaaaatccatgcaacacgagcttttcctgggtctcatattttgtgctcattccttggttgtgcggatcccacttatctatccgagcgtgtgttcctagtgccactatagctattgatatatttgctttgcattgcaattttgtgaatcttcctcaacattttaatatcttgattaacaattgcttgaattttgtgccacttgtcctaaccgagcaactcaataagctttactttgtaggtgtgagtgaacatgtccgatacaaattgcactatcctctcaattcacattgagtgaaatgggatacatcctcaactttggg

SEQ ID NO: 2066 - DNA, 546 bp, Hordeum vulgare
  UNSURE (39),(40): n stands for any base
atttattacttggcttctagggcatatttccacaatatnngggtattggaaaaatgtagatgcaaacatatccatgcttaactccttgcgccaccttggttgaagggatagtcccatgctcaaccgtcttattgccatctccttgtatgagggcaacgtgatgtgtcacctctcgcacacctccatggctgaaagtagattccgaagctcggtcatcttccttggggtgcttctgaagttggaaaaggctccatgcgtgtagtcggtcgccttgatgttggcgccaaagcttgtccttactcctatgctaatgaatgttgaacgtagtgtggtgtagagcttctattctatggcattcttcatcttcgcacacatgtttcttcgaggaggatttcccttcacgataatgtaggtcacaaatgtgatggttgtcatggtggtcatctcgaagatgaggatgtgtccaacttgtgcttgcatcaaatgtgtgctccgaatatgtgtgacttgagcatctctgccttgaagatgatgaaggggaataag

SEQ ID NO: 2067 - DNA, 494 bp, Hordeum vulgare
gaggtctccatgcatcgccacttcgacgacctccgcgccctcggcaggcaattggaagagtccggggttctaaatggggcccttaaagctcgaggaaattcatggggcttgcacatgccacttgtgtgcccagatggtgctgttgtggcatatgcttggaagcgtcaattggcaggccaagctggtgcatcagctgttgacagaactaggttagctctcaaggccttcactgaccagaaaagaagattctttcctcatctagaagatgaagttcttaaccatctccatgatggtgaatctggtattgctaaaaggcaaaggatgcctgcaggcaatggagagctggaagaaaaaactttgtctgagatacttaagaatctagaaaatgaagtgcccaacatgaaagtatccatgtatcgtcgtttagactggtcaaaaagagcttcatcattagcatctctgatggatgatgactttgtggatccatctaagga

SEQ ID NO: 2068 - DNA, 495 bp, Hordeum vulgare
aggttttacataagtgaggtgaaaatgcaaacagagcaactcctcgatcaccaatcctacggattaggctggtgtaaaatccagttcgacattttccctgtcctgtcctacggaataggctggtgtagcacaaatacagttagaaacatcctagctacaggttcagagtgggcagcgtcaggcgtcataggaagaacatccaatgtgataggcttcctgatgatctgagccaatgcttgagatctggtggtaggggcggtgaaccgggggtagaagcaaagccaaagacttgtccatgagcagaagccgtcggcatttactgcagagttttgtaaatagagtctgataatcggcaatccaacgcaataatagagaaagtgctttactgggctccacactgatgaagtactgcaatgccttgtcagcatgctccgtcacatgcttaaagacgtgatgcaccgataagcctctcgcatgaaggtaacttcctccctc

SEQ ID NO: 2069 - DNA, 518 bp, Hordeum vulgare
ggccgaacttcttcaaagcctgttgggatcaggtattattgcatcacttgatgatattgctggcaaagagtcttcaactagtctacgtgacaggctggtcagtgatgagcgatacagcatggctgtatatacttctaagaagtgcaagattgatgcttttccagtgtgggttgcatggggccatgctctagttcgaatggaacactacgctcaagcccgtgtgaaatttaagcaagctcttcaacagttcaaaggtgatgcacctcctgttgtccttgatatcattaacacaattgaaggaggtcctcctgttgatgtttcttctgtccgctctatgtatgaacatgtagcaaaaagtgcagcaaccatcttcgatgattccctttctgctgattcttatcttaatgttctatatatgccatccacattcccacgatctgagaggtccaggcaatccagagattctctagatagccaattttcgtctgctagctcataccttgaagatggtcctcgca

SEQ ID NO: 2070 - DNA, 539 bp, Hordeum vulgare
atgatcttttttctatgagctaaaaataagagttcaaagctgctacttaaagagtgcatgctgcatgtacaactattttgctatacaaatgtgcatctaaaaaaacacaagatcagccaaacttttgatagaaacgttgactaaagtgcgcactagactttctggattgtccatccctcatggtagaattatccgtcactgatgcaatggaactgcaaaatttacaccacacataacgcatacatgcactcccatgtgcaaatgcatcaacagccactcacccgaaaacatatacagatgagtgggtcttgtcctgaatttgatctctgcattaacccacctggcccagagcagaattctgctccttagtgcaaacccttcttcttttcactaatttaaattctccctcggcagagtcagaacacttacaattacatgtactgggccagccattgcttgcacatatcaagaaccggcaatgcatttgcatgtaatgcctgatgggcaacatattgaacatcagctacgcttccacttcg

SEQ ID NO: 2071 - DNA, 552 bp, Hordeum vulgare
gtcctcccgggcctgcaggcaattcggcacgaggaaaccccagttcccaaccctagcgaggaggaggaggcggcggcaaccccgtcgaccggaggggagatggtgttcttcgcgctgctcgtgggggcggagctcgacggcctcaccaacctgcagccccgcggcggctgcgacgaccccagctacccttactacttcaagctgcggtgcgagagctgcggggagacgagcgccaagaccacctgcgtctccctcgacgaggtcgtcgaactgtccagcggcaaaggcaccgccaatctcgtccagaagtgcaagttatgttcgagggagggatcagttgtgatgattcctgggcagggaacaccactgacttctgagcagagccagaaaggagagatggcctgtttgatggtctttgaatgcagaggctatgaacctattgagtttgcttttggtaatggctggaaggctgaatctgtacatgggacaccgtttgacattgatctttctgaaggagagtttgatgagtatgacgagaagggagagtgcccc

SEQ ID NO: 2072 - DNA, 523 bp, Hordeum vulgare
ctggtaggcagatattcaagtttcctaacaggaggctacatcactgcaagcttaaccaatttcatggcaaatccaccgaatcatgtgcacgaacttagtacaaatacgaaatcaacatcgaggtttcgactttctagatgcgctttatacatctctgactcaagtgtttgaagagcccaggagaaattggatcttagacatatctggtcttcccatgaaaaccctgcttcctcaccactttgaatgttgactgcagcttggatagagcgacggggcactctcccttctcgtcatactcatcaaactctccttcagaaagatcaatgtcaaacggtgtcccatgtacagattcagccttccagccattaccaaaagcaaactcaataggttcatagcctctgcattcaaagaccatcaaacaggccatctctcctttctggctctgctcagaagtcagtggtgttccctgcccaggaatcatcacaactgatccctccctcgaacataacttgcacttctggac

SEQ ID NO: 2073 - DNA, 488 bp, Hordeum vulgare
cgacgactaccgctacggctacggccacggccgccgccttcctctccgcggctcctgcctcctcgtcctccacccaccgccggcgtagccgtctccctgctatctccgcctccctcccgtccgaagaaccgctgctcatacgtgcggcgaggggcgaggacgggctgcccaggccgccggcgtggatgatgcggcaggctgggcggtacatggcgtcgtaccaggcgctgtccaagcgccacccttcgttccgggagcggtcggagaccaccgacctcatcgtcgaaatcacgctacagccctggcacgccttcgcacccgacggcgtcatcctattctcggacatactcacgccgctgccggccatcggggtgccgtttgatatctcggaatccaaggggccggtgatccagtcgcctgtgcggacggaggaacaggtcagggagctcgttcccatagatctcgataagctccagttcgttggggag

SEQ ID NO: 2074 - DNA, 551 bp, Hordeum vulgare
ctccagctcccttctaaaagcggaggcacgccttttctttgccaagtacatgaatgactgaaatacacagatgcataatgaacaagattgagttgatttggccatggtgtctctacaaggaacagctccagcaaaagggaatgaactctaatatgtagaaggtgttgagctgagaacagtaaggccaaaaaatatcgcaatgctgccggccaccatcaagcaacaggttgcaattcttcagtaagttgaccctggaaaagggtgtcatatctcaagctccttgtgacatcaaagaaatgtgctacggcttcttctggtgtttgctgaagaacaccatggcccaagttaagtatatgacctttcgggccagctgatttcacaaccctatggatttcatcagtcaatactggtaatggtgaaaatagatatgctgggtccacattcccttgtacactaattccatcaccaatgcgcctccttccatctgccatatccactgtccagtcaagcccaataacatcaactcctatgtccttcatgcgctcaagcaa

SEQ ID NO: 2075 - DNA, 496 bp, Hordeum vulgare
ctgcgcccctcggtttattgcggcagaagagcggcgagtagagcgacgagggcgtgaggccgcctgctgcttgtggcggcggcggcatggagaggggcgagagcatcctggatgccgtgctcgacgagaaaaccctagatttcggcggagatgacgtcgagatggctgacgcggaggtggaggaaacccccatccccgaccccccggccgccggagcaggagccgctggcggtggtgcgcaggcgggcggaccggctggaaagaaaaagaagaagagaaagtccgggaggagtaagaacagggggaggcctgatgggccacccaccaagatcggcgacattaatcgttttgtacttgacacgtgcaggcgcttgaaagagaaaaagtcataccttgtctggaatgctattggctgccttggcgtttctgctgtcagcgatcttgtccaagaggttgaggccattcagaagtgtggtgggcagacaattgctgatgg

SEQ ID NO: 2076 - DNA, 551 bp, Hordeum vulgare
ggctaatattgttatacaacttccactcctggcagcaagagaactcatcagctgctgcatatttgcatgacttgctgctcgatcacacaaagaaaaaaatggtagtgcttgggaaaaaagaacatccatacaaacatcgaccttcttccctcacattctgcaatcttgctttctgagcaggcaaaacctttcgaatacttcaattttgtggttgtccttcatgtatctctccgtcctcaaaaagatcatcatacgcaacaggcacacgaattctgtcggctattggtttacgaggttcagctttatcaacagaaggagctgcttcctctgcatcgactaagtgctcagggtcatcatgtgcttcaatttcctcgtcaactagggcgctgccctgtgagcttgcatcttcatttctgctcgactgtggtctgcctttcgtatacatgaactgcttctcaagctcccttcccttcaccataatttccttgtatgcctttggctctcgtgatttcaagatgttccagaggattcctccacctgttcggaaacga

SEQ ID NO: 2077 - DNA, 525 bp, Hordeum vulgare
gcagcgcgcaacctcccgcgcgagcacgcaaggggctccacgaggcggggaagcgccgaaggtcgacgcgaggcggatccggtcaggatgcaacgcggccgctgactcattcagtcgacgggacggctcaggttcaagtccatgagcttcggtggcaaggacgactagatatacgacaagtcgagcatgctcatgcgctaagctcctcgggactggtttacatggatgctattcgggagaaggcaaatatgaggagcaaataaagtcaatcctggcacaaataaaaacactccctgcatattgatttggccgcaatcaccgcatgattttcatgcattacaaaatcatatagataggagattgcggtagatcacgccgacttaggctacaatttccatgcatatttggttgtcgctacatcctttctcccgcacttttaataagtgatcatgagtaagaaaataaatttctgttttttgctattcagtacatgtgagattcgtttttagacttcacaacaagagt

SEQ ID NO: 2078 - DNA, 545 bp, Hordeum vulgare
attcaaaataggtcaaatcttttatgacgattgactaaaaatgaatggccgatgagagggcaaaagtatactatttccgttcgtacatcaatgccagctaaaaacaataagaattgtaattgaagacataaacaacggaaaaaaaatattaagagagtttgacttgcactttgacacaattttttgttggtgcatttcctgatgaacagattttctttactaaccctcctataaactttgtgtaaactttcaacttggtgtgagcggcgctgaactacccgctccattgaaagctcaacttcaaccagttccattctatttatagacgatttgtagtttttcactcctacttcaataagatcatatatgtggtggtcataagtccttccaaaaggagtttgttggcctctactttgagttagaaccatatagtcctactgcaaacacataaaaagtaacagttgaagtaatgcagaataatattcataattaatacacacaaaaagaaaagatcaatataacaaacatagaaaaggtttataatt

SEQ ID NO: 2079 - DNA, 419 bp, Hordeum vulgare
gccgcgccgcgcacctcgggcagacctacgcccgggcttgaagcccccgctcagctcgaccctcctggtcccgccagccatggaaggaaaactgctatgctacgtataacgactaatgagggaaggcagggggcgctcgaccgccgagcgccgcgcgggttaacgacgcatcatcatcatcatcatcgatcctattactacggggggagatgcggcctggatgttgggctgtttcccattgtgtgtgcgtgcgtgggtgggtgggtgggcttggatgccctgctgtagtgttcgtgtgctcggatcagatgcatttctcatcgatcaagcagggcttgtactcctttttatcgctttatatgcagtaaaattaatggaggaacccatgtttatctaaaaaaaaaaaaaaaaaaaaaaaa

SEQ ID NO: 2080 - DNA, 384 bp, Hordeum vulgare
ggtacatgggttcctccttattttctgctataagcgataaaaggagtcaagccctgcttgatcgatgagaaatgcatctgatccgagcacacgaacactacagcagggcatccaagcccacccacccacccacgcacgcacacacaatgggaaacagcccaacatccaggccgcatctccccccgtagtaataggatcgatgatgatgatgatgatgcgtcgttaacccgcgcggcgctcggcggtcgagcgccccctgccttccctcattagtcgttatacgtagcatagcagttttccttccatggctggcgggaccaggagggtcgagctgagcgggggcttcaagcccgggcgtaggtctgcccgaggtgcgcggcgcgg

SEQ ID NO: 2081 - DNA, 398 bp, Hordeum vulgare
ataggaccgtacaagaactcaacatgtatcacgagagtatcatggatcctgtctgtggtgatcatcggcatcaatacttatttcttttgtactaccttcgtgagttggcttgtatatagtgacctaccaaggtttgctaaagcaataattagcacactcgtcttccctttcatggcggcctatattgcagcggtcatttacttggctttcagaaaagttagtactaatgtcgtactcccttccagttcagtttcttgtgagattgaagtggcagaggtgccaatacaagacaacaaggatgaagatttggctctacattgctagattgaaagatcggatccagaccttattttggagatggtaatatctcgatttcttcaagaatgaagctgctttgg

SEQ ID NO: 2082 - DNA, 113 bp, Hordeum vulgare
ttttttttttttttttttttttttttttttatttttttttttttttttttttttttttttttttttttttttttttttttttttttttttttttttttttttttttttttttt

SEQ ID NO: 2083 - DNA, 455 bp, Hordeum vulgare
  UNSURE (389): n stands for any base
ctctcgaacccgtaaaggctcctcttcttcttctccaagctcctcacctcaccgccagctttgacctcgccggcgtccacccaaatccgccgcgccccgcccatggcttgaccatctactagttgtctccacctctcccatgacgtctgagcgcccgctcatcgacgccgcctccccgcacctgccggcggcggcgtcgcaactcccgccgtcacagccggagcctcccgttcgcgctgaccacctgggcttatccgttgatgtcccggaccccttccgctcctcccgccgcgaccatcccgacccgtccgcgtcggagcgggagctccacgaggggggtgagtaccgcgccgtcgccgtgggggagccctcgccggagtttgacgganactctgtacggacggccaagtactccgcgctcaccttcctgccgcgcaacctcttcgagcagttcc

SEQ ID NO: 2084 - DNA, 440 bp, Hordeum vulgare
ttttttttttttttttgggacgtcaacaatttctatttccttttcagtaaatcttagatggaatacatacatatacacaccctggaggctaaacctattgccgaattgccattaataaatgaatgacccatatacacactgaaagggtggaaacgaacaaaagaaacagaatataagaaagaatactaacactatatgcaatttccctgcaagggtcatgaaaacgttcgcattggaatttctgaacgattcacctgatttaaagccttaaacttctctatttcttgtccgatttgaatgtcagtgggaacaaaatgctccatgaaagccttggttgcaaaatgtgggaccattgctgtgacaacaataataagcagcagtaaccaaaacaagccttgtcccattatgtgatagatgaccccataaccaggaagaaccca

SEQ ID NO: 2085 - DNA, 518 bp, Hordeum vulgare
ccagcaccgcatcgacaccaccatccccatcgaggacacgattggtgagctcaagaagcttgtggaggaggggaaggtcaagtacattgggttatcggaggcgagccccgacaccatcaggcgtgctcacgctgtgcaccccatctctgctgtgcagatggagtggtctctgtgggcacgcgacatcgagcccgagattgtgcctctctgcagagaactagggattgcaattgttccctacagcccgattgcccgtgggtttttcggtggaaggggagtgacacaacaagtgtctgctgaatctagtctgaaaggccatccacgtttttctgctgaaaacctggagaagaacaagcaactttatctgaaaatggaagaactggccaagaagcaccattgcagccctgctcagctagctttagcctgggttctgcatcaaggggatgatgtggttccgataccagggacaactaagatcaagaatctagactccaatattgactccttaaaggtgaagc

SEQ ID NO: 2086 - DNA, 558 bp, Hordeum vulgare
caaaaagcccgcgtttaattgatggtcatcggaaagcccgtaagactagagagccatagacatagctagtgcagtctcagtcttctgttacacaagaacacataaatttacacggcacgtggagacagtgcaattgttcttattcacgggacaattcacaagatgaagatacagggagcaccattcatcacagtagcagatatcatggcatgttttgctcgcacatatcactgtctccacaatcttttttagtttcacttcttcggcgtatctgcataattccaggtgaatttcgcaaatgaagtatattgccttccaccggccacatcttcttcgcgtatctcattgctaatctctttgaggtcatcttctgtgagcttcacctttaaggagtcaatattggagtctagattcttgatcttagttgtccctggtatcggaaccacatcatccccttgatgcagaacccaggctaaagctagctgagcagggctgcaatggtgcttcttggccagttcttccattttcagataaagttgcttgttcttctccaggttt

SEQ ID NO: 2087 - DNA, 520 bp, Hordeum vulgare
gcaggccacagccgctgcaaccttccctcctggtctcccctccctcccaatctccctcgtcagccaccgctgccacttcacctccctcttctctgtcgtacgccggcggccagcttctcctgctaccccgtgctcgccgccaaccacggatctgccatgcacggagggtgtcaagagcagaaggacgtctttgccccgcaggaagtgctggtggacgagcacacaggcatgtcctcttcctggacgggccgactcagaggtggaaggcaactcgagcatgggagtagtggccacggctgggcaccatgggttggatgagatgcttcatggtgaggagcacgtgtgccatcttccagtccgtcctgcccagcctgatgcgtaccatggattccagcacggttcgaagcggccagaggttggacggaccaagaagaaaataggtttttccttgctgtcggcagcagcggtgagcgtaggggcagcggctgtggtcgcccgaggagcacagccgcacgggggc

SEQ ID NO: 2088 - DNA, 551 bp, Hordeum vulgare
gcacctctgtgctttagaaactacactcaataataatttagatctttagtccattggaaacctatggccttagttacgttgtctacagagacataaacgttgcaggcagcaaggactcttaatagaatcatcatcggctctcacaacctgggtaagtctcagttctgcacctactctaaacaaaaggatcataataaattgaggctaacctctgtgcctatggtaaacagaaggagcgaaacacatcataattcttaaaggaattatcctaggatgcacttgaccacgacaccgtcctaaaggtccttcctgatgcttcttagccgatctatgggttcaatacccatcaacctcaagagaaaaggatcatgtggtgcatctcagctgattaattgtttcatctctgctaaggttatggagctctaaacttctctgaaatagctgtgttccaaagtatgaattgattatccgtgcaacaaaggacagcacattagatagaaatggctgattatagtatgacacaagatactctccaagccgatgctccacca

SEQ ID NO: 2089 - DNA, 881 bp, Hordeum vulgare
  UNSURE (20),(829),(863),(867): n stands for any base
gtacccccgggcctgcaggnaattcgcacgaggcggttgctggtcaagtagctgcacttgtgttatgccatacacgagagttggcataccagatttgccatgaattcgagaggtttagcaagtacctgtcagaaactaaagttgctgtcttctatggtggtgttcacataaaaaaacacaaggatttattgaagaatgaatgccctcacattgtggttggcacacctggaaggatcctagctctggctagagacaaggacctttcattgaagaatgtgaggcatttcattcttgatgaatgtgacaagatgcttgattcacttgacatgcgtcgagatgtccaggagatcttcaagatgacaccccatgataaacaagtgatgatgttttcagcaacactcagcaaggagattcgcccggtttgcaagaaatttatgcaagatcccatggaaatttatgttgatgacgaggctaaactgacccttcatggtctagttcagcactatattaaactaagtgaggcggagaagaatcgaaaattgaatgatctcttagatgcgctcgacttcaaccaaattgtgatatttgttaaaagtgttggtagggcttcagaacttaacaggctgctctgtgaatgcaattttcctgcaatctgcatacattctggaatgacacaggaggagaggctgacccggtataagaacttcaaggaggggcacaagaggatccttgtggctacggatttagttggcagggggattgatattgagcgtgtcaatattgtcataaactatgacatgcccgattctgctgatacatacttgcacanggttggaagggctgggcgttttggaaccaaaggncttngcataacatttgta

SEQ ID NO: 2090 - DNA, 534 bp, Hordeum vulgare
  UNSURE (15): n stands for any base
aaccaccaacatttnccaataggttccttaacaaccataagtctgagtactacaataaaatactcagcagattcaatcgctgattaggtacaactggagcatctcttacatcaaagtttatgcaatccaatagaaatgtcaaggtgttgtgctgaaaagcaaaccctcgcagcccccacttggatcttcaagatggcatgtatgttgaagtgtcgatctgctcaggcagctccttgatgtcaacctcaaacctttcttgcacctgattgagaacgtcagagtcagaggcagaagcaacaaatgttattgcaagccctttggttccaaaacgcccagcccttccaaccctgtgcaagtatgtatcagcagaatcgggcatgtcatagtttatgacaatattgacacgctcaatatcaatccccctgccaactaaatccgtagccacaaggatcctcttgtgcccctccttgaagttcttataccgggtcagcctctcctcctgtgtcattccagaatgtatgcagattgcaggaa

SEQ ID NO: 2091 - DNA, 520 bp, Hordeum vulgare
gaaggttcagaaccaggcaataggcactgttataaaagctttccagcaaatgcaagaacagaagaacaagaagaaaagcgtaaatcaattctagcattagttggtggggctagtaagcaagtaccaagttctcccgctgtccgaatcagtggaggtccaaaggcagaaagtctgagtcccagagagagggcggctgagagagaaaggatggttctggatataaaagtaaagctccagggactatggcttcgtcttctgagacttggggcaactgaggatcccctttcatcattcgaatatggaaccattcttgctttgattgagtctgatgcagaaggcatcggagggagtggctttgttgaatgcatcagagagcatattcattctggttggcaatgccgcttgactgatgaacagtttattgctgtaaaagaactgcttaaaacggctataactcttgctagctcccgcgatgatgtgtcaaccattagagatgctcttgaagtttctgctgaaatgt

SEQ ID NO: 2092 - DNA, 483 bp, Hordeum vulgare
ctggcaggctagggggtaccctagtaccctaaacttatagacaaaatttcacgaggcatcaaaacagcttttgagattacagaatcgatggaccaaatagggcttccgtcttatttctacacgacgactaaaaacaaaaaatgacatacaacatcacagggcaattggtatttctttacataaacatatatatcctagtaatgtgttaaatacttgtggtagcatcccacaaccgaagaagtccgttccggccaccactgcatattcttttcctatccaggtccgatgctatacatctcaccactgcagatgttttctggggagttctataaagctgccatcctgcaacttttgatcctgtatttgagaaacttccgaatcgttcttgtggtcgatggaaaagagacatagaattgtcagcggcaccaattccaagccagtgatcaccggcactaatggacagaaccgatgccgagtgaagcg

SEQ ID NO: 2093 - DNA, 516 bp, Hordeum vulgare
ccgtaccgggcatgcaggtcgttcgccgtgataggagctccaggcggaggggcccaggagacccgcggcgcctccactgtcgccgcccccgcctatgcctcccaagacgccagcgctgtccacgcctccgagcctgtcccagccaccgaccccagtgaagccagcacagccgtcacctcctcttcccgagaccaagccggcagtggcagctgttgcgacgccaccagtgggaggggttgtcacgttcgagtaccagaggaaggtggccaaggaactacaggaatacttcaagaagaagaagctggaggagaccaaccagggacccttctttgggtggttggccaagaatgagattgccaatggaagatgggctatgtttgggtttgcagtggggatgctaacagagtacgcaacaggctcggatttcgtcgagcaaatgaagatccttctctccaattttgggattgtggatttggattgatggctcatgtttggcggtgttgttctgtacaagtc

SEQ ID NO: 2094 - DNA, 561 bp, Hordeum vulgare
  UNSURE (45),(46): n stands for any base
gtgaaagaagatagattataccttcagacttgtacagaacaacannccgccaaacatgagccataatccaaatccacaatcccaaaattggagagaaggatcttcatttgctcgacgaaatccgagcctgttgcgtactctgttagcatccccactgcaaacccaaacatagcccatcttccattggcaatctcattcttggccaaccacccaaagaagggtccctggttggtctcctccagcttcttcttcttgaagtattcctgtagttccttggccaccttcctctggtactcgaacgtgacaacccctcccactggtggcgtcgcaacagctgccactgccggcttggtctcgggaagaggaggtgacggctgtgctggcttcactggggtcggtggctgggacaggctcggaggcgtggacagcgctggcgtcttgggaggcataggcgggggcggcgacagtggaggcgccgcgggtctcctgggcccctccgccttggagctcctgatcacggcgaacgacctgcatgcccggtacggcctcgtgccgaattcc

SEQ ID NO: 2095 - DNA, 551 bp, Hordeum vulgare
gtctttccgggcctgcaggcaattcggcacgagggcaggtcataccgtaacccgcaggcagggctctagctaggaggagaaggaactcccacagaccgaactcacctcgcgaggtctgcgcttcctcgatggaccagatggacggcggtggcgccggcaggcgggtgaaggtggtggggaaggtagagaggctcgaagggcagtcgctgacataccccgagttcgtcgaccgcttcatgaagccgaacctccccgtcctcctcacgggcctcacctcctcctggtcatcctgcgaggactggacattggccggccccgacgaccgccgccgccccaacctcccctttttcgcgcaaaacttctcctcccctcgcgttcaggttgccgactgttccgccagagagtacacggaccacaagcggctggagatgtccatgcaggaattcgtggaccattgggttaggaattcgaataccggttcaaacagcggtcattgtgaagcttcctcgctttatctgaaggattggcattttgttaaagagtaccctgat

SEQ ID NO: 2096 - DNA, 532 bp, Hordeum vulgare
ataaatgcatgttagtttatgcacgcataatgtgcttacaactatctctcgtgtagagcactatcaattaacctcacaagatcctcaggtccatgaatttcacgcatcaaaaaatcaatgcgattaacaacattacaatcagatttcaaacaggtcgccgacaaacagcctttctgatttaaacacctcatttcgtacaaaattctttgcccattatgaatgtattcatacacctcggacaatgtcatccatagccttctgaagccgtcgtcttttaatatttttgtaacatctgacatagcactcggatttccttccgagacaacacaaagattctcaatactgaaagcctctgcagaaatcattttagatgcaacttcccgtatttgcataaggttatacacataatggtgagtggcttctggtgaattgtgtttagcatcctcaggctcttggatatggtaaagctcaattacattggccaaaacaaaccgtgtgagaaaaatgaagaaatcatagaagttcatgcctg

SEQ ID NO: 2097 - DNA, 518 bp, Hordeum vulgare
tggatcttgaggaagcatgatgaggagtcgaggcttactgttgcggacataatgtcacatatccagcatgagattgactatggaggtactgatgcacatgtatccccaagggtacatcagcatcccatgactgtgaatccgtttacaagtatccaaccctcagctgggttgtactcacaagcaacatctgggcatgctcccagacccagcctcaatgaccagtcaaagaatacgatattctcaaatgcattatcaagcccggtccgcaggagcctccagacctatcacttgacccaaggtgctggtaatggaggacggaacactgaagcaaactcagccgcgcaaaaccgagaggctaattctccaagctccaatgacacctccatggacatggtttcagacatcacgggaaatgggtactactaagtcagttcatggaaacatgttgcatgcacaaccaggaagcatcgagtaccagtattttctctggttttgtatgttatatgtattttccctaa

SEQ ID NO: 2098 - DNA, 545 bp, Hordeum vulgare
  UNSURE (6)(18),(23),(24),(38),(39): n stands for any base
ccaggncatacacatagnatttnnctctccaaacaggnncttgaaaaaaacaaaacaaatccaacaattttaagtgaatcgccaggtgtgcaactataaagccacacagtgcatgagctttagggaaaatacatataacatacaaaaccagagaaaatactggtactcgatgcttcctggttgtgcatgcaacatgtttccatgaactgacttagtagtacccatttcccgtgatgtctgaaaccatgtccatggaggtgtcattggagcttggagaattagcctctcggttttgcgcggctgagtttgcttcagtgttccgtcctccattaccagcaccttgggtcaagtgataggtctggaggctcctgcggaccgggcttgataatgcatttgagaatatcgtattctttgactggtcattgaggctgggtctgggagcatgcccagatgttgcttgtgagtacaacccagctgagggttggatacttgtaaacggattcacagtcatgggatgctgatgtacccttggggatacatgtgca

SEQ ID NO: 2099 - DNA, 513 bp, Hordeum vulgare
gccttctgtcttgatggacatgcttgctggcaagagagctgaagttggtacaaaagttggggcgtacatgagatcattttctggcgattgttcaccttcagatcttgagactggtttgcagcttgtctaccaactatttacaacaaaggtggagccaagggaggaagaagtaaaaatagtcatgcaaatggcagaagaagctatctatgctcaggaaagagatccttacactgcatttgcaaatcgttcgcgggaaataaattatgggaactcgtacttctttaagccaattagaataagtgatttgaagaaagtaaatccaatcagagcatgtgaatatttcaacagttgcttcaaggatccatcagcttttaccgttgtagtagttggaaacatagacccggccatctcaatcccactgattttggagtacctgggtgggataccgaaggtacatgatacagttcagccacttagtcgtgaggatctaaagggattgcctttcaagtttcc

SEQ ID NO: 2100 - DNA, 554 bp, Hordeum vulgare
ggacatatgcaacggtgcatctattattttgtcatcctgggtacacaaagcacatgcaatcgatctcgacaaaactaaatctggtaaaagcaatctaccatttgaatcaacaacacttcagtgtctgttacacgcacgcatgcggcagtaaccaatgttgttacaatcttacacgcacgcagcaacgaatcagttagctaccgatttctgtgtaccttcttccgtgatgaagaatcaccgcaccaacaaccagatttgttggctgatggtgagatggtaacaaactcttctagtaccaacttggctcttaacttaaatgggctgtgcactacgatctcaatgcaccgcgtgagtatctccacaaactggctgctaagaccagtgcaccagctatgccagccaaaatcttggcatctctgctaaatccaccagaactccaactaacaaccgatatcaacgaattccaacgagatgacttaggcataagaattactactgtgtactgttttttacatgggaaagatatcacccttcgcaaggccatttgcatggcc

SEQ ID NO: 2101 - DNA, 557 bp, Hordeum vulgare
ccgggctgaggctgagacaaggcagagagaacagtagataaaccagctggctcatctgatttggacaatcctatctctgaagcttaccagatcctgatgtcaatgtgagtaatttggcaggctctgcattatcttcccagcaagctgtccttaacgaagatgttgaggtaccaatcaagactgatgcagttgtggatactgaaacgaaaactgatacagttgtggaaactgacgcagtcggggatgttggagtgaaagctgatgcagtcgatgaggtaccaagcaaggaagtatctgccgtggatgttgaagctaaaactggcgcagcagaagcaaatgagtgaagtggcagcctatctcatggactgaaatggcatagctgacgagcaattattagtcagacccccgagaagacaggcaatcatctttgcttcaagtgctcatcagccacaagcaacttcggagcaaactgctgtacaataagcaagtgtactattttgccttccattgtggccaatcactgtacaaatgagcaccattgtctaactgcacgcgca

SEQ ID NO: 2102 - DNA, 555 bp, Hordeum vulgare
tttacaggccatgaaacggagggtaaattttgaagcaaattgacacatttctgatgatgtgtgcgcgtgcagttagacaatggtgctcatttgtacagtgattggccacaatggaaggcaaaatagtacacttgcttattgtacagcagtttgctccgaagttgcttgtggctgatgagcacttgaagcaaagatgattgcctgtcttctcgggggtctgactaataattgctcgtcagctatgccatttcagtccatgagataggctgccacttcactcatttgcttctgctgcgccagttttagcttcaacatccacggcagatacttccttgcttggtacctcatcgactgcatcagctttcactccaacatccccgactgcgtcagtttccacaactgtatcagttttcgtttcagtatccacaactgcatcagtcttgattggtacctcaacatcttcgttaaggacagcttgctgggaagataatgcagagcctgccaaattactcacattgacatcaggatctggtgaagcttcagagataggattgt

SEQ ID NO: 2103 - DNA, 552 bp, Hordeum vulgare
gtacccccgggcctgcagggaattcggcacgagggaagtcttgcctgctgctgaggtttgcggatgattcatatcttgagagctatatcagtactattggcgttgacttcaaaatccgcaccgttgagcaagatgggaagacgataaagctgcaaatttgggatactgctgggcaagaacgatttaggaccatcacaagcagctactaccgtggtgcccatggcatcattgtcgtgtatgatgtgactgaccaggagagcttcaacaacgtcaaacagtggcttaatgaaattgacaggtacgctagtgaaaatgtgaacaagcttttggtggggaacaagtgcgatctagctgagagcagagtagtttcttacgaggctggcaaggcccttgccgatgagattggaataccatttctggaaaccagtgccaaggacgcaacaaatgtggagaaggcatttatgaccatggccgcagagataaagaacaggatggcaagccagccagctggaaatgctagcaagcctgccacggtgcaaatgcggggtcagc

SEQ ID NO: 2104 - DNA, 550 bp, Hordeum vulgare
tgtttaaaaatactctgggcaagcaggtaccgcactgaaaagcaagtggtcattcagaagcaagatagatgcagatgtctccctttgaaacatgaacattaaccaaacgacacaaattaaaatagcaatattaacagtcagctaaaacaggccgcagcatctgctgcactgttgtagtttaagggacatgacacttcttccaacagaccgcatggtagtcgtacacttaatttacaggggaagaacaaccaattgagttttgcaagaacactgctgtgatctgagtgttgctcaagacgaacagcatccgttttgctgagcaacaggctgaccccgcatttgcaccgtggcaggcttgctagcatttccagctggctggcttgccatcctgttctttatctctgcggccatggtcataaatgccttctccacatttgttgcgtccttggcactggtttccagaaatggtattccaatctcatcggcaagggccttgccagcctcgtaagaaactactctgctctcagctagatcgcacttgttccccacc

SEQ ID NO: 2105 - DNA, 552 bp, Hordeum vulgare
  UNSURE (20): n stands for any base
gtacccccgggcctgcaggnaattcggcacgagggcgtgttgtcgcgggcgatgctcttcgtgttcgggttctactggatccccgtgtccgatcgaagcttccccaatgccgaggatgtacctaaagatcactctgaagaactggaaagaccaggggcgattgtatctaatcatgtgtcatatgtggacattctttatcatatgtcagcttcttctccgagttttgttgctaagaactcagtgtcgaagttgccgttgattggtctcataagcaaatgtcttgggtgtatttttgttcaacgagaatccagatgttcagattctaaaggtgtctcaggtgctgtaactgaaaggctccatgaggtttctcaagacgagaattcctctatgatgttactctttcctgagggtactactacgaatggggattaccttctcccatttaagacaggagcctttcttgcaagggcaccattgcaacctgtaattttgagatatccttacaggagatttagtccagcctgggactccatggatggggcacgtcatgtg

SEQ ID NO: 2106 - DNA, 546 bp, Hordeum vulgare
cagttattgccgacatgattattgaactataatgtttaatgggtttctatacaatgtaatataacgagggaattcatctcaaaataggtataatgtattcatcaatcagcatacgcctcaaacagagaaaccatgaatcacatgatcagctaaagttggcatacattgttacaatcatctcaacagatagtgtacagagagtgatgcaagggctttcaatcatctttctgatgcagagcacgaggactattaccattaagtgctgcatgatacacacgcttttcagccagcccaagattagaaagaactaaattaccctcagtcgcaagcaattttctgacgttgctggcatagactgtaggatcctgcttttcttgctcagaaggatagtatacaggcaagcgaaccacctccatgtagtttgcaaactgacagaggagcaaaaacacatgacgtgccccatccatggagtcccaggctggactaaatctcctgtaaggatatctcaaaattacaggttgcaatggtgcccttgcaagaaaggct

SEQ ID NO: 2107 - DNA, 332 bp, Hordeum vulgare
gctgcctcccacctctcttcctcctcctcatctcatgccaccctcgcctagaacccctccgcctcccgatctccggtgcaatcttacgcctactcaccgcgccccgatcgcgtcctgaccctcgtaccatcggatcttccgcccaattgctggacgaatccatcgaattgcccccatcaataacaccgctgccctagaggagggaaggcaagacgagacccttgggggttggttgttgcgggggcgcggtttctggccgcgccgcggtgctctaagtgcgtgggatgggtgcgccgaagcagaggtggacgtcggaggaggaagccgcgctc

SEQ ID NO: 2108 - DNA, 113 bp, Hordeum vulgare
ttttttttttttttttttttttttttttctttttttttttttttttttttttttttttttttttttttttttttttttttttttttttttttttttttttttttttttttttt

SEQ ID NO: 2109 - DNA, 156 bp, Hordeum vulgare
cgggttcgagaagttcaagaccgaggtctacgacaagaagcccgatttcttcgagccgctcaaggccggccaggcgtcccaagtacatggtgttcgcgtgcgccgactcgcgtgtgtgcccgtcggtcaccctgggccttgagcccggtgaggcct

SEQ ID NO: 2110 - DNA, 552 bp, Hordeum vulgare
ttatattaaacttaatatgatgtctttcgatacaagacgatcaaattatgcatcacatagcagtacaattcctcgtcagaaaatggtgaagaaaaaaaggttctattgcttatggcaaattcacatcgggccatccggcatccagtactggacaataacgggtacgcactcccatggcattgcattcacatcgatcggacgatatcttgatatatgtacgtttgtatatgtcggagttaaccggtggggaagatttactgctcccatgtttcgaacttgccggagacgaagtcgtagtggccgccgacgagcttgagggttccgttggtcacaccctccttgacgaacgggtaggtcaagaggttctggagggacacgttgacggcctccttctccaggacggtgcactggtcatcgaaaggcatggaggcgcactcagtctgcaccttcttcttggccgggaacccgatcctgacccagtcctcaacgaagtggaaggagtcgtctgcgccatccttgagcgagagcagagccttgattccaccgcagcgg

SEQ ID NO: 2111 - DNA, 488 bp, Hordeum vulgare
cctcgtgccgaattcggcacgagggcttaagcttctgagccttccagtgccggaacagagcagcatataagaatggcatccctgaaggccgtgaagccaaccggacttgaagggcaggccaaggagcctaccaaggttagtgccactaaggggcctgcaaagctcagtaacacggcgaccaagccagcagccgccaagggcggcatcaagaaggctgagtcaaagccacgggagcctaagaagagggtcaagagcaccaagccagcagcagcaaaaaactgacaacggcagcaggagaacggagcttgcatagctatctccatggtgctatgaattatatatgaatcctgcctttcccttcctctgtctcccatgatattgatcatgcctacacagggtgtgcgcacaatccatgtgacgaatattacaaataagacgtgtagttctgccatctgcttcatcttattctcccaaaaaaaaaaaaaaaa

SEQ ID NO: 2112 - DNA, 468 bp, Hordeum vulgare
ggagataagatgaagcagatggcagaactacacgtcttatttgtatattcgtacatggattgtgcgcacaccctgtgtaggcatgatcaatatcatgggagacagaggaagggaaaggcaggattcatatataattcatagcaccatggagatagctatgcaagctccgttctcctgctgccgttgtcagttttttgctgctgctggcttggtgctcttgaccctcttcttaggctcccgtggctttgactcagccttcttgatgccgcccttggcggctgctggcttggtcgccgtgttactgagctttgcaggccccttagtggcactaaccttggtaggctccttggcctgcccttcaagtccggttggcttcacggccttcagggatgccattcttatatgctgctctgttccggcactggaaggctcagaagcttaagccctcgtgccgaattcggcacgagg

SEQ ID NO: 2113 - DNA, 392 bp, Hordeum vulgare
tgggtagacacccctgttgactccgccgttttctcaactcaacccccatggctctcgaagcgcgcctccgcctcccactcgccgggccaactccggccaccgctttcgtctcaggatccaaccccaaacccagccacgtatccttctccctcaaacctacctccacttctctcgccgccgccaatgcgccgccgcccatcgtcgtcgtgggctccgccaacgcggacatctacgtcgaggtcaaccgtcttccgctcgtcggcgagacggttgccgcgagtgccggtcacagcctcgccggtgggaagggcgccaatcaagccgcctgcggggggcggctggcgatgggacccacctacctcgtggcgcgcgtgggggacgacgccaacggg

SEQ ID NO: 2114 - DNA, 312 bp, Hordeum vulgare
tttttttttttttttttttttttctgaagtgaaaccgttggttcaggcgtgcttttttttatttcgagggtgcgggatttgctcccgaaaatgcgtttccctttctagaatactactaacgcgttactgggctgggggcggcgcacgagggtgcggaaggagctcactggatccgtcggaactttagccgatcattattgctgatgaatagggcggctaaagtcaccattttctccggttattcggcttgcacggattctagaaggctcatcacggtttccctgtcaggcatgctgggaatggctcccttta

SEQ ID NO: 2115 - DNA, 10 bp, Hordeum vulgare
  UNSURE (1)..(10): n stands for any base
nnnnnnnnnn

SEQ ID NO: 2116 - DNA, 643 bp, Hordeum vulgare
  UNSURE (15),(249),(250): n stands for any base
gcttattgcttgagnatataaatggtacggtaatatacatgatgatggaacaaatattgtgcgtgagcaatgcgtacgagctggaaatacataaatgataattatgctttctgccgacgaacactacagggtgcaaacgaggtcatatcaacatgctcctgcaaaaaaagacgttctagacatgctttagagatatatgctttagagatatctaaggcggtactgattttgctgcccacctttatttgnngacatggctgccataatcttgattgaacttctcatatctatgtgcatggagatgagcagacggccgtgtattcctcagagcaagttcgatatcctctgtcgctattgggccaacttcaggcaactcatcctctgggatttcttcttgtctgccttctagaactgccattaaccgtctaagtggttgcattgctgcctccttacaaacaaggcgtatatcagagccggaatatccttcggtgttctccacaagagcatcatatggaatctccattgtgtcttgagtcaatggaaggaactcttcaaacatagcatgcctagcttccgcctctggtaagggcacaagaatacgtttttccaatcggcgtaacattgctgcgtctagttcccatgg

SEQ ID NO: 2117 - DNA, 517 bp, Hordeum vulgare
agtccatttaaatgatcctcttgcaatggcaaaattgcaagaagcagccaaagtaaacagccgtgcagcatacaaagaatattctaagcgaattcaagagctcaacaaggcgtgcaatctgcgtggtatgctgaaatttatagatagcactagcaagatttctttggatgaggttgaacctgcaagtgagatagtgaaacgcttttgtactggagcaatgagttatggatctatttcgttggaggcacatactgcccttgccgtggccatgaacaaacttggaggcaaatctaacacaggggagggaggggagcagccttctcggatggaacctctttctgatgggtcgatgaatccaaaacgaagtgcaatcaagcaagttgccagtggacgatttggagtttccagctattatctgactaatgcagatgagctgcagataaaaatggctcagggtgctaagcctggtgaaggtggtgagcttccaggtcacaaggttatcggtgacattgcagtt

SEQ ID NO: 2118 - DNA, 558 bp, Hordeum vulgare
tccatattactcagacgactttacaatacttgaggcaacaaaaatactgtacattattcaggctacaaagccgcatttaggcagcgaatcaaaatattatagctagacaataaaccaacaaacaatagccaaccaaaattttccatggtatgcctatccccaagtataaaagggccctctctttctttccctattgagcccagccttagcacaatttgctatcaccaatagataaaatcaccaatcctaaattatgttgctaccagcaccacaaacctatgcaaggcctgcgatatttatgcagcaattcgctgaaccagacctgcacccaaggcagtgatgccttctgcggcattttgttcatcccttgacaagtacttgtcaaccgcggcagcagcttcacgtccttcagtgatggcccaaacaaccagtgattgcccacgcctgcaatccccagcagcgaaaatgccatccacactggtcgcgaagtgtccaaattgagctttgaagttggaccggttgtctttctctaaacccaattggtcagcgattttctcc

SEQ ID NO: 2119 - DNA, 517 bp, Hordeum vulgare
gttacacccgctccactcgtccgcgctcctccccctccccgcagccccgacgtgatcccgtcgtggatgcagccgcgtgggaggtcgttcaaccgccgctcccgcagcttctcccgcgcccgcctcgccgtcgagggatcctaatctcgcccgcctcccgtaacgaacaaccatcccatctgataaattcacgcggaacagcccgccgttaacagccacgggaactaagatggacgccgccgccgccgccgccgctgccgccgacgcagtcgttgccaacggggtgctggcgaagctggaggaggagagggaggcgcagaagaggtactgggaggagcactccagggacctcactgttgaggccatgatgctcgactcccgtgccgccgatctggacaaggaggagcgccccgagatactgtctttacttccttcatatgaaggaaaatcagtgctggagcttggcgcgggaataggtcgctttactggagaactggctaagacagctgggcatgtt

SEQ ID NO: 2120 - DNA, 555 bp, Hordeum vulgare
gtccaaagcccaaagtggttttttatttactttcaaacataggcggaatatatcagtatcacgcataatcgaataatacaggaccgtgataaccagctttcccgaatcaccgagaaataggataggtaaatatcaattgcaaaaccaaattatgaaaaaggccacatgaaatgaagccactttatttgcttgcagacacccacagatctgggccatcacttggtcccaatgaacagcccccacctctgctcaccagcagagctcctatgaagtttcgcgttccacccagtcacaatatcgtcatagtcctcctgaccaaagtcggctagaaaatcatctttgttcttttcaacttcggctagctccctctgtaaaactttcaggaactgatcactgcggtcttcggcaatgacatcatggaaaccagcattctctagcatctgtccataagtctctacatcatgaaggtcgtaacccctctgcttaatgtatgacgcaaactcttcagatggttttcctggactcctacagtaatcgctgattaggaccttacca

SEQ ID NO: 2121 - DNA, 522 bp, Hordeum vulgare
gcaaactcctccatcctggtctccagccatggccaccgccacctccccgctcctctccctctcttccctctcggcctccctcccctccccatcccgggcacccgcctccctctccctccgcgccctcgccccacaggctcgcctgtcgacctcctacgccgccttccccatcggtgggttcggagcctcggcgtcgacggggaggttgaggaggagggggctgcaggtggtgtgcgccgccgagccgcccaagactggaagacagccggactcggtgaagaagagggagcgccagaatgacagacaccgcattcgcaaccatgcccgcaaggccgagatgcgcacccggatgaagaaggttttcagagcccttgaaaagcttcggaagaaagccgatgcccaacctgaagaaatcattgaaatagagaaaatgatctctgaggcatacaaagccatcgacaagacagtgaaggttggcgccatgcacaggaatactggagatcatcgcaagtccaggcttgc

SEQ ID NO: 2122 - DNA, 485 bp, Hordeum vulgare
caacagaggaatgtaagacaagcaatggcccaatattgtgtcagagcttctagtgcatagcagagcacataaacacagtagccagtaccagaacacttgccatggggaagaactggcagtctatagagttcgttcaataacatatgctgtccaaaattggcaagatgtgatgaaagaaaagctgctgcaatttacgatgacaactcccccagaaactaggcagctgcagcaggttcagcattcggaacataccaaccacgaattatctcaatggccttcttcctccttgcaagcctggacttgcgatgatctccagtattcctgtgcatggcgccaaccttcactgtcttgtcgatggctttgtatgcctcagagatcattttctctatttcaatgatttcttcaggttgggcatcggctttcttccgaagcttttcaagggctctgaaaaccttcttcatccgggtgcgcatctcggccttgcg

SEQ ID NO: 2123 - DNA, 452 bp, Hordeum vulgare
  UNSURE (423): n stands for any base
gttcccgggtctcagctctcaagtctcaactcccagttctcctcctcctccccctggccctcgcccgcacgctgctcgctcgatcgtcgcctacctagtacctaccataccatcacacctaccgcccctctctcccactgtctctctcgtccgcaccgtcagacccccccgcgcccgcgatcgaccccgcgccgcccgcacgctcccgaatcctcagccgccggacgcctccttccgacgaagcgaagcaggccgcctcgggctctccgccaccgcgtcctcctccctccgcactgcgccggccgctgctggattggcgtggagatccacctgggcctgtttctcctgctgcctgatatcagccagactgatcagtggtcatatcgaatacaaagttttcttgtatgttttgttagcatgcanaagatggttcccatgggttcggaatgagg

SEQ ID NO: 2124 - DNA, 424 bp, Hordeum vulgare
tttttttttttttttttttttttttagccctgcaacattcttctattaaaaggagagaatttttcctttacaaatttgaaagaaagggtcgccgatatacagccgaaatacaagagtttaatatatgtatatccttgccggtctgcaggatcaacgggctagatttttacaagttttatacagagaaacggttccacctctgaaggcactgggaggttgggagtgaagcattcaccaggttcgtttcaggctctcagctctcagcgtactcgcagtcgagcaagcgagtgaggaactcctggcagctcggccgatcttggggctctgcccagcaatctgcaattaacttgccaagaggcccttctggaatttcaagccccgacccttcagtaactgcatacaccacttgaactggggcgatccc

SEQ ID NO: 2125 - DNA, 415 bp, Hordeum vulgare
gtctcgcgcagcgccgagccgagccgaggccaccgccgcaacacgcatcccaaaaatcccgagcctcctcgccgccggcggccatggtgtcgcagcacggcatcctcctcgccacgggcctcatatccgaccacttcggccccctcgtagcaaaggtgtgcgactgcctcctccgccagggggcgctgcagctgcaggagattgtgcgccgtctcaacctcccgcccgggcaggtgaagaactctctcctcgtcctcatccagcacaactgcgttcaggccttctcgtcgcccagccccagaggcgataggaccatgacgctctacttgaccatcttcaacaatgtcctgcaccggctgcgcttctcaaagtttatctctgttatccgtgcggacattccagagtcggaagctct

SEQ ID NO: 2126 - DNA, 554 bp, Hordeum vulgare
tgctagattagttatatctgggccatgggcccgggccctaaaaagcccacgacaaaaaactgaagcccaggtctggcccaggccctgccatcgggcctactttgaagccctatcccggcccatctgttgaaaagcccgtcgggcttggggccgtgggctgagcctcttccttaaaatcccaatatgtcaagtccaagcctggcccggccctgccggtgggctcaaaactcaagcccaagcccggcccacaggcaagcccatagggcctaggccctggattttgaggccgggccgggccggagatgcccaggtatagatatagtattcgatattcagttatccaacttcacagtctggattcctttttacatttatggtagactaacacaggcttcagtgttttcaaaaatcacggaacagcaagagagagtcatcatgtctagtgagggctaggatcaaaatgttctttctgttccgcagctttgtttcgtccttcgagccctcgagtagaagttcagcaatgtaattcaccatctggcgcaagttcaaagcag

SEQ ID NO: 2127 - DNA, 519 bp, Hordeum vulgare
ggatcagcggccgccactgacgatgtcgtccctcaactcgctcttcaaccgctcctcccccttcggcaccaaatgcaaaacatgcctgaatttgatcatttcgaggatcaagctgctgcgcaataggagggagatgcaactgataaatatgcgcaaagagatggttcaatatcttcagacgggccaggagtctattgcgaggattcgggtggagcatattattcgggagcaaaatatattggctgcctatgagattgttgagcttttctgcgaatttgttctggcacgagtccctattgttgaggcccaaaaggaatgccccttagaattgcgagaggcaatagctagtataatctttgcatcaggaagatgctcagacttgcctgagctgatgcatctccgtaatttgtttaccaccaagtatgggaaagagtttgttgctgctgctatggaattgcgccctgattgtggtgttaatcgcactataattgagaagctttcagttaaggctccatcagc

SEQ ID NO: 2128 - DNA, 553 bp, Hordeum vulgare
  UNSURE (31): n stands for any base
gtccatgaagaaaggtctgcatgcgaccagncacacacttacagaggaacacacataattgtcatgcaatgaaagatacatgttcatcaggtcatgacaatgagccatcaaatctcgcctccacagcaggcacaaatcattgagttgtaactttaaccttgttaacaagttctgccgctgtccaggcggcggcggaggcacgggtggctgcaacaatggcagctcgggccttttctagcacgtctgacgagcctgggccaacggacgatgatctctccgcggcaggggggtgatgctcttgaacggccacattattcttggtggcagcatatgttcttgaactcacagcaggtgatttcggggactcgggagttttatttttgcttgtgtcgttgacaggtagaatcgatggcttatctctggaaatggaagagcctggagagctctcaattttaggtgtttggccttggcggactgatgatccggaatcgtccagcagatcttcgtatttcttattgaattctgcttcggtattagatgaatcccaatcaag

SEQ ID NO: 2129 - DNA, 547 bp, Hordeum vulgare
gtcccccgggctgaggaattcggacgaggcacagtctcgaggttttaccatccttttgctctaaaagcaggtatcctgcccacataaccctcctgcgcgggaaccacgaaagtaggcagctgacacaggtatatggtttctatgatgagtgccagaggaagtatgggaatgccaatgcatggcggtactgcactgatgtttttgattaccttactctttcagcaatcattaatggcaccgtcctttgtgttcacggtggtctgtctcctgatgtacgtactgttgaccagatacggacaattgatcggaattgtgaaattccccacgaaggtcctttctgtgatcttatgtggagtgaccctgaagagatagagacatgggccgttagtcctcgtggagcaggttggctttttggatcacgagtgacaacagagttcaaccatgtgaacaatcttgacctagtgtgccgggctcaccagctggtccaggaaggcttaaaatacatgtttcaggacaagggtcttgtaactgtgtggtctgcacctaa

SEQ ID NO: 2130 - DNA, 552 bp, Hordeum vulgare
gcacaagaacaaaacttgacacttgtatagaaggaatacgggagcgcaatgatgctcccagcgatctattgtacatgtggttaaaacaagagagaaataaaaccgcatcagatccgactatgatctgaaccctacaacaataaccacctccggtccatcttttctttaaccttacagattaaaacagcgacttctaaaattgtacaacaaagtcagagaaaatatgggacggcagtccttgggccacgcatctggttgttctcctctgtctctgtgaagaacttgacatcgcggtccatgttctcatcaaagcttagtatagaagcaacattgccacatctgtagcaataattaggtgcagaccacacagttacaagacccttgtcctgaaacatgtattttaagccttcctggaccagctggtgagcccggcacactaggtcaagattgttcacatggttgaactctgttgtcactcgtgatccaaaaagccaacctgctccacgaggactaacggcccatgtctctatctcttcagggtcactccacata

SEQ ID NO: 2131 - DNA, 497 bp, Hordeum vulgare
gggaagaaagaaaaaggcaaagcaagagatggggtgcggaggcggaggcgggggcggaggagatgctgatggagacgacgaggcgaggggaaaggaggatgcgctcgcatccagtaggctcctcgatccggaattcaagccctccaagctgtcccaagatcagctcgacaagttcaaggaattacacaagaaacggctacaactaaaggaaaaaacaaaatccaaaggaaaacctaaaggaagagctgggacgaatacaaatgtagcgaatgattctcaatttagcaataaggataaatcaattgatagtgccgcaatagatgtacagcatacaacatcgactacaggagcccaagcgaatcttgcaccatccctgccattgaggaacaaaaggaagttgcattgggggcttgatgttaaagaacggtgggagaggaaagcgaacatgtgaatttctgaagattatttaaattctcaccctccatgtaaatgggaaa

SEQ ID NO: 2132 - DNA, 551 bp, Hordeum vulgare
ggatagtctagctgttttggtacaactttgtactaaattagcgtcaattaatatggatatccctgtctcgctaagatagcggcgacatactgttctataacctgaatggcgtggatctcaagtacccaacaagagatctggacaggtatttaaaacaaaaggaacataggaatatctagctacataacctgcataaggcatcagacagaaaactgcaaaccaggaaatttgctgcctagaacttgtggttttcacccagttattctgcccactaaaagaactatgaatacatccaactaggtcatcaagaaggcatgagactcttttttcccatttacatggagggtgagaatttaaataatcttcagaaattcacatgttcgctttcctctcccaccgttctttaacatcaagcccccaatgcaacttccttttgttcctcaatggcagggatggtgcaagattcgcttgggctcctgtagtcgatgttgtatgctgtacatctattgcggcactatcaattgatttatccttattgctaaattgagaat

SEQ ID NO: 2133 - DNA, 567 bp, Hordeum vulgare
  UNSURE (30),(38): n stands for any base
ttcggcacgaggggccggcgatcccccagnagcgaagnatctatcggggttgcgcagcgccaccgccgacggaagcccccagcgagcgcggccgcaccaccgtgacgcgcctctttctccacccgttcgatcagatttcggtaggcggggtcgagcggggctggttcgcaggagaagggatacgggaggatgatactgctccagtccccatccaggtttatactccagatcctgaaggatcgcgtctccagcggcgacaagggcgtggacatcgattgccacacggtggagttcgacgatgtgcggtatcatatacagttttcaatgaggaatccaaaggtaatggtgctatcagtggcattgcccctcgcaccacctgaggctattctctacgacgggcttcctcttggtgctattgatgctataaaggcggcttatgggacagtggttcaaattcttgatcctccaaaggattgctttgatctcacaatgaagataaacttaacaaagcttccgacagatgaagagcagcggaatgttgtcttgacacaaattgcatctgtgagg

SEQ ID NO: 2134 - DNA, 541 bp, Hordeum vulgare
taattgcgcctattcctcaagtcgaatttcgaccaaatacaatatcctcccggaacaaacaaacaagcgacgggcaaacagtagggtgctcatgttgtctcaacggttgccaccccagtcttaccggaagttgaaacaagtgttctaccaatagcacccatgatggaaagttgagcaaaaccttcatatatttgcttgtccgagtcttccttcagtgacgagagtcgccttcgtgcttcatgctcagtctccgaaaagacccgccatgtaccaacttcttcagcttctctgcatccgatttagcacggtccaaagcctggatcagagactcaactctacgcctcatcctagtgtgcatgaatccttcagaacactttacatggtagcttacataagcatgaaaggttaacaaactccaaactgttttgtctagctttctaccctcaacatgccgagggaaaacaacaaaagtaacaaaaccagcgtttgcatcaagtgcatcagcattcacgccttttaactcaagaggtggtactggaga

SEQ ID NO: 2135 - DNA, 517 bp, Hordeum vulgare
ccgcgctcgacacgccctacttcgggccggggcctcggcgccgtcgtctggaactccggcgctctcatgacccaaatccagtggttccgtgacctcaagcccttcttctgcaactccaccaaggaggagtgcaaggagttctacgccaactcgttgttcgtagtcggcgagttcggtggcaacgactacaacgcgcccctgtttgcagggaagggcctcacagaggcctacaagttcatgcccgatgtcatccagggcatctccgacggcgtcgaggaattgatcgccgagggggcagtggatctcattgtgccaggggtgatgcccaccgggtgcttccccgtctacctgaacatgctcgacatgccagcccacgagtatggcgcacggagcgggtgcatccgtcagtacaacaccttctcatgggtgcacaacgcacacctcaagaaagcgctcgagaagctccggcccaagtaccccaatgtgcggatcatctacggcgattactacacaccgg

SEQ ID NO: 2136 - DNA, 557 bp, Hordeum vulgare
tttttcccaaggtcaatattgcgtaactcatggcgttcattacattttacatttataccacctcacagacaaaacaaatcatgcttttggaatccccctatttcacctttgtaccccacttgcaatgaattcaatcaaatgaaaatatacacgtatgaaccattgggactatatggaagaactactttcccttctccagtttagtagtgtgctattctcgacgctctacaggtgcaacagcagaagcggaacgctcacaaggactgaacaatcggttggtctgcgaaagggccatatagccaacccctggcgatatggccataagcagcctccgtcaagtgaatgccgtcccagctccagtgggtcgttggatcagcacaagcagtggcaccaggctcaccgcatttggctgtgacattgaagttgtaggccgccttggcaacggacccaggagccccacagcatgccctaggcaactgcttgtagaatccaaacttctcaggctggagcatgaactggacaaccggtgtgtagtaatcgccgtagatgatccgcac

SEQ ID NO: 2137 - DNA, 551 bp, Hordeum vulgare
gtcctcccgggcctgcagggaattcggcacgaggagcaaatccaaaggcaggagcaaaatcaactgcagcagagttttactccgaattgtgttcacatgctgatcagataatggaggcaattgagaaacacttctgtaatgaagaaaccaaggtgcttccccaagctagggttcttttctctcctgagaagcaaagggaacttctatacagaagtctttgtgtcatgccattgaagctattggaacgtgttctaccatggttggtgtcaaaactgagcgatgaggaggcatcttcttttcttcagaatatgcgcttggcagcaccatcatctgacacggcattggtcactcttttctctggttgggcatgcaaggctcgctcagaggacaaatccaattctggagaatatatatgcttaacatcaggggcagcaagatgcctgttggatgatgtagaagagctgaaaaaatgtcaatcattctgcccatgtgcttcacgtaccagtgcagatattcctcttcatctggaaaatgaaaatggttctaggcca

SEQ ID NO: 2138 - DNA, 541 bp, Hordeum vulgare
gctggaccggatcggtctttgcgtatagtgtacacttgtatactgtaatatactttggcctggatgctaagcctttagggcaggcaggatgcacctgacaggatgaaggtcaggcccatgtccatttttacagattatagcactagacctcgtaaattgcacgctatgcttgacaaaaatgactggctatgggatgaaataatatggtagctattctacacaagattctgtaagactatatttacaagagacaaaactaaaaaagaaagaatattcccctcgctagtttggggtagaacaatctgccgtatcagtcttgataactctggtattgtaagaaccacaggagccgcatttgtggtacagccaatgaaattgagatctcccttttctttcacagtcattacaaagaatatcctgacacctatcacggtattcctcaggaagctcttcggcagccaacaacgcatcaagcatgccaaagtacaccgccatatctcccaaggatttgcagcagataggacaagtgtagtgactgcaa

SEQ ID NO: 2139 - DNA, 518 bp, Hordeum vulgare
  UNSURE (11): n stands for any base
cccaaacccanagcaagcaagagcgaccatggctccgattggcgtgggcagcaccctccccgacgggcagctcgggtggttcgacgagaacgaccagctgcagcaggtctcgatccactccctggccgccggcaagaaggtcatcctcttcggcgtccccggcgccttcacccccacctgcagcaatcagcatgtaccaggcttcattactcaagctgaggatctcaaagccaagggtgtagaggagattcttcttgtcagcgttaatgacccctttgtcatgaaggcatgggcaaagacatacccagagaacaagcatgtgaagttccttgctgatggagcggcagcatacacaaaagcacttggtcttgagcttgatctcacggagaagggattgggtcttcgttcgaagcgctttgctctccttgctgacgacctcaaggtcaccgtcgcaaacatcgaggaaggaggccagttcacaatctctggtgctgaagagatcctcaaggcactgtagg

SEQ ID NO: 2140 - DNA, 555 bp, Hordeum vulgare
taggaaaccctgaagtaatgggcactgcacatagtccataaaggtacatgaagaaaatgcacatcgacaatttattcgcaccagcagtttggcagaaaagttcaaactacattgacatgacaccaggtccagcagtttggcagaaaagttcaaactacattgacatgacaccaggtccaggtgatcgctccggttccaaagagctgaagctcctacagtgccttgaggatctcttcagcaccagagattgtgaactggcctccttcctcgatgtttgcgacggtgaccttgaggtcgtcagcaaggagagcaaagcgcttcgaacgaagacccaatcccttctccgtgagatcaagctcaagaccaagtgcttttgtgtatgctgccgctccatcagcaaggaacttcacatgcttgttctctgggtatgtctttgcccatgccttcatgacaaaggggtcattaacgctgacaagaagaatctcctctacacccttggctttgagatcctcagcttgagtaatgaagcctggtacatgctgattgctgcaggtg

SEQ ID NO: 2141 - DNA, 543 bp, Hordeum vulgare
ggcctgcaggaaattcggcacgagggcacagccccctgtcgcgcaacagcagcactacagtgttcagcaagtcccgccacagatggttcaacagaaaacatcttcgcctcattctcagagtactcctcaagtcacgctcatgtatcctccatactcctctcagaagcctgccaatgctaccactgagccacttccgagaagtttggtagggcagtctccatactcttcacatcagcagaagcatcatgaagtcatgccttcgttttatggccaaggaaacacaaatttgcttcccacagcagagcataatatccagcatcaacagccacagcaactgcaaacacagagccaggcctcatgcccacctcaaccaagcaagccaagccactgcagcattgcgtcgtatgctgttcagggtagtggccgagcctacacaaccacatataagaatcctgccgagtgccctgcaactgttgttgctgttctgcctcagcattcggcagcagctcctatggcgttccatcatttgggaccccaagtcct

SEQ ID NO: 2142 - DNA, 545 bp, Hordeum vulgare
gtactcgtatatattatatcgcaaggggcaggttcatcgccaactgtcggttacaagcaagatatgtccattaaaagtgaggacatacgccagcatcatcactagactaatctaccattattatttcagattgacccttcagcagaaaaaaaaagtagaaggatctgtaccaatctgctggctaataaaaaggaagccagatgaaatacccgggtaagagccgataagcttccagctatagttatggaaataagttgtgtggtagcaatgaagtgctcaatataactgcccattctgcactatgcaggccagtctcgtggggatgtaacattgctaccagcattgagcttatcaaccatggcactggagtccgcagtcaccactgggagcgccatactcccaactagatcctttggataccctactacactggccgtttcgaacatacttccatatggattcttatgcaggacttggggtcccaaatgatggaacgccataggagctgctgccgaatgctgaggcagaacagcaacaacagttgc

SEQ ID NO: 2143 - DNA, 455 bp, Hordeum vulgare
ctagcttgaacagcaattggaggaatcaaggagcagcttgtctgaggagattgtaacactaagtgagcagaaggaaacagccctatcggagttacaccagtctcatgcttccattgggaacttggagacagagttagaaaagcgaagtgtgagtgtttcagttttgcagcaagctaatgatgacttaaagaagaacatctgtgcccttaccgaacaattcaacgaagtcaaggttgagttacagaagaagattaaagtgacacaagaagagaaggatacggttttaacccaactaaagcagtcagagttttctatcaagaaccttgaatgtgagataactcggttgaaggaagatctttcaattcagctagaaaacaactccagcttgaacaaacagtttgaggaatcaaggaccaatctgcagggggatattctagcacttcgtgaagagaaag

SEQ ID NO: 2144 - DNA, 552 bp, Hordeum vulgare
tacctccttattgtttgtattgagccctatttatgatacattaaagaaaatggaaataattgtctaatgatgttcacagataaaatacaacttatatattgactgacagtgaactttttggtaatcaaatttacagacaaaatggaaggcggggacggttgtgagtgcggatgtagcggaccagatcatcgctgttgttcttgtggtaatcaattgtgtcactcagctgcttgatagcttctcttttctcctgcactctagctgctagctcgtcgtctttttcttcaattatcttctcaagtcgaacaatcttctcagctgactcagtagcactcttaatcatttctgacatttccttttctttctttctcaatccaatagccagatcttcgttttccttgagcagttctttctgctcagcaagataattgtgtaacatgttctgaaggacactaaactctccaccacaagcagataagcggtgaatgaggcacgtaatgctttggctggagtgtgattcgagctcatccaattgatttttcaatttagaga

SEQ ID NO: 2145 - DNA, 503 bp, Hordeum vulgare
gacagagtgttgttaagggtaaggtgaagttcctttgtgtgagaggattggttgctgttggtttattagcatatagaggtgtttatgcatctgttatggaagtctgtgctgaggtgagaaaggtcttggaactgttagttgagcagatccgaattaaaattttggaaaagaaaagtcgttatcggtacttccatattctatctcaagtagcatatctggatgacatcgtgaacagcttgggcatacaccttccaaagattacatcctgacagtaggacaagagcattaggtacaaagccagcaagtctaggaaagtcatgcacaagagagtgtgaaagtaccagttacgctacagaaagcaatgtactctctggtcctgttggcggctctaccgaggtccaagacacttcagcccaacagtcacacgaccatctggttggccatgcttcctgtcctagtgagatgcatgacaagccagtccaacaaggtcctgaccaacttaa

SEQ ID NO: 2146 - DNA, 520 bp, Hordeum vulgare
cactcaaacctgctaatatttgtgaaccttgtttcaccttgatggcttaattgagttgtaatacataatacagtgagatttgagaaggcatcatcattcatctagttctacagattccaacatcagtaacagcagtccttgtctacagcagacacacttaattaacagaagatcaattgctccacttctcttcaaccaatccatatctcacaacgatacgcaagaacgcattccactgccaatcataaccgataaaggagatttatttgcagaaggctagcatgaagttgcatcgaggatgagaagcagaagacttgctaatcttgtggtatgtacagaactggaagtgggtcagctcagagcaaaaatcctaaactgcagcatctttagcattggacaacacattgtatttttatctgcccacatgatcacatcaactggggatctgaacgagcatagaaatcgttcctggtagagagcaaacacataatcttttaaagttgcaatgaagtgtggtccc

SEQ ID NO: 2147 - DNA, 517 bp, Hordeum vulgare
gcgtcaagaagctcaacggttgggacgtattctcagggcaaagggtaagcatcaagataggatggcaggtggaaaagaagaatacaatgcctttttctattctcttgtatcaaccgacacacaggaaatgtattattcgacaaaaaggcaacaattccttatcgaccagggatatagtttcaaggtcatcactagcttgccgccacctgaagaaggacctaacctgagttttcacacactcgatgaacagcttgaccttttaggcaaagtgttgagcgcaggggatgacatgattggtgttgagcacttggaagaggattctgatggcaaggctctcctgaaggctcggcgctctgctggattaatgagcgcattttctggagcgggtggaatggtctacatggagtacaacaagggcaagggagccaagaagaaggacccagctaagaggcatacactgttcaagaaacgctacacttaggggttctgttgtatggcatttgcaaggaggccagga

SEQ ID NO: 2148 - DNA, 553 bp, Hordeum vulgare
  UNSURE (16): n stands for any base
gtttctgtcaaaacgngatcataacatttccctaaaaggagaggaagcggtagtacttttccagattgttttaactaaccgtatgtcacaactgtatacaatgaaacaaagagttcatgctgtgcaaagcttcgcaatgtggattttggttatattgtatacaggtacttgcacaaatatttacatttctgcgaaagataaatgcccttgttctccctctcataagctccaaaattggccctccctctcataagctccaaaattgaccctccctctcataagctccaaaattgacccttctgatacggaactggagataatgaaaagatgcacaccacaagaatctggaggaaacttcccagtagaattctctaatgacaagcgattagcgcgaaatctggctgatgcgctaacagtgagacatgcattatgtccaataagtagagcccctttaaccataccatgtccaagcaaagccaatcccgcgctataggttcctggcctccttgcaaatgccatacaacagaacccctaagtgtagcgtttcttgaac

SEQ ID NO: 2149 - DNA, 361 bp, Hordeum vulgare
gacctaacagtcagcgctgtcgttcggccgcccgcccgctcagctcccgtctgtgactgccggcggccggcccagcaccccgcgaccgccgtccccttgccccctagcccgcccggttgttcccttctcctcgccggtcgccggctcgcgcgcggcccgccctctctcctgttccatgttggtgaattttcttctgcagtaggaagaggcagtcgggttgggtacgagtagaggagatggtgttcggacaggttgtgatcgggccaccaggctccggcaagaccacctactgcaacggcatgtcccagttcctctccctcgtgggaaggaaagttgcggtcatcaatctcgaccccgcgaa

SEQ ID NO: 2150 - DNA, 404 bp, Hordeum vulgare
tttttttttttttttttctaacggccaaatggttaggtgcttggtatataattgcataccgtcaactctaccatagtacagaaatacagaccgacgagaccagactacaggtgctgttgagtttctactagtcctacatgctgaaatcaaccaagtcacgagaaacaagtatacttgccaagttgccatatagtttcccagcatactaccttcgccccagaggtgaagacgaaattctacacatctagggggtagcaagaaacttcaggcaacatccacattgtcctagtaaacacgagctcgggtctacgccagtgaagcgtttaaccagcagctggcgccagtgaatgtcgatctcattgcatcccgcttgttttctgaatgatttcatcatctttcatgta

SEQ ID NO: 2151 - DNA, 517 bp, Hordeum vulgare
  UNSURE (3): n stands for any base
ggnagcttctggcgccagccaagtcaatcttgcagacccagctcaggctgcccgccgtggacgatccactggcgttcaggctgtcaatagatccaccttcattagatggaagctagctccgactcgacgggaacaggagcaatgggacagagcgaccagggcaaccaccggtggcattgatgtcatactaagggagtcgcaacagaaggtgcagctgaaaggggaccctaaggtggtggcagctgaggccagagagcaataccttaagttgaaagaaaggttgcagttgcttactttaggtattggtggcatcggtgtggtttctgcttatgtttcatacactcctgaaatcgctgcgagctttggtgcagggctgattggatctctggtgtatctccgcatgcttggaaccagtgtggattctctagcgggtggaactaaagcagctgccaagggcgctgcggcacagccaagattgcttattccaatggttcttgtgatgatgtacaatcgatgg

SEQ ID NO: 2152 - DNA, 552 bp, Hordeum vulgare
gagagcttccggagctactgtattgtactgtacttaacaaccctcactatttacattctgtactgatccgagtcctgccgacctccttgtgcacataatgttaaatgctcaaattaaatgtcgactcaaccatggcatgtgattcggggtcaatgcaccaaaagttcagaggcgtacattgtacacaacttgtagtatttgacagcacacctgtaatcctgtatgccagcttcccttcgcacagtcatgtaaactttttcagcggaatgctgttaatcagtcgatatgttcagacagtatcgtcggcgtgaatctgatttagtacttggcgaaatctctaggctgcagattacactcttccaaaaccttaatagaactatattgatgaatggtgaccaatctcccctcagggcaacaaccttctctctgttcttctattagccaaagcagcgttcaagcttcgcggtttccaacatcaggtattgattcatgaatcgcttgagtaaacattgcaatcttgtaggtgaaaaacccaacgagcatgggtatcaa

SEQ ID NO: 2153 - DNA, 537 bp, Hordeum vulgare
ggcaattcggcacgagtggctatgtacaacacagcatgagctcaattcctccagcaccagtgaagttaaaaacctaaaggtcaaccgtctcgtcttttccctcaaaaactagtctgagtttgccaggtcccttgagaacggcatcagttgctctgtactgatccctcgtgccgaattcggcacgaggatgacgtcagtattgatgtgccctgatggtaaaacaatcgaagccgaagctgcccatggcacagtcactcgtcatttccgtgttcaccagaaaggtggtgaaaccagcacaaacagcattgcttccatctttgcttggacaagaggacttgcacacagggcaaagctagacgacaacgctagacttcttgaatttgcacagaaacttgaggaagcgtgtgtcggaactgtggagtctgggaagatgactaaggaccttgcactccttgttcatggatcttcaaaagtgacaagaagtgattacctgaacactgaagagttcattgacgcagttgctgctgagctcaaatc

SEQ ID NO: 2154 - DNA, 558 bp, Hordeum vulgare
  UNSURE (15),(53),(57),(68): n stands for any base
gtgtcctagtatgtnctcttttatttgtaagactaccactttacattaccatncagncatactacagnaactcgtcttgcattgttttaataataatatgctacggtgcagtaaaagctcggtctgttcaggatgatagcatgacagataatggcgacataaccaaaatgacttgaatcgatgggtagtgactattgaagcattgaagtggaagaggactttcacagtcttgatttgagctcagcagcaactgcgtcaatgaactcttcagtgttcaggtaatcacttcttgtcacttttgaagatccatgaacaaggagtgcaaggtccttagtcatcttcccagactccacagttccgacacacgcttactcaagtttctgtgcaaattcaagaagtctagcgttgtcgtctagctttgccctgtgtgcaagtcctcttgtccaagcaaagatggaagcaatgctgtttgtgctggtttcaccacctttctggtgaacacggaaatgacgagtgactgtgccatgggcagcttcggcttcgattgttttaccatca

SEQ ID NO: 2155 - DNA, 553 bp, Hordeum vulgare
gtccccccgggcctgcaggaaattcggcacgaggcatgaagctgcagatccgtgtcgacgaaggcaccgggaagatcgtcgacgcctgcttcaagaccttcggctgcggctccgcaatcgcgtcatcctccgtcgctaccgaatgggtgaagggaaagcaaatggaggaagtagtgagtatcaagaacactgagattgcaaagcacttgtcacttccaccagtaaagctccattgcagcatgcttgctgaagatgcaattaaagctgccgtgaaagattatgaatcaaagaaggcgaagctgggagacagccctgcggagaaggctgccgaagcatgaacatgttcccaccatgaaggatgttgatcgtctgtgatgcatctgctcctagtaaagatatatgcttctgttttatgagggtgggaaacggtgtgcaatgtcacaaactccagtgttgtagcatgtatcataaggacgaacacgaacaatttggaataaacgtgctgtcatgttaggagaagttgtgcatgtatagcagctgctaagaaaatttg

SEQ ID NO: 2156 - DNA, 562 bp, Hordeum vulgare
taaagtgtaccttaaaggaccttcaaggcagttgctatacatgcacaaattttcttagcagctgctatacatgccacaacttctcctaacatgacagcacgtttattccaaattgttcgtgttcgtccttatgatacatgctacaacactggagtttgtgacattgcacaccgtttcccaccctcataaaacagaagcatatatctttactaggagcagatgcatcacagacgatcaacatccttcatggtgggaacatgttcatgcttcggcagccttctccgcagggctgtctcccagcttcgccttctttgattcataatctttcacggcagctttaattgcatcttcagcaagcatgctgcaatggagctttactggtggaagtgacaagtgctttgcaatctcagtgttcttgatactcactacttcctccatttgctttcccttcacccattcggtagcgacggaggatgacgcgattgcggagccgcagccgaaggtcttgaagcaggcgtcgacgatcttcccggtgccttcgtcgacacggatctgcagcttc

SEQ ID NO: 2157 - DNA, 412 bp, Hordeum vulgare
cctctccggtatgcacaaacagacttctcggggcagcacctgattcctgctttatgcatctgatctgattctcgtaagagtaacccccaggtggcataatttcgtgatcctgggctgccggcacggttcctggccgagaagatgttctccttcaagtccagcctcaagtcatcttccagtggcaaccaactttccacgccgcgcttcaccgaggaatcagatgtgcaggagcagttgaacaagttgcaggaggagctggtaaaggagaaagaggagaaggtacgtgcgctggatgagatagaggagctcaagaagaagagcagtaagaagaagaagctaaaaggaagtggcggggacgatcagtcggaccttgcaaacagattagagcagctggaagtagagctggaggcag

SEQ ID NO: 2158 - DNA, 553 bp, Hordeum vulgare
  UNSURE (53): n stands for any base
ggaaatatagtcggttttcatattttactacctgtatgttttacatatatgtntacattctctgtaatttacatctataaagctgaatgggcaaaagggtttactccgcacttggaacatctcattttgtcgagcattacaactatcttgagttcaaggaatttgaagaaacgaaatggaatctagagtgcatacttgtatttagtcactgcctggtgcctgaggatgctagattacactttgagtttgagggtttcttttcttcattatgtcaccaaatttcctaagaatcgtcctattttgctgccttgcaggactcctaatatcctttgaacgaggagagctttcaacatcagagtacatattatctgccgccacatatcttcctttcctgttgcctcccttggcatctatgggtgatgcttctgccgaggttttcgttgactctgaactgaacatagcatcaatcatgtccttcaattctttaatgctactctgtgcagcagcctcacttactttcaaggactcgtattcttgcacgatgctctttaag

SEQ ID NO: 2159 - DNA, 513 bp, Hordeum vulgare
gctgcaaccacgcctcccccgcctgctacccccggctctgctcccaagcgaagccaaagtaaaccttcacccgtacggcaagaggcgacgccgggggccaatctacgggcaccagatcgcggaggagcctgccgtctcctgcccattctccccaaaggtccccagagtcatgagatgcaagctcatttgattttttatatgttcaacaagcactgaagtattttcctcgatggaggctgaagctgctttcgatgttgaagattccagatcaaacgatgaactgcaggagttgtggccagttggtgagatagacccaaagagagggcgattcccttgttgcattgtctggactcctcttcctgtagtttcatggcttgctccttacataggccatgttggaatctgtcaggaggatggatctgtcctggattttgctggttcaaattttgtgagcatggataattttgcatatggttctgtcgctagatacctccagctggacagaaagaagtg

SEQ ID NO: 2160 - DNA, 548 bp, Hordeum vulgare
gtagtttagagaatatacgagaatggataacggtccagacaaatatttccacaactcctcaccgggttcagtcgcaatgtaatttcagcacaccaaacctttcgtgcagtatacagcaaagacgaaccaccctatcagaagcaaacagaatgccgataaccctattaggaaagaccagccggccataaaaataccgatgcacgtcacagtcacgaatggcgcgaatgaccgaacaacagacattttgtccacccattcgccgtgaagccacacaagagctgccacattcaaaacattccactccgccgaaccgccgtgggcaagccggttcaggcagtttgctacgaatgagtaacagttgcaggtgaacaggttgtagtatttgtgctggaaatgtcttgtgcccagttgcaaggtaccatcccaggatgttgctgttccaacttctgtgtgcttgtatgtcgactcgcatacatgtgcccccagattagcaggaaagcagcacttctttctgtccagctggaggtatctagcgacagaaccatatg

SEQ ID NO: 2161 - DNA, 516 bp, Hordeum vulgare
ctgggtacacctttttcgcctgcgcacgcctttcctggaaaccctagcagacgagctctccatctagctcccaatccccgccgcctcgctggacatactcgaagcggaggcggaggcggaggcgaaggcagacagaaccatcgcccatggatctgcagatcgtgggacgacacgcgttgctctttgacgacgacgcggcggcggaggtcgtgaactccggcggttccctcgtcccctggtccgccgccggcgcggccgatctcctcctcgaccgccacgacgtccgccacctcctcgaccgcgtccctcctcgtccgaaccgcgcctactccgtggccctcctctccaccccctctcccgacggcgtgtccgaggccgagcttgaccacgagcgcttcctcgacctcaccgccgacgtaggcaccggagatgcgtctccttcaggaaacgggacagatactgggcaggctgattataatgccgtcgctttctcatatgggggacctgctggttttg

SEQ ID NO: 2162 - DNA, 539 bp, Hordeum vulgare
tagcttgaacaaataggaactgaattttaacaaataaagcaccgaatggagaagaacaggatagtacagcgatacatcacatcgcacaatgtactacaatgtctctaatagcatggccctaattttcgccttcagctcatctgggacctgagttgctgcctgcgaagattgaacagtttccgcagggggcttctctgatccatgccggtgctccggcgtgctttgggaggcttcagcaccgccaggagtttgctcatcaagatatcggtcatccttgtgtttccttttggaaccagagcgatgcttcctccggtgcctcctatgctcatcatcttcagcataatgatgatcatccctatgccgatgccttgacttggaactgcgcagctcgtcttctgaagagctataatcgtgcctacgatgcctatactccctttctttggagtgctgcttgtgcttacgttcgtgtgcatccttactgtggcctcttgaacgctccgaacgatgcctcttcctcgagtgttcataactttcctcct

SEQ ID NO: 2163 - DNA, 519 bp, Hordeum vulgare
gcaccctccaattccgccatgccgaagggcgccaaaaagcgcgcgaagctcaagaagaagcagcaggggggccagcccgccgggtccaacggcggcgccaccaccaccaacaacaacgacggaagcaataactcgagccacggcgacgccgccagcgatggaaaccacctaccaatcaaacttaccattcctcccgtggacgcaagcgaggattccatggagagctccgaggagatggtgacgccgagggcggaggtggccgacgaggagagcaagggcgccgcgtcggaggtgccggttgagcgcgccgtcgaggtcgccgatgagggcgaggccggggaggaggtcatggttgacgctttgccgcctgaagctgctgatccggagcaagagggtaaggtggacgtgacggcggaggcgcatgccgtggtgcaggaaccggaggtgcaggacgtcgtggtgtccgaagcacccgaggtgctggaaccagaggtgaggagcgaggaggtcgtggtccgg

SEQ ID NO: 2164 - DNA, 552 bp, Hordeum vulgare
ggagtagacacaattttactgttgacccactttttaactcatatgctacaaggacagcagaacctagaacatactccactagacaagggggggtaatattcagaatactacacccaggattttaaccacaaccaatacaatgtaactttgcacagcaagatacggtaaacacgggtggagagaagcatcagctccatgtcaattcgaaatccttccaactccatcttctgcgtgagcactcaacgagcctagttacaagtacccatcacctttgcacaactttgcatcttctgccttcttgcttcccaagttccttccaattcatgtacctgcatctatctctctgaaccagcaaagacatccaaaatcccacagcaattccaccattttgcccgatgccccgcagcagcaaccgccactgccggtccccgtacaacctctgtagtctgcgcaggagctggctcacgagaccgtgacacctcatcctttgcctccggttcctgcaccacagcagccgtgtccgtatccctgaccaccaccccctcggccttc

SEQ ID NO: 2165 - DNA, 521 bp, Hordeum vulgare
tatagaacctacccggtaccaaaaaatgtccatggcaatggtcgcttccttcgccgcccgccaccaccacggtcacctcgccgccggcctcccctccatccctcaagcaagcgggaggactagccgcagcggtggcaccatctccatgaaggctcagaaaaagcagagcagtgagcctggaagtgggaagggggccggggacgggcgagtcagcggtgggcggcgagtgtggcgccgccggaaactgaccaaagaggatgatatgttgcgttacaagttggatcgtatccctttcttagaagagaaagtgagaaaagtaagggaaaatgggaagcttgtgtgcttggatatcaaccagctcatgttatctcaagagaataggtttgcattcacaatggaggtggcagaagaagctaatgcctatcttgagaaacacaggcatgagtatggattgaaaaaacctatactacatgtgctcagtgaccgcatgaatgaagctggattttctcggccagagggct

SEQ ID NO: 2166 - DNA, 547 bp, Hordeum vulgare
ttgtaaatatctaaataatatctatattaaatatttaagacaacaataaaatgggccagtagatcttgttcggcgaatctcagcatcccaatcccatgtcagcactgaagaaccacacagacgacagtcaagaaagatcaggctaccttcgcttaatattgttactaacatggaggtctgggtgcaaaacttcagagctctggggacaaaacgcatcttaaatttgattttgtaagttgctccagatctttcaaactccccctcaactgcgtagtgtatacaagaaaaactaggagccctgcagaccgctccattctgtcaggacgccccccaaactagtgttccttgatcgataaagcatgtgattctattcaattgccttcttcttttatgaaataaggcccgggcttgataggataaggataaaggtagccctctggccgagaaaatccagcttcattcatgcggtcactgagcacatgtagtataggttttttcaatccatactcatgcctgtgtttctcaagataggcattagcttcttctg

SEQ ID NO: 2167 - DNA, 518 bp, Hordeum vulgare
cgtcggcgacggagatgcagccactggcaccgtcgggctaccgccgggcgccggagatgaaggagaaggtggaggcctcgtcgatcgacctggaggcggggaacggggagacgctctacccggggatctcgcgcggggagaacgccctccgctggggcttcatccgcaaggtctacggcatcctctgcgcgcagctgctcctcaccaccgtcgtctccgccgtaaccgtcttccaccccaccctcaacgccacgctctccaactcgcccgtcctggcgctcgtgctcgctgtcctccccttcatcctgatgatcccattgtacatctatcagcacaggcacccgcacaatcttgctatcttgggtttgttcactctgtgcttgagcttcagcattggtgtggcttgtgcaaacactgaaggaaccattgtgcttcaggctttggtactgacctcagctgtggttgtctctctgactgcgtacacattctgggcttcaaagaagggcaaggaatttagt

SEQ ID NO: 2168 - DNA, 550 bp, Hordeum vulgare
gtctacaaaggcggaatcagaaaaacatttcccctttgcattctttgggaaaagaatgacacgtttgtataaacagaggcataggccagcaaatctgtacaggcagattcagcaccaacaagggaaaacagggcatgcagttctctcctacagaaccctacacccacacttcctagccaagctaaaactgagaatcgatcacttgagctctgatcaggcaagcaacggcgcagaggaatccttgcacctccatttcctgctgtagtaagcgtagagcgccaactgcgttgctcccaggacgactccaagcccgttgggcagatagatgaagagatcgcgcagcagcactccgtatatcgcgaaggaggcgctcatcagcagcgtggagagcgagaggtagaagggcatgaactccacgcactccgtccggatcaccacgcccatgacggctagcggggaagcaaacatggagatgagcgacgccatgctgacggcgccgacgaactgctgccgggtcggctggtcgaagaaggtgaggctcgcgtgcgcg

SEQ ID NO: 2169 - DNA, 518 bp, Hordeum vulgare
acacaatcatcaaccctaattcgcagcctgggcgccaccgcctcctcgaccccctttccctcgaaacccacctaaaatcctagccctgccggccgccatggcgtcggcgggcgaagcgagcgcggcggcggaagccacggaggggaagaactggcggcggaaggggaagcacgagaaggagaagccgtgggacgatgaccccaccatcgaccgctggacggtggagaagttcgacccctcctggaacgagggcggcctgctggaagtcagctccttctccaccctcttcccccagtaccgagagaagtatctgcaggagacgtggccgatcgtgaagggcgcgctgaaggagtttggagtctcatgcgagctcaatctggtggagggatccatgacggttaccaccaccaggaagaccaaggatccctacattattctcaaggccagggacctgataaaactcttgtcacgaagtgtccctgcaccccaagcaattaaagtgctcaatgatgagatga

SEQ ID NO: 2170 - DNA, 547 bp, Hordeum vulgare
tgcatgttcatacttaagcttgaagatttgtctgtttcaccactaaagcttgaaacttgaagacctccttgaatgacaagagttcaactacttgaaacagctagaattatcatcccagtcactgacgtactgcggttacttggatgacaatttgcgcttctttttggagtgtgattcttcgttgctcgcaacatacgactcgattttcacgtttccctcagcttcactatttctgaatttctttgcctttttctttaaggattttgtgatatcagcaatttcattgttgtcattactacttttggcagattcagatagcccagcagtattctcctttggtggaacaaatgcagcttctctctttcttctcttttcttctgatttctctgattgcttatcctgcttctcttgatatttcttagctgcctttaccttgtcactcaagaaatactcaccactctccagttcacgatcaatcttgctaggctgctgaggtggcggaaagggtgtgtattgtttcttctccttggtattgggcttcttttgc

SEQ ID NO: 2171 - DNA, 517 bp, Hordeum vulgare
cgaacccccctccctcctcctcagatcgcggagcactacgacggcgtggtggcgacggacgtgagcgagggccagctccgccacgccatcgcgcaccccaaggtgcggtacctgcacacgccggagggcctcccggaggacgagcttgtcgcgctggtcggcggcgagggctccctggacctggtcgtcgtggcgaccgcgatccactggttcgacgtcccgctcttctacgccgtggtgaaccgcgttctcaagaagcccggcggcgtgctcgccgtgtgggggtacaactacgacatccacccgttcggggagaagctgcaggggacgctgtacccggccatgcggccgtacatggacccgaggacgaggctggccatggagcggtaccgcgagctgccgttccccttcgagcccgtcggggtgggccgcgagggcgagccggccgacgtcgacatggaggcggagatgacgctggaggacctggccgggttcgtgatgaccggctccgtcgcga

SEQ ID NO: 2172 - DNA, 536 bp, Hordeum vulgare
cacttttactctacatattattctgacctgagaaaacaaaggtcctgatccaattaccacacccagcgctcatatacgtcacatgggcctcccagccagcatgaaggccttgaacacaagcttcctgggcaccgtcagcagatccccccacccctcttccatctccttcatcacatccttcaccagcgcctccaggtccacccctctctccctggccgtcgtcgcgacggagccggtcatcacgaacccggccaggtcctccagcgtcatctccgcctccatgtcgacgtcggccggctcgccctcgcggcccaccccgacgggctcgaaggggaacggcagctcgcggtaccgctccatggccagcctcgtcctcgggtccatgtacggccgcatggccgggtacagcgtcccctgcagcttctccccgaacgggtggatgtcgtagttgtacccccacacggcgagcacgccgccgggcttcttgagaacgcggttcaccacggcgtagaagagcgggacgtcgaaccagtgga

SEQ ID NO: 2173 - DNA, 491 bp, Hordeum vulgare
ctgctcaagctggcaagctgtgtcgacaagtagacctcaacctgctgctcacttcatgggcatgcatcaaagccttggtattcagctcgcacagcttgggaaggatgcttctgcagcaggagctgcacgcagaggtaatactcagcggaagacagttgaggttgagtctgttgcagcttcagggaagccagaagctcgagaagtagtgaagaaatctttccgcgccgagttcattgagaagctgcacaaagatttggatgatgatatcgatttcagagccttggaaaatggatttatatctgtcactcctctgaatgtgcacggccatgtcgagcctgaacttgaagctccagcttcagactggctgtcagcagctgtggctgcgtctgacaaagaaaaggaagcttctccaggtatagccgaagaaaaggaagctccagcgacctaacaaacacgcagacatgtacactgtaggtgctttagtccttgcc

SEQ ID NO: 2174 - DNA, 517 bp, Hordeum vulgare
tggggggtggcagtattcgtctagtagatgcaatcgcctactggttacatccaaactgtaggggctccagcatcaaatcattttacatgacgaagaaaataggcaatcgtaggagaagaagaacaaaaacaaagactgcactgaacaaacatggaacgcaaaagacgggacaagaatcaagccaataaagcaagggcagaggagatagacaccaaggcaaggactaaagcacctacagtgtacatgtctgcgtgtttgttaggtcgctggagcttccttttcttcggctatacctggagaagcttccttttctttgtcagacgcagccacagctgctgacagccagtctgaagctggagcttcaagttcaggctcgacatggccgtgcacattcagaggagtgacagatataaatccattttccaaggctctgaaatcgatatcatcatccaaatctttgtgcagcttctcaatgaactcggcgcggaaagatttcttcactacttctcgagcttct

SEQ ID NO: 2175 - DNA, 476 bp, Hordeum vulgare
caagtctgtggtctggtggagcatccaggatcacatatctggacttggagattcctcaaaaagcgagactcccccaggggcatcaggcagcaagcatagcaaaactgcaactgaaaaggatagtcctaaagttgacccccgaggtgtattccacgggcatgatagcactgttgaagatgtgcagttctgcccttcgagtgcacaggagttctgcagcgtgggtgatgatgcttgtcttattctttgggatgcccggactggtactagcccagctgttaaggttgagaaagctcatggtggagatgttcattgcgtcgattggaatccccatgatgttaactacatcttaactggttctgctgataactctgtccgtatgtgggatcggcgaaatctgggtcccggaggtgctggttcttcaattcacaaatttgagggccataaagctgccgtcctttgtgttcagtggtctcctg

SEQ ID NO: 2176 - DNA, 551 bp, Hordeum vulgare
  UNSURE (36): n stands for any base
caattgatacaaactgagccaggtacaaacacaatnctcattacaaacaatggcataacgtccgctagaaactaacggtacaaaatgttcccaataggccaataccccaatagtctggctacagaaataaagctccgctgtgttcgccaagcatacaacaagttaaataagctcacaagcaccttaagggtacaagtctaggttgttctagcatcagagaacataaccgatgtttcaaatggacagataactactacgatacctagagatatcacataattcaaggatatcacataattcaagccctcggagtgcagctggccaagtgagacttgaaggtctccagctctgaaagaacctcgtcctctgggcggtagatcaaatcactcatacgccatatctgcaaagttccacctccaccggtgctctcaccatcatcagatacactcacaatggtccaagggtctgatgagttccagtggaaatctacaatcttatccctatgacctgcatgttgaaagaaaagcccaccaggcgaattgggatttttc

SEQ ID NO: 2177 - DNA, 505 bp, Hordeum vulgare
ctcccatggcgaccactctcccaacctccgctgccgccgccgccgccgccgccacctctaccgttcggatcttccaaccgacccgattacacctccctagaacctctcccgttcttgccccctcgcgttccgccagtcgccgcctctccggcatcacctgctctcccgggattgccagcgtcgccggcgaagcgacgtccccggaagacgccgtacgcatcgtggccgtcgtcggcgacggaagcatcagtccgctcaaggatacaccctgggacgaggttatgcgccatacggctgataggttgaagtgggttgatgaagggtttgaaatgcttgtgttcactgacaagtcgattgaccatgatgatcttaggaaagaattgtctcattgtgatatgctagtcaatgttgcaataacaggccaggagtctgttcagtggcttacacaaaacagtaagaacatcccgaatgtactttgctttcagtcatctccgtccttagtaaa

SEQ ID NO: 2178 - DNA, 555 bp, Hordeum vulgare
  UNSURE (14): n stands for any base
ggtttacaacaggncagtaaaagatattaagcaccgtaacaaccaggcgtcacataacaactctcctataaatgtacaagtttctacgagcaacgtttactgcacaaggtaattgtacagcggacgaaatggggcatcagcagactgcagagaggctgttgttggagatcggggacagtgggactggcatagcgagcacaggatgcgggcctatgtcctgctatgtgtgagcatccaggatttatacaggtactgaagacaccccttgaacaccggatgctctcaaccagttacaaataagttccatttggcaagatgcgccgccattctttacagccgtgtaagtagaggtgcagatgtacatcagttgggaaagaaatttcccctttcatgctgtgtgaacaattcatcagagaattctctgcataatatcagcttcttttcctggagcaatctggtaatgcagccgtgaaccttcgggagttcccaaaggcgcacccgtgcaggagcagttgtcaaccataaaaagctcccatttcttgataccacatttct

SEQ ID NO: 2179 - DNA, 525 bp, Hordeum vulgare
ggcacgaggctgctaaccactgcacccctctcttttatcctatcagctccatccatcactgacgatcgatctcagtccacctgcatctgtaggtgtactagtagtacgccggcctaatccagctgagagctgatcgagctagcttgcatataccactgcacgtacgcacatcaaattaattagaaactactgtaattaagttatcagcagcgagaagagaacgatcgatcaacaccatggcttctgctttctcgtccaccgttggagctccggcgtcgaccccgaccatcttcctgggcaagaaggtgaagaactactaccatggtggcaacaagatgaagagcagggtggtgagggtcatggcggccaaaaaggaacttgaccagggcaagcagaccgatgcggaccggtggaagggtctggcctacgacatctcggacgaccagcaggacatcactcgggggaaaggcatcgtggactccctgttccaggcccccatgggcgacggcacccacgaggccatcc

SEQ ID NO: 2180 - DNA, 513 bp, Hordeum vulgare
acacaatcatcaaccctaattcgcagcctgggcgccaccgcctcctcgaccccctttccctcgaaacccacctaaaatcctagccctgccggccgccatggcgtcggcgggcgaagcgagcgcggcggcggaagccacggaggggaagaactggcggcggaaggggaagcacgagaaggagaagccgtgggacgatgaccccaccatcgaccgctggacggtggagaagttcgacccctcctggaacgagggcggcctgctggaagtcagctccttctccaccctcttcccccagtaccgagagaagtatctgcaggagacgtggccgatcgtgaagggcgcgctgaaggagtttggagtctcatgcgagctcaatctggtggagggatccatgacggttaccaccaccaggaagaccaaggatccctacattattctcaaggccagggacctgataaaactcttgtcacgaagtgtccctgcaccccaagcaattaaagtgctcaatgatga

SEQ ID NO: 2181 - DNA, 510 bp, Hordeum vulgare
  UNSURE (22): n stands for any base
gccgccggtaaactgaccaagnaggatgatatgttgcgttacaagttggatcgtatccctttcttagaagagaaagtgagaaaagtaagggaaaatgggaagcttgtgtgcttggatatcaaccagctcatgttatctcaagagaataggtttgcattcacaatggaggtggcagaagaagctaatgcctatcttgagaaacacaggcatgagtatggattgaaaaaacctatactacatgtgctcagtgaccgcatgaatgaagctggattttctcggccagagggctacctttatccttatcctatcaagcccgggccttatttcataaaagaagaaggcaattgaatagaatcacatgctttatcgatcaaggaacactagtttggggggcgtcctgacagaatggagcggtctgcagggctcctagtttttcttgtatacactacgcagttgagggggagtttgaaagatctggagcaacttacaaaatcaaatttaagatgcgtt

SEQ ID NO: 2182 - DNA, 541 bp, Hordeum vulgare
aggtaatttattgtaaatattctaataatatctatataaatatttcaagacaacaataaaatgggccagtagatcttgttcggcgaatctcagcatcccaatcccatgtcagcactgaagaaccacacagacgacagtcaagaaagatcaggctaccttcgcttaatattgttactaacatggaggtctgggtgcaaaacttcagagctctggggacaaaacgcatcttaaatttgattttgtaagttgctccagatctttcaaactccccctcaactgcgtagtgtatacaagaaaaactaggagccctgcagaccgctccattctgtcaggacgccccccaaactagtgttccttgatcgataaagcatgtgattctattcaattgccttcttcttttatgaaataaggcccgggcttgataggataaggataaaggtagccctctggccgagaaaatccagcttcattcatgcggtcactgagcacatgtagtataggttttttcaatccatactcatgcctgtgtttctcaagatag

SEQ ID NO: 2183 - DNA, 551 bp, Hordeum vulgare
  UNSURE (11),(19): n stands for any base
gtcccccgggnctgcaggnaattcggcaccgaggagccatcgtgcctcgtccgtgtcgcgtggtggcccagatgcgtgcgcctcgtgctctgcctcgacgagcgcggcctcgatccggcctcggcaggaagagctcgagccgaggagagggaggggatagatacgtgaggaggatgaggaggctgtggccgagctccctcccgcgccctcctccttcctctccccggcggtgccagcacccctgccgcgagcccctcctcttccctgtccggccggtctcatcctctgtagctctccttgttgggcggctccagattgcggaggacgatctgcagccgggtctacacaattgaggatttatgggactattgaatattatgcgggccacagtgtctcaaattaccatttctgagtgtttgctgtaatggatggagagatttctggtatcattgttatgacatttgacgaggctgctcaacttgcttattttggtgcccaggtgctaatcttgttgcaagttgttgtcttgatctctttctctctagggaagg

SEQ ID NO: 2184 - DNA, 555 bp, Hordeum vulgare
ttttcgacagtgttttttactagcataaatagaccaaagcatcaacttttaccaaaaggaagccacgaaggtagttcactattaaccatattagacagatggccttgtccggatgccttgttatccaactttcttgtgtggtgtgatgaacaaatccgttgacgaacatatggtgttagccagttgtgttatgccatttgtctgatacaatgtgtttgaaaatcaacaagtaattaattcatgcacacacattatgaaaggttgtgggcggtgactgatggcttcctcaccgcaggtctaccgtcttcccgttcatggatggtggccaactgctttccctaaattatctcttgtagcattgtttcattttccatctcctcattgtccgcccatccttcacctgcaaatactacaatatatttatctttgataaaggtggaacaggggatgaaaagcacctctctacaatcagaacaacaataacttgacctcgatggataataatcgtttttgcatgagagagatgtaccctgaaattatcacatcctaaataaa

SEQ ID NO: 2185 - DNA, 517 bp, Hordeum vulgare
caaattgcttgggaattcttctctggatggatatcagttgtgtaatttgttttctcacagctcacaatccagctagtgtattctagctgtgattgtttggtgatcaaactatgaggtttttgctgattggagctgtccggagttgctttggtcttgtgttgatatgcctggtcttcagcagtatacagcaaccagaaccacatgcagtggtttcctccatatttaggacctgtgactgcattctgtattgagagccatcctgctaaatgcataatacttgcaggtatttgtgttgtgcttgcaaggcgatagcttttgcactaccaaacagccgacatgggtgccgtgcagcttgagtctgttgctgctcagcatgcacacgctaagctaaatatggattcacttcctcaaggcccttcgttgtttgatggaaatgacacagccagggtcaatggttctaactctgatgagtatgaaagatttgagaagggattaatggagtatggatgtgcacatt

SEQ ID NO: 2186 - DNA, 891 bp, Hordeum vulgare
  UNSURE (858),(891): n stands for any base
cggccaacttgggtaatcctgacatttaaattgagaatcaagaaattttgcaaccataaaccctatgccacacagcctgctgcatgcacgcagcaagactcgccagagtggtgatcctataggttgcagtcctgaccaatgctggaaatgataccaatcgagtacttcctccgtcccaaaataagtgactcaaaaatgactcaagagaagagtcatttttgagtcacttactttgagatggagggagtagaacacaattctaccagatgccgcgttgtgctaaaatatgcaaggcttgatcggtcacgcggaagctgttacacactgaacaaaaggagaccatgcagaaacaaatgaaggacaaccaaaaggcagcagctaactgcggaggatgcagataaactgtccagtgatctgccttcgtggaaaacatcacgtagatgaatcgatttccactgctggagcgcgctcgccaacttctaggaagaacgtagagtccctccatggctcactacttcaaatttgccgggtgttgtatgacttgcaactatggcacttatgtgcaattaagtgaaactgcacctctgataccgccccgcaatcattgcacaatatgcgaaccatcttatcgtcgaaggagtttgacagagtcgctagttctgcatccagtctttcccatgcctttgacatgtcacacaccgacttggagcagagcgggcatgcgaattggcaatgctccttcatttctttcaagcatttttcatgaattgtatgaccacacggcagaacagagacatcatttctcgactcaaacaaagtactcgagcagattggacagtcatgatgcatggctccttncacacatgcatgactgttcttcaaaacagtagn

SEQ ID NO: 2187 - DNA, 871 bp, Hordeum vulgare
  UNSURE (764),(788),(808),(826),(837),(840),(866): n stands for any base
gtcccccgggctgcaggcaattcggcacgaggagcaaatcctctaccaccctttgttgtccactgcaatatctccaaatcttctactcggatgtctcccagctgctgcagtttattggtcttcgccggggtgtggtggctgccaccgatgctcgtggtggccgaggaccagcaggggggagactgctcgaccatgaagtgcggcaacttcagcatctttcatccgttctcgctcaccgacagacagaccggaagaccatgcggtcctgatccctacccggacttcgatgtcgcttgcatcaacagcagtattccaactctacggagttctatacccctgaacaatggctttgcaatcctcaacatctcttacgagaaacacagcttgtatgccattgatctaggcaagctggacgtgttgaacgcccccaacaagtgccgtgcagtgttctataacacctcagtcaaactgaacggcccgttcaagatcgctccggccaacctgcacatcatcttgtacaactgcacggagaaggacggagcagcggccagggcacgtcggaacacagaacttgtggagacgagagttaggtgcgggaatgagtgggcggtgcttgtgcgtgcgggagtacctcacgatgccactgggaactacgccgagtacgttttggagggctgcaacgccgtcgtcgttccggtgctggactcatcggtggggggcgaacgcgagcgagtatgagcagctcatgaaggatgggcttcctnctgacatggggagctggccccctntttttcctgcacctgcaccntgcacctggaaaggttgnacgaaccttcnttnccctacacgggggcagtacaaggatnaaaat

SEQ ID NO: 2188 - DNA, 556 bp, Hordeum vulgare
aatataacttgattaattaatatatttatggcacatcgatatttgagtatttccaccattctaacaggcacaaaagggaatacccaatgcccatgaaaattgtccagccattgcgctatggcagacaccggctaaatcaaaacctctcctccattcagaaaaaaagctagaatgagaagcgtttgtctccctcccttcgctactgagtcctaccaagttccaaaccaaaacaagaagaaacgcttgtaggcaaccgcctcctcgccaccactactgccaatcttcaccaatgcagattagcggagccgccggaatcgtccggcttaacgagcttcacctcatcgatctcctcctcgacgcagaacgtccggcactcgtcgctgcagaacgccttctcgcccaggtacatgaaggtatccatgtcgtctcgcagcctcttcctgcagaaggagcacgaaccagaagcagcgccatcagctggcatggacggccatgaccgctcctcgatgggctcaatggtgaaaataggcctcctggaagggacgcccttgggcac

SEQ ID NO: 2189 - DNA, 511 bp, Hordeum vulgare
  UNSURE (17),(21),(22): n stands for any base
tctcaagttgcaagggnaggnnagttggaaaatctacggtcgcagtaaatctcgcttataccttagctggtatgggggccagggttgggattttcgatgccgatgtctttggtccaagcttaccaaatatggtttctccagagaaccgactgctagtggtgaacccagaaagcaaaagtattcttccgactgagtatttgggagtcaaattggtgtctttcggctttgctggacaaggaagagcaatcatgcgaggtccaatggtttcaggagtcattaatcagttgctgaccacgactgactggggcgaacttgactatcttgtcattgatatgcctcccggaacaggcgatatacacttaacactctgtcaggtagctccattgactgcagctgtgattgttactacccctcagaagttggcttttattgatgttgcaaagggtgttaggatgttctctaagctgaaggttccatgtgttgcagttgttgagaacatgtgctactttga

SEQ ID NO: 2190 - DNA, 515 bp, Hordeum vulgare
cttttctcattgttacaataatcacacaaaaacgctgtaggcctagaaactccttgagcctattgtaacataaaggtctttgttttttctttgtccttaatggctgaacattatctctactatatcacgaagaggccactgcagctgttgctggaagagggacatccactaagcgctcaagcatatccagttgatcataaggtgctatctgactaaatccatcaggccaagttatagaaactgcatagttgcccatcggccgtatctcttcaggctcgatgtcttcaggtacatcgccatactgtactttctgctctccggtccattcgtccacactttgagcagatcggtcgttccgtctgactgttgctgggtgcaagaagaactcctcatctgaatctggtactttcactctgattgctctaattgatctatcataggacactgctgttgaaacttgttgtctaattttagcacattgttgaacaacacatactccaagattctgaaatatc

SEQ ID NO: 2191 - DNA, 379 bp, Hordeum vulgare
atcgtcaaaagcctcaacgcacacgcacgcacagcacacgcacacaagtcccaactcgcaggtcaagtccaagaagaaggaccgtcgagatggccggcgtcgtggtggtgttcgacttcgacaagaccatcatcgacgtcgacagcgacaactgggtcgtcgacggcctgggcgccaccgagctcttcgaccgcctgctgcccaccatgccgtggaacaccctcatcgacaccgttatgggggagctgcacgcgcagggcaagaccctccgcgacgtcgccgacgtgctccgggccgcgcccatcgacccgcacgtcgtcgccgccatcagggccgcctacagcctcggctgcgacctcagggtcctcagcgacgccaa

SEQ ID NO: 2192 - DNA, 409 bp, Hordeum vulgare
ttttttttttttttttttactgcaagcctcatacattattatcgagttcgccattggcgctccaacacctcacccttaattagtttcctgcaacggcctacccaaactcgtacacaccagctaatcaggcaagcaaatcagaatcagaagatatatcagatacagaatccccaaattaatcgtaatgaagcacggatggatggatggatggatggatggatggatcagttcttgacgccgagcggcatgggcatgccgtcctggacggccaccggcagcgactcgagcttgcagtcgagcggcagcagctggctctcctcgacgagcacccggctgatgagccgcagcagcgtctcctccatgtccttgccgtcgctccatgggtgcacctcggcctggagcagtcccg

SEQ ID NO: 2193 - DNA, 534 bp, Hordeum vulgare
ggcaattcggcacgaggggagcgatgatggtactgtgaagctgtggagtatgaatcaggcaattctattcttgcacctgctgctgggagtgttggcactatcagaacaagggcaaatgtctgctcagtgcaatttcaacctgattccgctcgctccattgcaatcggatctgcagatcacaaaatttactgctatgatcttcgcaacgtacgagctccttattgtacactagttggccacacaaagactgtaagctatgtcaagtatgtagatgcatcaaccatcgtatctggttccactgacaactcgttgaagctttgggacttgtccatgaatcaagcaagagtaattgacaatccaattcagacttttacaggccatacaaatacaaagaattttgttggcctttccatttctgatgggtacattgctactgggtcagaaacaaatgaggttttcgtctaccacaaagcatttccaatgccagtcttggcgtataagttcaacgtcacagacccaatttcaggccaggag

SEQ ID NO: 2194 - DNA, 546 bp, Hordeum vulgare
  UNSURE (4): n stands for any base
cggnattgattggcctatacaaggtatacctcaaaccaatgatgtacaaaacccttgggccacccccaacatctcaaatatcttcactatttatgctacgtttgctatgacgctaacctgtaatcctacgctaactctcgatatagctaacactaccaccctaccagtagttcccaactctggggtacccctattcccacctctgccttgaagggattataaaatagcaagacatgcacattcccctgataacaagtcactgaagtcggtccatttctactcgaaaccaggcagcaccctcgcccttcggcacagggtcagtccatttctaacaccttaatgttcccactggagttagcagaaagaagtgtcgaagactgccccctccaacacacgcacgaaatgaactgcgattgatcatcgatctcctggcctgaaattgggtctgtgacgttgaacttatacgccaagactggcattggaaatgctttgtggtagacgaaaacctcatttgtttctgacccagtagcaatgtacccatcagaa

SEQ ID NO: 2195 - DNA, 518 bp, Hordeum vulgare
ggtccaagtatacgttggccgccgcatttcagctaaagctccaggcgcagttgaggtggcgttaaagtttgagcataaggacagcaaaggatgtagccatggccctccatatgagtggaaggtttacgatatccttggtggcattcatggggttcctcgagtccactacaaagggcgccaaggggattacttcattatggttatggatatgctcggtttcagtctgtgggatgcatgttgtaataattcccacacaatgtcagttgagatggttgcttgcatagctatcgaagctatctccatacttgagaaagtgcactcaaaaggatatgtccacggggatgtgaaacccgagaatttcttgctaggacctcctggaacccctgaagagaaaaaactgtttctcgtcgaccttggcttagctaccaagtggaaggaaagatcgacaggccatcatgttgagtatgaccagcgacctgatattttcaggggaacagttcgttatgctagtgttcatg

SEQ ID NO: 2196 - DNA, 553 bp, Hordeum vulgare
gagccaaaacattttaagtacggtgtttactacactgcagttaagagtacacaaaagatttaacacgactacaaacatttactactgtacacgctattttctataattaatagcgacaagcagaaacatcttcacaagaacacgctaggcggccacatggcaaaactaacgagctggatcaaaaagatgaggctaactcgcgcttcagcccacatggcaaaagatttctacgatacggtacgcccataacatactgaagcaaggtagagattcttggaccatttctccttcacatgctgactggggaaagcagatgttctcagtgtctcttgagtttcatcggtaggcttccttcttggtacacttaagatcagtgcagtctgatcccaagtcgcagcaactgctgttatccggtaaccactgtcccacctcttatggactccctcactagggtacaagaagtccagctcaacaacctgttcggaaaaccctgcattgcgagacataacaaccgcccatttctttccagcagttgccatggaagtcacataga

SEQ ID NO: 2197 - DNA, 500 bp, Hordeum vulgare
aaaaccagagttgtcttggcggaatgcacaacaaaatttggaccttggatggttgcacacggtatggagctgttggcagctgataatgactatgcagatattatgctgcatgaagagcggcctaactttggtggcataagcatagaagaactgcaccggctagtctacgctcaagttctgtgttctcattctttaacttggcagatcgcaccgacttatctgtcctcgtgtctaaaccaaggtctaggtctgctggagattctactcctcaagcaacccatacaagataaccgtctagtgctgaagactttggaactttgtcgtttgtatgaactggaggatgttggtacgaacatcatgaagattgcaggcatttaccattggaagcatggtagaaaaggaactggggtttactggtttcagcaagctcatgataaagtacgacttgatagaattgctcaacaattatttgaacgcattgggaagtcagttgcagatga

SEQ ID NO: 2198 - DNA, 541 bp, Hordeum vulgare
ctaagcctgtactttctttttcgacaggctcactgtgagtacactagatttttagcaacatgccgggttttttacccaatgatacagtcacgagcaccccgcttcgtataaaatacgacagacagctgagatcaccaaagctaaaaacaatagatggtacatctatggcagagccgctgaaccagagcgaaacgaattcaaactcttctcaacaacaacaaaatactgagcctggtaactgccgagcaacgccaccaaactggagccaatcctccaccagatacagcattcaagcttcttcaagaatggcacgggcgaggtttgatcccagggccaacctgacagagctcagtgcatggattggtaggtgattactgcagaagtcaggacgcagcttggccattgacagttcttgtagcttattgagcaacaaggtcgtctcggcaacattcaataaagggtggggtttgcagttaagtagtttcactgagtcatgtagaaggggcagccagaaacgttgtggtgtagaaggatttctcat

SEQ ID NO: 2199 - DNA, 1113 bp, Hordeum vulgare
  UNSURE (1)..(6),(16),(18),(21)..(25),(27),(29)..(31),(34)..(36),(39),(40),(43)..(45),(52),(83),(85),(87),(108),(109),(128)..(135),(140),(141),(150),(212),(275),(901),(919): n stands for any base
nnnnnnttgggaaaancntgnnnnncnannntgnnnggnnacnnnatgggcncgaatggaccttttgcggaagcccaaaatgncngnccgttttggtggtgggggganncccaaccagttaccacacnnnnnnnnatggnnttcagccgncggcccccttttatctctgcggggggggggccctcgcccaaaaaatatcggtggtcctaatntcgacgcccgcatcaggatggtcgttgtaaggatgccaactccgtaatttttcacgccctgcntatgtcttgctgggggggggggaagccctctttttttttttttattgccctttttctttttactccctcctttctttggggcgcgggcgttttttttccctcccccctctcccttttttctttgtcccttcaactcctcgttttcgtctctttctttcgtttttaaaaaacaagtctctcctatattttttctcttccctctgtttttttctcttttctccctttttttcattatgtcttcttattttctcgccttccttttcttttttccctccctcttctccctttccccgttcttctttctctttcgcttttcctccacgtcactatactttccgtttctggttcccttacaccttttttctttcacctcttacattttcttcctcttatttccttttctttttccacacacttcttagtttattattcttttttctccctcacccctcccgttacatttttatttatccccgtcttttttctagtgttattatctctcatcgttgatgaatatctccttctctcccgtttataatgttcctgctccctctattcagtatcgcgtcccactcttttatcggagcgtgagtcgttagtatttagctcgccataattttatgtanttccggctgatcaaatcntaccttttgcagtccaccacgctatcctttcttatttgatctcgatcgtcgtgatccacgcatatattttgtttccactccttccccccaccttctcccttcttctgtgatggattttttctccgttccacttcaccgatttacccacatcccgtgtgttcgcctaatgcatttaatttaatttcattcaacac

SEQ ID NO: 2200 - DNA, 546 bp, Hordeum vulgare
tgtgagagcaagtctagcaaaaaaaagggtttcaaataacgaaccaaatctcaccattcacatttactacgactttagactccgaaaacgaaaccgatgtgtaacttgtttacacgggatcacagactgagaatgcactccattgaatttccatgtgcagtgccgatcctagaatcccaagtgcccattaccccgtccatacagtccacttgccttccaggaagcttctcgttttactagagaaggaaaaggtttaagagaaagttccaaagagaggtgacgagtcagctattgacatagggacctgcgttttgcagcaaaagattgcaatgtcttgcccggctggagaatcgagcatgcttctgcactagcttcacatcataggccctggtgttagtcataccttgagtatccatcttcatatccgtcagaatatatgagtagaagcgactgttgaatcaatcgccataatctgcagatttaaccaagatctgaactacaatccatcgaaaggtctatcccttgactgactttgttcaccaccaa

SEQ ID NO: 2201 - DNA, 518 bp, Hordeum vulgare
gcaaatagagcagttggataacagctctgaatgaaaggagtagtaggtcccacagcattttaaccgtgcatgtgagagggctggacgtgaagaatggatctacttctcgaggatgtctacatctgattgatcttgctgggagtgagagagttgagcgatctgaagcaaccggagatagattaaaggaagcacaacatattaataaatctctttctgctcttggagatgtcatctttgctttggcccagaagaatgctcatgtgccctacagaaacagcaaattgactcaagttcttcagagctctttaggtgggcaagcaaagacgctaatgtttgttcaagtaaaccccgatgtggaatcatgttcagaaaccataagtactttgaaatttgctgaaagagtttctggggtcgagttaggtgctgcaaggagcaacaaagagggcaaggatataaaagatctgctagaacaggttgcgtctttgaaagacacaatatcacgtaaggatatggaaatt

SEQ ID NO: 2202 - DNA, 551 bp, Hordeum vulgare
tatatctggtaccagcggccgcaagcgtaccttgctcaccatcattgatccaaatcatccggggtcgtgttacaggtacatggctgcctgcccagttgaaatcgacacatacggtacatacatcctaacccgcgtcttgtgtcgtgtctcgttacaggtttacaagacaaaaactatccaagcctcgttacagatgcaagacaccaacgcagcagcccctcgtcgtcctttacgggaccacccgcttcttcgggggcttgatcgaagatgctccggtcggggcctggctggctatcgagctccggcgacctatgggcgtcgtctttggaacaggttccttcggtttcggcctggaagcagctggctgcccgttcttcgtcaggaaaaacctggtcagtcttgatggacccttctgcgttcgatctgctgctggttctgaagcgctgccgatagaatactcagtttcgcctaccgagcaaccatcgtcggatgcattatcttcgtattcgggttcacctgatccaatggaccctgatattagttggttctgt

SEQ ID NO: 2203 - DNA, 533 bp, Hordeum vulgare
ggaattcggcacgaggctcgagttgtggtcgaccgaatccctaatccccagtccccaacctcgaatcccgccgccgtcgccgtcgccgtcgccgtcgccgtccatggaggagctgcgtcgggcgccgtcctcgtccatggaggagctgcgtcggcccccggagttcgaccacatgttcacggacgaggcgtgggccaggatgagcgaggacacgcggcgccggatcgtcgcgatctcgtgccgggtggaaccagagcccacccaagaggaattggaggcggagcgagaggactgggaggcggtgttgcaagggcggcattacgctgacgaatgcgcagatgatgatgaggacggcaagaccatgccgaagacgacgacggagcagaccgtggacacccggccgctgaaccaccatatctccaaacaaacattgtccagggatatacagaaatcaaaggcttttatgtggtatcgagaccaccagctacacctcctacacggtccctcaccacctgtgcctggtccgatgagat

SEQ ID NO: 2204 - DNA, 555 bp, Hordeum vulgare
ttatagtacgcgctaaaacatcaccattacataacatgtccagaaaaatggcaggatcaaccggttttaaacattattacagcattgatcagcatccatctaagaacaagataactcaggctaccctgacacggacaaaggagctgactcgaaaactgggtgccacagatcattcttagtagtcgtctacacctaatatggttgaccacacaactcgcaccaagaccgatgctccattgctaaaccgatacatttgctcctcttcgccatgcttggacgccacaaacgaaagcgcgtcttggccctcctccatgaaatctatccgcagcgtgtccccaagatccacggctgcaacgaatttttgaatgtgcttcccgctggatggtataaaaccaactgtgtcacggcagtgctcatcaatgaaggagtaggatccttgggaaaggacagtgttgccacgcatgcgcacaagaaagccatctgcaggcacctccacaaaatccaggtctatagtagcctccatgcctctaggaacaacacatgtttccagtgtaa

SEQ ID NO: 2205 - DNA, 387 bp, Hordeum vulgare
agagcagacaggaccaaaccatttcgtacgtgctagaacaagagtgaagtgaagcgaagcgatgaagaagaccgtcgtcctgtaccctggcctcggcgtcggccacctggtgccgatggtcgaggtcgccaagctgttcctcaagcacggcctggccgtcaccatggcgctcgtcgagccgcaggtcaagtccaccgacttctccgctgctgtcgcccgcgcgagggcctccaacccctccgtcgccttccacgtcctgccgacgccgacgccgccaccgcctgccgatgccaacaccgacggggcgcccaggcaccacgtcgtcaaggttatccaatcgctcgcggccatgaacgcgcccctccgcgacttcctccgctcgctgcc

SEQ ID NO: 2206 - DNA, 386 bp, Hordeum vulgare
tttttttttttttttttttgaatttgtacattagtacaaatttatgtaaaataatataattaactcagaaataaacctagtccgcatataatgtcgaaatgtacctaggccgcgacaaatcaaatatcaaggtcaataagtttcacattaattctgaacggttgcgaccatggaagtgcccatgtcgttgaggaattggtcaaacgccaagtacgacgagcctccttccttgagcgcgtcggcagctgcatccttcgccgccgtcacccgctccctgagtgccttgccgccctcagacgccataacccatctgaccttctcttccacctcctcggccttaaccacctcttcattgtatcctctcatctccaccccgagcttcattc

SEQ ID NO: 2207 - DNA, 305 bp, Hordeum vulgare
attcaggcattcccaccatcacaccgcgccgccgccccggccgccgcaccaccgtagggcaacctcctctttccgcttggcggctggggctcttcgccccccgcgagggttttcgccgcgcacggagcagcaggggcacgccgcgctgagaggttgagggagatggctgccatggttggagcgcgcagggccctcctcgccgcccgctactcccctcgcggcgagcttgcggccgcgatcctctcccccgcccggcgcgtcgattcgccgcacagtcttccagctgaaagaggatgcccgcgttt

SEQ ID NO: 2208 - DNA, 417 bp, Hordeum vulgare
ttttttttttttttactttagcacactcaaagttaccaacaagcatgaactacagaatactcacaaaccaagtgtatccatagtttgtatcattagttttttatgacatgtaacgaattgtgagggagcatcatcagacaaagaatgcttcaagctaacaaattccagactagaacactaataggatgttacatagaggataggatacaccgtgtccttgacatgaaacctgtggttaaaccaaatgtttcataggcaacataccttcaggatctacacaaccgattttggttctcaacctattaaatttgataacagtgtagacacgtcccattctgtttaccaatagtctttgcaagagcacaaaccattttcaaaatggtggaacctctttgcgtccctcgcaatgatctgacg

SEQ ID NO: 2209 - DNA, 518 bp, Hordeum vulgare
cctcgtgccgaattcggcacgaggcaaaataatagaaaaattaagcggagagtgtgctgcaactgaattatctgcccgaagtgaacatgacataatatgattctctagaggaaattggatgattctttgagagagatatctgtgttgtgcagtaataagattctgaaagcagaacaagaaataagagaactctaatacaaaggtttttgaggatattcattttgtgtacctcaattagcagtcagagtgcgtattgccctccatgttcagtatgctgaccgaagtaacgatgtggtttcacgcccgcatatgtcaatttcccaatagagattagtacattggagccttgggctccaggccgaggccttctgaaagtgcaactacacgctgcccgtcggctccggtggcggcaggtcatgtttggcatcaccaggaacttcgttatcctatcccagagagcagtccgtggtagatgcggtgagggtgcgtgcgccggagcagatgagtaatttgatttt

SEQ ID NO: 2210 - DNA, 541 bp, Hordeum vulgare
  UNSURE (34): n stands for any base
gatacgttttcacctggtctttacaaagactttncaccttctccagcaaaaccaggaatggctctttattatttcttttgtttttgtttcctgcactacctaaaaagtttatttcagataacccctaaatagtctatgtgaagcaacaaactgggaactcaaaaaatcaacagaaatataatttcatttgagatagatgtgataacttaaaatgggtactacgagttcgattcatctcttcaaatatttgatgtggttgttgcaaataaaggctcatccaccatgcttcttcctcccagtggacatgaaaattagtggtcgctggtcacaagataaagtataaaaaataaagagactgaaaagggagagaagagacacaaatgtcatgaacaccaccacccagacgacttcagctcttgatgtgatgcctcgatgacccaaaccatatccatgaagaggggatcaacactacagcgcagccgcgaccgacaggcacataccatagtttagcattaaatctaagacatcgattgaccctaga

SEQ ID NO: 2211 - DNA, 516 bp, Hordeum vulgare
gttggggagggggtttacggcgtcgggccggtacttgcagctctacggctgggaggagggagttttatgcattgtacacacaggaagggatggatttgagcaggagcaacaagaagaagaaggacaaaagggggattgagaaggtgctgctgatggcagagactatcggacttaaagttattgaggcatcaaagcatgatctcaacatggtggtggataaccgaccgcatcaaggtctggtgcttgatgcatcacccttggaaatggtgaccactaaggagttggaaccagttagggttcgtggtggaaaggcaccagtctggatagctttggatgaggttatggaccctcagaatctaggagccataattagatcagcatacttcttcggtgcggagggtgttgtcttgtgcgctaagaactctgctccattaagtggagtagtgagcaaagctagtgcaggctcgcttgagttgattgagctgctttcgtgtaggaacatgatgcagtttctgt

SEQ ID NO: 2212 - DNA, 537 bp, Hordeum vulgare
  UNSURE (5): n stands for any base
tcctnttgatgggagtaccaggagaacaaacattaataactgtggtatggatgaaacatggaacatccttacacagtagagacgctaggcttctcacttacagggatggcattctttccagccagatgataaagcaaaacccctgctgctacactaacatttaagctctctactgcaaggaatgatttcatatcttgattacctgaacaattatcaccttcttcccccacatctgcatctgtggcatctatttcttcttctacaacaattccatcagtattaccagcgatcttgaccaaatgtgtgcaggatcgctcaaccaggggcctcagaccagtgccttcactgcccaacaccagaatcgttggctcccctgtggtaacttcagatagaggtatagctttaggagcgacagtaccaccaagaactcgccacccattttcagctgatgaagacagaaactgcatcatgttcctacacgaaagcagctcaatcaactcaagcgagcctgcactagctttgctcactactccactt

SEQ ID NO: 2213 - DNA, 408 bp, Hordeum vulgare
acacaagcaaatatgcagagcaccatcgtgcttttcacatggctggtcaggggccaccttcacccaatgacacagttcgcccaccacctcgctagacatggcgttcctgtcaccgtcgccgtcgccgacgtcccgtctacaggcaagtcctctgagaccatcgccggcctcgccgcatcctatccttctgtctcgttccacctaatcccgccggcagcgacccgttccgccgagacggcagaccccgacgccgatcctttcatcgcccttatcgccgacctccgcgccgccaaccccgccctcctcgccttcctgaggtccctcccgtccgtcaaggctctagtcaccgacttgttctgtgcctacgggttggacgccgccgcagagctcggcgtcccggcctacctt

SEQ ID NO: 2214 - DNA, 375 bp, Hordeum vulgare
tttttttttttttttttgaaggtcaggaaagcaaacctctttttcgtaagtaattcaagtacgaattcgtaggtgtagcattcttgctcacgaaccgatgcgtgcgcggccacggccctctgtcatcaattttcctacaatgtatacaatttacctcaacaaattccaccctagaaaatccagattccagttgcacacaggctgaacaaggtggacacaaaaggttaaataacatagtcaacgattcaatcgagcatcgaaatcttgagatcgtccaggaagtcaacaaatgctgctgctgacgatccaccgacctccagcgcattcgcagcaatctcttgcgccagcatcatccgctccctgatctccttccct

SEQ ID NO: 2215 - DNA, 553 bp, Hordeum vulgare
  UNSURE (11): n stands for any base
gtccccccggngctgcaggcaattcggcacgagggagaaaaagcatttcgtactaggactctaggagagggaggccatgaagaagaccgtcgtcctgtaccctggcgtcggcgtcggccacctggtgcccatggtcgaggtcgccaagctgtttatcaagcacggccagtccgtcatcgttgccgtcgtcgatccgcaggtcgagtccaccgacttctcagacgcggtcgtccgcgcgagggcctccaacccctccgtcgccttccacgtcctgccgccgccgcccgccgactccaactccgacagcgcgcccacgcaccccgtcgtgcagattttccggctcctgaaagccatgaacgccccgctcctcgacttcctccgctcgctgccctccgtcgacgcgctcgtcctcgacatgttctgcgtcgacgcccaggatgtcgcgtccgagctcgggctgccggtctactacttctacgcgtcggccgccgctgacctcgcgctcttcctcaacctgccgagcaagctcgccggcgttaaggcaaagataaag

SEQ ID NO: 2216 - DNA, 535 bp, Hordeum vulgare
tagaaataacctagtcccatataatgtcgaaatgtcataggccacgtcaaatcatcacatatcaaggtcaacaagtttcacgttaattctgaaacggttgcgactatggaggtgcccatgtcgttgaggaattggacaaacgccaaataagacgagcccccttccttgagcgcctcggcagctgcgaccttcgccgccgtcacccgctccctgagtgcattgccgccctcggacgccatgacccatctgaccttctcttccacctccacgcccttaaccagctcttcattgtagcctctcatctccaccccgagcttcattccctccactatgtgcaccttgttcaccctctgctccgcgtacagcggccagcatagcagcggcaaccctgccgtgatgccctccagcgtcgagttccagccgcagtgcgtcatgaatgcgccggtcgccctgtggcgcaggacctccacctgcggcgcccaagacttgaccacgagccctctgcccttggtcctctccaagaacccttccggca

SEQ ID NO: 2217 - DNA, 553 bp, Hordeum vulgare
gtacccccgggcctgcagggaattcggcacgagggcaacagcaagcatatcttcgttacccttctactacttgaggcccgcccgtccattgtcttaccagaagccgagaaacttgcaaccatgggcagatctgctggagctcctcaggtcctctcggcgcaccaggaagacgaggacctgttcgagacctcctcctccttctcctgcgactccgacgacgaggcacagttctcggacggcgaggaccagttcgtgccggcctccccgccggcgcggcgactgaactccgacggcgtctacgatctgtcgtccatcaaggccgagctctccgtcaagtaagttcctcaggaaacaccttccttcttcatgtatcaacagagtagcaaaatggaagtttttcctgaccgtgctgatcttctctctttgcaggaaaggggggttgtccaagtactacgacggcaagtcccagtccttcgcgtgcatgtcggaggtgaggtgcctggaggacctgcccaagaagagaccctacaacaagaagatgaagccatgccgg

SEQ ID NO: 2218 - DNA, 533 bp, Hordeum vulgare
ccttctcgaacaacatggatgcagaagcctctttacatttgacaggctaataggcccgccaagaaaaatccccatcctcaaggaacaaagaagagacgcgaagccagccctggacagacactctgagtctcaaccgcgaaccctccctccctactgatggcaggcgctcttgttgacggggatggcgggaggcctgtagagcatgctggagctgccgctccgcgccatcatcaggtttgcgcaggagctcccggaggtcggcttggcgactaccttgctgctgttgttagaaccaggcgcggggcaagctctctggtcaccgtcgatctcgacgtggctccggcatggcttcatcttcttgttgtagggtctcttcttgggcaggtcctccaggcacctcacctccgacatgcacgcgaaggactgggacttgccgtcgtagtacttggacaacccccctttcctgcaaagagagaagatcagcacggtcaggaaaaacttccattttgctactctgttgatacatgaagaag

SEQ ID NO: 2219 - DNA, 516 bp, Hordeum vulgare
cccgccgcgccgtcccggctggcctcacggtgcggtgcgagcagagcgacaagcagaagcggcagcctttttccgcactcgttccccgcgagcagcgcttcatgttcgagggcgacgagctctgcggccccgacatatggaacacaacatggtaccctaaagccgcagatcacgtaactaccgagaagacgtggtatgttgttgatgcagaggacaagattcttggcaggctagcatctgccattgcagtgcatatgagagggaaaaatgagcccacatacactccaagtgtggacatgggggcttttgttattgtggttaatgcagagaaggttgctgtttctggtaaaaagcggtcacaaaagctctataaaaggcactctggacgtcctggtggaatgaaagaggaaacttttgatcagcttcagaaaaggattccggagagaattatcgaacatgcagtgcgtggcatgcttcctaagggcaggctggggagaagactatttacccacctca

SEQ ID NO: 2220 - DNA, 547 bp, Hordeum vulgare
cgaaggaatgaaagcttttgcacaacatgattaaattacaaaaaaaatatacaccatttggacagatgacatgaatgttccggtcacattcctaacagttgggccgagttgctgtatctttttcaatacccagggattctctagccagactttgttattcttttgtctctgataggcagtggaacaggtttttgagcaacatgtgggtgttctgatcctttgtacaccttgaggtgggtaaatagtcttctccccagcctgcccttaggaagcatgccacgcactgcatgttcgataattctctccggaatccttttctgaagctgatcaaaagtttcctctttcattccaccaggacgtccagagtgccttttatagagcttttgtgaccgctttttaccagaaacagcaaccttctctgcattaaccacaataacaaaagcccccatgtccacacttggagtgtatgtgggctcatttttccctctcatatgcactgcaatggcagatgctagcctgccaagaatcttgtcctctgcatcaacaa

SEQ ID NO: 2221 - DNA, 401 bp, Hordeum vulgare
aaaccccctccctcgagtccttcctcggaccgacggaccctcctcccctgctctattcaattcctttgccacaagtctccgatcggatctcccggcgccgaccatggagcccaagccgcccacgcccacggaggaggaggcggcgggggggacgacccctcgttttaagctggggaagcagtcgtccctggcgcccgtccgcggcggcgccgatgaaaacggcgctgagctgtcgccagaggccgccggcgtcgcgggtttccagctcatgtacctggcgcacgagggcaacgcggaggggatacgcgagctcctagacgccggcgccgaccccaacttccgcgactccgacggccgcacggcgctgcatatctccgcgtgcgagggccacgccgaggtcg

SEQ ID NO: 2222 - DNA, 368 bp, Hordeum vulgare
ttttttttttttttttttttttttaccacaacaacgtgagattacatttccacaagtgaagttgcgttgctatcaccaaaagcaaactataaaacagaagagacaaatctgtacatgaattccttgatggcttagtgaataacgtctggtgtacaacagcgttctgatcagcagggaagtaacattagcatgccattcttctgagagagaatttagacacacaaagataatggtacggtgagttgacttcctatcaatcatgaatatgagccgccaaatgaaatcaacaacctcagctggctgttatcgcgatgagcgtgacgaacggttggtgctgccctcattgcgatccttcttccgcaaacctt

SEQ ID NO: 2223 - DNA, 362 bp, Hordeum vulgare
acgctctcacactactacgaggaaacgagtaagaaagagatacaggagggaggcgatgggtttgtcacctcacgtcgtgatggtgagccgacttgtcgtggacaacttcttccgggtcgtcgtcgcggcggccgtcgtcgctgccgccgtcgtaggcagggcgtgccccattatcatttgccccgaggagatcctggagaagatgctggccctgccgcctgcccacgtcctgacggcggtgatcctggcggcggccctggagaagatgcggcgcatgcggcggacgcgggacgtctacctcgtggagtacggctgcttccggcccaagccctgctaccgcacgcccttcgccacgtgcctgg

SEQ ID NO: 2224 - DNA, 426 bp, Hordeum vulgare
ttttttttttttttttttctttttttttttgcataaacatattttttatacatattcgcaaaaataacagatattttagtttctctttaatggaaagatcatacagaacgggcatcagttttgcggggttcaataatggatacaatacatcaaatcaacatcattggcctgaactaagtaaggtgatgaagctatggttggttaaacccttcacatgtccttgtcgatttcgggcagctgcaccgggtagcgggcgatgcagtcggcccacggcccgtcggcgtcgccggctggcttgatgcactcccacgcgacgctgttgcagtcgaatccggcgccgaaggagatcatccacaccctgtcgtccttcttcatccggcccttggcctccaggtatgccagctcgtacaggaccgagctgctgga

SEQ ID NO: 2225 - DNA, 517 bp, Hordeum vulgare
ccctgtatccctctcccaactcttatctgtatccctctccatggccacggcggcggcggcggcgaagcggaagccggtgttcgtcaaggtggaccagctcaagcccgtcaccagcggccacacgctcgtcgctaaggtgctcagctccaagaccgtcctccagaaggcccgcgccactggcggccccggcccagcggccaagcccaccaggatcgccgagtgcctcatcggcgacgagaccggctgcgtcctcttcaccgcccgcaacgaccaggttgatgtgttgaagcctggcaacactgtcattatccgcaatgcaaagattgatatgttcaaagggtcaatgaggcttgctgttgacaaatggggccgtgttgaagtaactgaaccagcaagctttggtgtaaaggaggacaataatctacctgttgagttgtctagaatgtgaaagatggatcttctgagttcatattggaattgttcgctcgaactactgcaagttccttcttatcaagca

SEQ ID NO: 2226 - DNA, 554 bp, Hordeum vulgare
  UNSURE (17): n stands for any base
tgcaaactggatggtgncataatcatttaggagatcaaattgtatattacatgctcagcatcacaattgttctcagaaacacaactgctgcagcaactaacaatcactcatagatagaaatgcttgataagaaggaacttgcagtagttcgagcgaacaattccaatatgaactcagaagatccatctttcacattctagacaactcaacaggtagattattgtcctcctttacaccaaagcttgctggttcagttacttcaacacggccccatttgtcaacagcaagcctcattgaccctttgaacatatcaatctttgcattgcggataatgacagtgttgccaggcttcaacacatcaacctggtcgttgcgggcggtgaagaggacgcagccggtctcgtcgccgatgaggcactcggcgatcctggtgggcttggccgctgggccggggccgccagtggcgcgggccttctggaggacggtcttggagctgagcaccttagcgacgagcgtgtggccgctggtgacgggcttgagctggtccaccttga

SEQ ID NO: 2227 - DNA, 502 bp, Hordeum vulgare
  UNSURE (1): n stands for any base
ngggaagcctgcctgcgcggctgcgacgacttatttcccggcgatgtcggcggcgcaggctgcgagcgccatctcgcggccgtccgcgagtgcgcggctcagggtagctgccttcttcaccgataatcacaaccccgccccggcgcgcctctgtatccgacgactcagtgcggagagaatctttgcaggggttcaaattgcagcctccaacttcaacagatccagaatttgccatgttaaaagtggggatgctgatggctatccaaaaactgaagacgagttagccgacgaagaaacccttcagcgtaatttggacagggctatccgggaagaagattatgcccgtgctgccaaaatccgggatgatctgcacgtcctccatgaggatactgaagcttccgtccttgcagcaaatacacgattctacaacgctttcaagaatggagattttactgcaatgaactctatctgggctaaaggagactatgtgtatgttgtccat

SEQ ID NO: 2228 - DNA, 552 bp, Hordeum vulgare
  UNSURE (19): n stands for any base
agtgcttggtatggaactntacctccttgagggtgtcaagtcataagcaatagtaaattccagtcatgtataatataacccaagatggcatataacgccaacggctacgtaatatacagcataaaccaccagaaagtgtcagcattttattcttcgatgtgtgaagcatggtgaatgcaaatataccatgtgccatctatcttctcgaagacgttggtggcaatttgcttcccccaagattttcctttggtcttaaccaactccaagcatgtaacataaccaaggtcaccacgcacatgaacctctatgttcttaagctcaatgtttagagggaactcataatccgcattgcaaaccatctcccagctttgcaagaccacatcgtaaccggatatccgacctgcacctggatggacaacatacacatagtctcctttagcccagatagagttcattgcagtaaaatctccattcttgaaagcgttgtagaatcgtgtatttgctgcaaggacggaagcttcagtatcctcatggaggacgtgcagatcatcc

SEQ ID NO: 2229 - DNA, 375 bp, Hordeum vulgare
aggcttggctgcgccaaatcgcccaacaagttcagcacactccactgcaacgctacgcagcggctcgacggcagcacagcagctattccgacagccttccccttcgtctgccccccaaccccagagctctgctgggccgccgatgacggagcccgaggccggctccatcgcggccggcggcggccggctccggaacgccctgggcggcgcgctgtgcgctttcgccctcctcctcatcggcgtcctcgccttctccatccgcctcttctccgtgatcaagtacgagagcgtgatccacgagttcgatccctacttcaactaccgcgtcacccagtttctgtcaaagagtggagtctacgagttttggaactggtt

SEQ ID NO: 2230 - DNA, 385 bp, Hordeum vulgare
tttttttttttttttttttttgatagggacaaggctgctgactgtcaactcttatacaggttacaaacaatactttctctaacacagtgccaatcataccacttcaacattccaaggtatcataggcacttgctcagggaggagtggtgatccagtaaatagcaagttgttccacttgtcagtaattcactggttgacataattcagaatttctactgttcatgcggttctcgctcaattgctacatgggaaatggaatctcatgcgtccgggattacgccttcctatcctacatttcaaatggaatctccttgcactacagaaccatacgtccatactggaggttccagaaagaaaaaagtgatgcgcggaaaagcatacaaaa

SEQ ID NO: 2231 - DNA, 517 bp, Hordeum vulgare
cttgacacgtggccatcaagaagctcttctcccccgacaaagcaaaggagaacatggtggtcaatggagactttgaggaggggccatggatgtttccaaacacaagcttcggcgtcctgctcccgacaaaccttgacgagcagacatcggccttaccagggtggatgatcgaatcgaaccgcgcagtccgcttcatcgactccgaccagtacactgttccccaggggaagcgcgccattgagcttctctccggcaaggagggcatcatctcgcagatggttgagacgacccctcagaaggcgtacatcctgacgttcacgctgggctcggcaggggattcgtgccagccaccaatggccgtcatggcattcgcaggcgaccaggcccagaacttccactactcccctatgggcaatgccacgagtcaggccgtgaacgtcaacttcacagcgcgcgccgagaggtcacgcgttgcgctctacagcgtctactacaacacgagaagcgacgaccacag

SEQ ID NO: 2232 - DNA, 543 bp, Hordeum vulgare
actttttaatgcattgaagagatgaacttggaacacttcttacatctcacattacaagcccggctcactaaccacgcaatcccatcatggcttgctactttcagaatcacacaagaaagcaacagaacaaccatttatagctactggtagcttgagcctaagctcacattactcaatctcatagaaacctcaggcttactaacaaaactaagtggcctcctcgtccttgcaggcgaggtcacatatgtagtatatattcagaacagcacgagaacgatgacactaaccatggcaataagaatcccgatgctcgccttcaacccagcagccccattcaagccccagacacggacgtcgtcgatcaccggcccacacagcgagctgtggtcgtcgcttctcgtgttgtagtagacgctgtagagcgcaacgcgtgacctctcggcgcgcgctgtgaagttgacgttcacggcctgactcgtggcattgcccataggggagtagtggaagttctgggcctggtcgcctgcgaatgccatgacggcc

SEQ ID NO: 2233 - DNA, 517 bp, Hordeum vulgare
ctccgtgcctcgcctttcctcctctgcgcttcatcctggcagcgacgcatcgggtctccgccgtgatcttcgacctcgatggcaccctcctggacacagagagggcaacaagggacgtcctgaaagagttcttggggacctacgggaaggtcccagatgcggccaaggaggagaagcgattggggcagatgcacagggagtccacgaccgggatcatcgcagattacgggttgccgttcaccgtcgaggagtattcagaggcaatatacccgctgtatatcaaaaggtggcaaagggcaagcccgcttccaggggttaacaggcttctcaagcacctccacaagaacggagtacccctggcgctcgcttcaaattccatcaggagaaatattgatcacaaaattttgaaactaggagaactgaaagactgcttttcggtggttcttggtggtgatcaggtccctcatggaaaaccttgccctgacatatttctagaggccgcaaagagacttggtgt

SEQ ID NO: 2234 - DNA, 544 bp, Hordeum vulgare
caaggcacacacaatgataaataaaatattacaatgtatcgtctgatgtgagtttgtcaaaagatacccaagaaactgacaatatcgagagattccacgttcttgaatgctaagcaagcttcgttcccggcagctcttacaactctcccagcaatccctacatgtctttaaggacaataagtgctacccgcaatcctgtcaataatatcagataactcatagtgacacatcaggcatcaagcaagaagaaggccgtttcgtggctctgcatattcagatgaggctgggatgtccaatgcacgccttgcctttgcatattcagagaaagctgggaggtctagtgcatctcttgcaatggcctggtcttcgtcagttatgctcattgcttgagatatattttccaagctttggagcttccggatgtaaccaattaatagaagctccaagcgatcctccgttttggtcttgtagtgagaatcaagaaaacatatgtgcatcactctttcgaattttcccggtgaaaggtcccacccaatgctgacca

SEQ ID NO: 2235 - DNA, 374 bp, Hordeum vulgare
gtcctcccgggcctgcaggcaattcggcacgaggaggctgagttgcactcgcagaaggaccaggaaggaggttcgcaggaaggagggtcgcagggtggcggtgaccaggccccagaggccgagtacgaggaggtgaagaagtgaagaagctgccccagcccagccccaccttcttctaaatacagttattagctagttttgaggaacactagggatcttgttggctgtaataaaattttgctccactgaggcatgtgaaacatcctaaatgctcttagcgcgcacggtactgccgtattgtattacttggttgaactagggttcttcgctttgagttacgttgatcttgtggttcaaaaaaaaaaaaaaaaaac

SEQ ID NO: 2236 - DNA, 315 bp, Hordeum vulgare
cacagataacgtaacctaaagcgaagaaccctagttcaaccaagtaatacaatacggcagtaccgtgcgcgctaagagcatttaggatgtttcacatgcctcagtggagcaaaattttattacagccaacaagatccctagtgttcctcaaaactagctaataactgtatttagaagaaggtggggctgggctggggcagcttcttcacttcttcacctcctcgtactcggcctctggggcctggtcaccgccaccctgcgaccctccttcctgcgaacctccttcctggtccttctgcgagtgcaactcagcct

SEQ ID NO: 2237 - DNA, 868 bp, Hordeum vulgare
  UNSURE (34),(36),(38): n stands for any base
gtacccccgggccttgcgggattcggcacgaggngnanaactagtctcgagttttttttttttttttttacttcagaggaaatttaacaatttgtttttccaaagatttaaataaccctccttccaggagggggttgttgacccacaaaattcaaatgggttaatcaaaaggtttttactactgaaaacatttgaacttgtccccaaacaaacaagcccaggggggggttgccatcgttgcaatttgtttttgagggaaacaactcccctttccaaaaaaaaatcatttttttttttcctccttaaaccctgttagctgaaacctaccccggggttttcacaggagtagcaccagtagagctgccccctaaaaaacttttttaaaagcttttaaaagggcttaatacaaataattgggtagcaaccctcgactggggtttgaaacatcccccccaaaacttttgtaacaaagccatatttggggaataaatcaaagtaccctgcaataaaggcttcccattgggaatatcattgctagaaagtggggagcatttggttcacaggcaaccagtgagctggccctgacgggcatcctccttagccacagttgcaatggccacaaagggggggctttatgagggcaaatgttcattttaaaacccggtaccaaagctctaccgaaaagtgctttgcacccttgtcagcaccatctgaggtggtggatcttttgtggcagtgtcttgccatgttgttgatcggtgaaggtggcacttggatccggaaaattccttttttttgcatacccagaacacctaaggcaccttctggattgttgttgcagaaatacttctgaaaaacctatcatttt

SEQ ID NO: 2238 - DNA, 544 bp, Hordeum vulgare
  UNSURE (14),(15): n stands for any base
aaatattaacaatnnctgattctccaaaagatttaaataagcctacatacaggaggcggctgctgagccacaaaattcagataggttaatcaaaatgtttctactactgaaaacatatgaacttgtacacaaacaaacaagcacagtgagtggttgtcatcgttgcaatttgtatatgagggaaacaactcacctctccaagaagaaatcatttcttcttttcctccttaaaccctgctagctgcaacctacgccgtggctatcacaggagtagcagcagtagagctgccacctagaagactttcttcaaagcatttcaaagtgcttcatacaaatcattgggtagcaacactcgactggtgtatgaaacatcaccaccaaaacatctgtaacaaagccatagtttgggaatcaatcaaagtagcctgcaataaaggcttcccattgtgaatatcattgctagtaagttgggagcatctggttcacaggcaagcagtgagctggcgctgacgggcatcctccttagccacagctgcaatggcca

SEQ ID NO: 2239 - DNA, 522 bp, Hordeum vulgare
caaccctagccgccaggagctgaggaactaggaggcagtccgggatgcggcgatcggcgatggcgctccgctccacggcggaccggtgcttcggccaccactcaccgttgacgaacgttattcaatcaactttcaatgcaaacattagttcaagatggggaagtcttgcaagagctttcagtgcaaaaccacttggaaatgaggttattgggattgatttgggaacaacgaattcatgtgtttctgttatggagggaaagaatgcaaaagtgatagagaattcagaaggcactaggacgacaccatcagttgttgccttcagtcagaagggagagcggcttgttggaactccagctaaacgtcaagcaattaccaatccacagaacaccttctttggtacaaagcgtatgatagggcggcgctttgatgacccacagacgcagaaagagatgaaaatggtaccatataaaattgtcaaggctccaaatggtgatgcttgggttgaaacaacagatggcaagc

SEQ ID NO: 2240 - DNA, 550 bp, Hordeum vulgare
gagctttaggatggtttcacatgcctcagtggagcaaaattttattacagcccacaagatccctagtgttcctcaaaactagctaataactgtatttagaagaaggtggggctgggctggggcagcttcttcacttcttcacctcctcgtactcggcctctggggcctggtcaccgccaccctgcgaccctccttcctgcgaacctccttcctgggaaccaccagccgcgccgcctccggcagcaccaccaccagacatgtgctgcccgatctttgagaccgccttgttggccgcttccatcttgctctttatcttctcgatgtcgtcagaggccatctccgcacggagatcagcaaccgccgtctcgatctcggtggcaacctccgcagggatcttgtccctgtactctcccaggctcttctcgatgctgtaaatggtggtgtctgcggtgtttctgatgtcaatgagggccttgcgctcctggtccttctgcgagtgcaactcagcctcgtgcaccatcttctcgatctcagactcagaaagcccacc

SEQ ID NO: 2241 - DNA, 518 bp, Hordeum vulgare
cccatgtgcggcatgaacctcgccttcgaccgcgagctcatcggcccggccatgtacttcggcctcatgggcgacggccagcccatcggacgctacgacgacatgtgggccggctggtgtgttaaggtgatctgcgaccaccttgggctcggagtcaagacggggctgccctacatctggcacagcaaggccagcaacccgttcgtgaacctgaagaaggagtacaagggaatcttctggcaggaggacatcatccccttcttccaggccgcgaagctgaccaaggagtgcgacaccgtgcagaagtgctacatctcgctctcgcagcaggtcaaggagaagctcggcaagatcgacccatacttcgtcaagctcgccgacgccatggtcacctggatcgaggcctgggacatgctcaactccaaggactccaaggaggccgacgccaacggcagcaagccaaaggggaagtagatcgagggagagaaccttttttgcattagcatactgagcaggcg

SEQ ID NO: 2242 - DNA, 548 bp, Hordeum vulgare
ggtataatgcagcggaagaacacgtacattgatgggtgactttccggtccaataaattcagacagaaggagtacagtactactatacacacggacagttgcaatgtttattcaacaaccttttattctcacatttcagtgtacacaagattacacggaaacattagcagccacaagtataaccgtaggagtactaaaccttgataaaacaacgtcatggtttgataataatgaaattaaagaaggggaaaattaacgcgacccttaacgtaaacgtaagatagaacggcagctaatgttttgtagtacacaacagcctgaacctggatacctgatgcacgcactgaacctacgaactgacgaagcacgctcgctaccggtatacgccgccccaccgcctgctcagtatgctaatgcaaaaaaggttctctccctcgatctacttcccctttggcttgctgccgttggcgtcggcctccttggagtccttggagttgagcatgtcccaggcctcgatccaggtgaccatggcgtcggcgagcttgacga

SEQ ID NO: 2243 - DNA, 400 bp, Hordeum vulgare
tgagtgctaagcttatcttcggtgctgacagtcctgctattcaggagaatagggtggctacggtgcagtgcttatcaggaactggttccttacgagtgggaggagaatttcttgcaaggcactatcatgaacgcactatctacatcccacagccaacctgggggaatcacccaaaagtcttcactttagctggcctgactgttaggagttaccggtactatgatcctgcaactcgtggactggatttccaaggattcttagaagatctcagttcagctccctcaggcgcaattgtactgcttcatgcatgtgcccacaaccctactggtgtagacccaaccttggaacagtgggaacagatcaggcagctgatgagatcaaaagcattgctgccattctt

SEQ ID NO: 2244 - DNA, 433 bp, Hordeum vulgare
tttttttttttttttttttgcaggataaacacctcagcattcaagggtaagaaagcatcacaactgcagcttattcgggattcaaaatcaccatcatctttaatccggtgtgaacaaaactgtctcagacaacaattttagtaagtctacaaggcaaattcctgagttcagccaataacacgcctctggttgaacccttcggacactgctgtaggcaatttaagattttattgcggaagggggttgccatgttatcattcacttcagttttgtaaccgcagcatgtatggcatctgcaagatggggtacagtcctggagctcgaacctgccatgctgatcctcccatcggatgtcatgtaaatgtgatattcctgcctcatgaaggcgacttgatcactgttgagcccagtgaaagtaaacatcccaatttgc

SEQ ID NO: 2245 - DNA, 510 bp, Hordeum vulgare
cgcaaacccgttcgcctcgcccgctccagcggtctcaccggcgccgcaccgtgcttcctcctctcccctcaagcccaacccaaggccgccgcctccggtgtggtgattgtgccgctccagccgtggtgatcgacggcccgtgcatggtttcggacctgttgcattgcatataagatgcaaggcatatctgtgtgcgattcggtcgtctcgccccatggaacaagctgcagatcagcttgtgttgccaggaatgatctgaggttctgttacaaaataaatccagtaagccatggggcatgcgggtggcgctggtgtgcggaaaagctgcacgtgaggaccaaccgcagaaaaatgaacaccacagtaaggaccaatgccagatggttctttgggggagatgctcgtaatagcaacagtgatggtaatgctaaggcgaggctggagcgcagtgagtctgctaacgaagacatcttgatcttctactttcagctggatgtacagactcggata

SEQ ID NO: 2246 - DNA, 543 bp, Hordeum vulgare
  UNSURE (15): n stands for any base
ctgcttattcatatnactccagaaaaattgcaagtatgatgctatgtacatatgcccatcagaggggtcagagctgcagtaaaactcgaccaaatatacactgaatatccatcaggatcttcttcacattcactgactttagaaccacttgcactcaaaagggcaggaggaagttgcgcattttatcagtgcaatgcctccccaatctgcaaggtcagatactgcatgtagctcctctcattgcaggtttttgtgtcttcttgcaattccacgatgactcggtcttcattacacttgcccactcagtcctactgtagctacgacagatagtacctcgatcctctatcttctctgatcctcattggtggtggtgaataaggaacgttcttagaaaaactcctgctacccgacgtttagctatctgtagtgccatcgtcgtcattttcatctccggaagcttcataacgtggctggtcatacttttcacggagttgcttcacaggaatgaagtcccgagccatgtcctcgccataaaataggaat

SEQ ID NO: 2247 - DNA, 510 bp, Hordeum vulgare
tcctcctcgctccattagagccaagctctcgggtctccgcctctgctcgcctcccgctgatatcggaaccgcagcgggcgaagcagcagcactatgcgtccgtccctctgtcatgttccttttcttcttctgctactattacatgtggccattgctagaccattctttccactgccaagtaagactagtaatgaagagaagaagccaatacagacatttcgaccgtataacattgctcaccgcggctcaaatggggaaatcccggaggaaacaagtgctgcttacctgagggctattgaagaaggtgcagattttatagagactgacatccttgctagcaaagatggtgcattgatctgctttcatgatgtgacacttgatgatacaactgatatttccgtccataaggagttcgccaatcgaaggagaacctacgaggtggaatgggccaacgttactggctggtttgtagtggatttcacgcttgaggaacttaaaacacttaaagtg

SEQ ID NO: 2248 - DNA, 550 bp, Hordeum vulgare
gaagttgaaacatattgcattggatgagctatacaccaactgttacagtttcgtctggaaacgtttcgggaaaaaaaatgtttgctgcggtaatatatatctccccctcgagattcggggggttaatgaataggcatacataaactcgtgttaacactatataacagcgtaaaccaacatctattagtgacctttcaaggtcactgcggatcatcaaatgtcgacccattttggtcttgcgcattaatcactgaaaatggcagtgactttgctggaacacaaacttattcagcggccttcgtatgctgcgatcatctgagcaatttttagtaggaggctgctcgcggttgcgtccttcgggtgtggggttttcagttcttggtactggtgtacgcttccagcgaaatctgtgaataatccgtcaacccccaccgtatttatccagaaatcgtactcggcatagggatcctgatggaagttgaagtgcagaaactggttctcgttcctgtatgtgtaagggtgtacctgcagattatgagcatgcgctctt

SEQ ID NO: 2249 - DNA, 543 bp, Hordeum vulgare
  UNSURE (11): n stands for any base
ggtctgcaggnaattcggcacgaggcggcagtaaatacgtcgggctggcagtttctgaccgcaaaacaggattgccttgcctctgagtgtcttgggtaggacaaagacaaacatcaatttgatggcagacgatttcaaaacactggttaacaattactcccttgccgggcttgttgtgggttatccattcaacttacagggtcaatcttctccagatgcatcacaagtaagccttctcgtaggagaactttgtaaaactgggaaacttgatgatttgagctacacatattgggatgaaaattttacctcaaagtgcgtagaagcccttttaaatcctctgaacctaaacgatcgagttgagacgaaaacaatgacagataaatttgctgcagtttgcatactccagggttatttagataacatgaacagagcattgacatctgctgataatgtgaagagtaacttgagctcagcttctggtcaatgggcatttgcctcttaaaagttccttccgcctgtcagtctttcttggaagcatggttc

SEQ ID NO: 2250 - DNA, 544 bp, Hordeum vulgare
tgcctgcccggctgcccgtgagccaagaaaacgtaccgagactcgggaattacactgttggcatcgtgatgacgtacagtaggcatatgctggggcatggaaaccggcttgcaatttccgagaaatggccattaccgagctgttgcggtgcacgcttatgccgagaatctcatgagcaggctgaggctacaaggaaagaaggggaggaaggatcttcccaatagattagcatcggtttagacaagtacgaaagttgcttttgcccaggtgatgtgccgtcagcggaatatgtctaacggcgcatcagctccaagttatgctctgcctcggccaaatgaatgcagatgcgcttcatgatacaagaaacgggaactctttcagaaccatgcttccaagaaagactgacaggcggaaggaacttttaagaggcaaatgcccattgaccagaagctgagctcaagttactcttcacattatcagcagatgtcaatgctctgttcatgttatctaaataaccctggagtatgcaaactgcagcaaattt

SEQ ID NO: 2251 - DNA, 519 bp, Hordeum vulgare
gcttgcaaggcactatcatgaacgcactatctacatcccacagccaacctgggggaatcacccaaaagtcttcactttagctggcctgactgttaggagttaccggtactatgatcctgcaactcgtggactggatttccaaggattcttagaagatctcagttcagctccctcaggcgcaattgtactgcttcatgcatgtgcccacaaccctactggtgtagacccaaccttggaacagtgggaacagatcaggcagctgatgagatcaaaagcattgctgccattctttgacagtgcttatcaaggatttgcaagtggaagccttgacaaagatgcccagtcagtgcgcatgttcgtcgctgatggtggtgaattgctcatggctcaaagctatgctaagaacatgggattgtatggagagcgtgttggtgctttaagcatcgtttgtgggagtgctgacatagctgttaaggttgaaagtcaacttaagcttgtaattaggcctatgtactcgaa

SEQ ID NO: 2252 - DNA, 553 bp, Hordeum vulgare
gcattaagcttcccaaaacattgcattatacagcactgcaggataaacacctcagcattcaagggtaagaaagcatcacaactgcagcttattcgggattcaaaatcaccatcatctttaatccggtgtgaacaaaactgtctcagacaacaattttagtaagtctacaaggcaaattcctgagttcagccaataacacgcctctggttgaacccttcggacactgctgtaggcaatttaagattttattgcggaagggggttgccatgttatcattcacttcagttttgtaaccgcagcatgtatggcatctgcaagatggggtacagtcctggagctcaaacctgccatgctgatcctcccatcggatgtcatgtaaatgtgatattcctgcctcatgaaggcgacttgatcactgttgagcccagtgaaagtaaacatcccaatttgcttaatgatgtgggaccaatctccaggtgtttctctgactttcagtgcatcaaaaagctgctccctcatgctaattatcctatcagccatggccttcagttcc

SEQ ID NO: 2253 - DNA, 558 bp, Hordeum vulgare
  UNSURE (21),(22),(36),(40): n stands for any base
gtacccccgggacttgcaggnntttcttccactgtncttnccactggcacctatgtgctatggtcttttcaatgctctatttgcgcccctctattcaggatcagtggttgagtttatgccaaaattcagtgtgaggggagtatggcagagatggtgtgagtcatatcccaagggcaccagtaaaaatgatgaggctattaccgtatttactggagttccaacagtgtacacacgcctactgcaagggtacgatagtatgaatcctgatcaacaatctgcctgttcttacgctgcaaagcagctgagactaatgatgtgtggatcctcagcactcccttctccactcatgaaacggtgggaggaagtgacatgccaccgtcttttggaacgctatggcatgactgagtttgtcatggcactgtctaatccattgcatggtgcacggaaagaaggtacagtcggtaaacctcttccacgtgttgaggccaagatcattatggatgatggtacagaaactaaagatggagtcggtgagctctgtattaaaagtccatccct

SEQ ID NO: 2254 - DNA, 563 bp, Hordeum vulgare
  UNSURE (5),(21),(31),(36),(51),(52),(66),(82),(83),(100),(105),(118),(121),(122),(132),: n stands for any base
gattnactttcacactatttnactatgactncgctnccgcaattatgcatnntattgtcaaatagnaacagagaattattanngctgacactttgctatnatgtnctagctctctgtnagnnaagggtgagnactggaaaaataggtacatcaatgtaaacgtggctacacctctaataacttcttaagctccttcttgttaacctttcccatggcattccgaggaagagaatcccataagtgcagtcttgttggaatcttgtatggagcaagtttatcttttgaccaacttgtcaatgcttctaaggtcagtgctggcttcgaagcctgttcggccctttcccttgcgtcctccttaggcacaattattgcacatataacctccccataagcttcatcaggcaagccaagaacagcacactccagtacagtgtcgtgctccaacagaaccgcctcaatttctaatgctgataacttgtaaccaccaactttcatgatgtcagcatttgtgcgccctaaaattataaaatatccatcctcgtctacagttacagtatcaccag

SEQ ID NO: 2255 - DNA, 461 bp, Hordeum vulgare
tcgagggcgttgcggagtgagaagagacgagatggctccggtgaagctgtacggcgcgaccctgtcgtggaacgtcaccaggtgcgtggcggcgctggaggaggccggcgtcgagtacgagctcgtccccatcaacttcagcaccggcgagcacaagagccccgaccacctcgccaggaacccctttgggcaggtgccagctttgcaggatggtgacttgtatgtcttcgaatcacgtgctatttgcaagtatgcgtgccgcaagaacaagccagagctgttgaaggagggcgacatcaaggagtcagcaatggtggatgtgtggctcgaggtggaggcccatcagtacaccgccgctctgagccccattctcttcgagtgccttatccatcctatgcttgggggagccactgaccagaaggtcatcgacgacaaccttgttaagatcaagaacgtgctgg

SEQ ID NO: 2256 - DNA, 554 bp, Hordeum vulgare
gtcaatatctgggcacaatttatttataaaccagagcacgggaatgctcatttaagtacaagattcgacaggatcgcaagcacaagcctgaacattcaacaccaggacacatcacaagaacacacactaggaaaggcacacatcgggggtgacacacctcggcttatttcgacgaacaagccccagaaactaagatcatggcttcatcagcgcagcgaccttctggacggacggcctcgtcagcaggtcagtccaccaggccttcacatgcgggtaagcgtcaaacagagatgcatagggtgtggccgccaagcacagggtgacagacgcatggttaaggtccgcaaggctgaggaagtctccagccaggtacttggacttggtgagccgcgcctcgtacaccgccagcacgttcttgatcttaacaaggttgtcgtcgatgaccttctggtcagtggctcccccaagcataggatggataaggcactcgaagagaatggggctcagagcggcggtgtactgatgggcctccacctcgagccacacatccacca

SEQ ID NO: 2257 - DNA, 517 bp, Hordeum vulgare
gttcgacatggaggtcgggaggaaggtcgtgccggtgcgcctgctcgaggacgtcaaccgctgggacttcgtcgacctgcccatctttcggtcccaggccgacgccgacgacacggcgctcgctgagatcggacgggggagcttcgaccccacactgccgcccttccagctcgccgggcccatggagctctggatccaggacggcgacgacgtcaggctcgctttgccgcatgatgtggaagctggaaccctgaagaaagtagttcttgctgatggtgcggtggtaacagtgaaaggtgctagggcagtgagcctccgtttgcccctcgaactgccgcttcctctcaaccgcaccacatacaaggggcgcctgtctagcttgctttccattgctcgagccctacgcggtgcagctcggtctaatcagaaacccctgatgtccctccggatcgagggcccaacctccttatcctcaaccccttccatgtctccgaatgacaagctcaagctcaaaagg

SEQ ID NO: 2258 - DNA, 549 bp, Hordeum vulgare
  UNSURE (22): n stands for any base
aaaacaccaaatatttaccttnaaatgttaacctaattttgtttttttccccactgattacatgaaaagtcctttgatacgcttacaccacaggaaaaaaagaatttctaaatttatttactgtatgttgttaatttactgttcatcaagagcacatgctctatggagccaaaacagccatcccatgctctaagcgcttttgctttgctttgagatgtgtactgtctacatacaatttgcttattgctgcacttcactgtaaggcctccttgtttgcgcccgtaatttacaaagccagccagtataacatacaagttccatgttaacgcagaaatcagtactttttgccacatccagcaacaatgtcctttttgccacatccagcaacaatgtcctttttgccaagtacgagctctggaaataaaagcttccagcccctccacgtctcacaaagtgaaataaaccggtggggggtttaccacctccatcttcgatctcgacacgtttccggtgagcatgctctcggacatggcctcgtcaacctggaaa

SEQ ID NO: 2259 - DNA, 499 bp, Hordeum vulgare
gtggcgcgggctttctgcttggactcttggcttggtgttcccgcggtctaagaaactaagaagcatgcccttgatattttgggttgctcagcatgcagggtgcactcatgatctcacatgatgacattatcgcccagagagcatatggaggaggatgttttattcttctctttgtggaagctgaacttgacttctctgcataacttttgaggcagttttgagattcaaatgcagaaccacaagctgtagactaagaattgtgcttcttcatgcataattctttcggcagaaatcagaatatacaaggttcactagaaatattttgccaacaaggctaaatttgaaagtggttacatgtctgggatcattgaaggaggtacttcaaatttggtagatgagacctggttcagctcaacatcgaatatcttcaacgtcgcaaagagggtctgtggtatgttctgatctgaaagcctgcatgggccacaagccaccaaccccg

SEQ ID NO: 2260 - DNA, 552 bp, Hordeum vulgare
ggagcgctagaagccttatttattatgttatgatggaacttcaccttcatacatcagaaggaacgagttacaccccgcgctgggaaaggactcttttggacttttgctgctgtacatctacctctacggtcaacaagttctaaaaagtgctcggaaggtgataccataaaattctgaatcacctccagaaaaaaattgttcacaagagcatactctgctgtttcgtggatcaagtaccttacgtcacctgccaaaagaaaaaatcagatttgttgaccagcgtcggggttggtggcttgtggcccatgcaggctttcagatcagaacataccacagaccctctttgcgacgttgaagatattcgatgttgagctgaaccaggtctcatctaccaaatttgaagtacctccttcaatgatcccagacatgtaaccactttcaaatttagccttgttggcaaaatatttctagtgaaccttgtatattctgatttctgccgaaagaattatgcatgaagaagcacaattcttagtctacagcttgtggttctgc

SEQ ID NO: 2261 - DNA, 552 bp, Hordeum vulgare
  UNSURE (20): n stands for any base
gtacccccgggcctgcaggnaattcggcacgaggcggcgctcgccgagatcggacgggggagcttcgaccccacactgccgcccttccagctcgccgggcccatggagctctggatccaggacggcgacgacgtcaggctcgctttgccgcatgatgtggaagctggaaccctgaagaaagtagttcttgctgatggtgcggtggtaacagtgaaaggtgctagggcagtgagcctccgtttgcccctcgaactgccgcttcctctcaaccgcaccacatacaaggggcgcctgtctagcttgctttccattgctcgagccctacgcggtgcagctcggtctaatcagaaacccctgatgtccctccggatcgagggtccaacctccttatcctcaaccccttccatgtctccgaatgacaagctcaagctcaaaaggttggccccaggtcaagtggagctctcctcccgtgcgatccctgctgccacagatgatgaggatgaatcgtctagccccggattgtggccctttttgtcattgaatgcatcagat

SEQ ID NO: 2262 - DNA, 547 bp, Hordeum vulgare
agccgccgtatacatcagttcatgttaacgcagaaatagtactttttgcccatccgcacaatgtcctttttgccacatccagcacaagtacgagctctggaaataaaagcttccagcccctccacgtctcacaaagtgaaataaaccggtggggggtttaccacctccatcttcgatctcgacacgtttccggtgagcatgctctcggacatggcctcgtcaacctggaaaggctgcacctgggcgatcctttccgggatcgcctggccacgctccacacgagcaagaacttcatagtgtgctctcaacttcttgggctttgttctccactcaggcaagtcagaccagttcacctctccatcagcaatctgcttctccaccgtgaaccccattttgacgtatgtttgtgccgaggcccgtgcattcaccaacttgaacgtgcccttctcacccgccttctttccgagaaccttcgccagtagttcctcaagcccctgcaggctgccatctgatgcattcaatgacaaaaagggccacaatccggggc

SEQ ID NO: 2263 - DNA, 533 bp, Hordeum vulgare
  UNSURE (25): n stands for any base
gccccggctcagattcgccgggcanatcacattgaacatgcattggctatagagcgtatagtaccaagcttatcatatctcagaaccgaactttgttcgaccaatatgagtgaagcatgcttttggaagatctattttgtgcttcttcactcaaagctcaataaggaagatgccgagcttctttcaacgacacaaatctcggaagcaagagaagagttattgcaaagctccccaaggatgaaaaatgtatcgtctgagggtcctgggtgctcatcagaaagcagcaatgttccatctacccaagctgaagatatagagttctcaccctcgagcatccaagacaagattggaacggctgaagcaacatctttccaagaaccaacccctgatcctctgccagcggctgaggctgacaagcatcccatttcaaccagcgagccggaaatagttgacaagtctgtaatcgaagaagagctggtggtcataactgaaatcaagaatccgggtgacaaacccaacctgtacactccgga

SEQ ID NO: 2264 - DNA, 546 bp, Hordeum vulgare
caaaatagtttgcttgaactaacagttacagatatctgataggtagaccgtattgtgcgtacgctggttgtggtatctacaatcagaatcctgcatcgacacagcgaagaagtggtagttgcacacgggcggctagtgtttctatgtacagaccatgatggcacacaagtaaacgtgcaactagaatcgagaaagcaaaaccacagggacatacttataaacttgtcgtgattctgcttccatgctgttcgctttgtaatagctagggagacacgatccttcttttaacagcgtttgtatcaggcactgggttttggtatataccatcagccaacccttaatcatcatcgtcatcctccagatcgctgaatgacacatcttcgtcctgcccaaccgaagtgatattgccggttttgttgtcatcatggtccatatcctctagccaatcctccacttctttgtcgtcgtcatcatccggagtgtacaggttgggtttgtcacccggattcttgatttcagttatgaccaccagctcttcttcgatta

SEQ ID NO: 2265 - DNA, 531 bp, Hordeum vulgare
gggctgcagaattcgtacgaggttcaaactgtcggtcttctaccattgcactgcagcagattttctctgggctgtttgcagatgatgttttctttaagcagttgtatatcgaagacaagctcataccctgcagtatcagaaaccagcaaagtttctatttccattcttacaaagcgatgtgaggttatactgggtcagtttttagcggatgaaaatgacctaggagaccgtccattgcctagtgtgaggattgaagaaacggtttgtgtccttcaagagcttgctaggctaatattagacattgaaacagctaatgctctcaacataccactgtacctgaaagatgctttacgggaaaaccagtcccatgggagggcccatttgttgttgttgcttcccactttctctgagcttgtcgtctcaagagaagccagagttcgggagcttgttcaggtgcttctcagactcgtctcctcagagctgggcctgcaacgcctgatgtaaagatgaaggatgaactccgtttttttt

SEQ ID NO: 2266 - DNA, 544 bp, Hordeum vulgare
actgtagtggcttgaatgtgcttacagatcattcatcagtatagatggttcattattttgtatcaacaccaacacagccttgatccacagttcaaaatacaagttactgtcacagctagaggttgactactgctacgtcaaacatgaagaatattggctatatacctaatgtttacagaactgaaaacaacttactcgacaaaatgttacatgtacaaccctattcatttatagatgtgattcctcgagcgcctcttgcccgtcatgacggatatacaggatcatgtatgtaaatgaagaggtggaatactaacgaagacatagcattccaatccagcaaaaaaaacggagttcatccttcatctttacatcaggcgttgcaggcccagctctgaggagacgagtctgagaagcacctgaacaagctcccgaactctggcttctcttgagacgacaagctcagagaaagtgggaagcaacaacaacaaatgggccctcccatgggactggttttcccgtaaagcatctttcaggtacagtggta

SEQ ID NO: 2267 - DNA, 514 bp, Hordeum vulgare
atccaatcccaagcccgcgccgctcgcccagcccagatacacccccattcgcagcggcgagcagcggccgccgctctcctctctccttcaccgccccaccggctcgccaggcctcgtccgtagaaagcggctgagctcggcttgcagcgggaagcacacgccaagcgaatcaatccccgtcctcctccgcagctccgcttatccgagctgagggccgtcaggttgaccacgctgaggagacacttggggattttcagagatggtatgtcccaaagtttcttggggatgccttcttctactgctctgtttttcttggatgggagatgcagagcacatgaagtacaaggatccaaagcagcctgtcaataccagaatcaaggatctaattggtagaatgactcttgctgaaaagattggccagatgacacagattgagcgttcggttgcatctgcagacatcatgaaaaattacttcataggtagcatcttaagtggtggtgggagtgtccctgct

SEQ ID NO: 2268 - DNA, 553 bp, Hordeum vulgare
ctctactttgtcctactgattaataaaacaatacaaggcatcaaccaaacataatctgatgaaacaacaaatctactggccgatgacctgggttagcataacgccatatgctgcagggaacaatatccatgtggactaaggatcactagcaaggggttgattgatcatgctactgctacaaaagagcagcttgatggcgaaatacacctatgcccaagctagcatcaatgacagtagcaaactcaacgcggcccataccgttatttccttcttatctccgcgacttctggtgcccgagaaccctggctgcgatgaatttattgccaaaccgaagccgaaagggaagagcggatcatagtgtgggtctccaaaattcatgggcagctggtctacagacttgaaccaagtgcgcgaaagctttccggtgaagctgtagtccccaaataggacatcagcgacaccctgcccttctgtgccaggaagccaggcggcaacaagcgcttccatcaggggaagatatggttcaatgacgacaggccgtccagagacgata

SEQ ID NO: 2269 - DNA, 121 bp, Hordeum vulgare
gaatcttgcataccagccttggatctggacagctggaaaccatgagatagattttgctcctgaacttggcgaaacgaagccattcaagccatacagcagcaggtatcacacaccatataag

SEQ ID NO: 2270 - DNA, 543 bp, Hordeum vulgare
  UNSURE (19): n stands for any base
aaatccaacatacgatgtngcctccaaatcaagtcgtcactggtgcgcatacaagaatcggctgatcaacccacacggtgcgtgccttgctcactcgtctcgcatgcaatgaccttcagctgcacgcacccgcacggcaacttctcctgtctacacacagttttggggtacagattgagcagcgactctaaccccgtagtactcttgtggttgtaggctctggaggcgatgcttattcaacaagtggaagcgtggaccatccccaccgtttctttcaggcatcgtggacggagtcgtacgtgggcatccagtacctgttggtgaaccagagggcgtcggccgccacggcggcgccgtcctggttacggtgccaggcgtagtaggcgtgcgtccggttcttgatgtcgaggatggcgtgcccgaagctcgcctccctgaaggccgagtagctcggctgcggctccgacatgttggtggccagcccttcttggttccccccgtcgccgatggttatgtagaccggcgccgactggtccgggatcg

SEQ ID NO: 2271 - DNA, 430 bp, Hordeum vulgare
tatacctagaacactgagactgatgtatgtacatagttaccagaggtatctatggaaccatgctgcgagtatgagagctggaatatatggtgtcatagaaggtgacttggtttacaaaaaagaatgtcttggagaaggaactctaacagatacttcaaaaaataatgatgaccacacgattgcatctgaaatggacatatttgttgaaacacttccggaagaaacgatccagtctgtcaagatagctgattctgaagatttattgaaggcagtgtacacactcgaggatgttgtccttcctttgcctggctcagaaacattgtttcctggaaatgaagttgctgggatttatcatgaaatagctaataaggatggtattagcttaacaaagagcatccatggagtcaaggaattctccattacaagcatg

SEQ ID NO: 2272 - DNA, 549 bp, Hordeum vulgare
taatagcaactgtagttatgcattctaatgttagtctacatacgattcgtgtggattgtctcctgcgtacaccacaaattgtatatggatgaatgtctaatatgtcacatatgtggtgaacatatgtggtgaatatcggacccttttttttcacttgcacaggtgcacacggggttgcaaaaggcacctatgtttctgcagtgaattaacggaaatgatttcattatttcttaacgattgagaaatagctatttctaagttgtgacaccgaaaaccatttgacccgagcaacacccatgatagttcatatacaaaacaaaactgcttacacactcgttttccttttccttttcaggtaagctgcctattctgctcagtagggcatcctatataatggtggttttttccttgctagctgaccgcatgctcccctaaattgcagaaatgctagagaagccaacaagtagaatccagaaaagcatgcgagttatcagtcgtagtacaaagtttgctgatgaaacttccatgccgttcaacattagatcagtt

SEQ ID NO: 2273 - DNA, 495 bp, Hordeum vulgare
aatgctgtgacatgacatggtgcaggtgtaaatgcaatacgaaatatccggcatgagccctctgtccgagctggtgtggtctccggatgatggtctcagcattaaaatcgcggcgtccagcctaagcacaagaaaagcctctcttcgctggaacgcggatactttgaacatagtgatatcttcgcctcagcagagcggcgccaagagtggtgataacgtagatgccaccctaagggatgcaggagaaatgccgtcgcaacctccaactcacggtgacacctcagtgagagtatccgcggatagtccaaatagaacacaaaacattgatgcgcaacaatctacttctataacatcacagcaacaagattcaaaatgttctggagggatcagtgagatgagtgagggggaagagttgtctgacaactgctgtgcagataagttgaataaagaggaagtggatatttgccccacaagatgctccaacgatgcttcaca

SEQ ID NO: 2274 - DNA, 550 bp, Hordeum vulgare
tcggatcgtcgatatgcttgttgatacactatgcttacaggatacaggatccggaccgagtgtttagtacaagtacatacaatatgcctcacgaaacgaggccgacaagcaatgaacaaccatctcttattctaagtatagttatatctaacagttgcacattttgtactattctcacagtagcttcctatttacagataggattctcacataatagtcaatcccatcgtaaaatagaatcgtgtatcagtacaacctcaatccctcaatataccaaggatggtggatctatcatcacaacaccaagcttcgtgagaatatcagtgtcagcacaaaatttaaccagacaagccaacaccaacaggcatgcttgcatcgctggcgtttccggatgaaaggcggcaaagacagaaatcttccatgttttgggtactgccatcaggtgttgtccggctgacctgttccatttccgaaatgaagtagctctctttctcttagcttcttgctaagttcttctttcgacggtagtttccagccacccttcatggca

SEQ ID NO: 2275 - DNA, 543 bp, Hordeum vulgare
  UNSURE (3): n stands for any base
ggnctgcaggaaattcggcacgaggcggccgcgtttccttcatcgccggcggcggcgcccacgccatcgccctcacaagtgatggtgaagtatttacttggggcagaggtacccatggtcagcttggccatggaaacctagagaacatcgctcatccaaagttcgttaagttctttgaaaactacacagtaacctgtgtgtctactggatggaaccattctggatttgctacagattctggacaactcttcatgtgcggagatggctcatttggacagcttggcaccggtgataatcagtcaaggaacttgccatttgaagtgtcatcctttaccacaaagcatgtcgagaagcttgcatttgggatgcgtcattctcttgtcctattgaaagataattccgtttatggatttggctcaggaagacggggacaagttggtaaatctgcttccaaaaatcagaagatttatagtattcctagattaattgatggttttccaaactgtaaaatagtgaatttatatgccaatggagatcatagtg

SEQ ID NO: 2276 - DNA, 547 bp, Hordeum vulgare
gccccaacagtacggtctctctgttattaaccttacagtttacaaatgctccagttgacaggcccaaatcgcaggatgcaacaacattgctgccccaagccggattgcacacacacggagcaaatccttgttgcgcccctcccttcactctccaacagcattacaagaaaacatttactagtgttcacctttctcacatactgtgtggaaacacaacgaaaatacggtggtcggtacaacagtataactaactaatctgccactaagccaggttcacggcgatggtaaatccactcccacagtacacgccgagcgaagcaggagaacgtgagccctcgtcgcctagatttaccatctgaggaaccacctgatcacaagtatctcccaagcccagttgcccgtgctctccccagccccaagtgtacaaggctccgctgtctgttatcatagcagaatgttcagtgccggctgctatccgggtcacctgctctccatgaatagaggggcccttcgctaaacttgacactgaagatgattcatgatgtgt

SEQ ID NO: 2277 - DNA, 518 bp, Hordeum vulgare
gaaaaaagcaggggccctctcccgcggcgaattgcatgatcgaatcgcgccggggcggatgatggcggaggaaccggcgatggatttcgacgacgggggctacggcggcgccgaggacaacctctccatgcccctcggcgacttcatggccttcctcgagagcgagcccgccgacgacggggcggaggacccgcggcccgaggtgcgtgcgtcgcttttgccgccccggccttgccctaattcgcatcttagctcggaccgcccggatccaattcggcagccagggttggcctcccccgggctagggttttggatttcgtcggagcggacgcgtacgagtgtttgggatgtcatgctctttctacatatccgcaattcgcgatgtgtagtgtcctagtcgcttagactctgggccttttcgagtgagatgtgtgtgagccaagcgtgatcaagccttgggcaagggatttggtgccacttttcagtttgggggagttgttttattgtttcccctacta

SEQ ID NO: 2278 - DNA, 304 bp, Hordeum vulgare
aacagtatttaacaagcacatatatagacggtatgacttaattgcatcacatgcaataactgagcttttagcattccatttagtaggggaaacaataaaacaactcccccaaactgaaaagtggcaccaaatcccttgcccaaggcttgatcacgcttggctcacacacatctcactcgaaaaggcccagagtctaagcgactaggacactacacatcgcgaattgcggatatgtagaaagagcatgacatcccaaacactcgtacgcgtccgctccgacgaaatccaaaaccctagcccgggg

SEQ ID NO: 2279 - DNA, 524 bp, Hordeum vulgare
cgtccgagggagaactacaggaaggggaatgttgagtacatctacaagctcgtacatctgctttgcctgcctgagatgaagatcttcttggacaccactagatcgcttgcagctcacactgataatgtagttgatgagctctggaattacatcaagcaggggaagcttgttcctgctgctattttgcttcttgcagctcaaaggcaataccgtaatctcaatgggtttgatatcatcaaggctcgtatagaggattgtatgtgtggattaggaagtggtaaaactgccaaggcaaaaaagcagctgaaggagatgaaagtacatcttatcaatgcattggtgcttgttaggataattctcaaagctggtgaagctcttgaggcatatattcaaactcactcagaggcatctcatgaggaggtccttggaaaagtttcagcagttctccagaattatgatgttggtcctagtggaaaagaaatcggcattgaagatcttgactgctgcccctatgactgtggtga

SEQ ID NO: 2280 - DNA, 552 bp, Hordeum vulgare
gtgtctaaatttgcttatggcaaatcgattacagtcaacttgctcaggctgccgctgagcttggttacataagaattagagtcaaggttcaagctgaatatgacatatgttccacaacttcaggcccatgccaagcctcggaagatatatactagtactacttaaacaacagttttggattaataacgagattgcgaatgttaatagacaaggatcaagcatccactgtggtgggtaaaacaacgcagctcgataaccatctcgactaactgcagggagagtggatactcgtctcagcgaaccttcctgctcgggtcttcatacacgcttaagcatcttcaggacagtcgacgcagtagtaccaaataatcttctggatcgataactacttgtgggcgtcggcttacttgctactctcggataattcctctccaacatgccaagacgaaactcagagtgcctttcagctctcaacttctcggagccaccgggataattaacatcacgagtatatattggcaactctttcttcggtgcataggctggaaagat

SEQ ID NO: 2281 - DNA, 520 bp, Hordeum vulgare
aggccatcgcccagtgcgtccagagcttcatcaccgccatggacgccctcagctcacatgctcgccaacgaccaggtccgccccctgctccacgacctctccacctccatggggaagctcggtaccgtcctgccgcccgacttcgaggggaaggtcaaggtgaacgagtggctcgcaaggctgcataagatgggggctggggacgagctcacagatcagcaggccagacagctcaattttgatctggaatcagcttatagtgcgtttatggcctcgcttcccactgctggcatgtgaagaatgatcggagttggttcttctttctgttttgccatgctcttgtctttgcatcattcatgcagtggtatagatatgtgtaatttggctcacgctataccgtttgtcaacaacaatgccaatcttatcgaaagttgcccccctacatacagatcgattgtttcatactcattatagggacctttgattgtattcagcgtacagtgtgtttatggcctcgctt

SEQ ID NO: 2282 - DNA, 546 bp, Hordeum vulgare
ttttatttgctctgttattgaaaagaatgaaacaatcgaaattacacatatatatgacccaagtagcgggtcaaaagacaacatgttaacaaactagaaacataggaacagttcagaacaaaattgatcctttgcccacaaaccagcaatgggaagcgaggccataaacacactgtacgctgaatacaatcaaaggtccctataatgagtatgaaacaatcgatctgtatgtaggggggcaactttcgataagattggcattgttgttgacaaacggtatagcgtgagccaaattacacatatctataccactgcatgaatgatgcaaagacaagagcatggcaaaacagaaagaagaaccaactccgatcattcttcacatgccagcagtgggaagcgaggccataaacgcactataagctgattccagatcaaaattgagctgtctggcctgctgatctgtgagctcgtccccagcccccatcttatgcagccttgcgagccactcgttcaccttgaccttcccctcgaagtcgggcggcagga

SEQ ID NO: 2283 - DNA, 518 bp, Hordeum vulgare
atgaaccctaagatctcagactttggaatggcaagaatatttgatcctaaaggaggactagctaacacgaaaagagtcgttggaacatatggctacatggctcctgagtatgctatggcaggcattttctctgtgaaatccgatgtatatagctacggggtattacttctggagatcatcagtggactaagaaatgccgcagctcgtggacatggcaactccctaaacctccttggtcacgcatgggagctgtggaaagaaggcaaatggcgcgagctcattgataaatcgttgcacggtgcatgtcctgagaatatggtgctaagatgcattcacgtcggcctgttgtgcgttcaggagaatgctgctgatcggccctccatggccgaagtcatttccatgattaccaacgaaaacgccaccttaccggccccaaaacagcctggcttcctctccatgttgcttccgtctgaagctgatgtccctgaaggaagtttctctctgaatgatttgtcaat

SEQ ID NO: 2284 - DNA, 543 bp, Hordeum vulgare
atatcttctgaaaagagcttctcctgaatgatttgttaataccatgggaaaacatgatactcatatgagcatacatctattcagacgcaaatgtagcacacttgcatcttcaggcagagggccgcatctaatggagaaagtactactacctaccatccagggcagtaattgacaaatcattcagagagaaacttccttcagggacatcagcttcagacggaagcaacatggagaggaagccaggctgttttggggccggtaaggtggcgttttcgttggtaatcatggaaatgacttcggccatggagggccgatcagcagcattctcctgaacgcacaacaggccgacgtgaatgcatcttagcaccatattctcaggacatgcaccgtgcaacgatttatcaatgagctcgcgccatttgccttctttccacagctcccatgcgtgaccaaggaggtttagggagttgccatgtccacgagctgcggcatttcttagtccactgatgatctccagaagtaataccccgtagctatatacat

SEQ ID NO: 2285 - DNA, 522 bp, Hordeum vulgare
gatggagcatctgatggtggtcggacatggtgcgctcatccggactacacgcataggccaagcatcaggcaggccctgaatgccctgaaatttgaggcgccattgcctgtgctaagcgccgaagatgccggtgccgacgttcttccctttgcctgacttggctgctctggtatcatcaggaggtgcgcataacccaggcgttactgagtgcgagtcatcaggggctaatgctggccaacggtctccggtgagggatagacttctggagccatgaatgtggtggatttgttgaagctgctgtcgcgatgattctgattgatgcgcatattgtgctgcaacatggcttcacatattgtgctgcaacatggaggcgtgatcgattgcatatctgtctcagctgagcttggatttgcatagcatggaaatgttgggatatatcggtcaaaaagacctcacatgacgaaacatttcgaggcaataaagtgccattgcagttttgcccgcgggggcgccggttcccca

SEQ ID NO: 2286 - DNA, 467 bp, Hordeum vulgare
gttgtcttcttgttaggtctttttgaccgctataacccaacatttccatgctatacaaaaccaagctcaactgatacagatatacaatcgatcacgcctccatgttgcagcacaatatgtgaaaccatgttgcagcacaatatgcgaaacaaacaaaatcatcgcgacagcagcttcaacaaatccaccacattcatggctccagaagtctatccctcaccgaagaccgctggccagcattagcccctgatgactcgcactcagtaacgcctgggttctgcgcacctcctgatgataccagagcagccaagtcaggcaaagggaagaacgtcggcaccggcatcttctgcgctagcacaggcaatggcgcctcaaatttcagggcattcagggcctgcctgatgcttggcctatgcgtgtagtccggatgagcgcaccatagtccgaccaccatcagatgctccatc

SEQ ID NO: 2287 - DNA, 319 bp, Hordeum vulgare
  UNSURE (37): n stands for any base
ggctgcgggtttgtctgggttaaagttctcctttggnctaactctaatgacaagaaagaagaatctgagggtactgataaaagagaaattagacaaatagcagaaaagatggacagaatagtatcatttgagcatccggtgcagtcaaatgatgacaagtcagcatatgaatcaccgtgctcgacgacaggaacagccagggtcaaatatgttagaggagtcgctgtgccgttaggaaaaactaagtctcttgttgagagatttgaaaagagagagagttctacttctagcattgattgttcatcgccaactggcattt

SEQ ID NO: 2288 - DNA, 554 bp, Hordeum vulgare
  UNSURE (27): n stands for any base
tgcaggcggtttacacttattattatntatttcactacctccctcgtccgtccggtccggggctgtccacgcagtaaaatgggggctaattacagactgatgaacagccaaagctctctcgctcgctcaaatgtacaaacacgggacaagaattacacaccaccacgacgaacaacaggctaccccgccaccatatggcgcttccattttcctgtggcaaaaagaatggtatctactctgacggcgtcaacttgggcttcagaagaccaccaggtcttgcaaggacatgttcagctcttgagcaagttgcgccgactggccgctccgcatcatcaacggttgtagagctcgcacaatcttctgcaaatggttaaaacaccgggtgcaacgctgcaacctctgttcggcttgaagatctactccaactggtgaactagctgacaatgttgaatgaatgaccggtccaaaaatctttataagatccaataacatctccaaagcaacaatagtgtgcctttcagtcttgctgttcagtaacccggcaagaacaggca

SEQ ID NO: 2289 - DNA, 417 bp, Hordeum vulgare
gtgcggttagcgttttcattttggcgcgcgtctggtctcgtctctcccatccccttccctctccccagaaagaccaaaacaccccccaaaatccgcgggcggcgcactggcggcaagttgagcggcggccatggacgaggggctggtgtccgtggacaagttcagcggcggcagccaggtctacttcctcacgcacctccacctggaccacacgcggggcctcggcgcgtcgggcggctggcgccacggcccgctctactgctccccagccacggcgcgcctcctccccatccgcttcccgggggtcgacgcctccctcctccgccccgtcgccgccggcgcctccgcctcgctctccctctcctcccccaactccgggcgccccgtctccatccacgtcaccgccctccccgccct

SEQ ID NO: 2290 - DNA, 410 bp, Hordeum vulgare
ttttttttttttttttttttttttttttttttagagtatcaaaacacttcctagcccacttgcttccacagtccatctgttaattattacacgagctaaacaaattttacttgtgaaaataactcaaagggaggtaggtcgcacacaggctcttcctatccagttgttaaactttacaggagcagaataaaatttacttggagaaataactcgagggacgatgacaggttcttcatccagctgctgtcgatctttttgcaggagcgagataaaatttactcggggaggggagataactcgagggacgatcataggttctacatccagctgctgtcgatcattttgcaggactaagataaaatctacttgggaggggagataactcaagagaaagggatggtttcttcggg

SEQ ID NO: 2291 - DNA, 520 bp, Hordeum vulgare
gccctctgccagtccgccgtcgccgtcggggtggcggccattgggcttcccgcacggcgcgggttcgcccggcccctctccccacaagaccaccaccggaacagcccgggtctcgttctgggggcgaaaggaggcgctgcagtaagcggccgagtcgagggttagggagctggagtatgtacatcgatgatcgatcttaccatcctcggaggcagcggtgaagttttccatccgaatgagcgagtatatctcgaacgcgttgatgagcgggggcaggtctgagccgcgcgtcttattcaaggtgtagaacgcgtcgccgttatacaagaattgcccgctgtcatacaagctgttggcctgtaaaagggacggggagaagcctcggtgcagcaaatcgccggcgttgtagatgtcgaaccttctgttcgggttgctaccattgatttcagcaaaatggaagatcgggagaaggcggacactcttggagtcgacattgttcttttccatggtaagccacatg

SEQ ID NO: 2292 - DNA, 548 bp, Hordeum vulgare
tgatttcccttgtcttttgtgtacgatgcagatatcccatggacccatatgaccggttctgggagcagtggcaatacaactcgtaccccttgatcaacctgaacactagcagtcaagtggagattctcccgggcaacgactacttcaatgtgccgatggccatcttccaggaagccatgaccctagacccaagctacacctccatgtggcttaccatggaaaagaacaatgtcgactccaagagtgtccgccttctcccgatcttccattttgctgaaatcaatggtagcaacccgaacagaaggttcgacatctacaacgccggcgatttgctgcaccgaggcttctccccgtcccttttacaggccaacagcttgtatgacagcgggcaattcttgtataacggcgacgcgttctacaccttgaataagacgcgcggctcagacctgcccccgctcatcaacgcgttcgagatatactcgctcattcggatggaaaacttcaccgctgcctccgaggatggtaagatcgatcatcgatgtacatac

SEQ ID NO: 2293 - DNA, 477 bp, Hordeum vulgare
cctctcaggtgataggcatgcactttttcaaccctcctcctataatgaagttggttgaaataatacgaggagctgatacatcagaagaggttttctctcaagttaaatctttttctgaaagaattgggaagaccgttatatgttcacaagattaccccggcttcattgtgaaccgcatcctaatgccgatgattaatgaagcattttggacactttacacgggggtggcaaccaaagatgacatcgatacagggatgaagctcggcacgaatcatccaatgggccctctgcagcttgctgacttcataggcttagatgtttgcctttcagtactcagggtgctccacaacggactaggagataacaaatacagcccttgccctcttcttgtccaatatgtcgatgccggacgacttggaaagaagcgcggactaggtgtatactcttatgggagaagctcttcatcggttaaaccca

SEQ ID NO: 2294 - DNA, 530 bp, Hordeum vulgare
  UNSURE (44): n stands for any base
gttttcataagcttatttgacaaggctctgctacagatccaagncccgcataagcctgttattgcgatgctgagtgactacatgtactactccctccgtcccgaaatacttgtcctagaaatgaatgtatctagacttattttagttatagatacaaccattttattcatttctaagacaagtatttccggacggaaggagtactacttttggtcttcttgttttcttccactgatatacaaagtacatacacaacttcatttctttgctcaacagccgcacagaaatgtttacagagatgacttgggtttaaccgatgaagagcttctcccataagagtatacacctagtccgcgcttctttccaagtcgtccggcatcgacatattggacaagaagagggcaagggctgtatttgttatctcctagtccgttgtggagcaccctgagtactgaaaggcaaacatctaagcctatgaagtcagcaagctgcagagggcccattggatgattcgtgccgagcttcatccc

SEQ ID NO: 2295 - DNA, 544 bp, Hordeum vulgare
ggtctgcaggcaattcggcacgagggtgacgagcaaaaggtgtaggcaaaaagaaagaaagagatgcaacagtaagaggtttgcagttgcaaggagcagccgttgctgacagctctacacatcaagtccataccgtttcctcatcaggataggatcttgatgcacttcggtagctaggaaagttggtgtcctaactggaatcttgtaaggttttgcgattgtggtgagggtagttcacatgttcatgctcctggccatcatgcaaatttggaggagaaactagcttgttggctcattttgtgagaatggacgacggactataccttccgatccccagccaccttctgtttccatatcctgagatctcccacggcttcgatgagttcctagcgtgcactcacacacacagctgtccatcgtggtcgtcgccggccgcggcgcacacccacacgtgcctgcatgcgcacacccaagtcgtagcttccggcgaagactacgccgtggagcaagacgagctgaggaacccccggaagcctctggggaa

SEQ ID NO: 2296 - DNA, 557 bp, Hordeum vulgare
  UNSURE (33): n stands for any base
gaagcacagtatactgccctgtgtacacttacntattagctccatccaatacaaacacaacaagtacattacaaaccgaacacttcagaacagaggtataatcagcaagaccttgatagggtgtctcacttccacacttctgctcccatccaccatttattcaagcaggctatatgaaagggaaaacacacacacgcaacccaagccattttctatctgaaatcttggtacgaagaacttgagccaattaggcaacagagttcacgaagctggcaacagcatccaccacttcaggaataccgagttctccggagacgatgccgccgtcatcgacatcgccagcctcccggaccgctgctacctcagcaccgctagcgtcaaagcatggcgtgagttctgcagcagtacagacgacagagccgaagctgcaccgctcatcgaacggcagggcaccgatctcggcctcgtcgatcttgcctcggacgtcgagcaggaggctcgtcagcctcgcaacctcggcctccagcgccgcatggccctgcagccgcctcaggagc

SEQ ID NO: 2297 - DNA, 472 bp, Hordeum vulgare
acactgctcttgctgctcgccgtcggcgtgccgtttactcagacccggacgcagagcgcgcgggacaaggctgccatggcggaagacgcggggccgttgatgggaggcatcgaggactcgccgatgggacaagagaacgacctcgacgtcatcgcgctcgcccgcttcgccgtctccgagcacaacaagaaggccaatgccctgctggagttcgagaatgtggtgaagctgaagaaacaaactgttgctggcaccatgtactacattacaattcgggtcactgaaggtgggaccaagaagctctatgaagctaaggtgtgggagaaactatgggagaactttaagcagcttgaggagttcaagccggtgcaggacgctgcaattgcataaggtaagactgtcctctgtttcacattgaataccgtcaaataaaatcgcatctatttcatgcggcaaaataccaaggatggtt

SEQ ID NO: 2298 - DNA, 536 bp, Hordeum vulgare
aaaattactgcattgaatatgctattaaagtaaaacatctgaaactctaataagcaggttaaggtaaacatatgctaattgcttcccaaggtaaaacaagtcaatcaaaagtccagacaaaatactataataaggagaattttattaagaaatgtggataaaacaacttgcaagaagcagacttattcttgatattacacgagaacaggctaaaacatgtctgatagatacagtcatacagatcaacaccatatctgcagatccttgcacagttgggatgtgcctgaaattgtttagatcaatcaatcaattctctacaaacaaatggccaaaaaggttgtaaacgtcatgtgtcttgatctctagtattgcatgatgaacaattcaataattggtaagcaggttcatgcaaaacaaaggggatcccatgataaattgctggcattttcatatgaacatcaccaccattttttagaagttgatcaataaagaaacttatggacatacgtatttacagcctgcatgatttaaccagg

SEQ ID NO: 2299 - DNA, 455 bp, Hordeum vulgare
ctccgccatccctcctcctccccgccgggatcaaagatacaagatgtcagatagagccacacattggtgttatgcctgccgtcggccaattcgtcttcgtggacaagatataatctgccccaactgcaatgatggcttcatacaagagatcagtgagataggaggcgctttgaacacctacggtatgtttgggccacgcttcgatcgcctagatggacgatttggaatgatggacgctgtgtctgccctcatgcgacgacggatggcagaaatgggcagcaatcctgtgtttgatcctaatgcagccggggcaatcaccgcacgaggaaggccgccctcaattggccctaggctgatattcggcagcaacatgcctgctcaagggagcgacgagggtggagtaaacgtgcttgccaggggaggtcgcagaatcggcgcggaccgtcaaaacttcg

SEQ ID NO: 2300 - DNA, 548 bp, Hordeum vulgare
tggtcagaattagttgaatgccaggaggcagcttacatttatacacagctccaggcctccggccaacataaggtgaacgctacaggcatccaccacagattcatcatatatatatatatctagactgcacaccacgtctcctgcttggagcaggaactcagggagcgtctgtcaggggtcgtagtgccattcggagtaggttatctggccagggtcgtcgttgtaaaccgcgggctcgcccccgcctcctccgtactggtaagaactgggaccggggccggggccggggctcgacccgaacggccagaggaacgagaaggagctctctccgtcgtcgacttcgttcctcgtgacaggcccagggccagctccggctccggtgaccccacggctcacagcttcgctgctgtggaccgaaggtcgtgagcgggctgcattgctgtctgatcctcgctgcggcggcagcgagtggcggcaaactgggcaggagttgtgctgaaccaaccaggggatgatgcagttggcatggtacaggtgcttgcacggca

SEQ ID NO: 2301 - DNA, 456 bp, Hordeum vulgare
gtacactttaaaggaaactcagctaccaagaatacagattacggatcccattgcgaggtactacggcctcaagcgagggcaggtggtgaagatcatcaggcccagcgagacagccggcagatacgtcacatatcgctatgttgtatgacagtacacaaagtgaaatcaaggaaccaagaacatggtgatttttgcagttacacacatgacacatgacacacatacccattcgcttgcttggagaaaaacggcatcgcttcaagccgccattcttaaggatcgtatgcctgttacgtaagtggatttcttaataagccgagtgtatggagcataagcaaaatcctcatgttgtaccattgtttccagaactttatagaacaatacagaacagaaactagtgtgttgagagccatggaaggctctgcagctccgattgctatatcatttgaatgaacc

SEQ ID NO: 2302 - DNA, 441 bp, Hordeum vulgare
atatagcaatcggagctgcagagccttccatggctctcacacactagtttctgttctgtattgttctataaagttctggaaacaatggtacaacatgaggattttgcttatgctccatacactcggcttattaagaaatccacttacgtaacaggcatacgatccttaagaatggcggcttgaagcgatgccgtttttctccaagcaagcgaatgggtatgtgtgtcatgtgtcatgtgtgtaactgcaaaaatcaccatgttcttggttccttgatttcactttgtgtactgtcatacaacatagcgatatgtgacgtatctgccggctgtctcgctgggcctgatgatcttcaccacctgccctcgcttgaggccgtagtacctcgcaatgggatccgtaatctgtattcttggtagctgagtttcctttaaagtgtac

SEQ ID NO: 2303 - DNA, 549 bp, Hordeum vulgare
gtcccccgggctgcggttcgcgtctctgccggtgttaggaccgccgtcgccgcacccgccggcgtactccggtttggcaagacggcttgcctgcactccggccactctggccaagctgtgctgcgatcgaacgcgctgcagctgaggcccgtgggacagaggaggcgctcggcgctgagaagcagcgtggatgactccaaagccacggatgacaaggtggagttcgggtactcgaggaaagacgtgctgctgatcggcgtcggcgtcaccctcctcggctacggcctcaagtccggcctcgagttcctcggcgtcgaccccttgcaagccggcaacgtggtccagctcttcatcgtgctcgggatgacggtagggtggatctcctcctacatgatccgggtggccaacaaggacatgacctacgccacgcagctcaggaactacgagaagcaagtcatggagaaacggctggagagcctgtcggaggcggagctgcaggtgctgctggagcaggtggaggaggagaaggaacgcctgccgccgatgagg

SEQ ID NO: 2304 - DNA, 549 bp, Hordeum vulgare
ttggggagttacactcagtgctgctgctaagagcactacattgtgctacagattcttataacaaaggaaaagccgtaatacatcgatgcaagctatcctaacagtgtgtactgggctagtatcattatcgaggtgttctagctatcagttggcagtggtttgatcctccgtcttcctgttgatggtgataccctgatccctcctcatcggcggcaggcgttccttctcctcctccacctgctccagcagcacctgcagctccgcctccgacaggctctccagccgtttctccatgacttgcttctcgtagttcctgagctgcgtggcgtaggtcatgtccttgttggccacccggatcatgtaggaggagatccaccctaccgtcatcccgagcacgatgaagagctggaccacgttgccggcttgcaaggggtcgacgccgaggaactcgaggccggacttgaggccgtagccgaggagggtgacgccgacgccgatcagcagcacgtctttcctcgagtacccgaactccaccttgtcatccgtggc

SEQ ID NO: 2305 - DNA, 518 bp, Hordeum vulgare
gaccggtgaaagcattgatctaagctctaaagtgccatttgctcacggagttggcataatatcagatcagttatatgagaccatattggggcattgccaaggacaggactacatgtttccggcaaatgatttgtgcgcccaagctctggatgatctcaatcatgtaagaagaagaaagaaacatcttaatgctagaattgatttgaccgttcgccgtgcaatttttgcagcttttgtccgaagttcagcaggcccaaattttgttggacacctgcatttttgcgtccgctccatcccgaccagaagctgatagcgggactgagtactctggtggtgctggtaggaggatcctagttggaaatccgccacctcgccctccatttgaatgtgtcgtaagtagtaatatctccattcttcatgtagtacaatgcgagttcgatagtttccatcgcttttaaccatttattagtacttagccgagaaaaaaaggagctcattagtactccctccgatccttt

SEQ ID NO: 2306 - DNA, 547 bp, Hordeum vulgare
gtggaatcaaactctctctttaaagagtacaacttttatatgaaattgtttcaaaatgaatttgacgaaacgaaactgaattttatgtagtgtagtcccaaacaggcccattgccaagtcaaggttacaccacatttaaagctaagactatatatgggaattgtgcacgagtgtgtgagatagctctcgcgaatggatggcgatgcgagcccccgataggggtcggccgccctacttcccggccccaaggccagatccagccttctccgccgcatgccaagctgacggatctggcgcctcaatccagatcggcatcggcgatgcccctcggtgtgaggcagctggtcgttgctgttacgtctactagagtggtttttcgagtatccatcggctgaacatggcgaagcacctctcgggctcgtactctggcgcggtgtgcccgccacccttgatggttgcgaatgtcatgttgttggagtaggttaaggtgaagctgcaagaaacgcatgcatcaacaagaatatagagtaattaagcatgaaaagga

SEQ ID NO: 2307 - DNA, 351 bp, Hordeum vulgare
tggagtgcaattatgtgacaagtcattcatatatttggcagggctccagcttcttttctcatctggaagacgttctgttatacctggactgtctggtatacttgctgggcttttgtaccgtctgaatatatttggtatccgcaggctaaaggtcccagagtatgcaacttcactgttttcgcggttgtcatggcccttctctaacaactcttatcagagattgccaattgcaacaactgatgaaaacattcctgatcaccaggctcgtcaaatgcagggcgtgcacacagctaccccagatccaacggagtcgtcgattgccacgcttgtctccatgggttttgatcgtgc

SEQ ID NO: 2308 - DNA, 50 bp, Hordeum vulgare
ttttttttttttttttttttttttttttttcttttttttttttttttttt

SEQ ID NO: 2309 - DNA, 233 bp, Hordeum vulgare
  UNSURE (3): n stands for any base
canagttcctgaacctgatggcccgcaagatgaaggacaccgactctgaggaggagctcaaggaggcgttccgcgtgttcgacaaggaccagaacggcttcatctccgcggcggagctccgccaagtgatgaccaacctcggggagaagctgtcggaggaggaggtggaggagatggtccgggaggcggacgtggacggcgacggccagatcaactacgacgagttcgtcaag

SEQ ID NO: 2310 - DNA, 548 bp, Hordeum vulgare
gcaggcaaagcatcagcgacacgctgttattcctttcgataccatatacaagggaactgttcgatgttatacaaccatttccatttccatttccgggagcgtagcatagcttcccgacacacacacacacacacactgatacatacaacagctcagacgccttggtcggtcggggaccagcgcaccacacacgctaggcacgttcgatggtttcaactttcgactagaggattatgcatttgttgccactctttgcaccggatggcgatgcccctgccgcgctcttcctggccggcggcgccctcctctcctctaccctcttatcccttctcttggccatcatgaccttgacgaactcgtcgtagttgatctggccgtcgccgtccacgtccgcctcccggaccatctcctccacctcctcctccgacagcttctccccgaggttggtcatcacttggcggagctccgccgcggagatgaagccgttctggtccttgtcgaacacgcggaacgcctccttgagctcctcctcagagtcggtgtccttc

SEQ ID NO: 2311 - DNA, 517 bp, Hordeum vulgare
gctcttcccatgcccgcctccttcttcgccgcctactaccacttcgactccctcccgccgtgcctcgtcggggagcacgccgcggccgccggtgctaccgcagataaatctgatcagagagttgagcactatatttcaggctttgcttcaagttcagtaaccttatctgatctggagcccttaattcacaacaagagaacagtaaaccatgtactagcagctgtctctagcattaagagcgcgcaatgcctcctattcaccactatgtacgagctcgaagccggtgtcatcaactccctaagatcagcactcccatgtcctgttctcccagttgggccctgtattccccacatggccctggaagaccagcattccaagtgcaatggagaagttaccaccagtccaggagactgcttcacctggttggactctcagcctgcgaactcagtgctatacgtctccctcggcagcttcctctctgtgtcagcctcccagcttgatgagattgcattgggcc

SEQ ID NO: 2312 - DNA, 485 bp, Hordeum vulgare
aaattgagattttccattttgacagctctgccagaaaccttactaagagccctaggacacactgctcatcaaaactacactcatttgaattgatggtaaaccaaatggttgaacagatgatgcatttcaagcatcggttttggaacgttgctgatcgtgttcagtaaatcgtgacgtgcataccatctccatcaatgaactgagattatcatatgaagatccacccttttcgatagctctgccacagacctctttccactgaagggcacgcctccttattgccttggtatcggcttcatcgcaggccatgagcctcttaactgcccttgcaatgtcctgactcccaatcaggccatccttatcggcccatttccgcagggccagtccaaccttccagtcttgaacaattagacgaccattaatgggttgatcaaagaacagtggtagagcaagcataggcacaccagcaaagacagcttcaagcg

SEQ ID NO: 2313 - DNA, 533 bp, Hordeum vulgare
ggcaattcggcacgaggcgagaaccgggcgtggatggagttccgcgacgccaacgggaccgacgggggcctcgggggcggcacggtccatctcgagactactaaagcacatagctggacttgcatggatctctatgtgtttgcaactccataccgtgttacatgggattactactttctaggccgtgagcatacccttgaaatcaaagaatgggaaagtaaggctgaatatgaatatgtgaaacataatggagtgtccatcttcctcatgccgtcaggaacaatcgggacactcagagcactctgggatgttttccctcttttcacaaatactggatggggtgagaatgcaaaccttgcatttctcaaaaagcatatgggcgcgacctttgaggaacggccaaaaccgtgggtttcagaattaaatcctgatgacatccaatctggagattttttggttttatcaaaaattcgtggacgctggggtggttttgaaacccttgagaagtgggttactggagcttatgcaggcca

SEQ ID NO: 2314 - DNA, 552 bp, Hordeum vulgare
ggcatgggaacggcacaacaacgggccaaccaaatgcacttctacatagtgtacataggtttcaaccatttctaatcagttgaatacaacaatgcacatacatttttgtcaaacgtgtatctattttctgacaaaaacactatgaatgttttcagaacactaaagcggcggcaagccagacgtggagctttactatacaatttgtgccaccatggccttccttattcgaggaagttgatcgtacctcgcggcaagccggtgtgcatcatggaaaatattgcagacctaccgtggtatgtacagctgaagtactgactaaaaggaagtacaattaaatagcatgggcgcatggttaaataggagcactcagcagttttcatccctcacgtagtccggaggaagcgatgcacacctttcattcatgtgagcgtatggttccatggcgttgtacccaggcagttccattcgatatctgcccttgatttggcaaaaggggagcttcacagtgtcgtctttgttgcaccacgccggaagacgtgtcatattggcttc

SEQ ID NO: 2315 - DNA, 518 bp, Hordeum vulgare
gcggaggaggcccggctgtacggggacccccggggcgcgtggccgtcggcgcccgcgccgctcagggtctacgtgtacgagatgccgcgcaagttcacctacgatctgctcaggctcttcagggactcgtaccgcgacaccaccaacctcacctccaacgggagccccgtgcacaggctcatcgagcagcattctattgactactggctgtgggctgatctaattgctcctgaatcacaaagacttctgaagaatgttatcagggttgagcggcaagaagaagcagacattttctacgttccatttttcacaacaatcagttacttcttgctggagaaacaagaatgcaaggcactttatagggaagctttgaagtgggtgactgatcaacctgcttggcaacgttcagaaggcagagatcatgttattcctgttcatcacccatggtcttttaagtcagtccgaagatttgttaagaaagcaatatggcttctacctgatatggattctactgggaa

SEQ ID NO: 2316 - DNA, 550 bp, Hordeum vulgare
gtcactgcatatcttaattctcaactggagcatcagttacaaattaacgctagatttttcaagtagtgcaatttacaaacgagtgtaacagtggggcaaactcatatcaatgacttgtaaagaagagctacagcgtccccgtcaaaaataaaaaagagctacagcgttacgggaactggaaaaatactacaaagaaaaagctggttcagagcatcctcgtagtattcccgaccctacactcacatgtgcatacgcttcttgattctctgaccacgcgccgcgaccgctgaatatgcagcttgatgttcaccagcttgccagcaatcattctccatgtaaggtcttctggtccaaggggctgagcaggactcgaataaagaaaatgcctcgagtacttgagaagattggattgcatctccctgactcttttgccatcgacgcctcttaggtacttcaccagccagccaggttgcacagcatcagttgatgaaacaaacaatgctatcttactgtagtcaagtattccttcaaaagggagctctagctcatc

SEQ ID NO: 2317 - DNA, 545 bp, Hordeum vulgare
  UNSURE (16),(31),(37): n stands for any base
gtcccccggctgcagnaattcgcacgagggnaaaggnacgagggcctctctctccatccccgacctctcgtggccgctgcgaagaaaagagcttatcatggcttcaaaacgtatcctgaaggaactcaaggacttgcagaaagatcctccgacatcatgcagtgcaggtccttctggcgaggatatgttccattggcaggcaaccatcatgggccctcctgatagtccctatgctggaggtgttttcttggtgaatatccatttccccccggactaccccttcaagcctccgaaggtatcgttcaagacaaaggtcttccatccgaacatcaatagcaatgggagcatatgcctcgacattctgaaggagcaatggagtcctgctttgacgatctctaaggttctgctttcaatctgctcgctgcttaccgaccctaacccggacgaccctctcgtccctgagattgcccacatgtacaagacggatcggtctaagtacgagacgacagcccgcagctggacgcagaagtatgccatgggatgat

SEQ ID NO: 2318 - DNA, 551 bp, Hordeum vulgare
gagagctatgtaatttattatggactttggcaatgataggttgatgttttgactacgacgcgatcctacatggatcagggagacacacgcaaccgacaagtaatcaaagaaaataatgacccagagatagtttctcgggacagcaacacaatcttctgcatgcaagcagtggatacgagcatgggctccgtatcatcccatggcatacttctgcgtccagctgcgggctgtcgtctcgtacttagaccgatccgtcttgtacatgtgggcaatctcagggacgagagggtcgtccgggttagggtcggtaagcagcgagcagattgaaagcagaaccttagagatcgtcaaagcaggactccattgctccttcagaatgtcgaggcatatgctcccattgctattgatgttcggatggaagacctttgtcttgaacgataccttcggaggcttgaaggggtagtccggggggaaatggatattcaccaagaaaacacctccagcatagggactatcaggagggcccatgatggttgcctgccaatggaaca

SEQ ID NO: 2319 - DNA, 401 bp, Hordeum vulgare
acagcccagcaaccattccatccgtgcccgagcaaagcaaccgagctacaaaggcaccagctgctctgcaatggcctcctccaatgctctgctcctgctcttctcggccgccttctgcttccttgcacggcgggccgccggcgactacggctcgtggcagaccgcacacgccacctcctacggcggcggcgacgcgtccggcacaatgggcggcgcgtgcggctacgggaacctgtacagcacgggttacggcacgaacacggcggcgctgagcacggcgctgttcaacgacggcgcggcgtgcgggtcgtgctacgagctcaagtgccagggcagctcgtgcgtgccgggcagcatcaccatcaccgctaccaacctctgcccgcccaactacgcgctgc

SEQ ID NO: 2320 - DNA, 393 bp, Hordeum vulgare
tttttttttttttttttacttaaacggttaagccataaacatgcattgtccagggtcttcaaaataacaagtgtgcccccacaaacatttcccaatcatatgaagggattcgtaggttttacaacgcaacaacagaagttacaagacactctcgacacaccactccatgtacttctaaagtactctcacataaatcaccttgtggtgtttccacaatgcaaggctacactaacaatgattaaaatgctcaactccacaagaataataacttatttatctctagtacaagtgtcctactagtatgagagaagggaaggcctaagcgggtgctgatcagcagcagcctcggaatagccaaaggcctcttttgtagtactccttctgtcctaaaat

SEQ ID NO: 2321 - DNA, 491 bp, Hordeum vulgare
atcaccagcagtaaaagccgtttacctcacatgcagcaccttgcacaggcgatcccagaagctcattatgtcacggccggtaaggtgtctcgacccgccctcacggccatttaccctgagaagatgcccatagccgtttgcgtgcacaactgcgtgaagcaagtgagaggagtcatcaagatgcaggtacccgcactcctcgagttcctcgccttccatgtcgaagttgcacaacaggcacctgcagaagaaaccgcatccccgcggccatggaagtcccgcagcggaggcagcaggtgcggcgacggccagccatctggatgctgtcgttctcgatgatgaaatggtagcgcttgccgcacaccgggtgcccactccatcctgcaaccgcacacacagatgcattagagaatgagattccatcaccgctactgtatgattgtgacaatcagcggaatgaaaacaatcacggacattgttcactcaaaaaa

SEQ ID NO: 2322 - DNA, 481 bp, Hordeum vulgare
gtgacaatgtccgtgattgttttacttccgctgattgtcacaatctacagtagcggtgatggaatctcattctctaatgcatctgtgtgtgcggttgcaggatggagtgggcacccggtgtgcggcaagcgctaccatttcatcatcgagaacgacagcatccagatggctggccgtcgccgcacctgctgcctccgctgcgggacttccatggccgcggggatgcggtttcttctgcaggtgcctgttgtgcaacttcgacatggaaggcgaggaactcgaggagtgcgggtacctgcatcttgatgactcctctcacttgcttcacgcagttgtgcacgcaaacggctatgggcatcttctcagggtaaatggccgtgagggcgggtcgagacaccttaccggccgtgacataatgagcttctgggatcgcctgtgcaaggtgctgcatgtgaggtaaacggcttttactgctggtgat

SEQ ID NO: 2323 - DNA, 518 bp, Hordeum vulgare
gagatattaaggtcatcggggtagaacctgctgaaactagtgtgatttctggcgacaagccaggttatattccaagcatactagatgttcagctccttgatgaggttgtgaaggttaccactgcagaggcagttgatgttgcgaggctgcttgcactaaaagagggcttgctggttggcatttcgtcaggtgctgcagcaattgctgctataaacgtggccaaaagacctgaaaatgctggaaagctgattgccgttatcttccccagctttggagagagatatatctctagcattttgttccgtccgatatacaactccgttcgaaggatgaggaagcgatgatcaacttctcccattccaagaaagacggacccgacaggcttccacggcatgacaaacataacacatcaagcagggcagcattgtagaaatgctctggcagcagaaggacactggtcgtaaatgtttgaaattgcgcagagtagctgccgagtgggcttcagcactgcatcgact

SEQ ID NO: 2324 - DNA, 546 bp, Hordeum vulgare
ttaaatctgaacgaacacatcgccagctaatataggaggccatttagtaagatcagtcaaatatcagatgacaagtctgctttgttcctggccctatagactactcaaacattgatcctaaacgaactaccacatctaattcggcatgtttcaccgagttccaaacgtttgaggcagataacatacaacaactcatgattttcccttccctcggttttttatggaaccaagtcgatgcagtgctgaagcccactcggcagctactctgcgcaatttcaaacatttacgaccagtgtccttctgctgccagagcatttctacaatgctgccctgcttgatgtgttatgtttgtcatgccgtggaagcctgtcgggtccgtctttcttggaatgggagaagttgatcatcgcttcctcatccttcgaacggagttgtatatcggacggaacaaaatgctagagatatatctctctccaaagctggggaagataacggcaatcagctttccagcattttcaggtcttttggccacgtttatagcagcaa

SEQ ID NO: 2325 - DNA, 1035 bp, Hordeum vulgare
  UNSURE (1)..(3),(54),(56): n stands for any base
nnntttcatgtacccctgatctcacaagctgcagccttccatctacgagggtananagacccccaaaacagagagagagagagatttaggggagagagtgacacacacagatctacagagacacacagagatagtgagcacacaatacccttacacatcgtgagaggatatctcttacattttttcattcccacatacctttccccttactctctccctcttttcgtccgcgctcttctttcttgtgcgcgcgcgcttttccattttcctcctcccctcctccttttttttttccattccctcctccctcttccctcctctcctttttccgttccctccttttctttccctttttctttctcctccctcttctctccctctttttcttttttttcctcccccccctcctttcctttttttccttattcctctttccccttcccccccttcttcttttttccttcctctttccttttcctttcccccccccccccccatttcctcccccttttttcctcctctcccttttttccttttccctcttttcctctccctcttttttccgttttccctttttttcccccctccccttttcccttccccctttcttttttcctttccttccccccccttttttttttctccccctttttccccccttctttttttttttctttccccccccccctttttttccctttctttccttcccttttccccctttttcccttctttctccttcctttcttttctttcttccctccccccttttccctttccttccccttccccttttttccttttcccccctttcccttttttcttctcccccctttttctcttttccccttcctttctttcctttccctttcctttcccttctcccctccccctttttccctatttctctccctccccccttcttttcgcctccctcctttttcctttttcttttctcctttctttcctccctttttccttctctccctccccccttcatcctcctttctccccctcctttcccccccatttctt

SEQ ID NO: 2326 - DNA, 541 bp, Hordeum vulgare
ccatgcatatagattagcaaaaaacgctatctgtctgttaagccaacccgcgtggcaacccaagttacaaaatagagctaactgcaagtaaaatccacctttctcaatgttacacatgagttttgagcaagcgtgctggcaaatctcaaattattcaatgatgcgatcattccttgacccaccccaaaactatagcgacaaaattggctaccgcaattttggcttcagagagcgcagtggtttttttacttgtcgacgacttcgatgagggtcgtctcgtaatcggcaggagcctggaagccatggaggttcatcaccgtggcggcaacgttggcgagcccgggtgtctggatgtcagagcggaatctcactcctgggtggagaccagggcctccgatagcaacagggacaggctgaagtgtgtgcgaggtaagaatctggatgctaccgctcttgtcgagcatcggctggccagctttgttcctcttaaccatatcctctgcgtttccatgatcagctgtgacaagatagataccaccaa

SEQ ID NO: 2327 - DNA, 399 bp, Hordeum vulgare
atggacacactcactcaccccaccactcccccgcacactgacaccgctctgcgctctatttaagccaccagcgccgcgccgcgccgtacgcacaccgccacgcctccgactccgctcgactccagccatggccgccgccgccgccggtcctcggctgctccccttgctcctcctgttgctgcagttgctcgtggtcgccgcggccgcggcctctggcgtgacgtacgaccaccgctccctcgtcatctccggccgccgccgcctgctcatctcggcctccatccactacccccgcagcgtccccgcgatgtggcccaagctggtggcggaggccaaggagggcggcgccgactgcatcgagacctacgtcttctggaacggccacgagaccgcccccgg

SEQ ID NO: 2328 - DNA, 393 bp, Hordeum vulgare
tttttttttttttttggggggaaccgaacttgacagaactgaactgccttacctaagctgcaacagattcctcacactacatcagcattccaacacttattatatagaaagttcatgatgcattctacaatatgcttcgtggtaacagattccttgctcgtggcttgaactcgtagccatattaggtataaacgagcctgagacgcaatgcatttgcgcatatggtcagtatcctgagtatactgcgtaaaagaaaaccagaactgcagcttccgaatttgattttggacgagcagatttgtggtgctggaacccttagctgagtagaattcacagattaagaacagtctgcttcaatggcaagtgttttggtgacgccagggcatggatctt

SEQ ID NO: 2329 - DNA, 419 bp, Hordeum vulgare
aactgactccgtgggcgttcgtcaagccgggcacggaacgcgctgctgctgccgcgatccgagcgagctccacaagccgacgccggcggcgaggaggaaggacggctccgatggacgcgtcgggcgagatgcagtgcgtggggcggctggagatcgccgcgccgccgccggcgcgctacctccgcgtgggctccctcccggtccccaccgacgactccgcctacccccccgccctcctcccctccgcttccccgactgggactggagctccaaggtatcaaatgctgccactggagaccgaccccaacacactccccgtgattccaaacctcccagagaaggttttcccaacggatgcaaagagtactgaaggattacggtatggaagtggacttttcaaccaaaacttatcaaggaag

SEQ ID NO: 2330 - DNA, 432 bp, Hordeum vulgare
tttttttttttttttttttgtttaccagttcacacagcattacgacgtatggctccgtaaacaagtacgtactacacgagacaacatgatcgtcacaacagtcacaaacttcaaagcaacaacatatcatacacgtacagtagtcatactgtgaccggaggttctgctcagacccagagcttgtgcagcgcgtgcagctggcccagagaagaagatttcagagacagacggtacatctctttcagcttggccgcgtctcccctgccgccgccgacgccgttggcctgactagcgacggaggctgctggcctgcttgtgtccgggttcttcagcatgctcttcagcaagctctgcagctggctccagaacttcggctttatgtccaggttcacatcgtttgagtattcctcgtttgcttcgaccacgtggcgg

SEQ ID NO: 2331 - DNA, 521 bp, Hordeum vulgare
gagcgcatcgtgctcgaccagctcgatcacccgggcgtcatcaggctcttcttcaccttccaggactcctactccctctacatggcactggagtcctgcgaaggtggagagttgttcgaccaaatcgtacggaaaggccgcctgtcggaggacgaggcacggttttatgccgctgaaattgttgacattctggagtacttgcatagtgtaggcctaattcatcgggatgtgaagccagaaaatttactccttacttctgatggacacatcaagattgctgattttggtagcgtgaagcctactgtggacactccaatcaaagtcctcccaaattcaacaaatgagagggcctgcacatttgttggcacagctgcttatgtaccaccagaggtcctgaactctgccccagcaacttttggaaatgacttgtgggcattggggtgcacgttgtttcaaatgctttctggctcttcgccatttaaggatgccagtgagtggttgatttttcagcgaattattgc

SEQ ID NO: 2332 - DNA, 520 bp, Hordeum vulgare
cattgttaatgtgtattcgatgatacaaatacaacgatacaaatcgatcatctcatggacttcttttgttaactgttctggagggcgaacatttcaatcactctgatactatctgctgcggcaactaacaaacaaacaaaactgtttagggaggtagacgggacatcgatcaacatgtcacaagtgattttcttcccaggcacgcgaggagggcaggtgcgagaaacccccatgtgttccaccaagtgaaaaagatgggtaaggtctactcagggtgcttaatatcacccgtttggtatctagatttcaattgaaaatcaactcttttggcagtgctggagatcttcaatcgcattcttccattgccaggcacgctgttttgcatcctcaaatatgaacaccttctttggcgtggagatcctaaaatgcgaggagtcggctacttgtacattgagttcacttggatcatcagaccaactaatattccccttggtcaccatttttgcagggtcaacacaga

SEQ ID NO: 2333 - DNA, 305 bp, Hordeum vulgare
ggcaattcggcacgaggcctcgtgccgaattcgagcacgaggccgaatttcagtaccgttgaagacgaaatatttgtggaccgaccagatgatccagaggtactcgatgattatgaatttttcaaagatgaagttactgccatcaaggacaatgttctctacaagcaaaaagtgaaacgacgtgcaagccagtataaggtatatttccttggcatttttatttcttgctatatgtttcttccatatgcgtgcttgtgtagttgtgcactcgtacctatttgtgttaattctgatgcgcttcttgg

SEQ ID NO: 2334 - DNA, 542 bp, Hordeum vulgare
cggggtgtttttgcagtttgttttgagtgagatagggttttcctggtcattccagtgcgctagtgcgtgcagtcgatagcacttaacaaaaagtagggagtctaagattctgcctgccaagatcactatactgaagagaactacctgcgcctgcgtctcttgccagtttcgtccatgaaggactcccaaccatcgtgctccagcttgctaaaatcttctagctctgcgatggagagcaggtactgcgtaagcttccgcagctcttgatcacggcctctgttcttactggcattcttgaacggtctgatcaccaggccgttctgcggattcatgacgaaattccttctgaggtcatcgaacatgatcgtgttcttttcgttgtagtgctcagggaacttagtccaaatgacaccaagaggcttgcagtcgaaaaccttcttgtcaggagcatgcacggttatcatcgccatgtgatccagaagggcggtgatcttgtagttggggttgctaagaactccaagttgctccatcttcaactgcac

SEQ ID NO: 2335 - DNA, 552 bp, Hordeum vulgare
gtacccccgggcctgcagggaattcggcacgagggcagagaggccggggcgatgcggcgacggggagtggggagctgcttgccattcctggagtagggccgcggaaccagaggaagctcgttgagaagggattcgatggcgttgcgccgctcaagcagctctatcgggataagttctttggcaggtctgatgataagatggttgagttcttgcaaagttcagttggcatcatacacaagaaccatgctgagagtataactttgttcattaaagagagcgttgatgaggaggtgaaagacactgacacatctaagccttgcagaaaaaaagaggctcaccttctgtgttgaagggaatatcagtgtcgggaagtctacattccttcaaagaattgccaacgagactatcgaactacgtgaccttgtggaaatagtacctgaacctgttgcaaaatggcaggatattgggcctgatcactttaacatacttgatgctttctatgctgaaccacagaggtatgcatacactttccagaattacgtctttgtgaca

SEQ ID NO: 2336 - DNA, 551 bp, Hordeum vulgare
gtgaatctcttaaagaattatatttaggaacggaggggagtaatagggcgccgacaccaagcaagtagtagccagacgtcatttacaggaacacgaagtcagacactatcatacagcattgcctagcactacagatagaaaagagtacctaggtttcgagattatacagcattcagaaggtcgtcgccagttaggggtggtgcttctcaggctcggatgtgatgattgatcaagtgaccatccagattttacaatataccaccatgtcatggccacaaaatgatggttgcatcagtgatgtttgcccctactttgggagcaaggacgacatcgcccgtctgaattcaagagaccctagagcagattttggtaaagggctgcctccagggaaccacaaatcacctctgccaggaagcataacctgtgggcttatactcttgtcaccatcacttgtctcagcaggaagagcttcgttctttttcttcacaaattcaaagaactccgcaacttgccgagcatattgttgtttagcttcaatgtccttgttaaaa

SEQ ID NO: 2337 - DNA, 518 bp, Hordeum vulgare
cctcgtgccgaattcggcacgaggcgccggccctgttcctcctcaccgggtccccgctgttcccatcccggccgcaatcattggccattgagggtttgatgcttttcctgtcttattatcaatttctcgtttggagacgatcgcgtgagatagaagaaagggggggactggactagaatctgagctctggtggatctgaactgaaagtgggacgagaaaaggttcagaaatttccatgaaagcttcgtcgtccatggcaggcgacgcgtcagggaacacagaccctggccaacagggtgttcgtttcagttccatggaccagtcttgctttgcaagacctggccagtcaatccctggttatcctccgttctttggccctcaatcttccaacttttaccttcctgatgacagtgtgggtaaagcttgtgatccttttgaaccgaatcctccagtgaatgagcctatagcagattgggatcctcaggcaatgctgagcaaccttaccttccttgagcaga

SEQ ID NO: 2338 - DNA, 550 bp, Hordeum vulgare
  UNSURE (29): n stands for any base
ttatgtaagtgcttgatattattgatgancccaaactaaagtacacttaagaaagaggcatggaccaaaatggctccctgaatagaggaagaaccgagaccgacatacatataacattcatacataacaattgacaccatcatggttgtctatgacgacgagctccatcagttgtctccactaagctgcccaaaactgcatgacccgggtcccgaaggcaggaaggagaaggggttctcggagatgtcgaatccagggcgggcgaagtcatcaagggcaccgaagcatgggtcgaagttcaagggcgagaaataaccacgtgtgtcatcggcaactttcatgtctagattcggaacaccatcagatgtgctgcctgggaagttataccctgtgctccctaccatgtcgtccatcgcctcactcccctgaggctgctccgatgctcctgttgctttgatatcatccattggaagagcaggtgtgtgcccttggaaaagggcgacatgcccgaatagcttatcctttcttgagaaggtcgttccacatgagc

SEQ ID NO: 2339 - DNA, 517 bp, Hordeum vulgare
ggcggtgaaggagccgctggatctgattaggctcagcctcgacgagcgcatctacgtcaagctccggtccgaccgcgagctccgcggcaagctccatgcatatgatcagcacttgaacatgatccttggagatgttgaagagattgtaacaactgttgagatcgacgatgaaacatatgaagagattgtgcgaacaaccaggcgtaccatccccttcctttttgtccgaggcgatggtgtcatattggtctccccgcctctgcgaactgcgtgagccatgaagtttgatggggggatcctgctgattgtcgactatgagtagcgtgtggttcggtcggttgattacatggactgcctgtcgtctgctgcagtatcactgttggaccgtagggttttagcatgccatgatacaattgtgtaacaacagctccttgtgtttgaattcacttgattgtgatgccagtttattctactccatgtcaaactaacactgttctggattaatatgtggtctcgc

SEQ ID NO: 2340 - DNA, 548 bp, Hordeum vulgare
ttagagccctcgtaattgcgcgagacaccatattaatcagaacagtgttagtttgacatggagtagaataactggctacaataagtgaattaaacacaaggagctgttgttacacaattgtatcatggcatgctaaaaccctacggtccaacagtgatactgcagcagacgacaggcagtccatgtaatcaaccgaccgaaccacacgctactcatagtcgacaatcagcaggatccccccatcaaacttcatggctcacgcagttcgcagaggcggggagaccaatatgacaccatcgcctcggacaaaaaggaaggggatggtacgcctggttgttcgcacaatctcttcatatgtttcatcgtcgatctcaacagttgttacaatctcttcaacatctccaaggatcatgttcaagtgctgatcatatgcatggagcttgccgcggagctcgcggtcggaccggagcttgacgtagatgcgctcgtcgaggctgagcctaatcagatccagcggctccttcaccgcctcgtgccgaattcctgca

SEQ ID NO: 2341 - DNA, 550 bp, Hordeum vulgare
gtccccccgggcctgcagggaattcggcacgaggcgggatcggtttcaccaggagaacgagctcttcgtcggccgtgttgccatgattggcttcgccgcgtcgatcttgggagaggccatcaccggcaagggcatcctgtcccagctgaaccttgagaccggcatcccgatctacgaggcggagcccctcctcctcttcttcatcctctttaccctcctcggcgccatcggcgcgctcggagaccgcggcaggttcgtcgacgagcagcccaccggcctcgacaaggccgtcatcgcccccggcaaaggcttccgctcagccctcggcctcagcgagggaggtccgctgttcgggttcaccaagtcgaacgagctgttcgtggggcggctggcgcagctggggatcgccttctccatcatcggggagatcatcacgggcaagggcgcgctggcgcagctcaacatcgagaccggggtgcccatcagcgagatcgagccgctcgtgctcttcaacgtcgtcttcttcttcatcgccgccatcaaccccggc

SEQ ID NO: 2342 - DNA, 542 bp, Hordeum vulgare
  UNSURE (8): n stands for any base
caactgtncggcatgcatggcgaattagctgctagctcttgtttttataaggcaacgaccaacttcttcttacacctaagtacaccccaaggtctcacgaacacaacaaacaggcaaagcacgtacgtacgtacaattaatggccaaaaagcattcgcacgtgccggtgccgatctagtcgtcgtcctcgccgctgatgaacttgccagtgccggggttgatggcggcgatgaagaagaagacgacgttgaagagcacgagcggctcgatctcgctgatgggcaccccggtctcgatgttgagctgcgccagcgcgcccttgcccgtgatgatctccccgatgatggagaaggcgatccccagctgcgccagccgccccacgaacagctcgttcgacttggtgaacccgaacagcggacctccctcgctgaggccgagggctgagcggaagcctttgccgggggcgatgacggccttgtcgaggccggtgggctgctcgtcgacgaacctgccgcggtctccgagcgcgccgatggcgccga

SEQ ID NO: 2343 - DNA, 518 bp, Hordeum vulgare
cggtgggcctgtgctctgcaaccgcaagcaaagcaacacgtacgctaagcgagcgggagggggagggcggggttggtcggagccggagaagatggatcacgcggcggacacgttccggacggacctgatgaccatcacgcggcacgtgctcaacgagcagagcaggcacccggagtcgcgcggcgacctcaccatcctcctctcccacatcgtcctcggctgcaagttcgtcgcctccgccgtcaacaaggccggcctcgccaagctcaccggcctcgcaggcgagaccaacgtccagggggaggagcagaagaagctggacgtgctctccaacgaggtgttcgtcaatgccctcgtcagcagcggccgcacctgtgttcttgtgtccgaggaggacgaggaggctacgttcgtcgacccaaagctccgtggaaagtactgtgtctgctttgatcccctggatggctcctccaacatcgactgtggcgtctccattggaacgatctttgggatctaca

SEQ ID NO: 2344 - DNA, 553 bp, Hordeum vulgare
ttgcaatggcattctgcacaagctcgaggcactggttctgtcccccggcctcaacgatgcacacagccattcctgagctgaatacatgtatacatggatgtatatttcgtatcatcagtgaacgaattgtggaaagaagcagagctcatgtatgaagctgttcgaggcctccacgctagtatattacactgaatgacacagacgtatagaaaagaaatgcctgatatatgaatcacatttgccagcaaggcccatgagtcgtcgtcgatttacacgccttgcgcgacatgaccgtggatcttcatgcagatcctgccttcttggcttcctccgcgtacagcgccttgatctcctccacgtcgtcgctgctgccgaggaatatcggggatctctcgtggatgtcggtggggatcagatcgagcgaccgtcctttgcctgtgaaagactggcctccagcttcctccatcaggaatgacatggggaacacctcatacatcacacggagctttccgttcgggctcttcttgtctgcggggtacagaaatatgccgcc

SEQ ID NO: 2345 - DNA, 447 bp, Hordeum vulgare
cctcgtgccgaattcggcacgaggtgacgagcaagttctgtgcataggctctagtagaaagaggcctgttctaaaatgggagcagaatactgcatggcccggacacttaaccttgaccaacaaggcactctattttgaggccattggactggcaggtatgaagaaaccattgaggcttgaccttacagaccataattcaaggattgaaaaggcaaaggttgggccatttgggtccaggttatttgactctgctgtatctgtttcatctggttcagcgtcagatgagtggacattagagtttgttgattttggcggagaattgagacgagatgtatggcttgccttcatcaatgaaattatttctgtttataggttcattcgtgaatatggaccaagcgatgatgatccaaccattcatcatgtatatggtgcccacagaggcaagaa

SEQ ID NO: 2346 - DNA, 542 bp, Hordeum vulgare
gtgtggcaaataatctaatctctccttgaaaagctagaagaagagtgccgctagtgtggctgaatttactatgtgtactcctaacctctcgaggaaatatggaattctagtcccacccatcttctagcaagcccatgccgagagatgatactacaaataaatccataccattcggtgtgagctatacctaattggacatcccggctgttatgtacatcttactacaactgtacaaaaaactgtacattacaacacaacgcctcacactacaaatatcatgaagggcggattccattcacatagatgtcactacgttggtcttgcacgtcttccgattctgtctgcctggaagcttttgcggggagcgccttgttgctgttatcgtcgccctcgtatggcagcacgatcacaggggcagcgtgtatcgactcccatcgctccttcaccaagcttttgaatgccgccaccatttctctccggaattctagctccctcgtgaatagatcaagggtagagacggcaagaatgtatctgaaaggaac

SEQ ID NO: 2347 - DNA, 785 bp, Hordeum vulgare
  UNSURE (1),(2),(13),(32),(49),(50),(62),(71)..(75),(102)..(124),(130),(131),(137)..(139),(150),(151),(163)..(229),(253),(254),(256),(258),(259),(297)..(333),(348)..(542),(544)..(585),(587)..(645),(647)..(691),(693)..(696),(698)..(699),(701)..(714),(716),(717),(719),(722)..(727),(736),(743),(744),(761),(770): n stands for any base
nnggtcagatggntgtgtgcccgagtgtgggncacaggggctgcctggnnttttgcggaggncaaaaaaannnnntttgggtggggggggggcacaacacannnnnnnnnnnnnnnnnnnnnnntttttnntttttnnngggggggggcnncccaaaaaaaannnnnnnnnnnnnnnnnnnnnnnnnnnnnnnnnnnnnnnnnnnnnnnnnnnnnnnnnnnnnnnnnnnggggggagaagttttttttaaggnngngnnaaaaaaaaaaaaggggggggggggaaaaaccccccccnnnnnnnnnnnnnnnnnnnnnnnnnnnnnnnnnnnnnaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnncnnnncnncnnnnnnnnnnnnnncnncnccnnnnnntttcccccnctcccannccccccccccccaaccnccccaacancccccaaaaaaaaca

SEQ ID NO: 2348 - DNA, 543 bp, Hordeum vulgare
  UNSURE (57): n stands for any base
ggcaaactgcttatttgtgatcaccaaaaatcgccaagctcaacacgcccttatttnaatattacactggaaaagggagattggacgactggcatggatgatgaactagagtttgtttcactcgctcaaattttacaagacactaatttctgtttcctaaccacacaaataaataaataaattgaacccatacctaccctatggacaactaagaattgaacgggagacaacacttctcaagatatcgagcaagcaattgaagcaggtctagccgctcttcttctacaggggcgggtggtggagtaagtgggagttctgaaggcaggtgtcggtgaaatgagtctactgcggctgcgacaccatcttcattccctattgctatcgccagttccattgatcgtgattttacctcagggtcaagcatgaatctgatagcatttgaaagtgcttcggtagtaagctctgtcacacggataggtacaggacccacaccgcgcgcatgaactatctcgccccagaagaactggtcgccaaaaaaaggca

SEQ ID NO: 2349 - DNA, 517 bp, Hordeum vulgare
ccggctcctctgaaatccccggttctccatccgtccatccctctcccctttcctccccctcgtctaaaccctagatcctccgcccaactgctaaaaccctagcagacgaagagttgctgtgtcgggggcaaggatggccgagccctccagggtgatccacatccggaacgtcgggcatgagatctccgagactgacctgctccaggtggtgcagccgtttggcgcggtcgccaaggtcgtcatgctgcgtgccaagaatcaggcccttgtccagatggaggacctttcttcctcaattagcgccatccagtactacactactattcaacctagcgtgaggggaagaaatgtgtacttgcagtattcttctcatcaagaattgaatactgatcagagctctcatggacggaatcctgatcaggatgaacccaaccgaattctcttagttaccgttcatcatatgctctatcctatgaccgtcgaagtgcttcatcaagtgttttctccttatggattt

SEQ ID NO: 2350 - DNA, 553 bp, Hordeum vulgare
tggtacagaccaagctggcatcattttacaaccatacagaagatacaggcaacaatccttggtcatggtgcaaacaaagacaggtacacataacaaacttggaaagtttagaaagaaagaggggtcatctcactttttccaggaagaactgctatatgttctgcatctgggagaaagaaatcctaatggtggatccctcgagcttgctcgcatgcttacagaccagagcttcggtcgcctcttcctcgctctcgaactgcacgagagcctgcgtcttgccgctcgcctcaaacagctttgacttgacgatggtgccatgctcacttaggtgttcgatgattgcgtcctcggatatctctggtgaaagcgctgagatgtggatgatcttggtcggagcacagcaatggcggtagttcttcgccacattactgttgaaccggttaaggttggaggttgagtagtcatgtgcatcaggagcaggggtaatactcgggtacttagagaagttcacttccagtttctgcccaagtaacattgctccctttaaatagtg

SEQ ID NO: 2351 - DNA, 1123 bp, Hordeum vulgare
  UNSURE (234),(1123): n stands for any base
gtcctccgggcctgcaggaattcggttcgaggctccggcccaccaggccgcgcttctacctgaacgaccttaccgtggcgtgcctgaacgccaccttcaacccggtgttctacctgaccgtgacgctgtaggcgacgattgtcgtccgtaaccccaacacccgtgtttggtatttactggtgaccggacggtacgcctacattcgagtttcaaggtggtattattgtgaccgtntctcacggagtcttcctcgtggttgttccatgtgtcactcttatcattttttgtgtggttttttgttttttggtggggtttattcgggttttttggatttcgtactggctcaatggttttttgtttctttgacttatgacttgttaacaacagctttctgtaccttcggtgtttttatgtccagttgtttttatgtttctaggtttcttgctgttttttgttttttcgaggaggctcgggtccggtggtgggttgtgtagtgttttgtctacttccccttccttcttcctatttccttgctctggcgcgtgtacgctcttctttcttttgcactgtatcgctgtgctttcttgtttttttatctacctctgtttcatttgtgttgtttgttctatattttttgttttttttatgcttttcttgcacttccgttatcattgtggttttgtggttctgtggatgtgttcgttgttttgattcattttcttctgttttgttgttttggtctttttgttcctttctcctgtacgcttttttgtccactttgcggtctcttttttcgccctgcttttttgttttctttgtttttcgtcgttctttttttcggttctatttatagttatctgtttgttttaggtgtttttttttgtggtttggttgagtttcttaggtgtttatgtattgcggggcccatcgttttgtctcttttcccttctcttgatatttctgttttttttgtgtttatatgtttttttttcttttcttttctttgtctctgctcttctgcttatcttctcttttttcgcggcaccacgtgattttttgaaagagagttcgatctatgtgagtgcttggcgaggtttagtgctctgtagtgtattgtgtgtcn

SEQ ID NO: 2352 - DNA, 552 bp, Hordeum vulgare
tgaacatatctttgttgcaagattgaagatagcttgagtttatcagacctcaggtttgagaaacctgtggtttataggccaagctacaccttaaatgataactaagatcacacaatctatatcttgattttatacagtctacatctatatggatgaagctcttgctactttttgatgttttctcagggtgcacagctctttcattcatctcttttttcattcttgtcagctcccggtggggatatatcttgctcataggtgacctgagcaaccaggccaatgaaaattagacccagagcagcaaccttcctccattccacctctggtgttgcaaagacggcatttgcgattgtaagaccgagtatcgccatgagtgcaaggtaaatattcatccgagtttttgaccccgcactctcctctgcaatctctctgaccttctgtgcttcgatcttggccttcaccttgatttcctcattgttttgaggttttttgaccttgccaaggcttttgaagaacatgccttcgtttttctcctcttcgatccagtcttcg

SEQ ID NO: 2353 - DNA, 517 bp, Hordeum vulgare
gcaccaccttcgtcgtcgccctcaggactgccccgggacgcatgaattccttcttctcgacgaaggtaaatggcagcatgtcaaggacaccacaagcattggagaagggaagatgttctcccctggcaatctgagggccacatttgacaaccctgattacgacaagcttgttaactactacgtcaaggaaaagtacacgctgcgttacaccggaggaatggtccctgacgtcaaccagatcatcgtgaaggagaagggcatcttcacgaacgtgacgtcgccgacggccaaggcgaagctgcggctgcttttcgaggtggcgccgctggggttcttgatagagaaggccggcgggcacagcagcgacggcaagcagtcggtgctggacaaggtgatcaccgtcctcgacgagcggacccaggtggcctacggctccaagaacgagatcatccgcttcgaggagaccctctacggctcctccagactcgccgccagcgccaccgtcggcgccaccgcc

SEQ ID NO: 2354 - DNA, 552 bp, Hordeum vulgare
  UNSURE (19),(22): n stands for any base
caacaacaggcatggcttnagnactctataacggacagcttgttttaaccttcaggttgaagggaaaaaaaaagaaggtggggtgattatcaggcggtggcgccgacggtggcgctggcggcgagtctggaggagccgtagagggtctcctcgaagcggatgatctcgttcttggagccgtaggccacctgggtccgctcgtcgaggacggtgatcaccttgtccagcaccgactgcttgccgtcgctgctgtgcccgccggccttctctatcaagaaccccagcggcgccacctcgaaaagcagccgcagcttcgccttggccgtcggcgacgtcacgttcgtgaagatgcccttctccttcacgatgatctggttgacgtcagggaccattcctccggtgtaacgcagcgtgtacttttccttgacgtagtagttaacaagcttgtcgtaatcagggttgtcaaatgtggccctcagattgccaggggagaacatcttcccttctccaatgcttgtggtgtccttgacatgctgccatttaccttcgtcg

SEQ ID NO: 2355 - DNA, 1366 bp, Hordeum vulgare
  UNSURE (1)..(3),(13),(17),(21),(23),(24),(29)..(33),(35)..(37),(40),(41),(44),(46)..(55),(57)..(60),(66)..(70),(74)..(76),(81)..(85),(88),(90),(93),(95),(98),(99),(105)..(121),(123)..(125),(128)..(130),(133)..(136),(143)..(149),(153)..(156),(158),(159),(163),(167)..(203),(212)..(215),(217)..(226),(239)..(242),(244)..(249),(252),(253),(255)..(260),(262),(263),(265)..(268),(270),(271),(287),(299),(327),(329),(332),(333),(338),(339),(353),(356),(358)..(368),(390)..(396),(401)..(404),(409)..(411),(413),(414),(424),(425),(427),(428),(430)..(436),(448),(464),(466)..(470),(472),(473),(478),(488),(530),(565),(598),(669),(701),(855),(1118),(1252),(1289),(1337): n stands for any base
nnnaattggccanttgntaancnntagannnnncnnncannttngnnnnnnnnnncnnnnattttnnnnnttgnnntttgnnnnnttntncananccnncccccnnnnnnnnnnnnnnnnntnnnttnnntgnnnnggggggnnnnnnncccnnnnannaaancccnnnnnnnnnnnnnnnnnnnnnnnnnnnnnnnnnnnnnggggggggnnnntnnnnnnnnnnggggggggggggnnnngnnnnnnccnngnnnnnngnngnnnngnngggggggggggggggngggggggggggngggggggggggggggggggggggggggngnggnnggggnngggttggttggggnggngnnnnnnnnnnngggggggggggggggggggggnnnnnnnttttnnnnttggnnngnngggggggggnngnngnnnnnnngggggggggggngggggggggggggggngnnnnngnnttcgngcgggggggnggggttttttttttgttttgtgttgtttttggtgtttgtttntgtttttgttttgtttgtttttttggtgttttttngttttgttttgttgttgtttttggtgtttgttngtgttgtttgtttttttttttttttgtttgttttttttcgtgtgttgtttttttttttgttttgctttttntttttttttttttgttttgttttttgttgttnttttttttttgttttgttttgttttgcgtttttttttggctctgtgtctttttttttttttgccttttttttttttttttttctttctgttctttttgttttttgtttctttttttttttgttttttttttttcgtcttttcttttttgtcttnttttctccgtttttgttttttctgttcttgtttccttgtttttttttttttcctgctcggtcgctgttcctttcgtgtttctgcgttgttttttgcttcgtcttgtgtttgctttctcttctgcttgtttttttcctcgttcgtttttttttttctcctttttctgttcttttgtttgccggtcctttttcttccgtttttttcttttgtcttttcttcttctcgtcgttgtttgtctttttttttcccccttttttgtttgntttttttgtctgtttgtgttctgttgctgtctctcctttcgttttgttttgtttgtcgtgctcggcttgttgtcgtctgttgttttctgttcttttcgcttcttcttttgtctcttttttttttctctttcttngtttgttttttcctctggtgtgttgttctctttttcncgtgtttttccttcgttcttgttcgcttttttgctctttgtgtcttcncttgtctttctttcgtgtgttcttctgtg

SEQ ID NO: 2356 - DNA, 551 bp, Hordeum vulgare
gtataagacccggcaaaataatgatttccagagtagtacaggtcaaattggtgaagactagctaaaattcaaaacagtcaattcaatagcccatccctcggttgagtagactcaaacatgctgacttcaaaaattccataaaccaagtatacagatcttgttcctgacagcagatggaaaagatacacatagttgagtgctcctatcaccaataatcacggcaggagcatttcccatctctgaaatggtgaaagcggcttacatctctgaccacaatctctcgagcagtgacctgggacatcaacttaatagcaacatggcagtcatcacacacacgtagattcttcattactcggataggaactccttcaggtaagctcagaaacgcaaatgccatcgccaatttctcactgtggtgagttaaactaacttctttctcctcatcctccatatcatggaacaccatgctcatgtctggtgcatagccacattgcctgattttggccatcatttcttccaagtactcatcgatctctccttgccttggatga

SEQ ID NO: 2357 - DNA, 181 bp, Hordeum vulgare
ggactgaccggacgggttctggcgatgctattgttgctgctgctattaggaagttgacaacttgtcctgagatgtatgaggaccaggatacattggagagggagctaagatttgctgttgctgctggcatcatttcacagtggactattggtgccgtgcgagggtttcccactgaaagtgc

SEQ ID NO: 2358 - DNA, 512 bp, Hordeum vulgare
taaaggtaaaaagacggtggctttaacagtagcatatatcaaatacaataaacaattttcatcgtcaggcaatataagtctttcagtggcggagacattttcgtactgaagtttaagtttgttatggtagaaactggatgctaaaatggtagacaaaggtacctgtcaactcttgtggtaaaatattatccttgttcacttcttctgcaccacctatgaatcacgctcataacataaatttctgactccttcatcagaaatgatttactagttaaccaatcaccagttcaccacatagaaggcacatatacttgctccttcaagttctgggtagcactttcagtgggaaaccctcgcacggcaccaatagtccactgtgaaatgatgccagcagcaacagcaaatcttagctccctctccaatgtatcctggtcctcatacatctcaggacaagttgtcaacttcctaatagcagcagcaacaatagcatcgccagaacccgtccggtcagt

SEQ ID NO: 2359 - DNA, 518 bp, Hordeum vulgare
caaagaccaagcaagtctcctaggaatggaaatggctttctagaagacgatctggatttagatggtgatactgctatgcaagaaccatctgggagtacatcagaacagaaggatctttcaaatgtggataggttttcctctgttataaatcttattacagaactttgcttggaggaccgacatgtgatatttcgagatcaagttcggaatcctggctcagcaaccaatgaagaataccatttccaggttgaactagcaggacagattcttggtaatggtattggtgtgaacaaagattttgcgaagcttcaggcggcagaagaggcgctgaggttcttgaaaacaactactgacccacagattaagaagcatttgagaccaataagatgcagcagttgatttctcccccctctggccccgcaaccgaatgagttggaagaaagttggaatgtgaagcgcctctttggggatccctcaaccatgacgtgcatccaccattagcctttggatagggaacc

SEQ ID NO: 2360 - DNA, 543 bp, Hordeum vulgare
accgctatgaacatataacttgaaaatcagcacaaacattccagtttcaacgcccctgaacaatttacaagcaatcgcatccgtcaggaaaactattcacgactaatcctacattcctacctgtttacagccaactacgccagcatcctaccgagatgactacatctgcagttgtagttgtccggaggcaaatagtttaccagaagattctccgacagaaggtagtcaaaagattccacacagctccaagtcccgctctctgccctttccaaaaggttccctatccaaaggctaatggtggatgcacgtcatggttgagggatccccaaagaggcgcttcacattccaactttcttccaactcattcggttgcggggccagaggggggagaaatcaactgctgcatcttattggtctcaaatgcttcttaatctgtgggtcagtagttgttttcaagaacctcagcgcctcttctgccgcctgaagcttcgcaaaatctttgttcacaccaataccattaccaagaatctgtcctgctagttc

SEQ ID NO: 2361 - DNA, 500 bp, Hordeum vulgare
gccctcaagactgccccgggacgcatgaattccttcttctcgacgaaggtaaatggcagcatgtcaaggacaccacaagcattggagaagggaagatgttctcccctggcaatctgagggccacatttgacaaccctgattacgacaagcttgttaactactacgtcaaggttttttacacgctgcgttacaccggaggaatggtccctgacgtcaaccagatcatcgtgaaggagaagggcatcttcacgaacgtgacgtcgccgacggccaaggcgaagctgcggctgctgttcgaggtggcgccgctggggttcttgatagagaaggccggcgggcacagcagcgacggcaagcagtcggtgctggacaaggtgatcaccgtcctcgacgagcggacccaggtggcctacggctccaagaacgagatcatccgcttcgaggagaccctctacggctcctccagactcgccgccagcgccaccgtcggcgccaccgcc

SEQ ID NO: 2362 - DNA, 547 bp, Hordeum vulgare
tccctcgcagtggagacagggcggcagacgtacgcaagcccggccgtccgcccgcccgctgtattaccagttcgcatcatcacaagacaacaacaacaacagcagcatgcttcagactctataacggacagcttgttttaaccttcaggttgaaggggaaaaaaaaagaaggtgggatgattatcaggcggtggcgccgacggtggcgctggcggcgagtctggaggagccgtagagggtctcctcgaagcggatgatctcgttcttggagccgtaggccacctgggtccgctcgtcgaggacggtgatcaccttgtccagcaccgactgcttgccgtcgctgctgtgcccgccggccttctctatcaagaaccccagcggcgccacctcgaacagcagccgcagcttcgccttggccgtcggcgacgtcacgttcgtgaagatgcccttctccttcacgatgatctggttgacgtcagggaccattcctccggtgtaacgcagcgtgtacttttccttgacgtagtagttaacaagcttgtcgtaa

SEQ ID NO: 2363 - DNA, 485 bp, Hordeum vulgare
cggaacagtgctcccaccgccggcgccatgagtaagttgcagagcgatgccctgagggaggctatcacaaacattaccaatgactgccgtgagaagaaccgcaagttcgttgaaaccattgagctgcagattggtctgaagaactatgacccgcaaaaggacaaacgtttcagtggctctgttaagcttcctcacatccctcgcccaaagatgagggtttgcatgcttggtgatgcccagcatgttgaagaggcagggaaaatgggccttgactgtatggatgtggaatcgctgaagaagatgaacaaaaacaagaagctagtcaagaagcttgcaaagaagtatcatgctttccttgcatctgaggctatcattaagcagattccccgacttcttggacctggtcttaacaaggcaggaaagtttccaactttggtgtctcaccaggagtcccttgagtccaaggttaatgagaccaaggccac

SEQ ID NO: 2364 - DNA, 556 bp, Hordeum vulgare
gaagttccagacatagaacaaacactctcagtacaagacaataattgtcactcgacgcgcacgaaaatttgataattgagaaagcaacaaaagttcccaagttgtcaatctcctggaaatcctagaagactagagtctagaacaaccggtacacctttcccattgtgctcttcaggtacaggcaccgcacgttttgccaattcttcttcaacagagagacaaggaagttcacgctcatctgcacgttctggaagatctgcttctcctccatacccaggtggccaacggcaacacccatgcaaagcacctttttcaactggaacttgacagtggccttggtctcattaaccttggactcaagggactcctggtgagacaccaaagttggaaactttcctgccttgttaagaccaggtccaagaagtcggggaatctgcttaatgatagcctcagatgcaaggaaagcatgatacttctttgcaagcttcttgactagcttcttgtttttgttcatcttcttcagcgattccacatccatacagtcaaggcccatttt

SEQ ID NO: 2365 - DNA, 2094 bp, Hordeum vulgare
  UNSURE (14),(16)..(20),(22)..(24),(26),(27),(29)..(33),(620),(812),(829),(855),(928),(932),(966),(971),(1020),(1065),(1172),(1207),(1220),(1334),(1351),(1355),(1368),(1435),(1446),(1493),(1500),(1502),(1528),(1566),(1572),(1729),(1759),(1787),(1870),(1873),(1915),(2003),(2009),(2041),(2044),(2072),(2081): n stands for any base
ttcttttttttttntnnnnncnnntnntnnnnnccaggtcgcaccgacacggcgcgacgacataggttttctcacacaagtgacgcacggcgcacccagtgccgatctaagcaagagagcgggagcaagagcagacacgcgagcgcaatcggagatgaggtgatggatcgagtaggtgctttttttgtgcgcgagcgcccatcagtgtcataactggagagaaacgcgcgcgccacgcagcgaccgcggcgacgcacagaggagagcgacggcacaacacactgtgcgtggctgatcttatctcgcggcgcatccgaccgccggcaccgtctgccgcgcaggcgcaccgacagcatcgacccggagctcgcacgcagagcatgaggcaggcagaggacaagcaggcgaaagcagccacacacaccaaccgacgcgacgcaagagtgaatgtcgactcagacacgacagcgaaccgacgatctctacgtccacccatcgcatcaactcgtcatcgaacacaccaccacctgcgcgtgtaggaggacacgacacagacgcgcccacactcaggccttaatttctgaagtcatcctcgccggtagctccagccagccaacgcncccgcggaacagccagaagacagacacagagcgcagagacgaagagcgagctagaactacaacatatagagccgcaaccagaagcaatcgatcgcgagcaacgacatatcctgttcgataatctgcgaccaccagacgtccgacaatccgaccagtcaataatataagacgtgcgcacatatctcacgacgngtgccacatccgcaaanatcaaattacctaccaacacctaacngcacaaatacataattcacattcacacccaagccgctatcttacaccacgcactactacgctcacgcaacacntatntatacaaaaaacccttcagacatatgaatacccnaccanacacgatatgtgtactctgaccgaaacgcgctaaaacgtaatgcgcgcngcgaatcagagtcagtgcatatgcacacagaacacgagacaacanccgtgcgagcagccgcgccagctcaattaatacacggcagtcatgttcgaacagtaataacgcgaattacaagacgaacatcatatcacatccgttacgccacacantgatgacgcacgaccagttcaactcacagcgattnaccaaccacgcangatcaaaccaccgcaggcccgacatcacaataatcgcgcacgtcaccagcgccaacggcatgtcgcgcgcgagtaatcgtgcgcgcatcgcacatcctaagcgcgagcgcgcgncccagatacacgacacncaanatcaccgatacgncgcgaccgagcgtcgcgacgcagtacacgtactgccgcccacacccaccgcttctcgcgcatcgtantacgtgtgtcngagacgaagatcgcgacatggcgcgtaagtcgctatcgaacacacanccgcgtnancacaaataatccaacgcacgcatatncacatttacgtcgcacgacgcgcgcgcacacgtcatanaaacgnctaattgttgcgtgatgcagatcgatagacacgcatgtccaactgacgcgcggagagacgcgagtcggcaatcgacattatatcacgcgacacactagtgcgcgaccccaccacacgagcgcgagtgtgtaacgcgagtaaacgagcacagcaaagnacaaaacgagtgtagagagcgcgcgcgaanacatcatttgtacatcacgacatacagnacgcccacgaatcgcgagtagacggcgcgacacacaacgaccgtaggtgaaggcgccaccgacgtagaccgcaggcaatcagntanagacggggatatcgcggggacgacaataactagcgtacaccngaactatacagagactatattttaccacgaaatcgcgtattagcacgcacgtcatatcacgcccacaccgccagcgctccatcgactncatcancgccaatcgcacaaccgccaccacagacaccngcncgtagacgacacagctgccatccgcatntaatcgggntatcgcgctgaag

SEQ ID NO: 2366 - DNA, 526 bp, Hordeum vulgare
ctaaaggaaaagcacagagcaactttagcttacaacttcccgggtttacatacgtagtacaagcgacaacggcaacttattgcactacacctcagctacagcactagagtactactagcttattagggcatataaaagcagctagctaatgatctacatccatacaaattaccatattcagacacagtcgttgcccaagcgacgaggggcaataagatacgtacgtacgtacacacaacttgatgtcctgtatttacaatcaatcatgcagctggatgcaacggagtcacccagtcagggcagtcctgcctctgcccagcaagggagtagtacgcgagaacctgggcttgcctctccccacagggttcacggtcgagcgtcatgcgatgcaggccgccagggctcggaggcgtgaactcgatgttccagaatggcctcgccatgagaaggagctcgaggcctgctggggaggccttatagccttgcacccatatgtacctgagcgacggcatatggagcaccgcga

SEQ ID NO: 2367 - DNA, 516 bp, Hordeum vulgare
ggcgtactgaaggggtctcaagcaccgatatagtcggtagaatattgcaaacattcaagcataaagagggtgttaacgagaatgctggcgtggaatcatgcgatcagatgaaaacccagctatccaattttcttccaacttcccgccggataatgcagttttcaaatgggcaggctccttcgccaggtgctcgtgttgtttatatagatggtgcatttgaccttttccatgctggtcatgttgagatccttagaagtgctaggcaacttggtgacttccttcttgttggtgttcatgatgaccagtccatcagggaaaaaagaggctatcctcctatcatgcacctccatgagcgtacccttggtgtacttgcctgtcgctatgttgacgaagttataataggcgcaccatgggaggtttcaagggatatgatcactacattcaacatttcattggttgtgcatgggacagtaaccgagggtggttctgctagtgaagttgatccgtatgcccttc

SEQ ID NO: 2368 - DNA, 530 bp, Hordeum vulgare
gatataaatctcagtgcccgtggtagcagttaacaccaaatcaatgccaagggctgaacataaccttctctggttacacaaatcaaacaaatgtcaacagatcatcactaggttgtttctcagcagtatatatactttaaactataacttagtacaattaggaagtatgcaactctaatcacttcacagacccttaagtaataacatacaagaatacaacaatggtctgctgaaggtgttcagcgatgaatatttcccctccagggataataaagtaaaaaaagaatcatgtatgtgaattcttgctgttaagtggacattccagccgaaaaagggcaacagtagaagactggcagtctgttaatttatttccttgagctgattccctttgccgaatggccatcaacttatcactgactactttctatagctgagcaattgttgcaatctgttatagaataactctttagtacagaggcaccatgaatttcctcagcttgcagcaaaactgtaagctcctttgcagcatt

SEQ ID NO: 2369 - DNA, 518 bp, Hordeum vulgare
gctggaaataccatcggcttacttctttcccctattatcatgtcacgaactggaacatttggaccctttgtgatttttggtttgtttggatttctgtgggtgctggtgtggatgtctgctataacaggaactcctggtgaacatcctcaaatatcagcatatgaactagagtatataacaaagggtcagaaattggtgaaacctcaagttcaaggtgaaaaactaagaaagatccctccgtttagaaacctactttctaaatggccaacctgggctttaatttctgcaaatgctatgcatagctggggctatttcgtcatcctttcatggatgccagtgtatttcaaaaccatatttcatgtcaatctgagagaagctgcatggtttagtgcaattccctgggtcatgatggcagttttaggttatgtggctggtgttgtatcagatgcacttatccgaaatggcacaagcattactttaactcggaagataatgcagacaattggctttgtgggtcc

SEQ ID NO: 2370 - DNA, 547 bp, Hordeum vulgare
gtttttgcagtagcctacattatgagtttaaatgccctcaacgacttacattgctgtctttacaccctcaacaggttccccactttgtttgtgggttcctggtctcaccttttcactaatcatgcagtacatctgctagccattttaaacaagggcaactcttgccacaaaaactacgctagttcaagcctttcaactacactggcaaatatttttcaatccctaccactaccattgccagtttgccacccctaaagcatgactcctacaccgccatttattctctggcatgcttcaagcatccttgactcttgaaattcacatttccgacttatacagcggaaagattcacatgatctaaacctctgacactctgcttccacaataagacaattcaccacatacttccactacattgaagcacacgatgtggtagtccggatgtgtaatgctcatctcggttcatggaaattctcagtactgtccgatatgataatgccacaatactcccagtgaatcatcaaatcgtttactatatgtttcctct

SEQ ID NO: 2371 - DNA, 519 bp, Hordeum vulgare
gtcacgaggcgacggagtaccaagccctggaaattgccagccgtgtcgaggcatcagtctacgtgtggcgccggagggttcctgcgaaaccggtgaacggcttaggccgcaccgccagcgcaaggtcctggagcatggtgaaagacatgttgatggattcagagaagagggagctgctggcggagcgagcagagggcctcttgatatgcctgaagcagaggttccctgcactgacgcagacaagcctggacatgagcaaaatccagtacaacaaggacgtgggcaagtcgatcttggagagctactcgagggttctcgagagcctggcttcgaacatcgtcgcgcgcatcgacgaccttctcaacatcgacgagctgaacaggcacgtggagcaactgtcaacgggtgaagcggacctgaagatggcttgcggcagggtcgtggtgccaccctaccagcaggtgcctgcctcgggcgcaccgtttgtgacggcttacaccacgcctagcttctccccgg

SEQ ID NO: 2372 - DNA, 463 bp, Hordeum vulgare
gtttcttctattcttcttttggaggcaagcagcaatacacagcagcttcttctcgcagaaagaagaagaagcggtactccatagcttagcactaaagagttcaaaatacagtaagaaggcgagcacaaataaaggacacatgtacacacagagagactggcaggcaggctggtgcccgccccttggcaattctacgagcagtccactggcctcctagcttacatatccgtagtcgtcgagacatcgatcatcgtgctccggttcacgatgatcatccccctgacctccgggccgagatggtccgtcaaggctttcttcgtggcggcggcggcaaccttgttgccgtgagaccgtctgccggcagagagcgaggtcctcgggctcgacagtcgccccggggagaagctaggcgtggtgtaagccgtcacaaacggtgcgcccgaggcaggcacctgctggtagg

SEQ ID NO: 2373 - DNA, 521 bp, Hordeum vulgare
gcgcccgagcaactggacgaccagatggggagaccacggaagacgaaggcgaaggccgaggccccgccccccgccctctccatcggcaactgcaaggtggagatccacgggagcggcctaaggtgcgcgtccacggagcagaatctcaccatttcgggaaccaggggcgcgaagattctcatcactgtcgatggagccaggagttcttcgggtgggactggtgaggggtctgatttcatccttctgaaccccaatgaagccgatagcctaaataaatctttgctccaggaagtattgaggctttataagaaggagctttcaactatggactatgctgctgacactgggaaaaaatcaggatttctcgaaaaatgcataatgaatgggaagtacaagactctaattctgaggtctagttcacttgccgggcctgaagagatcatagctgctgtatcatatcagatagtgccagctgacacacaatatgctgaaatacccctggcagccgtgacatcgccttt

SEQ ID NO: 2374 - DNA, 555 bp, Hordeum vulgare
  UNSURE (25): n stands for any base
gaaagttggtccagtttgataattntctacatgcagtccatgacggatggccatatctttacagaaaagccctaaagctttgagacaccggatttacaatagccaacgaaggcaataacttcgcaaaagtaagtataagttcagcccctcgactataaattaacttggagcacatcagagagattctgcaaacgggggcgcctcaagatcaacctcttgcctcatgacacaggtcatgagccactcactgctgaatgtctttatgcctctttttgctgcatccattgcaagctccatgccttcttcacaagccaagaagattgtctttgagggctcatctatgtcatccagcttattgatgatcttgccaccagaggatttgataactggagagaggacaccaggagagggttcgatgtgcttggtcaaacagaaagtgtagccagaaaataataagcaaggcctctctttagccctcataaccgcatctctcatttcagacttgtacttcatcttatattcttcatcatccagaacatgttctgcttcacctac

SEQ ID NO: 2375 - DNA, 517 bp, Hordeum vulgare
ctgtcgtctctctgttagatcttaaagtgataccagtgtttaatgagaacgatgctatcagtacgaggagagcgccatacgaggattcatccggtatattctgggataacgacagtttggcgacgctgttggcaaaagaactggacgctgatcttcttatcatgcttagtgatgtggagggactctatagtggtccaccgagtgatcctcaatcaaagattatccacacgtacatcaatgaaaaacacgggaagctaattaattttggggagaagtctcgcgtgggaaggggtggaatgcaagctaaagtggcagctgctgttactgctgcatccaagggcgtacctgctgtcattgcaagtggatttgtaacagatagcattattaagattatgcgaggagagaaaattggtacgcttttccataatgaagcaaatgtctgggattgtaccaaggaagtgacaacccgtgagatggcagttgctgcaaaagattgctcgcggcatctccagaattt

SEQ ID NO: 2376 - DNA, 549 bp, Hordeum vulgare
gtttctcagaacagtcagctgcttacatatatagcatagatgtaccgatgcaattctacagttacaacagccagtgccataactacgacattgtatggataaatcattgtacagcaaaccgaaggcaatcacggaaccagatagcgacacagtaacaacgttctcctgtctttcttcattcctcgcgcaaagagaagggggctttgaagaggattattctacaaaaattgatttaactacagcaagaatcctctaccctcattgcaaaggaagatccttgtgggtgtacacaactcccttgtctccgttcactacttgtccactccctcgtagaatgcaccgagtggttagaagaccgtcgacaccaacaggtccacgggcatgtatgcgccctgtgcttatgccaacctctgcacctagaccgaagcgagtcccatcacagaaccttgtgcttgcattatggaacacagcagcactatcaacttgttgtaggaaagtatctgctgacttcttatcggttgtgataatacaatctgtgtgtgcacttcc

SEQ ID NO: 2377 - DNA, 463 bp, Hordeum vulgare
ggcacccctccccccctacccattcccctcccgctcggcccggcgatggcgcaccgggtggacaacgagtacgactacctcttcaagatcgtgctcatcggcgactccggcgtcggcaagtccaacatcctctcccgcttcacccgcaacgagttctgcctcgagtccaagtccaccatcggcgtcgagttcgccacccggaccctccagatagaaggaaagactgtgaaggcacagatatgggacacggctggtcaggagagataccgtgcaattactagtgcttattacaggggtgctgttggagcactcctagtctttgacataacgaagaggcagaccttcgacaatgttcagaggtggctccgtgagctccgggatcatgcagatgccaacattgttgtcatgatggtcgggaacaagtcagacttgaaccacttaagatcggttcctgaggaagaca

SEQ ID NO: 2378 - DNA, 541 bp, Hordeum vulgare
gaaataatcttgttacacatgttgttcgatttctcgattgtacaagtgaaatcgatgatagttataagaatacaaaatgggaatgatttgatggagaggcaggttatagagtatggtaaaggtgttcttgcgataggaattaccagtcatgggattcaggatgagaaacaagaatatctgagaccaaactataacctatgtatgtcatggtccagttctgcgaaaacaaaagtttccgacaagaatcacttccactggaaccagttcttcaactggaacagcaagaaccttttgcgttggtggatggttcagcaacgttaatagtcgttccttgcatcgaacgcccgttggcagcagcggactcctgtgctgcaagtgcttttttgcttacaatctggtgaatttcactcagcacagtatggaatgccttctccacattgattgcctccagtgcagaggtctcaaggaaagagaggccttctttctcagagaatgcttggctgtcttcctcaggaaccgatcttaagtggttcaagtctga

SEQ ID NO: 2379 - DNA, 494 bp, Hordeum vulgare
cgccgccgccgccgccgccgccctacttcccccgtttcgacgtccagcggccgcgtcaagaatccgccaaccggggcggttactgcgggtatccgtatgtttcctaccagaagctcggatgcgattaaaaagcagtaagctcgatcaatgccatcgccccgcggtttccccgcactggaaatcgttttgaattttgtcttccaaagaaaacaaatggcaaacacggacagtgtatgagattcagacttttgaatccaccctgtcgtttgaaaaacggaattttccaatacgtgtgctgccatcaaaggacccctggtggcaaacatttcaggcacaggtgcaatccatttccatacaccaactgaacccagaacagaaagctgccaggctaagcttgctacgtacagtagtgattagtttgcacttctattgcacctcttttgtcaatttctttgctagattattgtaacgcgtagcatgtcttttgcttcgtt

SEQ ID NO: 2380 - DNA, 532 bp, Hordeum vulgare
  UNSURE (21),(28),(29),(37),(38): n stands for any base
taaaaaggttggcttttatanaacaatnnacaagaanncgaagcaaaagacatttgctacgcgttacaataatctagcaaagaaattgacaaaagaggtgcaatagaagtgcaaactaatcactactgtacgtagcaagcttagcctggcagctttctgttctgggttcagttggtgtatggaaatggattgcacctgtgcctgaaatgtttgccaccaggggtcctttgatggcagcacacgtattggaaaattccgtttttcaaacgacagggtggattcaaaagtctgaatctcatacactgtccgtgtttgccatttgttttctttggaagacaaaattcaaaacgatttccagtgcggggaaaccgcggggcgatggcattgatcgagcttactgctttttaatcgcatccgagcttctggtaggaaacatacggatacccgcagtaaccgccccggttggcggattcttgacgcggccgctggacgtcgaaacgggggaagtagggcggcggcggcggcggcggcg

SEQ ID NO: 2381 - DNA, 534 bp, Hordeum vulgare
gccattcggcacgaggcaccaactccttcaacagcctcgcttcctgcaactgcgccgcgccttccggtggcctctgtgccatgcaggcgccgcccgctctcgagttccccacgccggagttcctgcacccgccgcacttctatcaggatctgagccctgagagctgcgtggtggaagcaggcggcgcgtggccgccgtgcgaccccatggaattcaaccctcttcctgacgcgctgctctcacaatcctcgtccttcgcgtcttcaaatggcagcagtgttgcatttccagagggcttcgagccgtggctcagcacggcggatgctgtgcctcatgctggcttgagcgattttgttctgcagagccaacaagcggcgcagttcagccgaggatttgaagaggcgagcagatttctgcctcaagagagcaagcttgtgattgaccttgacagtttaccgtcagtttgggtgaaacaagataacaaggttgtggaggtcaagagagagaaggctgatgctcaagtggcaattcatc

SEQ ID NO: 2382 - DNA, 556 bp, Hordeum vulgare
  UNSURE (25): n stands for any base
tttcataatactggaattaagacancatgtatttacaattcttaattaagcaaatgaaaaaggcacatacttgaaacattactgaatggtactctggattctggaaggaagaatataatacaagactgaccatgcaagaagcacctatatctaacataactaagcctgctccaccaaaaatgcactaactgttcctgtgaaaactaaccgtgtatgggcacatacaacgggcaggtgctacagaagagtaatcaggttcatcatctactaacgggttgttggccaggaacaatcagctctagagtccaaaaatatgaacaggtcaccatttacagaagctaggaagattggggattcgccttccatgttgagagggcatacaggatacgccccttccatccttgtagtaaccacttgttgtcctcgtcgatgatgaaattcttgtggtagcacttcaccttctcccgcgcacgcttcatgatctcctggtccagcgggagctgcttgaacccagctctctgattccgcacctgccactgcttgtaggtctctggcc

SEQ ID NO: 2383 - DNA, 458 bp, Hordeum vulgare
agctcctttactgtgtgctctctctctctctctccccccacccccgctccccttctccaagcaagcagctcgaagccccgggtttggttccccaaaatggcgaaatcgccggccgatcggagcccaatctgagcccggaagctcggcagtagtccctccctcgcccgatctcccgaatccccaaaagctcccccgttggaaatggccgccactgtcccgatcgggctcgcggcgctcgattcggtggtgttctggcccgggggacccgagagctgcaggttttctgattgactctgactcacccgtggttgctctcgctcttcggtggggttccgggtgtctctctttcgccgggacgggcaatcggtggattggaggaatgctcagcgagagacctttggcgatgcgtcaggagatgggcggcccgagggaggaggacgagccggaggacgagcttg

SEQ ID NO: 2384 - DNA, 401 bp, Hordeum vulgare
tttttttttttttttttttttacagaaaatgaacaatggacagaagctaacttcatactcctcagttatacacacgggacagcgataaaattttgttctagacagctctgatagctctctctcaggattgcaaatttgtacgctcgcaaaatatcgactctcctcccctttttacacctagacgacaacttatacaggacgcctatcttctccacggcagcatcaggtgggtaaactcgctcagccaaaccctgacacgactataagctcaaactacaaaatgtacaaagtctcaatacaacatgtttatttctaacttggcttgcagaagcccaaaagaaggcggcagaaggtagatcttggtggccatggttagctgtacatggtcattcctatgccat

SEQ ID NO: 2385 - DNA, 539 bp, Hordeum vulgare
gttcccggctgagattcgacgggcttgggttttaactcgcatccttctcaggttagcaggagaccggccatggcgccgtcgcagcccaagtcagggctcttcgttggcatcaacaagggccacgtcgtcaccaagcgcgagctgccgccacgcccgtccgaccgcaaggggaaaggtaccaagagggtgctgtttgtcaggaacttgattagggaggttgctggctttgctccctatgagaagcgtatcactgagcttcttaaggttggaaaggacaagcgtgcactcaaggtcgccaagaggaagcttggtactcacaagagagcgaagaagaagcgagaggagatgtcaagtgtcctcaggaagatgaggtctggtggtggtgctgctgccgacaagaagaaatagattttgcatgttggcgaacattatttatatcaatgctttgcctcgtattttcagattatgccaagtttgtagcttgtggaaattggatacgagtgtagcgctatctttaagtttatatcaatgctttgcct

SEQ ID NO: 2386 - DNA, 554 bp, Hordeum vulgare
gtaaatagaaagcatttagtactatagatagtggattacggaaacaagaagttcacaaaaaagagtgtcaaaaataaaagttttactctaaactcagaatgcaatgtactactatgtcaatccagttgggcagatagtgctgaaaattcattgttttactctaaacttgaaataatctaagatgtgaggcaaagcattgatataaacttaaagatagcgctacactcgtatccaatttccacaagctacaaacttggcataatctgaaaatacgaggcaaagcattgatataaataatgttcgccaacatgcaaaatctatttcttcttgtcggcagcagcaccaccaccagacctcatcttcctgaggacacttgacatctcctctcgcttcttcttcgctctcttgtgagtaccaagcttcctcttggcgaccttgagtgcacgcttgtcctttccaaccttaagaagctcagtgatacgcttctcatagggagcaaagccagcaacctccctaatcaagttcctgacaaacagcaccctcttggtaccttt

SEQ ID NO: 2387 - DNA, 196 bp, Hordeum vulgare
  UNSURE (125),(126),(135),(136): n stands for any base
aaggctgccgccgggagccgcaagaccaccaagcgcggggacagcatctggggcgcctggttcttcttcactttctacttcaagcccctgctgtcggacaagggcaagagcaaggggtcgtccgnnggacgccannacggcgttgtcggggttcgacaagacggacctccgcctcgacatgttcctggtgcagcac

SEQ ID NO: 2388 - DNA, 453 bp, Hordeum vulgare
ccaccaattaaattttattctgttaaccgaacttggtacagattcaaggagaaacaggcccacgatatgctaggagaacacgagggttaaaaagacacccgtcacatacaagctagaacaaactaatcttcagcacaagcttgttgctgaaggaggcctagcacaataagcaacagcaagtctcggaacaagatgctaacagttccaacttctcgccccttggagcatatgatctggtgatcacaaacaagatagaccatccattacctatgtcataagcaggtcgttgactccaaggtgaggagggcgcatggagaccctaacttcatgttcttcaggctcgtttccccgtttggggaccatgatctcaagaactgcagcagcctcatcaaagtatgcctcaagcttggcaccttcaggtatacgggtggctagaggtatttcacggatgaa

SEQ ID NO: 2389 - DNA, 466 bp, Hordeum vulgare
  UNSURE (436),(439): n stands for any base
caaccaatggcctgacgccagccactgctagctagctggcgtgtacgtagctcctgtcggcgacgaccggccggcgacggcggtgcgcggcggaggtatctagctagctagctagctaggcgggtgttaggccgtgtagggcaactatacatctttggcaatgtcttcttcttcttcctcctcctccgatggattattggaagattgtaatggagtgtgtaaactgtgtccgcatccttcctagagatttcaccatcttgcgtttctacgacctatactagtgctctgttgtttcgttaaaaaagagatatactatattactagtggtctggtctggttgtggaggctactgtattcctgtttgtggcgagctcgtgtttttgtcatgccaactttttactgttgatttttcagcactgcaaaaatgggttgtatngtnaaaaaaaaaaaaaaaaaaaaaaaaaaa

SEQ ID NO: 2390 - DNA, 435 bp, Hordeum vulgare
  UNSURE (90): n stands for any base
tatcaacccatttttgcagtgctgaaaaataacagtaaaaagttggcatgacaaaaaacacgagctcgccacaaacaggaatacagtagncctccacaaccagaccagaccactagtaatatagtatatctcttttttaacgaaacaacagagcactagtataggtcgtagaaacgcaagatggtgaaatctctaggaaggatgcggacacagtttacacactccattacaatcttccaataatccatcggaggaggaggaagaagaagaagacattgccaaagatgtatagttgccctacacggcctaacacccgcctagctagctagctagctagatacctccgccgcgcaccgccgtcgccggccggtcgtcgccgacaggagctacgtacacgccagctagctagcagtggctggcgtcaggccattgttg

SEQ ID NO: 2391 - DNA, 298 bp, Hordeum vulgare
ttttttttttttttttttttttttttgttataatttcctttcttttgattgataggcactgccctatagaccacatataggtgatacggcttttcaggaccacgaaagcagatatccagacaccaagaaggaagctaatttttttgtcataaaacattcaggtaacacaacatctagcatgtcatactcagaagttgagcaactgatatcatgaaacatgtctgcgacacatggaccagtaagtaacatgactacttgttcttcccggtcttcttcttacccccggtggttgctggtg

SEQ ID NO: 2392 - DNA, 330 bp, Hordeum vulgare
acaacagatctccctactccacatcacggtcctcttcccctccggcgactccagcgcggcggcaaggcggaagcaagatggattggcaggggcagaagagcgcggagatgctgatgcaggtgctgctggtggcgtcagcggtggcggcgttcctggtcgggtacgcgatggccgacttccagctcatgctgctcgtgtacgccggtggggtggtcctcacggcgctcgtcaccgtccccaactggcccttcttcaaccggcacccgctcaagtggctcgacgccgccgaggctgatcgccacccccgcccgcagatcagcagcgcaccag

SEQ ID NO: 2393 - DNA, 940 bp, Hordeum vulgare
  UNSURE (745),(831)..(939): n stands for any base
ggacccccgggcctgcaggaattcggcacgagggagagaactagtctcgagttttttttttttttttttggagggaccaccataatttggcttatagatttttaaaaattaaccacgggcccggttaatagttttaaaacaaagacccccattcccaaggggcttaacagattccaaaatacctaaacaggcaaggggggttagtcaaacaaaaaaaaaacaccttaggggtccctggggaaatatcctactaacacatttaaggtcctttaatggaattttaatttccctttttaagaaaaaaaagcctagccttttgccaccaacatttttacccctagcctcctaagggcccatgatcccagcaaaagttgtcagcccatggtacccaacctgccgaaaaggaaaaacccttgcagcccatccctaaatttccttgaccccaacttaaaaggggggcctggtgaccccacatttgttaagccggcctttaaattaaaccacgattttgccaaacctgggataataaacatactaaaactcgccaatgtttccgggcttttgcatgacaatagggaacttgataatgaccttggaaaaaggcctgataatgacctgccttttcccacgcttttaagggttgaacatgcttttgagagcatatttaagaaaattgattttaaccatccttacctttagggagcgagccaacctttgcccttggcggcggcggcggcggcggcgncttttgcggaccgagagcggcaaccagggaaagagagcgagagagaactagtctcgagggggggcccgggaccattcgcatagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 2394 - DNA, 532 bp, Hordeum vulgare
  UNSURE (23),(28),(29): n stands for any base
tttttcagaattaaaccacaggncacanngctcatagttttcatacaaagacacccaatcccaaagtgcataacagattccagaataactcaacaagcaacggcagctagtcagacaaaaaaaagacaacttaggtgttccttgggaaatatcctactaacacatctcaggtactttcatcgaattttcattttccattttcagtagaaaaagcctagcactttgccaccaacattcttacgcctagcctcctcatggtccatgatcccagcagaagttgtcagcacaatgtaaccaaactgacgagaaggaagaagccttgcagtccatccctcaatctccttgacaccaacatcaaagcgaggactgatgacaccacacttgttcagcctgccattcaattcaaccacgatcttgccagacctgtgatcatcaacatactcaaactcgccaatgtatccgtgcttctgcatgacgataaggaacttgataatgaccttggaagaaggcctgatcatgacctgcctcttcc

SEQ ID NO: 2395 - DNA, 472 bp, Hordeum vulgare
gagctcgcgcctcgcggatctcagttttataacttgccaacttggctttggtaattcctgggactgacgaaccactcaaaatggtggttctggcagcttctataatatcaaagtctggaaaggcacttgcttcaaggcaatatgttgacatgtctcggataaggatcgagggactacttgcagcatttccaaagttggttggaactggaaagcaacatacttatgttgagacagaaaatgttcgttatgtttatcaaccaattgaagagctgtatctgctactcatcacaaataagcagagcaacatccttgaagatctggacacactgaggctgctctccaaaattgtacctgaatactccccttcattggacgaagagggtgtccgcaaggccgcattccaacttatatttgcttttgacgaagccatttctcttggaaacaaggaaaatgtgactgttccacaaattaa

SEQ ID NO: 2396 - DNA, 399 bp, Hordeum vulgare
gggacgagtgtgtatatatttcatattgtatctgtgggcatgaagaacgctacgttccattcaaaaatttacaatatgaaagtacaaaattgcattttcgtataccagctatttatcctctatatcccatgaaattcttgagccgaaagatgatgtcacaacggctcaacaagtcatgaccaaaaaacaaaaggttcatatatatactccagacatgcgcgcaatcacctgactagaacaaacggcctcagaccacctgatagttagcagtgatcagtcgaacctgctgtgaatattttgaactacctccctgcaatggaaggatggcggtaaccttcacgttactaaatgtatttgatgcagaaaatccaaccgagatgggaaaaaatgttgatggat

SEQ ID NO: 2397 - DNA, 442 bp, Hordeum vulgare
tgttcctccgccacttatccgcaatgcctcccccggtctccggttggttgatctgacccgtcgaggtcgagccgccacgacgggtggcttcagagggacgggaggtgggcgggcagggcagggctttcggcggttgcttgcctttgaggtgaaagctcgcacgccctctttctctcccgctcgatgtggaagtcggatctcttgttttcctctcgggcgccgcgctcttcttccttgccgcgctcttcttctctgctctagtttgaggtgaagaaggtgcataaaagggacaccaagtatggcaaagaaagggaagtggtttagtgctgtcaggagagtcttcagctcctctgatccggaggggaaagaagctaagactgagaaggcagacaagcctaaatccaggaggaaatggccatttggcaagtcaaagcgctttgat

SEQ ID NO: 2398 - DNA, 400 bp, Hordeum vulgare
ctttcaggcaggtggttaacaatagtagggactccaagccaataatgtacatacctctcgaaaaactcataatgtacactggaaaaccaagcgcacaccaatcatctcaccttttttttttacctcttcacattccttctctgcagcatcacacaccacaacccacagtgaaaaaacctttgtctgcaaacagttagaatcgtctcaaatcaacccggacagatcatacagtttcacggagggttcaaccttgcaatctaaactagagaatacaaaaacggaaaagatggcgatctagcaatcataggtgacaatgcctgacgttcattggatcatatcaggcaacatggacatccttcagggaggcaggatccaccttcggaggatccgaatggcgcct

SEQ ID NO: 2399 - DNA, 510 bp, Hordeum vulgare
  UNSURE (184): n stands for any base
cggtgctccccgcctctccccgcacgaaaccgacaacggcggcgtcctcccctcccgcggagcagccggggccggctcgacggcctcccccggcgtacaaccctactcctctcgggtccagccctccggctccacccggcccttctcatcccgacctagggtttgtgcgaccccgcttagctcngtcccggcttcacccagtcgcgggcataccgaccgcctccccgagccgttcgagcacagacctcctcgcagaggcaccgttgccgccgcccccgccgccgccaagcacgaggctgtttgtagctaaatacaaggaattggtgcaatatcaggtcatggaggggagcaagaacatggaagagtcagacactgcatctgttgtcaaagtatacagggagcctgccatcattatcaatggtgtcccagacttgcctcctgatttcgcatctggttcacaaccttcagtaagagatgctccaggatctcgagttgatcatcgttttggtg

SEQ ID NO: 2400 - DNA, 550 bp, Hordeum vulgare
ggaaagcaattgatagcactcgaatagtaaattagctttacaagttttgttgtacgctgggttgtacaaagtacattgaaagctagtgtcaccagcatgcatagactggaatacttagacatatctgtattgtaacagtgagattgattgtattgtaacagtgagattgattgttaggttatgccccttgaacacgcaagctttctctcttcagtttttctgccctgacagtctctgcattgcgcttatgaacactactctcagatatgttcttttcttttggaggtctgcctctttttttaggttgagtgtcacctgatatagctctatcctttcgaggcctgccccttttttttaggttgagtgtcacctgatatagctctatcctttcgaggcctgcccctttttttaggttgagtgtcacctgatatagctctatcctttcgaggcctgcccctttttttaggctgatcactaggtttcacacatacatcttcagtttttcttttggagctctgcatcttcagtttttctgccctgacagtctctg

SEQ ID NO: 2401 - DNA, 429 bp, Hordeum vulgare
attcagtaaggaatagatcggggtgtagtttctcctgaaatattgcagaacttttttgacctcgagaaatatcctgtcgtggatgaattgattcaccggttccaaggtttccgtgaaaggttactggcagatccccaattcttgaatagattagctatcgaagagggtatatcaataactacagctgtcttagcacaatatgaaaaacggaaaggacggttttttgaagagattgactatgtccttactgatacaattagaggttctgttgttgacttttttacagtctggcttcctgctcctactatttcgctcttatctattgctgataatggttctggtgagagcttggagcttgtcagaggattgttagggtcactgccagataatgcatttcaaaagggtattgtgggccagaattgggacatt

SEQ ID NO: 2402 - DNA, 551 bp, Hordeum vulgare
gttccagtggcaccaaacacaaaaaatggagatacagtcatacagtccaatttctaccagtaccagttgtggtataagttgtactgtacttgaatccaactcatttgatcaaatacaactcatggctgccaaacaggatggggattttttttttctctctcatggaaactcaacttgtgttgccgaattgccaatccaagatgacaccaagagttcaaatggtgttgcgcgtttcaaaatttgactgtttcctgttgatgtacatatggttcgtgtatttacgccagaaatgtgtacaagaagctccttttagccgtgagaaaagaattgctcaaataaaaactctgctcttcaaaatttcatgtcttctttcccgaaaaacaatgcaatgtggttgggattcagtcttgctgtacgaagaccctgtgtctatatgcctgtactgtatgcggtgtagcataagatggagactgttccttgagttggatgcccacagccaatagccttctggctatgtctgctcacctgattggttcttattaatatcgtct

SEQ ID NO: 2403 - DNA, 542 bp, Hordeum vulgare
  UNSURE (4): n stands for any base
gggnctgcaggcaattcggcacgaggatcttctccgcgccgcccggcggcaagaaggccaaggtgatggccgacggcgacgacggcatggtcaccagcttcagcaacatcgactcacagtttggctcgtctctggacatgcccggcatggacgactacctgcagctgcagcaggactccgtcgcctgcagagtccgcgccaagcgcggctgcgctactcacccgcgaagcatcgctgagagggaaagaagaacaaggatcagcaagaggcttaggaggttgcaagacctcgtgcccaacatggataagcaaacaaatacttcagacatgctggacattgctgtagactacatcaaagtgttgcaggaccaaattgagaaactaaaacaggaccaaggaaactgctcctgctcagccgatcagaagtgctgacgccacagaaccagatatgcgaggttatgtttgtactttgtaccaatgtgattagcaagaccaagttttgcttccggggattaagttgtaaatgcctttcgcacgtcaagt

SEQ ID NO: 2404 - DNA, 541 bp, Hordeum vulgare
gccttactacttaaattatacacattctacttgtcacctcctagtagtcttgaagccattgaagctaatccatagtacaaccaaggaaggagaagatgggcatggagactacttgacgtgcgaaaggcatttacaacttaatccccggaagcaaaacttggtcttgctaatcacattggtacaaagtacaaacataacctcgcatatctggttctgtggcgtcagcacttctgatcggctgagcaggagcagtttccttggtcctgttttagtttctcaatttggtcctgcaacactttgatgtagtctacagcaatgtccagcatgtctgaagtatttgtttgcttatccatgttgggcacgaggtcttgcaacctcctaagcctcttgctgatccttgttcttctttccctctcagcgatgcttcgcgggtgagtagcgcagccgcgcttggcgcggactctgcaggcgacggagtcctgctgcagctgcaggtagtcgtccatgccgggcatgtccagagacgagccaaactgtgagt

SEQ ID NO: 2405 - DNA, 542 bp, Hordeum vulgare
  UNSURE (4): n stands for any base
gggnctgcaggcaattcggcacgaggcggcgcctgcataaggagaggcaagcagtcgccgagcgacagcgtccagaaggaactcgccgacgagctccgagcaaaggttgcagatgagttcatcaggcgaagaggagataccgaatggttcctcgaaggcaatttcgagagctatgtgcgcaagatgaggaagcctcatgcctggggaggagaacctgaactgctcatgtgctcacatgttcttgggatgcccatcaccgtccacatgtacaccaagggcgctgacagccccaggatcatagcagagtatggccaggagtacgggaaggacaacccggtccgagttctttacgacggctacgggcactacgacgccctgcagccatctattgtaaggacacaatcaagactgagaggagcgtagctacccggagaccgcgttatgtaagcttcttctactacttctctagcgcagccgcataaattccgacatcttccacaactcgatttcgttcgagttggcagaccccagtatagcacata

SEQ ID NO: 2406 - DNA, 552 bp, Hordeum vulgare
gccgaagcttatttatacattcagccccgaagaagatcgaacgacagagcagcgaacccgggctgaacttcatatgtgctatactggggtctgccaactcgaacgaaatcgagttgtggaagatgtcggaatttatgcggctgcgctagagaagtagtagaagaagcttacataacgcggtctccgggtagctacgctcctctcagtcttgattgtgtccttacaatagatggctgcagggcgtcgtagtgcccgtagccgtcgtaaagaactcggaccgggttgtccttcccgtactcctggccatactctgctatgatcctggggctgtcagcgcccttggtgtacatgtggacggtgatgggcatcccaagaacatgtgagcacatgagcagttcaggttctcctccccaggcatgaggcttcctcatcttgcgcacatagctctcgaaattgccttcgaggaaccattcggtatctcctcttcgcctgatgaactcatctgcaacctttgctcggagctcgtcggcgagttccttctggacgctgtcg

SEQ ID NO: 2407 - DNA, 521 bp, Hordeum vulgare
gcacagcttccccaagggctacctttcccccccgcacccacaccccaacagcacagcttgctccgtggtcagggtcttcttcttgcttggcttggtagccgggtcgcctcttgcttcctcgagcgcctctccccctcgcccaagtctctctccgaaccataccggtccccggcagccgcagggggttttctcggattgccggagaagagccatgcttcacggcggccggccgctgtccctcaggggctccctcaaggccctcgaagccgatatccaccacgccaacaccctggcgcatgctatccacagggcctatggcggcacctgcgtgcagatgaggctgtcctacagctccatggctccaatcatcctcaaccttatccagtggatggactgcagctgctccctctcctacaccctccccagctacctgggcctcctggaggttcttgtctacaaggtttatgttgatggggatgcatccatatccaccatagaaaggcgagcgagcctcaaagaat

SEQ ID NO: 2408 - DNA, 550 bp, Hordeum vulgare
cagcacctgttcttttttaatatagcttggcaatttgccagagcgtcgatacgaaacaagtaaaaaccttcaccagggatccatcaaacacttcttcttctgtacacttattaccacaacgatgcgattgcgcaaagccagagcaacaaataatggcgcttggcaaacggactgactgcttcggccccggcttcgcttgccagactcgatctgcggaggatggtcggctgccggagaacccttgtactgtaagtacatcatcgctctctcctgtttccagccggagcgtcgctagactaggtagtcatagtagaccagcaggaggttgtcggggacgatgaggggcaggctgtcgatgaagctgtggaagtgcctcacgttctccttctccagggtcacggggtcgatcacgtcgtcgtcgccggtgagcacccacaggtccctggactggactctcttcaggcttccgcggcagaaagggcacgactgagaccttgtgtaccaatctcggtaacagttgatgcacatggcatggttgcagttgggaagg

SEQ ID NO: 2409 - DNA, 167 bp, Hordeum vulgare
cgcccaccaacccccaaacccaattccgccgccgccgccgccgaacgccgccgtagcagccgccgccgctgctccggtggtcgccgtctactcctccactaggagttgccacgaggagggttgtttggcaaaaaacacgaccgcggcgaaggagcctgatactgttg

SEQ ID NO: 2410 - DNA, 520 bp, Hordeum vulgare
ttttgtggggtaaatcagaaatggctgcgtccatagtagtggggagtcgggaactcctacaaacttcaagtgacactaccgaatattgataatggtgttaacacaacttcataccagagacggagtcttccaagagaaaacctagagctggcgaagtggcaactgatcttacagtgacggtgagttgtgtatgcaactaaacctgtgaggtgttatgtacatggtacaggtgcagtcggttcatgttcatgtcacatgcctgttacagcagtcaaattctactacagattctgggccctttccgagtggccggccacagagaacctactagcacagcaacgcggagcctgggtgctgatcaacgacacacggacggcagcagcattagaagtcaccaagcatagcttctgagttggccccttgaaagctgacattccagatctgagatttgcacgggctagtcctcctaattcgaagctccggcgcgaggctgaaaggtcatcaccgttcatcatccctt

SEQ ID NO: 2411 - DNA, 550 bp, Hordeum vulgare
gtcctcccgggtctgcaggcaattcggcacgaggatttctttacggacacaggctccttgggttgctttctcctgtaaaaaagaattttttatcgatgtcatccttacatattgatatatgtactgcagctaccgttggtggtagcgacatccaagaaacaagtgacaaactagtgcaagtccaacagcatacaagtaccttgatggactccaagtacagagatgcgttgaaggatggcccagttgcagcgatgatgatgtgggactgccccaagatttacactcaatcacttgaatacacgtgtatcataaagatgatcatgcacggacatggcaacaaaactttggatgatggtcaagctgctagtactaccgcgatattatttccttattttataggttggcgggctacatcgatgcacgtgtatgacaatgcgtacatcaccaatatccttcagccttccgatggttggagaattttaagatggtgccgggtggagaggtgccccaagttacacacggtctttactgttccccagagcggatacaa

SEQ ID NO: 2412 - DNA, 551 bp, Hordeum vulgare
  UNSURE (47): n stands for any base
tgtatgcagtttattctagcagggacgggttgtttaagggtatgtgncccccaacacaatacattttaaccatgtggcacaccatctctgaaaagtgaactcttttccacagcaacaaacaacacacacacacacacacacacacacacaatcaacatcattgtttgtgtttacaaataacaatcaccccataaccgacaattcatatagtaataagcaagcacccatgcagaatgagctcatgtgtgctgcataagctgaatgcccactctgatttatttctcatttgctcgagagctctgagcaaagataatcaaaccaaaccaaatcaaacaggaagccacagcaaggcaatgcaaatgtagaaagaagaccacaaaccaatcaagctggaagcaaggcaagcagcacacacacaccagtaactgccgaactagcgcaatgcagatgtagagagaacaccgcagaccaatcaagcgggaagaagcgcaagcaacacacaatcacatggcaggaaagctttagttatgcaggacggaccactgcatgct

SEQ ID NO: 2413 - DNA, 518 bp, Hordeum vulgare
gagcagtcagcacatttcatgcatcatctgatgctggtggcagtaattcttctgatataaccccaagcacaagtgggttaatgacgaacactgagacacacactgcttccacacccttcaaaacagatttatcctctctaggatcatatgcttcacctggagtttccgggagtgctaagcgtcggttctctgaggcaccaggacaatcacagtacagagatcgggctgcagaaagacgaagtctatacggatcatcttcatcacttgccaatgatggactggatacaactggtgaatattcgtctcgaaagggttcaagtgagatgggatcaatgccatttcctccaggggtgggtgaacgttccgttggtgaaattgacaacactgaaaattatgaggtgatcactgctgacagagcaatagacgaaaacaatgtgggcaatcgtattctgcgcaacatgggctggcaagaaggactgggtcttggaaaggatggtagtggcatcaaggagccggtg

SEQ ID NO: 2414 - DNA, 499 bp, Hordeum vulgare
gaaaagaaaacaggtacagagatagtttgaattacttggtgcttgaattacaccaagaaatatggagctagcaagacaaaagggaaatttaacggtacaaatgcaagccttgggggtcttaacattaacaccgatgaaacgagtagcagaactaattatacatgatgaaataaagagaagtacttaggacatctccctgaatcttgcaattgccttcttctggattatggttttatagctgtcgccggctcgggcctccagcgatggatcggctctcttctgctgactaccaaggccagctctcacatcgccaggcttggcctgcaccggctccttgatgccactaccatcctttccaagacccagtccttcttgccagcccatgttgcgcagaatacgattgcccacattgttttcgtctattgctctgtcagcagtgatcacctcataattttcagtgttgtcaatttcaccaacggaacgttcacccacccctgga

SEQ ID NO: 2415 - DNA, 552 bp, Hordeum vulgare
gtacccccgggcctgcagggaattcggcacgaggaaggaatgaaaagggtttgaaagattcagctactgtgaaagcagagccacaagattcagctccctctatcaatattcctgttctatctttggatgaattaattgaaaagactgatgattttggggcaaaggctttaataggcgaaggatcttatgggagagtgtactacgctgtgcttgataatgggacaaaaatggcagtgaagaaacttgattctactgaaaatgagcccatatcagaattctcgactcaggtttccttggtttcaagattgaaacatgaaaacttcgtagacatattgggatactgtatggagcgtaaccttcgcatagtagcctatgagtttgccaccatggggtctctgcatgatgttctacatggaagaaaaggagtacaaggtgcacaacctggtccaccacttaattggatgcagcgaatgaaaattgctgttgatgctgccaaaggacttgaatacctgcacgagaaggtccagccttctattgtacatagagatgtta

SEQ ID NO: 2416 - DNA, 550 bp, Hordeum vulgare
atgcgttatttttcgctacagataattccaaagttttacagatatggaaaaggacgtctctgtgttccaccaaagccacacgtcttaattcagttagttaaagtgatctgacaagtaaaggctccaatttcttcatatcttggcttgcatatcatcagctttcagtaaaagagatagcagcatgaggcaagcggacggactatgttcatgcagaccatcttcagttaagaggtatatcttatttctttggtcaattctgtggatcaactgtccagcgctggtggtggcgcaggtggagtttgcctgctcaaggtcaggggagataaagccttcaccacaatgctcatgcttggacggaactcggcttcatattgcacacacagagctgctaccgccccaagctttgcaactccctttggcggatattcaccctccaaccggggatctatgcaagccgtcaccttgtcttcggttaatcttggtgtagcccatgtaaccaggctctgctgccctcggggcgctgtatggtccacaggctttcttcctgtca

SEQ ID NO: 2417 - DNA, 430 bp, Hordeum vulgare
atcaatcagatttttcaatcagccgaactgcagaagcccgaagcaaaactccaccctcttcactccacgacctcgccgcctctcttccccctctccccgatctccgtctccctcctcccgccgctgccgccatggacggcgtcgtaagccagatcttggagaagcaggtcctgtcggtcgccaaggcggtcgaggacaagctagacgaggagatcgccgcgctcgagcggctcgacccggacgacatcgaggcgctccgcgagcgccggatgctgcagatgcgccgcgcggccgagcgccgggccaagtggcgcgccctgggccacggcgagtacaccgaggtccccgagaaagagttcttctccgccgccaaggccagcgagcgcatggtctgccacttctaccgcgacaactggccgtgcaaggttat

SEQ ID NO: 2418 - DNA, 415 bp, Hordeum vulgare
ttttttttttttttagcaacgacaaacatttccactcaaataaacaaaccaaaccaggtatggacacatggtaataacgagatcaatctacaacagtgacaaccatcggcacacaaacttctttcctattgctactaaggataacaagcataacagcttggcgtaatcctatatatataatcctttgcccacgccttcaatacaggaacaaaactaatcagagtctgatgagttgccagcgcctgattgtcgaacgcttcgcttgctggcggcagcttgcttggaagcatttgcaggtccctctccgtcaaggaagatcacctgagctttcgcaatacgttcctccagatcttcagtgctgaagtcatctttaccacccagctgatcaaatccaaccacataatcctcaaccttg

SEQ ID NO: 2419 - DNA, 517 bp, Hordeum vulgare
ggctcccccttcttccccagcaccgcctcctccaaatcgcagccgaaacctccgagaagcccgcctcccccatccatggcttcagccgcgacctttccgaagctccggctcggtccacgatgccacggctactcccagcttcaggcggccgacccggtccatatccacatgaagattggtggttcctgcaagtgccccatgcctgcccaagggttgcttgtttctaccgggagaagcgccgcgaggcacgcgttcctgccggtgtcggccgcccgatcaggtcggggcgcaccggtcgccgatgccgagaagaccgggctgtcgttggacagcttcaagacatccgttgtcaaacgcgacgacgaaaagatccatttaagaatcgagttgccagggaaggcaacacagaaggtgtttgatgaggctctgacgagcctggcacgcgacgcgccgccggttccaggtttcagaaggtccaagggagggaaaacatcaaatataccaagcagcattctcc

SEQ ID NO: 2420 - DNA, 536 bp, Hordeum vulgare
ggtgtggagtggagcaccccaaatgattgattccgggtagttcgaagccgaagcctggtgtcagtggatcatgctccagacaaactggataggatttttcatcaatggtgtgctgtcatcatgggcccaaatctaacgtgtctgcatgttcagtgctactagtcagcagtgtcacgcacatatcttgggtgatgtgtcacccgcaacctccagatcatctccaatgtctcgtctgaacaaatgtttgcttgctaatgctattctgaagttgaagcacattcatcagggaatgcacagatgcagtttctctctcaacttatcagggcgtggaggaggggggctcctcttcggaaggctcttcggagtcggattgcttcacgtcgggagcatccatggagtcggatacctccacatcaatagcatcatcagtgtcagcctccttctccagctccaggatcacattgaacccgaacgacgagcccggcgcgaacgacgactccaggtcgccttccgattgtgtcgtcgcgatttcaggg

SEQ ID NO: 2421 - DNA, 456 bp, Hordeum vulgare
cagcaccgcaacaagcgcgagtccgccgtccggctccgccaccatcccaccggcatcgtcgctcaggctgtggaggataggtcacaacataagaatcgatcatctgctttatctcggcttcggaccctgattgctctcaaagtcaggaggccgataaaccttgataactacactcctccagttgaacttcttcagatattgccactgaagtctactattcgatcaaaggacgttggcaatcaaattggcccaaataacccaaaattttcaccaggaatgcaagctttattagatcttctatttgctgttgaaggttctgtatcagaggcagcgaaagttctaggcctaagcactggtgccctgtcaaggttaattctatcagatgattctctgcgagcagctgcaaatgaactgcgagcctccaagggactgaagccactaagatgatgccccttt

SEQ ID NO: 2422 - DNA, 553 bp, Hordeum vulgare
ttatttaatagatccatttgttgaaggcatcatcaagcgatggcaacatgtgaaagtacaattgcactgtacaacaacaaggttacaatggtgtgcgacaaacaagcaagcatgatgatgactcctgtataagacagaccatgtgtatgttctgcatttcttgcggtagggaattgggcataagctccaatggcatgccatgaaatcatgaacaatgagacatcttggcacctgtggcgcagttgaagatgacaacattgtaaaggggcatcatcttagtggcttcagtcccttggaggctcgcagttcatttgcagctgctcgcagagaatcatctgatagaattaaccttgacagggcaccagtgcttaggcctagaactttcgctgcctctgatacagaaccttcaacagcaaatagaagatctaataaagcttgcattcctggtgaaaattttgggttatttgggccaatttgattgccaacgtcctttgatcgaatagtagacttcagtggcaatatctgaagaagttcaactggaggagtgtagtta

SEQ ID NO: 2423 - DNA, 364 bp, Hordeum vulgare
  UNSURE (348): n stands for any base
aaggaagtgaaagaagtcgtggtggtgtgtgatccatcctacaaaaatgtatttgaaggttctgctgaaaatttgcaaatacctattaaatttacaaccccgggaaaagagagacaagactctgtttttaatggacttcaggaaattaatggagattcagaacttgtttgtgtccatgattctgcaagacccttggtatcctctgaagatgtgaaaaaggtcttagaagatgctgcggtgcatggagcagctgttctcggtgtgcccgtcaaagctactataaaggaggccaacagcgattctttcgtcgtaaaaacccttgataggaaaactctttgggaaatgcanactccgcaggtaatga

SEQ ID NO: 2424 - DNA, 275 bp, Hordeum vulgare
tttttttttttttttttttttttttttttttgaaacaaaaaacattgccatattttcattggcacggaaagaatgttacatacaggttatatatctcgtgtatgagctacatgtttatttttctagtttccaagaggccaaaattgtggaaaggcaatggaatttcgtgctgataaattcatacaggtgcctctcaaatcaagtaaatattgttcatatcggccctatttatcattcatcaaacgctcagctaggagcatgtcatcaggagtagt

SEQ ID NO: 2425 - DNA, 520 bp, Hordeum vulgare
cattgtcaaggtcagcgaggtcgagctcgagtttttgactggcatcaactcggtggaggacgatgttgccatgaagctgtggcgccctacctttaagctcatgcttatcactcttggagatcaaggatgcaagtactataccaaggatttccgtggagctgttccatcctacaaggtacagcaagttgatacgacaggtgctggtgatgcatttattggttccctgctccgaaaaattgtccaagatccatcggcattgcaagacaagaaaaagcttgaggcggtgatcaaatttgccaacgcatgtggagcaatcaccgccacgaagaaaggggcaatcccttcattgcccaaggaagaggaggtgttgcggctgatggagaaggcgtagatggggcttatgatttccagtagcttcgtattctgcaaattgtattgtacgctgttctggatcaggagcaaggtgtattcctcccaggatacccctgcttgcctttttgttttgccctatttcccttta

SEQ ID NO: 2426 - DNA, 552 bp, Hordeum vulgare
ttgaggatctgcttattaagataagaattgcaatcacaaacaaaaaacccttagtaaagggaaatagggcaaaacaaaaaggcaagcaggggtatcctgggaggaatacaccttgctcctgatccagaacagcgtacaatacaatttgcagaatacgaagctactggaaatcataagccccatctacgccttctccatcagccgcaacacctcctcttccttgggcaatgaagggattgcccctttcttcgtggcggtgattgctccacatgcgttggcaaatttgatcaccgcctcaagctttttcttgtcttgcaatgccgatggatcttggacaatttttcggagcagggaaccaataaatgcatcaccagcacctgtcgtatcaacttgctgtaccttgtaggatggaacagctccacggaaatccttggtatagtacttgcatccttgatctccaagagtgataagcatgagcttaaaggtagggcgccacagcttcatggcaacatcgtcctccaccgagttgatgccagtcaaaaactcgagctc

SEQ ID NO: 2427 - DNA, 1039 bp, Hordeum vulgare
gtattcctgggtctgcaggcaatccggcacgagggagagagagagagagagagagagagagagagagagagagagagagagagagagagagagagagagagagagagagagagagagacacacagagagacacacgccgctccgtctctgtgtgttatgtctctctgcgcgcccgcagataatatctcgtagacacacacacacgtcttttctggcgctctctatacattcttgaaaacaacgccacatatttttttccctacgcgcgcgttgtgcatacatcttgagctctctcaccccttatatatccctctatataggtgcgcttacacctcatccctctcgcacacccctttcttctctccctctctatctctcgatgtcttttcctacacattttctctcttgcgcacacacttttttttctcccccctctctttttactgttttacagacggtctttttccccccctcacagcgcgctcttttttctatttgccccctacaaacaattccttttttttttttctcctcccctcctcgcccatctaaactttactatttttcctctcttcctcccctgtcttttttatgcaaatcctcctctcttccctcttcttctcttccttttcgcctttgcgctccctcccctctcttgttgcgtcctcccctccctctttttcccttttttcttcacccccccggtgtcttctttttctttcttccaccccctactactttttcttttctttttgtgttctgccccacatttctttttctctttttatactcacgccccctccctcttcacacttatcttttttctctctccgccacaccatttctaccctcccccttcatttttctcttctaccccctctcctatgcttttcttttatttattttattttctcccccaatctttcttctcctttcacctctcttccctccggctttcccttcttttctcctctctctctccttttccccctctttttttctcttcttccctcccttatctccattccacacccctctt

SEQ ID NO: 2428 - DNA, 551 bp, Hordeum vulgare
  UNSURE (27): n stands for any base
gcgttcatgttttatttgtatatgttntcaatgcaaggcacaggctcttttgctagtaataacaatgccaacatccaagatcatgcatcatgggtgcggccacggttgcttggctagtaaaataggcaaatcaaccttagaaacatattaaaaactaacaacaatgtggcaaaataattatactagcggataacactcaggtccttgctaactacttgctgctactttactatttgatcaacctgaagaagagtttacaggtaaggtactcctaattaactaagcactaattgtccgaccaccgtcgacggcgatgacctggccggtgacgaaggatgccgccggcatgcagaggaacgacaccattgcagccacctccgctggctcgcctgcccgccgcattggagtcctcgccaactcgttctctctaatctccagtgggagactgcttaacatgtcactcttggtcgcgcccggggcgacgcaattcacccggatcttgttctgggcccattcagtagcaaggctccttgtaagctggtttattcctc

SEQ ID NO: 2429 - DNA, 530 bp, Hordeum vulgare
aaccttcttccgagggttggaaacacctttggtggaaagtggctttgagtatggtagaacaagctgcaaaaccacttgcccgtcctgtcagggtatgggttcttgatgctactcctggcaaagttcgtgctgggttagatggtgaagatcatcctgctgaacttatcgaggtcctcagaacaatgcctgtgcaggttatattttagcaggaagttgttgatgctcttgttaaaggaaaattttctgtggatgttgcacggtgggtggcaacaaatctgagacggagcagcccatcaggaccacgatcttctccaagcttctcatggatattcgacttaaatggcatctctgagatgtacaagtcatatgaagatactaacctatggaggattgtagagaacgtaccacgaggagtacacattaattttctcaaggccgaaagaagtttgcatagatgggcccttgaagaccttcagagaattcatgctgcagaggaggtggccgcagatgaggccggaggagttgaaatg

SEQ ID NO: 2430 - DNA, 552 bp, Hordeum vulgare
gttctcaccatttgtaccagcaactatctatatccagtgtatgacgagatcgatattcatgttggttctgttacagtacaataaccgcaccccggctgtctgccattacatacacggtccatggaagaaacgaatgaatgaacgaatgcactatcaagcgcagacggtcgcccgcccgccccagttcgctttgtgcctctcttttgtaattctacaaaactggaatgcaggcaccccgatgtgatccatgtttattgttgttcatggcaggcctgcccgcttacaatggagatgtggcagtgccgtttggagctctgtaccctcactcccgtcctcttatgctggtctcgacgcggaaggtcgacgaaaggattctgaagagcccgtcagggttatctgcgtgaacccagtgcccagcatcttcaagcacatgcatttcaactcctccggcctcatctgcggccacctcctctgcagcatgaattctctgaaggtcttcaagggcccatctatgcaaacttctttcggccttgagaaaattaatgtgtactc

SEQ ID NO: 2431 - DNA, 544 bp, Hordeum vulgare
  UNSURE (16): n stands for any base
gtcccccggctgcagnaattcgcacgagggccattcctttctttgtaaactcaaatgagtggcacttggatacatcaatttcagctacaggacgatcaaaagttcttcagtttgtggtgtatattccatctgcaagggaatgccctttgtatttgcagcttccagatggggagctttcaaaaactaatgcatttatttccccaatgtggggaggtgttgttatttggaacccaccgggctgttcacttggttcaaaagaggtgcatgggactcggagacaaatgtcatcacaggaacttatggagactctggaaatcttcattgggcagctaagacagttatttggtctaaaaccaaactaccatgcacaaggcatggatgtcgcaactaaattcctagttagtgaaaaggggtttgcacaatgggaattggatttactatacagacatcatgcatgttccaaccttttgtcatgtgtcgccaccttggaatctctttcgagcttggtccaatcgctcccaagaatgatcgttatggatgaaat

SEQ ID NO: 2432 - DNA, 549 bp, Hordeum vulgare
atggtccgttccacttggaaattgcacgtatttgatgcgagagagagagagagagagcgctaggctctacttccaggaacaaaatgtgggtcctccgcccggactaggcaaaatctaccgtatactgtgagttacagatgtacatgcacgcaagccctactcctctgcctaggatgccattacagatcaccattacctactctgccttccgtcacctgtccaactccgtgggatgacgatgccagccgtgaagcgcgcacccagcgatgctttgccgcctgtctccgatgatggatggatggatggatcaggaggaggtcgtcgcctgggattgggaagcaaggaacgccgagtgcttggcccgctccaccttgtagcgtttcagctctttgatcgccgccagcagcacatgcaaacacaccggcgcaaagaatggcatgtagatcgcgaagtagtgctccaccgaagcataactgattgacataatcgacggatggaagaatgcatcctcggccaatgccctcgccctcgttgcagacactgctgaag

SEQ ID NO: 2433 - DNA, 522 bp, Hordeum vulgare
  UNSURE (2): n stands for any base
gnaattcggcacgagggggtccatccccacccacgcgcagccgtcgccaaaaccatcaaatccgccgggggcacagatcggagaggaagaagaagaggaaggagaggatggtgcgggtggcgaccttcttcgggatgaccttcggcgcgttcctcttctgggagtccatggacaaggtgcacgtctggatcgccctccaccaggacgagaagcaagaaaggatggaaagggagctggagataaagaagatgcaagcagagctaattgctcaagcaaaagagagtgaatcatgatcagtcttttggcccaatggtttcaactagctgctttgtcatgtttttattttccaagtgataaggcttggttgatgtatgcttgacgcctccaataaattaagatgttataacttgattgaatgcaagaggctatgctcatgttgaatcatgttcagtttataaaacagcgcaacccagcttcattgccttggttatgaggtgttgttttcaattgcttataaaaaaa

SEQ ID NO: 2434 - DNA, 492 bp, Hordeum vulgare
tagtcattgaaaaaacacctataacacagcaatgaagctgggttgcgctgttttataaactgaacatgattcaacatgagcatagcctcttgcattcaatcaagttataacatcttaatttattggaggcgtcaagcatacatcaaccaagccttatcacttggaaaataaaaacatgacaaagcagctagttgaaaccattgggccaaaagactgatcatgattcactctcttttgcttgagcaattagctctgcttgcatcttctttatctccagctccctttccatcctttcttgcttctcgtcctggtggagggcgatccagacgtgcaccttgtccatggactcccagaagaggaacgcgccgaaggtcatcccgaagaaggtcgccacccgcaccatcctctccttcctcttcttcttcctctccgatctgtgcccccggcggatttgatggttttggcgacggctgcgcgtgggtggggatggac

SEQ ID NO: 2435 - DNA, 519 bp, Hordeum vulgare
ctcgcgccagtcccgtatcctcgcggcgctgtcgaagaaggtgatagatctcgatgagctgcggatgcttgcggctcagggcgtccccgacggcgccggtgtccggtcgactgtgtggaagctgctactgagctatctgcccaatgatcgtgcactttgggagcaggagttggcaaaaaagaggtcacaatatgaagccttcaaagacgagttccttaccaacactgtaggtggaaatagcgcggctggaggatcagaaggccacggtggcggaaatgcagagcacgtcgagaatgggtttcttgacaggtcggagatagcccaagatgatcatcctttgagccttgggaagaccagcgaatggaatcagtttgctgagtattcagagataatcgagcaggttgaccgtgatgtaaaacgcactcaccctgacatgcatttcttctgtggagactcttcttttgcaaagtcaaatcaggattctctgagaaatatattaatcatctttgccaagctgaa

SEQ ID NO: 2436 - DNA, 550 bp, Hordeum vulgare
ttggcaaatatattaatgaacttggacatacgatacaaaaaaaacacaattactacagaagttcagttttgcggtgccaacaaaatcatattacagatttcactgaagaaatatattggtactccagttacagtattaagcgaacagatgagcattcactgcagcttgtttgcaacgtagaggaggtggccgatgttcgtcggagggtagctctgcagaagcttgaggttggaggtgaaatcgccggcaaggagccgtttccggacgaggatcagcattgcgcaacatattctcagcaaggtttcctgaggaccatcggggtcacttaacagtgtgtcccatatatgaatagtatcggcaaagttgaattcctgggttaacagcagtgttatccacctgaacgcgtagaactggggattaacttctgtagttatttccaagtggtgctgaagttctccatcatacttcttcaggagttgcattaatttggacagcgtccctcgaattccgacagcactgttgtctagcttctggcagaagttgtctctaa

SEQ ID NO: 2437 - DNA, 521 bp, Hordeum vulgare
gcacggggtcaggtcagccgcgccgcccgtctccggcgaccccaagccccaacgattccatctccgaccacaggagctccagggttcctctcctctccatctggtcctccgctacgccccgaatcgatggagataagggccccgcctacgagcctcaggctcgcgacgccgccggccacagccagcttccgcccggcctccctcaggacctccttcctcaacggcagcgtttctcttcgagctgtgcaagtacgccaatcaaatgtcaacagatttaagtgcaacgccatacggagtaacctctttgatagactaactaggcttgtcaggtcctatgcaaatgcaattctgagttcatttgaagaccctgagaagatcctagatcaggcagtcttggagatgaatgatgatttaacaaagatgcggcaagccactgcacaggtcttggcatctcaaaagaggctcgagaacaagtacaaagctgccgaacaagctgatgctgactggtatcggagggctca

SEQ ID NO: 2438 - DNA, 542 bp, Hordeum vulgare
agggtgtaacgatttgcattatggcgacaaaattaactgtacaaagtacaatgtcattcacaggaaaattgcgagagaactctacgcgcacccatatacctttaccaaaaaagtgcactggggggttcagaacctcggatgcacattgctgaaatctgcaaggctataacttccggggttcttcggctaggaggttccatcaagcctggcgacacagacatgtcctgtaaataaaatctaatactctttggtcttctttcgcagctcatttagctccgtctcaatctctgtgtcccggaaagggctgccggatttgctggctgtggttgttctacccggaggaagctcgcctttcaaagagctcccggacagttcttttctcatttgtgcaagatcatcgtcaaccgatgttgtctcaagcattgcaaactttccttctagatcatcagctcccaattgaccaagtgcctcagcttgggattccatagtcataactttctcctccatcttctcaaacgctgacagggcaccacttgtattca

SEQ ID NO: 2439 - DNA, 496 bp, Hordeum vulgare
tccagggccagcgcctcggggtcaagatttacggcgaccagctcgccaagcccggcgccatcatcatccgccagcgcggcaccaaggtttatcctggaaataatgttgggatgggaaaggatcacacgctcttttccttgattgatggacttgtcaagtttgagaaatatggaccggacaggaaaaaggtaagtgtctacccatatgagaaagagcctgagaacccaaacagttacagagcaaggaagagagagaacttccgcttgcagcgcgaacgcttgaaggccagagcagagggaacttatgaaccagaattggtgttggcagctgcagatgcaagtgttgaggtcaatgcagactgctgataggtttactgtaatgtacttctctttttacacaatccatgtttgacaaatctttcttgaatgtaaatcatcaactgcaagatgaatgcaagtccagcactatagcttcattttaaaaaaaaaaaaaaaaa

SEQ ID NO: 2440 - DNA, 474 bp, Hordeum vulgare
gaagcttagtgctggacttgcattcatcttgcagttgatgatttacattcaagaaagatttgtcaaacatggattgtgtaaaaagagaagtacattacagtaaacctatcagcagtctgcattgacctcaacacttgcatctgcagctgccaacaccaattctggttcataagttccctctgctctggccttcaagcgttcgcgctgcaagcggaagttctctctcttccttgctctgtaactgtttgggttctcaggctctttctcatatgggtagacacttacctttttcctgtccggtccatatttctcaaacttgacaagtccatcaatcaaggaaaagagcgtgtgatcctttcccatcccaacattatttccaggataaaccttggtgccgcgctggcggatgatgatggcgccgggcttggcgagctggtcgccgtaaatcttgaccccgaggcgctggcccttgga

SEQ ID NO: 2441 - DNA, 518 bp, Hordeum vulgare
gttagctcctcccttgctgaaagcagttggaaactgtgggtgaagtgcagagccatttgtcaaagtttacagtggagcatcgtgatgcaactgacatagctggatggggctgcaaggatccccaaccatgctgggtgctgatgcttgaggtacttgacaatctgcctcatgaccttgtgtattcaccagatcaggtctctccatggatggaggtgtggattgaaaaagtaaatggcagttcacaagtctgtgaggtctacagaccattacaagacccattagtttcccgctgcagtgagattgttagcatgaatgaagagaatccatctttgacagaaaaactatcattcgctgcaaaaggactcatctcaaaagtattcccaaagcctcggagagcttggttacctaccggatgcttgaaactactagatactttgcatcaagctttgccaagtatgtcccttattgcttcagacttcagttatcttcctgatgttagcatacctggagatagagct

SEQ ID NO: 2442 - DNA, 559 bp, Hordeum vulgare
gcagcaacattatttttattaagagaacgtgacttccaaagcacgttaaacaaaacttgaccaacctaagaatttcagtcttctacagaaaaaaaaactcttaaataacctgctctgacaaattgattactgagttgcatattagatattcactgggatctaatgcagcgactcccatggcaaacagaagaagcgacgcagaggcatgctggactactactacttcttgttgtgggtaggcacactgaaatagaactttgtgttcctgaaatcatcaagaagtggattgtatccatctttggtcttcgtcttcaatggcatcccaaactcctccataaaggcagccgaatcaagtatgattgttctcctactcttcactggtttaaatgcaccacgattcatctggtcttttgagaaaccagagcagtggtggtcgatccgctccaacagccagaaattggttgggaagaagatatctgcatctccctgtgcatcgagatagttgggatgatccaaagttttcccatccttcttcgaagaaaccaatggagctctatct

SEQ ID NO: 2443 - DNA, 490 bp, Hordeum vulgare
tcggatgattggcggaggagattaccggagctcgcgaggaggctcgaggaaatcttgtttatgaaatacccaagcaagagggagtactactgtatgatgcgggcaccaattgagccacaattgcagtatgctatcaagaccttgagtgcacggaaccaacaaaatcaacaaaacctagcctcgtcaagacagatagcatcttcccctggccatgggacgatgattctgacacctggtatcacgcaaggcgcaagtgaaaattctagaatgtcttatgtgacaggcaatattggcccttcctcgtctagtgcagacatggttcctccgaacaccaacatgggtaccttgctgccaggggaagctcctgatgagcatgtgaacacacttctatctctggggatgaaccctacacagcatgatcaccccagagccaacaacaacaacctcatgatagacacagtggacatacctgcaaccaacaggctcttga

SEQ ID NO: 2444 - DNA, 535 bp, Hordeum vulgare
  UNSURE (19),(32),(35),(52): n stands for any base
tcacaatttaacaaatagntacaatatacaanagnaatacaactcacaacgngaagtaaatataccttatacaggtaaataatacaaatgccttaagaagactttaaagaaaagcaaatgacagtccatatccctgctaacgccgtcagtcaccaaacctgcttctcaaatgttaccatctgatcagcagcacccgggggtaaaagagtaaataaaacagggtggatcaggtcagtccatcgtcgggaggtagacgcggtggaaacaattcacggttaacgtcctacggcaggtcggacacttgctctgagcctggatggaggcctggatgcacttctggcagaagatgtggccacatatggttgatgatggatcgaccagctcattcatgcagactggacagctaaactttggctcatttcggacttccttcacaggtgcacgcgatttcaagagcctgttggttgcaggtatgtccactgtgtctatcatgaggttgttgttgttggctctggggtgatcatgctgtgtaggg

SEQ ID NO: 2445 - DNA, 426 bp, Hordeum vulgare
  UNSURE (411): n stands for any base
gcatggggaaccgcacggagggcatcgcggacgacaccggcgccagcggcctcccctgggcgcagtggttgcgcggctggacggccgaggagaaccgccacggcgacctcctcaaccgctacctctacctctccggccgcgtcgacatgcgccaggtcgagaccaccgtccaccacctcctccgcaacggcatggaaatgctggtgcccaagagcccataccacagcgtgatctacggcgcgttccaggagcgggcgaccttcgtctcccacgtgaacacggcgaggctcgccgggcagcacggcgaccaggcgctcgccaagatctgcggcgtgattgccgccgacgagaagaggcacgaggcgggctacaccagggtgtccgccaagctcttcgaggtggaccccgacngcatagtgcgcgcgc

SEQ ID NO: 2446 - DNA, 343 bp, Hordeum vulgare
ttttttttttttttttaaaggctaacttcaatcttggtaaggaagcaaagactggagcaacaataaacggaaatagttttgcaaaagaaaagagaaacggcaatagagtagtctgtttttattcaggtaggtaagccacccttttactaggggcagtttttttttggggggcaggtaagccgcctttattattcccgcaagcctacgtaaggcatacaagcccattcttcagcccaccatgacgtgcctatcgaatatccaactgaagcgggccggcctgagctcgctacgggccgccctctggtgtgccagttcctccatcctccggatcttgggcggcagc

SEQ ID NO: 2447 - DNA, 517 bp, Hordeum vulgare
gaacaatggcaagttggacttatccagaggttctttcattccaagccctagatggcaaagtccttcaaactatacaccgatgattgtaccgcagggtcttgttcaagtaccaagctggaactcatatcctgggcaaatggtacctgtttcatctcctgagagtcgactacagtctccaggagctcaacaatactatggaacttctcgacaaggtgaaggcagtgcaggaaatcagggaatgcaatcaccctacagatccagttcatttcctgtacctcagtatgcactgcagagagagaatgtatttcctgagagacctgatcaaccggaatgcatatactacataaagactggagactgtaaatttggtgcagtttgcaaattccatcatccccgtgtgcgttcacagcctcccccagactgtatcttgagcccaatgggtcttccattacgcccaggggaggagctctgcaagttctactctcgctatggcatctgcaagtttggcgtaaactgc

SEQ ID NO: 2448 - DNA, 547 bp, Hordeum vulgare
aaaatactgtacatctctggtagcaaactcgatttttacagaacttgattccgggggagttagggggagagaacattcgcggggcgcgaccgaggacggacggcgcgcgatggctttttatacatcatcatcatcgagatcaatcaaggtcaaattgccggggagccttaggacgcgtacgcagacccggagggcgactccaggagacggcgagccatgggcgcgttgggcgacgccgacgcggagtagccgtacgcgtagacccccatcggggccgccatcggatggtcgaacttgcagtttacgccaaacttgcagatgccatagcgagagtagaacttgcagagctcctcccctgggcgtaatggaagacccattgggctcaagatacagtctgggggaggctgtgaacgcacacggggatgatggaatttgcaaactgcaccaaatttacagtctccagtctttatgtagtatatgcattccggttgatcaggtctctcaggaaatacattctctctctgcagtgcatactgaggtacaggaa

SEQ ID NO: 2449 - DNA, 517 bp, Hordeum vulgare
gggacgtgattggtattgcagaaactggatctgggaaaacactatcttacatactacctggtttggttcatgttggtgcacaacctcgactcgaacaaggtgatggcccaattgtcttgatccttgctccaacaagagaactggctgttcaaatacaggcagaagctacaaagtttggatcatactcgagaactagaagcacatgtatctacggtggagcacctaagggactatgttctggcagagtttaagaatgggaagagtcctataatggctgccacagatgtagcggcacgtggtcttggtatggtgacttgtttgaatattaggattatgttatagttccaactttcatttcattgatctcttgatataatgttggtaataattcagaatgcgcctataccaacatgccaagttattatgattagggcactctcaatgcatcatatcttaagttcaatcatgtacattaaattatgtgtttagatacaacttctctaatggcttatatctt

SEQ ID NO: 2450 - DNA, 554 bp, Hordeum vulgare
gacaaaatcatgctcagttactgtttcgattggactttcgtaatctattagtcgctgatacatgagttccttttcatatgagcccccagtacaaaaatattaagaactttgtttcgatcttctaccagttgcaggatttcaaagaaattcccccaaaaaatgtatttaatttaatgcctaaatgtatgcagataaaacttcatctttctgtcttctccagcatgagaatggatcttctttcttagtatcttctacgtactggaatggaattcgatccagaacggttaccaccatacccaccaccaccaaacccacctcggccccttgaccggaaattacctcctcctcccatggaaccagctgacttggacatagcttctagcgctggattcacaacctgtccagcttcacgcaagatcttaacgagattccttgaatattttgaattggaatgggtgaagaacgtgaaggccattccagtagcaccagcacggccagttcgacctatcctgtgaatataatcttcgatagttgtcgggaaatcaaaattaatc

SEQ ID NO: 2451 - DNA, 516 bp, Hordeum vulgare
cacgctagcccatccccagatcctccccagcgcaccgcctcgccgcagcggagccgagcccgatgccgcccaaggcgtcgaagaaggacgccgagccggcggagcgccccatcctcggccgcttctcctcccacctcaagatcggaatcgtcgggttacccaatgttggcaaatcaactttcttcaacatagtaacaaagttgtccatcccggctgagaacttcccattttgtaccattgaaccaaatgaggcacgggtgcatgttccggacgaacgatttgactggctttgccaacttttcaagccaaagagtgaggtggctgcatatctggaaatcaacgacatagccggtcttgttagaggagcaagtgcaggggagggtctgggcaatgccttcttatcccatatacgtgctgttgatggaatctttcatgtcttgagagcatttgaagacaaggaaatcactcatattgatgatacagttgatcctgttcgtgatttggaaactattagtc

SEQ ID NO: 2452 - DNA, 551 bp, Hordeum vulgare
aaacaaacatgcagaattgcataacaaataacttcgcaccctaattacgacaaacttatccagtcacaagttacaacttgcagttttccgatagaggcctcaaacatcattcaggtgtacacttggcagttgggacacatgacttcataacatcgaggagtactttcaaaagcagagtgaacgaaaatttatattcctcccttccagttggtgcttatacccttcccgcacagtctgcaatcagtactgatagtacctgggtgaactcaaaaatgctaaaatacacgaccctgtgatgaattcatcacttctttccacctccagaaacattgaacttgaagaagatgatgtctccatcctgcaccacgtatgtcttcccttcctgcctgtacttcccagcagcctttacagcagattcactgcccagctcttttagatcttcaaacttcattacctcggcacatatgaagcctctttcaaaatcagtgtgaattgcaccagcagcttgcggagctttactttgacgtctgatctgccagcacttcacctcg

SEQ ID NO: 2453 - DNA, 533 bp, Hordeum vulgare
ggcaattcggcacgaggctcttgcctgggagacaaggagggaaatgctgctggcaatggcttcctcctgttggattcagaatttaacgtcaaaggacgttgggagaagccaggtcacagccccctgtttggctatgatttctggtaccagcctcgccacaagacgatgattagttcatcatggggagccccggcagctttcaggacaggttttgatcttcagcatgtccaggatggtctctatggcaggcacctgcatgtgtatgactggcctggtggtgagctcaagcagacacttgatctaggcagcacaggtcttcttccgctggaggtgaggtttttacacgacccatcaaaggacactggctatgttggctgtgctttgacaagcaacatggtgaggttcttcaaaactgcagatggatcatggagccatgaggtggctatatccatagaaccattgaaggtgcgcaactggatgctgccagaaatgccaggattgataactgattttgtcatctctctcgatgaccg

SEQ ID NO: 2454 - DNA, 529 bp, Hordeum vulgare
ttaggtggctcaagctcccatgaagccaatgtcagagggttctatcaggaacttattccaattgacaccacatcacatacaacaccgcagggaagaaaccatcttaattacagtgagctcaacaccatggatctccagctgcatacgttacacccttcgtcctagatccatatgtcagaggtgcagtctcccccaggatatctcatctcatgggccaaggagggaccttcaggctcggtgccgaaatccacgaagaagtcggggttgacactgagcccccctttctcggtgtcgacgtcgatctgcaacatgtgagatcccttcttgagaaggtcagggccgtagaactgctcgtcccaccggctgaagagagagttggtcacatacaccctcttgccatccaagctgagctgaatcatctgcggcccacctctaagccgatgccccttgacttggggcacagcatactgctcttctttgtcatcgtcggtcacatagacaacatcaccgcccttttgaagaagcccac

SEQ ID NO: 2455 - DNA, 524 bp, Hordeum vulgare
gcacgaggctccgccagaaccctaggaaaatacggagaaggcgcggaggaagcagccggcctccctcgctcgggaagatgacggagaatcaccgcttctggggagttgttgtcaaacctggagagacggtgaagtgtgacccaggggattcacattatcacatttcgacgatagcactggaggctggcaaggcagaagagaatgtgcaagttttcgtcaacaccgatgatacaaggattatgcttggcacactgtcagttcataatcatcctcatgttttagctgatctggtgttcaaaaaggagtttgagctgttgcactcctcaatgaccagcaacatcagctttacgggctacaaatttgatattatgaaaagatatccttccacatttccttcttcaatgattgctacgtagcttagacatgcatttgtgttctttaactgttttcctgtcttgtcacatctcactcatgtactaaacaaggtgatgaatctgacgaggaggttccaatggccattccac

SEQ ID NO: 2456 - DNA, 510 bp, Hordeum vulgare
aacagcatttcttagcatagcaccaacaccattctagagatatcctgattgtgcgtagggtccaatatacccaaaagaagcaacctctttacacatcatctcttccctggatacccaaattcatttcaccagcattccccctgagctaacacctcactcaagcctgtccatggtatctttcaggccaccttacttgcgacaccatgcttcatcttggaatgatcgtcaagacccttcaaggagctgaaagccctgttgcatgaattgcagacgtggccagcagattgcttagacttgtcatcgctgttttcaggtgtcttccttgcatgtttcgcagctggatgaggggtcgcgacgtggacatggtcacccgacttgcgagcctgttttgctgccggatgaggggtcgcaacgtggaaatggtcacctgacttacgagcctgtttagccgctggatgaggggtcacaacgtggacatggtcacctgacttatgagactgttttgccgct

SEQ ID NO: 2457 - DNA, 539 bp, Hordeum vulgare
gtccccggctgagattcgccgggcgttaactggcccctacacgaacaagggcgagatctgcgtcgctggcacgcgcatatacgtgcaggaagggatctacgacgcctttgtgaacaagtcagtggagcttgccaagaaatccgtggtcggagatcctttcaacccgaacgtacatcaaggtcctcaggttgacaagaatcaatacgagaaggtcctcaagtacatcgacgtcggtaagagcgaaggcgccaccctactcaccggagggaaggcctgcagcgacaagggttactacatcgagcccgccatcttcaccgacgtcaaggatgacatgtcgattgcgcaagaggaaatcttcgggccggtgatggctctcatgaaattcaagacaatggaggaggtgattcagaaggcgaacagcacccggtatggcctggccgccggcgtggtgaccaagaacatcgacaccatgaacaccgtgtcgcggtcggtcaggtccggggtcgtctgggttaactgctacttcgccttcgacccgg

SEQ ID NO: 2458 - DNA, 555 bp, Hordeum vulgare
ggagtaacctgaaagctccagctgtataaatattatatataactaggaaatctttcccatgcgtttcgatcggatgtccgtccagatcacaaccagggcgtgttgtagagtggagtgaccaccgtcttggtgtgcaggtacttgtcgagggcatccgtgcccatgtccttgccgaagccgctcatcttgcagccgccgaacggggcgtccgggtcgaaggcgaagtagcagttaacccagacgaccccggacctgaccgaccgcgacacggtgttcatggtgtcgatgttcttggtcaccacgccggcggccaggccataccgggtgctgttcgccttctgaatcacctcctccattgtcttgaatttcatgagagccatcaccggcccgaagatttcctcttgcgcaatcgacatgtcatccttgacgtcggtgaagatggcgggctcgatgtagtaacccttgtcgctgcaggccttccctccggtgagtagggtggcgccttcgctcttaccgacgtcgatgtacttgaggaccttctcgtattgattcttg

SEQ ID NO: 2459 - DNA, 551 bp, Hordeum vulgare
gtctccccgggcctgcaggcaattcggcacgagggaagaagatcgcgatgcctgcccacctgatgtttgacgggcaggacgagaagctgttcgacctttctccatggtggcccagaggcttggcgtttacaccgctagggactacgctgacatcctcgagttcctcgttggcaggtggaaggtccccgaactgaccggcctttctggcgaggggcacaaggcccaggactacctctgcaccctcgccggaaggatccggaagctggacgagagggcccagtcgcgagccaagcaagccggtaagatgcccttcagctgggtgtatggtagggaggtgcagatgtgagcaccaaacgccgccatcacagctccaccttgcgttccaggattcccgcgtacctacccgtctgtcgtcgatgcatgtggagggtgtgtctttgatataacgaggttcggactcgcctcgtttacatagttcttcttcggttcaggtttgtcagtcgttaccgcgttccttatagcgatagggagatgtcgtccgtccgtatgtg

SEQ ID NO: 2460 - DNA, 548 bp, Hordeum vulgare
taagttggagctccgcattatacatctaacacggcagatacaggatgccaaacgttttatcggtcacaaaactcaagggatccgaacaacacaagcagcacacgctgcatgttcagttcatgtccagtccacactcccacacggccggcataagttgtacacagaactaagaacgcacacatacggacggacgacatctccctatcgctataaggaacgcggtaacgactgacaaacctgaaccgaagaagaactatgtaaacgaggcgagtccgaacctcgttatatcaaagacacaccctccacatgcatcgacgacagacgggtaggtacgcgggaatcctggaacgcaaggtggagctgtgatggcggcgtttggtgctcacatctgcacctccctaccatacacccagctgaagggcatcttaccggcttgcttggctcgcgactgggccctctcgtccagcttccggatccttccggcgagggtgcagaggtagtcctgggccttgtgcccctcgccagaaaggccggtcagttcggggacc

SEQ ID NO: 2461 - DNA, 509 bp, Hordeum vulgare
tcgatagcgtatacatatggtttaagggcctctctgcatttctttcagaagcagaactaaccagtacccttcattctctggaatcaaaagaaaatggaaatctcgtagatcacaatggtggagtgagtatatctagcgctgtggatagaatatcagataaatgcgcacatgtggatggtggaactgatgatcagcttgcacttaaggattctctaggagctatccgaaatgctgttcaagctgccggacgcatacaagctaccttccgtgtgttttccttagaaaagaagaaacaaaaggctcttcaaaatggggatagctctgcttcaccttctattatcgcaagagctgcattatctatccagaagaacttcaggtgctggaagaaacgtaaggaatttcagagaattcggaaaaacgtcatcaagatccaggcacggttcagagctcaccgagaaagaaataagtacaaggaattacttcagagcgtcggcatccttgagaagatc

SEQ ID NO: 2462 - DNA, 553 bp, Hordeum vulgare
ttgagctcggcttaggatttaccatgacatttattggcctgtacacgcctagcaaatgtgagagagatggtactacatactacaaagcagatggtacttaaagcccctgaggctccattatcatacataggccttacatcttcctaaagtctggccacaagtcagcttatgcacatgggttttttaattttatgtacagagaagtgaaaaaaaaaaggttcatcatggactttggtgatggtactggaatttgttggtaagtccttgtgatttggcaggatccactactcaccaaggcttttactgcccttcaggccgccagctgctttccagatcatcatttaacagggggggaggaggacacagggtagtggctgccctgtgctctgtcatcagcatcggctgctaccagatcagctactttccatggccaacctttgcttgttggtgtatttcgagcatcttgcggtagtccagccttgcgacagggcagccgacgatagctgataccctcgaaacagcttcgctgacagctgtttccactctttccttg

SEQ ID NO: 2463 - DNA, 517 bp, Hordeum vulgare
cggaagtggtgttctatggtaggctcagacaatttctctcagcagtactctgaagttcccatggaatgccatggttctatacaatcacacatgagaatggcaacaacaatgtagcgatgtatgacccttcgctaaacaaatggcaccacccttctgttccccttgctcctgcaaacatagtaatgccagtggcatctgcaggtggccttgtttgcttattggatcttagccacaggaacttctacatatgcaaccctcttacacaatcactaaaggaaattcctcccaggtcagttcaggcatggtcaagagtgtcagtagggatggtgctgaatggaagagctcctaatgagggttacaaagtgatgtggttgcgaaatgatggaaatcatgaggtctacgactctctgcagaatatgtggtttcagccaggcgagtttcctccaagcatcaagctcccacttgctctaaatttcaggtcacagccagtcgcggttggcagcacactgtacttcat

SEQ ID NO: 2464 - DNA, 536 bp, Hordeum vulgare
tatgctcagttctggggagatgacccaagatgtagtacaaatattacatgctgaacaagacagaataacggaacaaatagaagttttaagacccaacagatgtctgctctttcgaccttttgatcacatcaaccttaccggattcagctcaaccgatcagttgcaattgcaccgacacaaattcccgcaggtgacagaactgacagtaacaacagaacggtccgattgcttcagtaagtaacgaaaacaaccgctttggcattgaatttgtacacaacagataaccttctcgccaagtcacaacgacacagaaacgtataacaaaatgaaatgacaacgtcaacctttgctaagaaccggtcagggcgaggcagaggggcacggaccgaatgccgcgccacatgctatccactgctttttgcggctgcaagggagcatgcaatcaggtaccttctgccactccttgctcacaaggttgtacatcacgaggcggttcattcgcttcgccttcaaggagagcatgagcaagccgctgt

SEQ ID NO: 2465 - DNA, 353 bp, Hordeum vulgare
gcggacgcgcacgaacatacacatgatggggatccagccgaacctgctgaaccagctggtgtcgctcctcctcggggcgtccgtcgccggggtgctcatcttcttcatgtcctcggccgggatcggcacggagccgtccgcggccggcatatccagctgggtcaatggaaccatggcggtgccggttgcttctgcccaggaggctaaccacacaagctcaagcaaggtcgaaggcgttgcctccccccaggaggcctgccacaacgccagccaggcggcggaggacgagctgcagcggctgctgcgggaggtggcggacgagcacaagacggtgatcatgacgtcggtgaacg

SEQ ID NO: 2466 - DNA, 461 bp, Hordeum vulgare
ttttttttttttttttacatcatacattagttgttgatttcgcattctcatgtcgcaacataaacacttgaccacacacctctatcttgtcctctgcacaactgctcacacatttgtacatctcaaacgaaaatgaccgaccgcatgcgcatatgccgtcaatcactcaatggatgcatatcccagggaccttccaccgcacggggccaccccgacgttgcgcgtcgtccatccccatgtacactcgccactccttcattaggttcccaaggtcatgcagcttggctgcgaggccgacgcaacaattggcgtgcatggtgtagagcgtgttgaagtcccgggtgttgttgcagaacccggcattgtgcactgtgtcgaggaactgcacccgaagcccgcgcttgtcgacgaggtcgaatttgatctcgttgaacacctgttgctcgtgctttcccgggaaa

SEQ ID NO: 2467 - DNA, 520 bp, Hordeum vulgare
cccactttggacaggtcctcttcatgatcactcttccatcacagaaatgctaagcttggctgtagaatggggatgggcacacacaagtgagaatggtgtcactttggaaaaacttcttggcaccatgattgaggaaagtgacccaaggttaccgcctggatatataagacttgatgaggaatgccatggagttggaatatgtacttattaggatgtctgtgatgtacaattgttgagtaaagtcaagctaaatttggtatacgatgtcagattgccagccgagcaaaagttaactctccaccgctcggtactctcatccattcattgcagaagatgttaatttggaaatttatgattcatagaagaatatgcgtgtggcggagttgggatactaatgtcttgagaagttacggctctcagaggttggaaggcatcctgcctgaatttgtgggtatctctgttgtcttgaaagcatgccacatttacaccccacatcatccttgtttggattttggatgta

SEQ ID NO: 2468 - DNA, 554 bp, Hordeum vulgare
gttagctattttgcagattgctaggctaccatcggcccgatgactgacgtgactacatgagcaaacacattcttgttctcttggcatagtgagtgcaaatagaaagcactatgtcaaatagaaagctgaaaatgctagcccagtatctggctacctaaaaatgcaaagacttttatatttgcaaattgcaatcaccactgcccctgatatacacatatggattacatccaaaatccaaacaaggatgatgtggggtgtaaatgtggcatgctttcaagacaacagagatacccacaaattcaggcaggatgccttccaacctctgagagccgtaacttctcaagacattagtatcccaactccgccacacgcatattcttctatgaatcataaatttccaaattaacatcttctgcaatgaatggatgagagtaccgagcggtggagagttaacttttgctcggctggcaatctgacatcgtataccaaatttagcttgactttactcaacaattgtacatcacagacatcctaataagtacatattccaactc

SEQ ID NO: 2469 - DNA, 522 bp, Hordeum vulgare
  UNSURE (5): n stands for any base
gcacnaggccctcgtgccgattcggcacgaggccgcggcgtccgcctccgccgcgaccgcattgtcgtcgtgctggagaacaagatatttgtctacaactttgccgacctcaagctcgtgcaccagattgagacggcgcccaaccccaagggcttgtgctcggtgtcgcagcagcccgggtctattgtgctggtttgcccgggcgcacagaaggggcaaatcagggtcgagcactatggtgctaggaagaccaagtttatcaatgcgcacgcctcccgtgtcgcctgcttcgccttgtcgcaggatggaagactcattgccaccgcaagcactaaggggacacttgtcaggatcttcaatgccgctgagggcaatcttctccaggaagtaaggagaggtgctgacagagcagaaatatatagcttggctttctcaaataatttacagtatttggctgtatctagtgataaaggaacaattcatgtgttcaatttaaagataaatgttggtttgaccacaaat

SEQ ID NO: 2470 - DNA, 223 bp, Hordeum vulgare
  UNSURE (9),(10): n stands for any base
gttgcattnnctcctccatttaccgggtcaaactggcaccggtagaagcttccatccatgccgacaaccgccacagtattcttctcatggccaaatgcaacaatgtactgctcgccctcgtggagcctgaattgagcaacagaccactccgagtggaaatatttaggtagcacacctttaataaaagaaaacgatggactcatatgaggaacatcagcttctg

SEQ ID NO: 2471 - DNA, 519 bp, Hordeum vulgare
gcctcgtgtccgaattcggcacgagggagataatgagcggcagcagcagcagcttggcgtccgccatttctgcagcagccactgctgctcgtcctcgccgtggcgcggcgaagcagcagctgagcacaagggtgaggccacacctgaagcatggtgcaggctgttgggagagcagtggcagcggcagggcggtggcagtgagggctgggcccgggccgctgacggagatcgagccggacctgcaggaggaccccatcgacaagtggcgcaccaacggcgtcagcccggaggactttgtgtatggagtgtatgacggccaccacacctatgatgaaggccaagaaaagaagggcttctgggaggatgtctccgagtggtaccaagaagctgagcctcctcagggtttccaagcgctcatctcctggtcatttccccccgcggtcatcctcggcatggctttcgatgtgccgggggagtacctttacattggggcggctatcttcatcgtcgtgttctgca

SEQ ID NO: 2472 - DNA, 539 bp, Hordeum vulgare
caattttagactatactgtttcggacatttgctctgcatctttttacaaggttgctttatttgaagatcctttttttggagctatgtcatccctggtttccttagagtgtatttatcatacatgtcatctgaactgacctccaactgcatctagccaatgtgaccaccacttctgaatggcacctatggttggatgaggtcatctctgttgacggtgaagtcccagagctcgccgtacttctcgttgaagtcccagatgtccatggagttgtagtccgcgatgagcttgtcgcgcttggacctctccatcatgtagatctccggctcaaagttgtgcggtttgtccggcttgtccatctcgatgatgcagaacacgacgatgaagatagccgccccaatgtaaaggtactcccccggcacatcgaaagccatgccgaggatgaccgcggggggaaatgaccaggagatgagcgcttggaaaccctgaggaggctcagcttcttggtaccactcggagacatcctcccagaagcccttct

SEQ ID NO: 2473 - DNA, 478 bp, Hordeum vulgare
ttccgccacattttccgcgggcaacctaggaggcatctccttcagagcggctggagtgtctttgtcagttccaaaaggcttgtcgctggggacgccttcattttcctcagaggagagagcggtgagcttcgtgttggtgtgaggcgggctatgagacagctttccaacatagcttcttcagtcatatctagtcatagtatgcaccttggagtccttgcaactgcatggcatgctatcaacacaaaaaccatgttcactgtctactacaaacccaggacaagccgttcagagttcattataccatatgacaagtatacggagtctgttaaaaacatttattctattgggacgaggttcaagatgaggtttgaaggggaagaggcaccagagcaaaggtttactggtaccatagtgggcagtgataatcttgaccaattgtggccagaatcaagctggagatccctcaaggtgcgttggg

SEQ ID NO: 2474 - DNA, 536 bp, Hordeum vulgare
acattaaacaggatcgatcaaacatacatgtactactaccactgtcactcccggaatagatagacacaagacactgctggttcctggatggttaatacagacactactaataacgctacctacatacacaaatatttacatcagggatcggatcaccaattgagcatccaagcaagggacaagccttggccctggatctttctctgccaaagagcaaaccatccgacgcgcgacggcgcaccaaagtctctacatttcctagtagtaactacagtaacacccaaagggttggttgttgcatctgaagggggaggggaggggaggggaggggaggtggtggtgatcaccaatagcaatagaccatacatacttcaggggttgttacttcttttctgggggacctagcccccctcggcgatacctcgccccgtgcctcagtcggccttaacacaacctagttggctagaatttagatcgcttgacacgggaagatgagccttctcggttgcgccgtcaccttccactgaaccttcctc

SEQ ID NO: 2475 - DNA, 514 bp, Hordeum vulgare
  UNSURE (49): n stands for any base
gtcccccggctgagattcgacgggcctgtgccgccggtcccaagcccgntgagaaaatgtggagggaactgcatcgtttccattagaactttcatggtcttgaaatattttaatttgagtgacagggaatgaagggtgtagaagttacagcgttactgtcgttaatgtcctaatcaaacaatgaatcatagcataatgtggtaagcatatgattcaagctttgaatgcatccttgcttgataaaaaagctatgcaactttaatggtagttagagcttaccttgagaaacttacttgctgcctttctgaagctacacaagatgttcttacgatcccaaaggggagtgagcgtcctcgtgtagtgttctttagaccgtccacacgagcgcttgtgtacgaaggaaccccccgttctcttgctcggctatgggctgacaacacttgaaattaacaagtgttaattatggggtaacctctctttataactgccacttcttttgaagagatgcctcttc

SEQ ID NO: 2476 - DNA, 513 bp, Hordeum vulgare
agtattgttgaggtacagcagtttatactttacaagatataaaaatctcaattgcaaatagacctattaatttcgacatgtgtttaacatgaaaataaatacatcatgaaacatatttcgaaatacatcgtactcaacggaaaaacagtacttaagacaaataccgagaataacaaggtctaaaacagttaagtactcttgaaagaaccaatgtgtaaaatcggtgtggaccattgtttagcctgttttgccaattcatgcaattgcaatgacctgaatgcgattacaaggacttgaatgcaaaagtggcaacggggcaagattttccctctgtctttctcgaacggttcctcactgagaaatctcgtaaccacggaagtgagaccgcgagcgggccgtagcccgttgcctctgagccacggggattcgtctccatgcccttgccgcatcaccgatttggctcgacggccaaggctgcgtctatagccccgatgtcttcgccgcggggaacca

SEQ ID NO: 2477 - DNA, 518 bp, Hordeum vulgare
tctctattcacacgcttgccttgcttcttcccccgcgcgcgtcggctggaccctgattccgccgccctgccctgcccgctcctcccgatccccgtccgagtttagttggctgccatggctgctgaatccgggacagagagtggcaactgcagtgcttgggcagcaaaagatccttctggactactctcccctcacactttcaaccgtaggactgtacgacatgatgatgtttctttgaggatcacacattgtggtgtctgttatgctgatgttatctggacaaaaaataggcacaatgactcggtgtaccctttagtccctgggcatgagattgctggagttgtaaccgaggttggttcagacgtcaagggcttcaagctgggcgaccatgtggctgttgggacatatgtcaactcatgccgtgactgtgagaactgcaatagctccctcgagaaccactgctcaaaatttgttttcactttcaatggtgttgatacggatggtactgtcacaaaggg

SEQ ID NO: 2478 - DNA, 553 bp, Hordeum vulgare
ttccgctcaaaaaataaactttttatttaacaatcagtcccattgtatggaagattcaacttattttacatgtttctataaggattcgagatgggccaaccgcgaacatattattactttaaagagctctctatgtcgattacaaaccggtacttcacatcccggttgacaagcctctcgagagcctcgttgatgtagtctatctttatcaactcaatgtctgggtagattttgttcaccgcacagaagtttatcatctcctgtgtgtccttcgtgcctccggttacactcccagataaagtccgtgcacccagattaagtgttgctggatgcactctgatttctccagggaagccaactagtgccatcaggccaccaactttcagaagcgcaagataagggtcaaatgggtggtcaccagaggcagtatcgacaatgaagtccagggaacttttcagggactccatctgttttttatctgatgaaaccacaaaattatctgcaccaagaaggttgattgcttcatctcttttcgattcacttgtactcaaaa

SEQ ID NO: 2479 - DNA, 517 bp, Hordeum vulgare
gaaaagcatattgacccttatgctgaagcagccatgagtgagtaccctctcttctttgagctcattccccagagaccacattacaaagggttagtgaacaccagtgacactatacgagatctggcctgtagaggactgtggttcttattggttggtctggctagggaggtactcaagacatcctgtgatacagaagctttagaggttgcacatttgatgaaaaaagctcggcaactggaaagaaatgggttcaatgtgaagcatttcgttgcccgtctgaaggagccacagacccgactcagaaagcttgaggactccagggcaaggctcgaggatgcccggaccaaagagcaagaaccaaaaggtgttaaatcactttcaacccatctgagtaatctgaaacacaatgtactaacaatgcagaggcacttggaggggaacaagcaagctcgtagtgcatctgtgcgtgatgagtcgagcgaaggaatcgatctggccagcctggagaaggaagtag

SEQ ID NO: 2480 - DNA, 546 bp, Hordeum vulgare
gtacataagctctaataagttagttccctaacaaatggccctattgcaggagcaaaaacaagaaacatgcttcagccaattcaacgttacaggggttgtgtttcagtacgacacctttccaaagttccactggagcctgaacctcataatcaaaatctggatcaggttcagaggatcagctaccaggtgcatactgtgaatccatcgactactatttagtatgtacagaccaagaaagcgtcaaagatcagcgtatttcagtctcatcacagccacttcatccttcatcgcctgacagtatttttctgcagcttctacttccttctccaggctggccagatcgattccttcgctcgactcatcacgcacagatgcactacgagcttgcttgttcccctccaagtgcctctgcattgttagtacattgtgtttcagattactcagatgggttgaaagtgatttaacaccttttggttcttgctctttggtccgggcatcctcgagccttgccctggagtcctcaagctttctgagtcgggtctgtgg

SEQ ID NO: 2481 - DNA, 523 bp, Hordeum vulgare
caccggcgggggcgtcaccagcttcctcctcggcctctccccggagctcggccgctcgctcaggctcgacgtgctctaccccgtcggcggcttcacccgctgcctcgactccgacaacggattcgagttcatctatccagcaaactgggttggagaccagacaatactatacaatcaaattaagaaggcagaactgcagagatcgctagaccctccgccgttgacaagcgggggttcttcgactcgacctcggaacgtcagtggaccggtggcagcttttggccccccgggatccaacggggagctcaacgtcagcgtcattgtgtcgaccgtcccacaagacttctcgattgagtcttttggcggtcctaaagatgtcggggaagtggtgctgaggaggatcgcaaggacaaagcggaacccggatatcagcgccactctgatcggtgccgcgttgagagaagacaccgtgaacaatgtgaaatactacaagctggagttccgagtcgagagcccttccttc

SEQ ID NO: 2482 - DNA, 557 bp, Hordeum vulgare
gaatactctctgttacatttctcttttgatttaccaaaatcttagcaccaaagaccttgcgagggaaattacgggtcgcgaaaaagtacttcagacattgatgtcacaaagaacattgtgatacagaaacatttatttatgttacattttactcctcggctaaacgaaaccatgacattcgcaagcgaagttcagactagtcgataaaggtccaagggtcacggatacaaaactgtgtatctacaagatcaaacatcaaacatcaaccattaggctgaaggaatccgccatcgcaaagaactcttcctgaaccgacctccatgccgactccggtgcctgggcattcaaggtgtaaagtttgccgtctctcgcgcagcacaccgccacattgtgccgtcggaaggaagggctctcgactcggaactccagcttgtagtatttcacattgttcacggtgtcttctctcaacgcggcaccgatcagagtggcgctgatatccgggttccgctttgtccttgcgatcctcctcagcaccacttccccgacatctttaggac

SEQ ID NO: 2483 - DNA, 521 bp, Hordeum vulgare
agaccatccaagccagcaaagacttggccgagcagctggagagaatggtgcaactgcgaactctgtggattgacaacataagttctgctgaatgcgcaaatatttttaccgccctatcaaacatgccgcttctttccagcctgcttcttgctggaagagatgagaatgaggcgctttgtttcgagtccctccagccaatgtccacacatctccacaagctgatcatcagagggaaatgggccaagggaacactgaactgcccgatatttcgcagccacggagaaaatctcaagtatctagctctaagctggtgtcacctttgggaagacgaggatccactagggatgcttgcaccacacttgccgaacctcacgtatctgcgactcaacaacatgcgtagtgcaaacattttggttctttctgcagattcctttcctcacctgaagagtcttacactaaagcacatgcataatgtcaacgagctaaagatcattgatggcgcccttccgtgcatcgaaggt

SEQ ID NO: 2484 - DNA, 547 bp, Hordeum vulgare
aattaaaacattgttttctacatgttcgatcaactgtttcctgaaatcagtattacagcatgaaactgaaataacacaaaaaggtacggggcctcctgaaggcaatggacaccaatactttctggacagaaatcgtctcacaatatggaagtacaagactcgcaaatgatggcttagtaattatagcataccagaatgattgaagctagaatggcgtcgatgcaccataccagaatgctacaactgaaagaaccactgtgccgcattcagagtttcagacacgaacctcctgaacatgcaccatcttctgctgcattccgttcttgtcccactgagttttgaagcccccatgcaagcccaccaaccagagcttcttcagggagctaagggattcaatgccttgagggaccttatccagcttcgacaacgacacaacatacaaaccttcgatgcacggaagggcgccatcaatgatctttagctcgttgacattatgcatgtgctttagtgtaagactcttcaggtgaggaaaggaatctgcagaaag

SEQ ID NO: 2485 - DNA, 518 bp, Hordeum vulgare
ccttcttctccctcttactcctgctgcttctcaccgcccatggcgcgacccctgctcttggttacacacggaccgacttcccgccggacttcgtcttcggtgccgccacctccgcgtaccagtatgagggcgcggtagctgaggatggcagggccccaagcatctgggacaccttcactcacgctggcaaaatggccgacaaaagcacaggcgacatcgcttccgatggataccacaagtacaaggatgatgtcaagctcatggctgacactaacctagaggcttacagattctccatctcctggtcaaggcttattccaaatgggaggggagctgtcaatccaaaggggttagattactacaataaccttatagacgagctaatgaaacatgggattcaaatccatgtcatgctctaccatctcgatttcccgcaagttttggacgatgagtatggaggatggttaagctctagaattgtggaggatttcacagcatttgcagaggtgtgcttcaga

SEQ ID NO: 2486 - DNA, 547 bp, Hordeum vulgare
gctaaatgtaatttattgctctctcacgttgtacataagggagaaacaatttattttacttacattgatttattttacccaggataaatttagcatttcccttatatacctaaaataataaagtcacacaactcaatgcatctgactatacaactcactgttgagcatgggttcttgtatcgtcgacctcactcccaatactgatgccattgttttttagaaagcctgcataccagcgagcagagagcctggcttctcgtggccgcgcttcgtcatcgaagtcgacacgatacatgccataccctaacttgtaccctgctaggaactcgaagatgtccaagaagttccatgcgaagtagcctttcacattggctccgtttcttgatgcatccagtgtgctccctatgtaggtcttcaaatattccaccctgtcagtgtcattgaggatatcattcgcgtatgccttgccattttcttggacataaatgggcaggcctccgtaggcttctgtcaggtactgcagtacaaatcgcaatccttctgggtc

SEQ ID NO: 2487 - DNA, 534 bp, Hordeum vulgare
ggaattcggcacgaggtaagtcaaatgtcactatgttggatatagtgagcactcggatgcttggtcaatttggtttccttgcaaaggtgttttctatattcgaagatctaggcatatccgtagattgtgtggcgaccagtgaagtcagcatttctgtatcactcgatccatcaaagatctggagcagggaacttattcaacaggagcttgaccatgtggtggaagagctggagaagatcgcattcgtccatcttctccagcaaagagcgatagtctcgctcatcgggaacgtgagaaaatcatcgctcatactagagaaggctttccatgtgttgaggagaatcggggtcaatgtccagatgatctcgcaaggcgcatcaaaggtgaacatgtcgctgatcgtccacgacagcgaggcgaagctgtgcgtggaagccctccaccaggccttcttcgagggcgacggggatggcgatgatcgcctgacggcggaattcgacgaggaggagaatctgcggcttgagctgtgatgag

SEQ ID NO: 2488 - DNA, 553 bp, Hordeum vulgare
aatgtcgtccgtatgtttacaccgacaccgggcccggtcatcagactcgatcgattattcatcacatgtacatttttttgcgggtacatgtacatgtgttgcgtatacgtagtacgtgtgcatcctctacacgtaccagacggtcgagacgaccaccacaggtccggtcatctgactcgattaacagccagcattcatcgcatgtactggtgcatgtgtgtgtgtgtgtgtgcacgcacgcacgcatcgtccgcgactgcacgtgtagatacatcacagtctgcaagtctacaccttgccgttgttttgctcttgcagcagcggtttctccgggcgtcctgactgataacacacactactaactgaatgctcatcacagctcaagccgcagattctcctcctcgtcgaattccgccgtcaggcgatcatcgccatccccgtcgccctcgaagaaggcctggtggagggcttccacgcacagcttcgcctcgctgtcgtggacgatcagcgacatgttcacctttgatgcgccttgcgagatcatctggacatt

SEQ ID NO: 2489 - DNA, 106 bp, Hordeum vulgare
  UNSURE (60): n stands for any base
ttagaacctgaaggtttactatttttcattgggggggggggcctaacccccaaaaaaagngtacactacgggcacgtgcttgttcatatgaagagtcatatggaca

SEQ ID NO: 2490 - DNA, 534 bp, Hordeum vulgare
ctagtacatcatgtcttgcacatagtactctggtttcgcaccacaagaggtttgccaaatcagtagtatcatcacatcacagcgccaatgcatcacatcgttgcatgatagcgtgattctagccgatgatttgtaacttgctagcaatgaaagatgactcggctggcattggatttgcttgtaacactagtctctgcctaacagtcctctgccttgcgaacagtttcagaaaatcaaagatggcttactacatgcatcagactggatacaagtttatatttctggacagttggatcagactgtggatgatcagaagctaacaatgtgctaatcataagttaacaaatgtgacattctagattgctaattacttatgtatgaattttccccccacagtcccataggctatactgcttctgcttcacctctgaaccatagatctcatctcactaggtgcagcccttgtagctttttgaagcttagtcatgcttctgcttgggatcatgttgaaatgcttttgcaccttccttgtct

SEQ ID NO: 2491 - DNA, 456 bp, Hordeum vulgare
cccgcccgcgtgctgagcggcttgctgttcgcactcagatgcagatcctacgctcgattcttcctctcctccgacgctctgacggtgccacttctccctccgcaatgcaccgcctctcctcccctttgcggtcactcctctctttcacgacctctactctgcctagctggtggccgctccgacgagttttgcctcataatccagccgctcgtcgtgtttgcagatttcctcatggatctcgcagcatggcccgcagcagtggagtaaaaggctgggatgcacagatgcctggttgcccatgtcctatggctatatttcctaaaagcagccaccatgatggttctatgtacaagggtaggcatgcatggaaaaaggaatatcgtattgcagatcgtaaccagacttggttggagccgatgatgttagcagatcccacagattgctgcattctcgatg

SEQ ID NO: 2492 - DNA, 549 bp, Hordeum vulgare
gacgttcacgacttgcttattacatagtttgattcaatcatgtttggcacacctaaatttagacagacacttttaattagtaattgtttgattgttagcacaagtccacgactctttgatggcataaccacgtctttcgagttcttccccggtcatatcacagacacactatttgacgaaatttacttaaggttgggatgaactggagtgagcgtgacacccccgaggcaaagtcgaccaagtcaccttcactgagagtagcgcaaagtcagtcttcatcttttgagtaaaaatcccatggtcgttagccatgcaggaacaatgatgttctgcagaactggatgactctgcgcccaacttgaacttcaacgtcatccaagaagccataactacagcaaccacagacctctttaagccacatgagtcaccaatggtgccattgaagagccggatttcttcattcaacccactggtaaaacatctgagacacaaattgaaactgttttgcacttctgagatgacaacttctagagtcgcctcaactgcctt

SEQ ID NO: 2493 - DNA, 516 bp, Hordeum vulgare
tctgcctgcagggcagcaagaaaaatggcttccgtcgccttcttctcgctgctgcttctctccgccgcggctgctcccgctctcggcttcacgcggggcgacttcccgccggacttcgtcttcggagccgccacctccgcgtaccagtacgagggcgctgtagctgaggacggcaggagcccaagcatctgggacaccttcactcacgctgggaaaatggcggataaaagcgttggtgatgtcgctgccgacgggtaccacaagtacaaggatgatgtcaagctcatggttgacactcacctagaggcttacagattttccatctcctggtcaaggcttataccagatggtaggggagctgtcaatccaaaagggctcgagtactacaacaacctaatagatgcgctagtgcaacatgggattcaagtccatattatgatttaccaacttgagtaccctcaaatactggaagatgagtatggaggatggttaagccctagaattgtggaggatttc

SEQ ID NO: 2494 - DNA, 552 bp, Hordeum vulgare
tggggtctctatggttttattaagtagatgacatcgaaggatactggtgaacgtacaacaacacatcaacccgctccatcgctaccgccctcctcttttattcagtgtgtatttagtgcaatctctgtccccataaaggaaaaagagaaaactagtatctatacatatgtggtatgcctaaggtgagtgtgcctgatgaggcgactcatcgttcagcatgccatcctgcattgttgagctcgctctgaacatggatgccattgttattgttcttcaggaaggcagagtaccagcgagcagagagcctggcttgccgtggaagggcctcgtcgtcgaaatcaacacggtacaggccgtaccgtgcctgataccccgacaggtactcgaagacgtccaagaaggcccaggcgaagtagcctttcacattgaccccattccttattgcagccaatgtactccctatgtagctcttcaagtattcggtcctgtcggtgtcgacgagagagtcattactagatgattgaccattctcttggatataaatgggaaggt

SEQ ID NO: 2495 - DNA, 482 bp, Hordeum vulgare
ttcttcagctcggcctcggcgtagggaagcctaggataggccctcctcaccttccgccgcaccaccaaacgcttcttggtgggacaaggaagggattgcctggaaaagcttcttgccttgccccgttctcttcttctttaactagccctggcggttgccgcctagaggtccagtagggcagagcaggtgccggggaggagacacaggtgctggggagaggggcaggcttgtggggatcgggaggatgatggagaggcgggtcttggttgccattgcggttcttgcggcggcggcggcactgtttgttgcggcggaggcccagcaggcggcggcgcagcagggccaccagacagagaggatctcaggaagtgctggtgacgtgctggacgatgaccctgttgggcgtctcaaggtgtttatctatgatctccctggaaaatacaacaagaagctgctgaagaaagaccctaggtgcctgaacc

SEQ ID NO: 2496 - DNA, 538 bp, Hordeum vulgare
  UNSURE (3): n stands for any base
ttncataaacgggttttttacatgctacaaaccgcgaggcgagagatgctaccaaggcttcaggtcaccgaccgggccggcagtccagttcagacgggcctggccgggcttcaggaagacgctttcgccatgcggaagcttgcgagcaagcccattgagtatctgatggaacgcatcccctgcttgagctggctgggggaacagcatagcctgcttcatcgaagggtttgctagaagcctttgcttcctcagtatgtcctctgttggtatggatgtcaggatgctgtccagcctcgggacatcctcctcgggaacaaacacgccgatttcctcccatgggatggcgtcggcgaagggcaggacgatgtcgtctgcgatgatcaccgggatgcaaccgaaaaccacggcttccaccagcctggggctccatggagcccagcccaatggacacaggcagaacacagacctttgcatatcttcgtagtacgttggtgggtgatccgttgagatgtcgaacagcgggttgttcttgaagttc

SEQ ID NO: 2497 - DNA, 552 bp, Hordeum vulgare
  UNSURE (20): n stands for any base
gtacccccgggcctgcaggnaattcggcacgagggacatctcgacggaccacccacccacctactacgaggacatgcagcgcgccattttctgtctgtgcccgctggggtgggcgccatggagcccccgcctcgtggaggcggtggtgttcgggtgcatcccggtgatcatcgcggacgacatcgtcctgccttttgcggacgccatcccgtgggacgagatcggcgtgttcgtggcggaggacgacgtcccgaaacttgacaccatcctgacgtccatcccgatggaggtgatcctgcggaagcagaggctgctggcgaacccatcgatgaagcaggccatgctgttcccgcagcccgcgcaggctggggacgccttccaccagatcctgaacgggctggcgcggaagctcccgcacagcaagagcgtgtacctgaccccggggcagaaggcgctgaactggacccagggccccaagggcgacctgaagccatggtaggtagcagtggcaccggcattggcgccatgtggggacgatgttcagtcagaacc

SEQ ID NO: 2498 - DNA, 547 bp, Hordeum vulgare
gtaacttacttaatttttccgccttacagatcggcatctactgtatagcagtataatacaaaggtcatgcatatatataacactatatgatccatgatcacctacaacagcagcagttctagcactaggacaacaaaaacaaaaacggaaccatgtaatacatggaaggtgaccaggcacataacaacaaaaagaagcaaggtaatcagaaaggaaggagctttacatttgatgacagtaatggcttgcacggctgggcttactcatcagtcctctcacatctggttctgactgaacatcgtccccacatggcgccaatgccggtgccactgctacctaccatggcttcaggtcgcccttggggccctgggtccagttcagcgccttctgccccggggtcaggtacacgctcttgctgtgcgggagcttccgcgccagcccgttcaggatctggtggaaggcgtccccagcctgcgcgggctgcgggaacagcatggcctgcttcatcgatgggttcgccagcagcctctgcttccgcaggatcacc

SEQ ID NO: 2499 - DNA, 1172 bp, Hordeum vulgare
  UNSURE (12),(13),(19),(49),(58),(992): n stands for any base
ggggggaggccnncccccnttgaattttgagggcagaaattggggttgngaaagcctngttgttaggggagcctcaataaaccgagtcgtattacaatttaagtgatttttaccctcactaaagtgagaaagatcccaattcaagtgaaattaaccctcactaaagtgagtcgtattacaattgatgtgataattaaccctcattaaagtgagttgtattacaattcaagcgaaattaaccctaactaaagtgagtcgtatcactttttttgtgaaattaactcttgggggggggggtcttactacttttttacggtatattacattctctaatgagtaaacggccacaccctacctgtttttaaccccctcttttcgagagtcctttttcttattttggtattagaaccctcacgaaggtgtgtcgtgtgccgttaattgtataactaatctgttattggtgatttttttggaatcactgtagtgtttcagaatcttcttcgttcctttccaacgattagaatttatttgttatttaaccccccccccgacatgtcatttttcattagcgttctttgctacacttcgtgtgttttttgtattatggcgcaccataatttatttctcttcttttcccaactctgtatccgagtagatgggatatcattttacgatccgcactccggcgcgtcgttccacatattttttcagcggccgcctgattttttttacgaaacccttatcgtacacttataatgtgtttattatgccgcggggaccggtgattttagacgcacttgcttacgttcagcctatgtagtctcggcccacccatttcctttcggtccgttgccgtggtctcattgtgtgaatatatatactttcaatccgccatatataccacagaatgtgtatttttaacctcagcatacaagatatcgtccattattgttctactaattatctattctttaataggacaaccgcaaganaactccacaccttagtttttgtttattgtcacgtccgttgacgtgatgtgtccccggcgcgtatctactttctctatctttatttaccacaccctcaccggtgtgcttcttttgatgcgtcgctttccatcgcccccgcctcgcgatttaatgttgattgtggcgcctcagtataagcgt

SEQ ID NO: 2500 - DNA, 439 bp, Hordeum vulgare
gttcttcaagctcggcctcggcgtagggaagcctaggataggccctcctcaccttccgccgcaccaccaaacgcttcttggtgggacaaggaagggattgccggaaaagcttcttgccttgccccgttctcttcttctttaactagccctggcggttgccgcctagaggtccagtagggcagagcaggtgccggggaggagacacaggtgctggggagaggggcaggcttgtggggatcgggaggatgatggagaggcgggtcttggttgccattgcggttcttgcggcggcggcggcactgtttgttgcggcggaggcccagcaggcggcggcgcagcagggccaccagacagagaggatctcaggaagtgctggtgacgtgctggacgatgaccctgttgggcgtctcaaggtgtttatctatgatctccctggaaa

SEQ ID NO: 2501 - DNA, 550 bp, Hordeum vulgare
  UNSURE (22): n stands for any base
gtctttgccaatgggtatactnaatatatttagagatatattaacaaaacatgcccagcaatcgcttggatgcgatgcggacttaggtaggtaaaacatcagatattaaaagtggcatgcttaaaaggtgtaaaggcagctgccgtcgtcgctccttgccgttgggtcgtagttcttggcattttggtcggtgcaaccttccggcacgggcaaagtaccttgctgtgctcctttacctcctcctatgcagcaagagatggtgggtgtgtatggagaattttctaaccgtagaaggaaccagtcttcatcgcatcctggttagcatcacccagagctgcctggctcatgtaggtgtcagcaagctgcacacgcttgacattgtcctgctcctggacgagcatgtgcccgtactctagcagcttctcgactgtcatctttggctgctcgaaggtcacgggcccgtcccgcgagttcaccagcctcttgccaatgttctcgattccggtagagccgacccacttgcgcacctcatcgtcgtacacccgagcac

SEQ ID NO: 2502 - DNA, 481 bp, Hordeum vulgare
gctcctgtcacaagaagtacataaacatatatgtatgaaatatttctctgacaaagcattttgcaagacagtacaagactaaggatgaataattttgacagcacagctacattaacaaatgatggcatatgtgtcatatgcgatcaacataaagaagaaaaacatctgcataatcaccattttcagctagtgttcatatggtagtaggagtgtaccaggtcacagccagcaaaacaaatatttaatcatctcgttttgtgtcccaatccttcatcttcttacttccctttggtttagcaataggtgcattcatgcccgccatttttgcagtatattttgaccgcagcggcccgtttgtagcccatggtgcatcccaatcggtagtgtcctcattaataagatgtgtccactttgttctgccactccgcccgaaatgcttaacttgcgtgaccttaggcaagatgctcttgtccatcttatc

SEQ ID NO: 2503 - DNA, 543 bp, Hordeum vulgare
ggcctgcaggcaattcggcacgaggcaaggtcagatttctctatgcatacgtgtgtccgttgcttggatcatatccacaagtacagttctgcacaatcaagggctgtagcacattagaactcaaacctttatgccctgtttggaatggatataacttttgtgtgggcaccagatggcttctggccgttggatctaaacgttcctagctgtccgattaacataattctttgggaagtcaaagaatacgtcttctcctagactttacgtcttctcccctgtttccagactgaactttctgtaacctggctctttgattcagacctgcataatttgggatcctaacaataccgatgcccacacatacatccattccaaacaggtccttctgctgaatttagaaaatcaactactcacaccgatccatataagtgtcgtggttttagttcaaatcggagggagtagcacttagttatgatgaaactatcataggcagtcacatgcatagtaaagtatccagtgagctctttttgctctacctatcat

SEQ ID NO: 2504 - DNA, 548 bp, Hordeum vulgare
cctaaactgaatgttattcgaaatttatgatccctttacacagtatactttgagtcgtctagaaaaacactaacattactttgagtcgtctgaaacgtgactaactaaacatttagttattcctcacaaataaagatgaaggttgtttagcattcagtcctttctactatgtcacttcaatgaatttaacatgcctaaccaccacaaacatgcccaaaatcatcaaaatccatcatctcaatggtacatataattgtggctttactcgtctctagaattggtgtcttcattccgacagcattgcacttgaaactgttgcaatatgtgaaactcgggagtttcctgaaaaaaacacaagtgtccaaaagctgctggttttataagaagagaaacgtaacacaaaattttctgaattttaactatgtagctattgtttgcacaggtaaagatatggtgaatctacatgcaggtcttcacaaaattataaaagagaaagagattaattatattttactgtttctcctcaacttagaatttttgtttgcaat

SEQ ID NO: 2505 - DNA, 553 bp, Hordeum vulgare
gtccccccgggtctgcagggaattcggcacgaggaaacgacttgatcagccaggcgatagccgcatttcgcgcggaatgttcaaattcggaacgcgctaccaccgtatcgtaggaaatatcagacacaccgcttaagccgcgcacgacttccagcatacgttgccgtggtgcgcttaatcgcccttgcaacatatcgcagaccaccagcgcaccggcattaatgaacggattacgcggtataccctgctccatttccagttgcactaaggaattgaacggtgatccagacggatctttgccgacgcgttgccagatttcctcttcggagtaatgacgcatggcgacaacgagactcagcactttggaaatagactgaatggaaaaacgttcttgcgcgtctccggcctgaaaaagctgtccgtcaacggtacagatagcaatccccaatcgggaaccgtctactgtagccagcgccggaatataatccgcgactttaccctgaccaatgagcggccgcacttgccgcaagatgttttctaaaattgcattatc

SEQ ID NO: 2506 - DNA, 545 bp, Hordeum vulgare
cttacatctacaaacgaacatttacagagcatcttccagtccagcgtggtggtgttatcccatctctgaatgcagaaacaatgaagcagtgaggggaatgacaggctgcgtgcgtggtgctactatgataatacataacttatttacatgggtttcactgggcgctgtgtcttcttcgctcgtccgacagaccgggctgctgttgctgctgcttcgacaagacgacgtttccatggaggtccatcttgtaccgcagctcggcgtagtccataacgatcctgcagctgctccaggcctccgcgtgcatgctcacgcccaggtaggttatgtggtcttgaatgctgttgccgctcacagatctggagaaggcgaaccatgtcaagcaagagcaagaaccttgttaacaaagagcagaaatcatgcagtgcgaggcagaattcacaggacatggtggtggagggagagagggagggacctgctgcatgcagggtcttctccggagtcgtcgcagatcttctcaaccgtgtataccaggctcccgagcc

SEQ ID NO: 2507 - DNA, 546 bp, Hordeum vulgare
  UNSURE (40): n stands for any base
gtcccccggctgcaggaattcgcacgaggtcaagcctggnggctgctggagtgaatgttacaaaagttgaacagattacacattttcctgaaatgcttgatggaagagtaaaaacattgcaccccagtatacacggtggcattcttgcccgaagagaccaggagcatcatcttaaagcattgaatgagcatggcatagggacatttgatgtggttgtggtgaatttgtatccattctatgataaggttacctctggtgcaatttctttcgaggatggcattgaaaatattgatattggtgggcctacattgatccgagctgcagcgaagaatcataaggatgttcttgttgttgtggatcatcgtgattaccctgctctattgaaatatctacaagaaaagcaagtggacccgcagttccgcaggatgctggcatggaaagctttccagcacgtggcttcttatgattcagccgtctcagagtggttgtggaagcaatcaaacagtggagatatatttcccccaagctttactgttcccctctcga

SEQ ID NO: 2508 - DNA, 553 bp, Hordeum vulgare
  UNSURE (28): n stands for any base
ttgcccttggttacccagccgctgctgngctagcaatgtgatacaacatgacgcgacctaggcaagaatgctctcgccgccgtcatacagttattcctagttggacgcaagaccacctgcgcctgtcttattgcgacaaacatccgcgagtttccgcggcagactgactaacagtagaccagtgatatgaccttatggactcaggttaggctcagtgcctgaagtggcggacgccggtgaagaggagggagacaccgtacttgttgcagcactcgacggcatccttgtccctcatgctgccgccgggctgcgcgatcgtaccgatgccgttctcgcatgcctcctccacggcgtccttccaggcaaatgggaagaaggcgtcgctggccagagcagctcccttggcagcctcccctgctttcctgaaggcaatcctcaagctgtccaccctgtttggctgcccgctccccatgcccagcatgcagttgtccttggcaatcacaatagcattgctcttcacgtgtttcgcacagagccaagcgaacttggcatc

SEQ ID NO: 2509 - DNA, 518 bp, Hordeum vulgare
caacaatgaagattttgtggtcataaggaagccgctgcttattgcccaaggcgctccatcctatctccctaccacggctgaccccaaaggcgtccatccgaacctatggagctcatcgatgaggcagaagtatggactgagctcctcacgggactacacctacaacacactggatcaaaatgcagtgcgaccacagtgagaagcttctgtgcgacaggtgatgaagaaggaaggccatgcatggctttattggaagcacctgtgcagcatatttgtagtatcttgtaatattccatggtgtgatgcgcactgtatacatctgtgcgcctagtcactctgtcaatcccgaactcattgtgcatagttccgtcattagtgaagattgtatatgtgtgaccctggttggctagttggaaaggacatgttgtcaacatttccttgggtgtttattaagctaggtagagataagcagtttattaagtgaaaaagatcctgtgtaaagtaatgttactagcaca

SEQ ID NO: 2510 - DNA, 543 bp, Hordeum vulgare
tcatagcacgtaatactttggcggcctaacaaccaccatctcaccacacaactaaaactgtgctagtaacattactttacacaggatctttttcacttaataaactgcttatctctacctagcttaataaacacccaaggaaatgttgacaacatgtcctttccaactagccaaccagggtcacacatatacaatcttcactaatgacggaactatgcacaatgagttcgggattgacagagtgactaggcgcacagatgtatacagtgcgcatcacaccatggaatattacaagatactacaaatatgctgcacaggtgcttccaataaagccatgcatggccttccttcttcatcacctgtcgcacagaagcttctcactgtggtcgcactgcattttgatccagtgtgttgtaggtgtagtcccgtgaggagctcagtccatacttctgcctcatcgatgagctccataggttcggatggacgcctttggggtcagccgtggtagggagataggatggagcgccttgggcaataagcagc

SEQ ID NO: 2511 - DNA, 518 bp, Hordeum vulgare
gctcgtcagtgcacacggatttcagctcagtttgtggctgaataggatgacaggtgacggcaatggtgcagctggttggttgctggtggacacatttaatatccgtgagggatgcacacgttttgctggtcaaaatctgacttccatgccacaagatggtgattttcttcgtgttgctgcagtcggggataatgctgagtttgtattcctggactatgcaacatatggtgttgtcctttatgttcatctgaggagcagggtggttgagaaggtgtatgagcagccaccatatggccatggtaatgttcatccgggtataagccgcatacatatctccccctttatgatgatgtggccgcctgttttccctgcactgaaaggaggacatgatcaagggcaatgatggcggcatgtttgatctttgttatagcgtcactgggtacgacttctataatagcaagttctgtttctctgatgaggtatggaaatggatgaggaatttatatattcagatggtt

SEQ ID NO: 2512 - DNA, 554 bp, Hordeum vulgare
tgcaaacttcaggttcttaagaatcaacttaaatgggcccaacatatagtgttatatgacgtggcacaaatgtctacacatttgcaatgttagtcttaatatttgttaacaaactcggaaccaagtacaagccaagagcctattactcatactcattgaccaaatagcagacagaactacacatgttgattgcagagcaatgagaaatactgaaggagttaaacacagtaacattgttagacgagatgcagacagaaccatctgaatatataaattcctcatccatttccatacctcatcagagaaacagaacttgctattatagaagtcgtacccagtgacgctataacaaagatcaaacatgccgccatcattgcccttgatcatgtcctcctttcagtgcagggaaaacaggcggccacatcatcataaagggggagatatgtatgcggcttatacccggatgaacattaccatggccatatggtggctgctcatacaccttctcaaccaccctgctcctcagatgaacataaaggacaacaccatatgtt

SEQ ID NO: 2513 - DNA, 517 bp, Hordeum vulgare
  UNSURE (41): n stands for any base
attcggcacgaggctcccttcttcctcctcgtcctccaagnccaagaaactcctcgtctccttcaattcgcctcctcctcttcttcttctccctgccagtccaagaaactcccagcgtgaaagaagcgggcgatcggcgatggggaagatgtgctgcagccaggaggaggacgaggcggggttcaacctgctgccgctgctcatggccgccttcgtcatcatgctgctcttcgtcgtctgctcgccgccgccccggcgcaggcgctgcgtcgtcgtcccgtgctactaacctcgtgatcggcggcgcggctctgcaggcaggcaggcaagtgttggttgtgtggtgggcgtttggttggtggtgtctgaattttctgactgatgcgtgttgggtggttccacggaagaataatctcatctctgctggtttggaatggatcggactgtaaagctaaagtcattctgtcgcaattaagtcttgcttgttgttaattatattcgtactcgaaaaaaaaaa

SEQ ID NO: 2514 - DNA, 481 bp, Hordeum vulgare
  UNSURE (14): n stands for any base
taattaacacaagncagacttaattgcgacagaatgactttagctttacagtccgatccattccaaaccagcagagatgagattattcttccgtggaaccacccaacacgcatcagtcagaaaattcagacaccaccaaccaaacgcccaccacacaaccaacacttgcctgcctgcctgcagagccgcgccgccgatcacgaggttagtagcacgggacgacgacgcagcgcctgcgccggggcggcggcgagcagacgacgaagagcagcatgatgacgaaggcggccatgagcagcggcagcaggttgaaccccgcctcgtcctcctcctggctgcagcacatcttccccatcgccgatcgcccgcttctttcacgctgggagtttcttggactggcagggagaagaagaagaggaggaggcgaattgaaggagacgaggagtttcttggcttggaggacgaggaggaagaagggagc

SEQ ID NO: 2515 - DNA, 516 bp, Hordeum vulgare
gtgcagattacaaggacctcccacatatggcctgcctccgcccttgttgtctcatctccgtgctgctctaaactgtgatcaccacgaatcaacgccagaggctgatataaaggaaaatgacaggatggtgctggaaacactcgttagcatatttactccgatgcttgaaggcttaggcgaggcagacgactacaaccgggagagtgcgagttgggacgttgtgctggcgctggactacaaggatcttcagagaaggataattttgtccattgttacttcttgtggctcaggattggcaatgcttgattcctagttggaagtgtttctttcatcactaattgaataagctgagaccacactggaaccagaagtaggtcgggagtaccttccatagctgacatgcggacggtggtgaagctgttgaacacggaagtacttcgttgcagtgcaattcgccctggtggtttaggaggatgcaagggctggcacgaagaccacacatcccaactgaagatg

SEQ ID NO: 2516 - DNA, 551 bp, Hordeum vulgare
  UNSURE (37): n stands for any base
caggggtgaacatgccagctttattaggtcagcgacnattgctccatcacaataaattagctcaaagatacacagtagctttcttctgccaaaggaaagtttgcatcaacaatctggagtagctagcttaaaatttcaagccacaaactgatgcctgaaattcgcccacctaattgttggcggatcaaatatatcatgttggagcatcttcagttgggatgtgtggtcttcgtgccagcccttgcatcctcctaaaccaccagggcgaattgcactgcaacgaagtacttccgtgttcaacagcttcaccaccgtccgcatgtcagctatggaaggtactcccgacctacttctggttccagtgtggtctcagcttattcaattagtgatgaaagaaacacttccaactaggaatcaagcattgccaatcctgagccacaagaagtaacaatggacaaaattatccttctctgaagatccttgtagtccagcgccagcacaacgtcccaactcgcactctcccggttgtagtcgtctgcctcgcctaagcc

SEQ ID NO: 2517 - DNA, 532 bp, Hordeum vulgare
ggcaattcggcacgagggggaggcacgcacgcaggagatcttgactgccaaggtcgaccggctgcggtccacgattggatccataaaggctgaaatccggtccaccatcgaagagatccgcaacgggctggccatcatccgggcatagtatgagaaattcgagcgttatgcagacgaggaggacgacgaggaggagattgcttcgatggcgatgcggagcatcaggacagcatcgttgatggccgggcaatgggtgcccgagactcaggaaaacgaggcggtttttgatgcgctgagggaggcgtaccggctccttgtatcgaagcatttcagcaccattcaggattggatatctgtgcttgttagggtcaatcttgcagataatcgcttcagagattccgcgttgaaggaattcatcgatgttaagaatgaaatacgtgctgtgagaggccagtgcaatgagcttggtctcgatcttgataatgttcataggaagaaggatgttctggaggaagatgaagaggattgggtg

SEQ ID NO: 2518 - DNA, 507 bp, Hordeum vulgare
  UNSURE (9): n stands for any base
aaattaagnggttgagctgacattatgtactacagaaattaagaaccacattgcacaaaagatgccagcaccaagctaaacagtggattcatgcgtacatatcagatatctaacagtaattcatcactgaagatataacctagagtcaacctgtttattgcccagtacaggccaatgcatagccaagaaatcagaacacacctcgtgcgctatgttaagaccagttccgaatctccgatgttgaagtgtagcttaagagaagctggatggtcgtggaaggacggtcagcaacaaggaaaaactgcttggcatgctttacaaaatcaagggctttcagtttgttggtgcctcgttctgatttggattctcaatccgactgccagtacaaatgattctgaaattttccatccacaggttggaagcagcttcagtgacccgtgtacttcaagcacctcaagcgtgcaagggaataccggccgctccgcaccatacaacagcacagcaaaa

SEQ ID NO: 2519 - DNA, 524 bp, Hordeum vulgare
gaacggcggctcctcctcctcctccgccgccgccctccccgcgaccggcgcggagagtttattctccatccaaggcaagccctctggccgcaaacaaaaaaaaggaaaagaaaaactcgcggatttactctgtccgaggacgcgaccgtcgccgcaggagacggagggaggaggtcgccgtcgaccggggaggacgacggaggcggtggtcggtcacgcgcgcgcgcttccttcatatcttcccgcggcggcgacgcccgtgtggcgccggtcacgacaaccaggagcactagtggtcccaagcaatggttcatttcaagaacagatacatggtgatggaggtcttcatcgacgcgagcagaggagaggctgatcccgtcatcctcacccagttcaacataaccaaagttatcagagacagcatccagctcaactttggggagtgtggcctcgctgcatctcttgggtcattgcaagtgaagtatgtaaatcctctcacgaagatttgcgtaatacgagtgtcg

SEQ ID NO: 2520 - DNA, 507 bp, Hordeum vulgare
aacattagttggtactatgtcagttcgaacctagaccctgggtggagagccattgaaaaggtggtacagaggcacaattgctcactgtaaatctataagttcttcagaactgatatgcttcaagtctctgaaaagaagactaatggcgcgaaacaaacttccatcttcactagctatctagccccttaagtttgccaaagcaactctgcacggactcgatgatctccggcgtgataccatcaccagcagccagcttgtactgctcaaacttcgcttcttcgcactccaatgcggctttcttgcaggccctgatacttccactcacatccaagaggttgaacgacacagggatcttcccaatgttcctcaccattgtgatagcagcccaaactttttggtgatcttcacgcgacactcgtattacgcaaatcttcgtgagaggatttacatacttcacttgcaatgacccaagagatgcagcgaggccacactccccaaagttgagct

SEQ ID NO: 2521 - DNA, 540 bp, Hordeum vulgare
  UNSURE (5): n stands for any base
cgggnctgcagggaattctgcacgaggctcgtaggatttacagggccgcgcctgacagtgaaagtttcgtcgccgtcaagacgaagtccaaaaagccagcggtttacgattgcttccgcaaggcggccgtaggtggtgtctatgcagaaatcagtggcttgaaatcaaccatattagctgagatgattgcatttttacccatgtttatgcggataggagcacagatgcaaaatagaggattggagaacatcaatttttccgacgatcctcatacagatgtgaaggatatccagagttccctggtggttttatctggacagatgttgctcgtctcgggtgcacccgttccgtttgtttcccaagtggacatggatgcagctacgttgcatcctttgaggagcatcggcagatttgccatcttcatcagtaatcggaggtgcctagctgtggacactgacatgttcccgtcaattgaggcaaactgtgtctacttcattcagcttctgggttcgtctgcttatatctgcaagtccaacatcg

SEQ ID NO: 2522 - DNA, 552 bp, Hordeum vulgare
ttgggaagtaataataatactaaaagataagaagtggacacatggacaaaagatagcatcaagcacagtaggtgtagcattaggttgataccaagtacgtactaattaagacagcaaacagtagttccactacaggtgatctaaccttcaatcaacctgtttcttaaccgtgacaaggcaaggcatgtccaaaataacaaaacaataaaagacaggagcagttacttcgcaaaagcatagccttgtcggttggccatcaagatcactatcccaagggctgaatgaagatctgccgggcgccttatagcatctgttgccatgccagctgagaatccgggatattgattgtgtagctcgatagaagctggatgaccgtcacaggacggcaagcgatgaggacaaaccgcttgccctgcttcacgaaatctggattctcagagatcctctgtactttcctgtcctcgatgttggacttgcagatataagcagacgaacccagaagctgaatgaagtagacacagtttgcctcaattgacgggaacatgtcagtgt

SEQ ID NO: 2523 - DNA, 516 bp, Hordeum vulgare
ctatagccataccttccccacccacacacgagctaagtgcacacagcaagcgccacagatcctgcccagccgggctatccagtactgcatcgtcttctccgcagcaagcagagcaggggatgaagcgcgtggtggggagcccggggacatggagcggcatggtgctgcggctgtcgcagtgcgtttttgcctccgcctccaccttcgccatggtctccggcttcggctactccaactacagcgccttcttctacttgaatgtatcattgatcctgcagcttatgtggagtctgttccttgcttgtaaggatatctttgctctaaggaacaaaaaggatcttcacaccgcggataatttattgttcattgttctgattgatttcgccgtggcgattttcatgttctcagcagcctgtgcctccgcgagcctgactgttttcttcatgtgggatgtgcacttgtgcaaggcatacccgcggctcgcctgccggcacttcgggctttcggtcgtgctgg

SEQ ID NO: 2524 - DNA, 542 bp, Hordeum vulgare
  UNSURE (6),(12),(22): n stands for any base
gtaatnctaatncatttatatncgaagaggtgagtgacatcagattcttctcatttcatctctccaactaaagaccgggacggaaccaacccatggcttttttatcatcatctaaacacaaggatggaaccaacccatgactttggaatggaaccatgacattccatgacttttgatcctcaaaccaaacacaccttagaagaacgaaaccagtagccagaacccggagaaagaagatgcagcctgcaggaaccaggtgatgaacgccagcacgaccgaaagcccgaagtgccggcaggcgagccgcgggtatgccttgcacaagtgcacatcccacatgaagaaaacagtcaggctcgcggaggcacaggctgctgagaacatgaaaatcgccacggcgaaatcaatcagaacaatgaacaataaattatccgcggtgtgaagatcctttttgttccttagagcaaagatatccttacaagcaaggaacagactccacataagctgcaggatcaatgatacattcaagtagaagaaggcgc

SEQ ID NO: 2525 - DNA, 550 bp, Hordeum vulgare
  UNSURE (20): n stands for any base
gtacccccgggtctgcaggnaattcggcacgaggagaaggagtagcagctgctgctgtaatggaacaaaatcctggaagtttacagcatcgtacgctatgtgttgctttgtgtcgcgagcattcatgaggcgatgcggtctatgtggccgtttgctcgtatccctcttccatctctgccgcgtagaaagcaagaaaccatggcgaaaaattaagggacggaggtccctgcacgggcaccaccatggcaccctggctggagctcgacccaccgcaagctaggccaaaatcccccttaggcccacgcgacaagcctcaggcgggaaaatcgagaagccggctgcgccatcaacggcggcgcgcggtggccggaggaagcctccgcctcatggggatggtggcctcgtcgggaaataattgaggatggacggagagaaaacgtggggcccagcaatgaacgctttggttggatgccgtgcagcttcattcggtagcttgacctcgtagtgtatccatggacacaccaataccactcctctctttcaaaaaaaa

SEQ ID NO: 2526 - DNA, 498 bp, Hordeum vulgare
tggtattggtgtgtccatggatacactacgaggtcaagctaccgaatgaagctgcacggcatccaaccaaagcgttcattgctgggccccacgttttctctccgtccatcctcaattatttcccgacgaggccaccatccccatgaggcggaggcttcctccggccaccgcgcgccgccgttgatggcgcagccggcttctcgattttcccgcctgaggcttgtcgcgtgggcctaagggggattttggcctagcttgcggtgggtcgagctccagccagggtgccatggtggtgcccgtgcagggacctccgtcccttaatttttcgccatggtttcttgctttctacgcggcagagatggaagagggatacgagcaaacggccacatagaccgcatcgcctcatgaatgctcgcgacacaaagcaacacatagcgtacgatgctgtgaaacttccatggattttgttccattacagcagcagctgctactccttct

SEQ ID NO: 2527 - DNA, 393 bp, Hordeum vulgare
  UNSURE (392): n stands for any base
agcggctgcaggagaacagcaccgacgccgcccggtgcgaggcagcggcgctgcaggcggccacatccgagcgctcgtccaacggtttcacgaacgacggcgttgccttcacgggatacccggtggtggggtaccaacaccgcatccaggcatccggcgcatacctcaacgggccagacgacggtctcctcaccgcctgcgcgtgggacccgcgcatccgaggctccttctactacaactccggcttcagcgtcgcgctctccaaggcgccggcgttcgtcgccgacatgaaacgcctccgggacctcaacccggacctgttttgcgccgccgtcgacgccagggtgggcgtgctcctgcgatacatcaaggcatcaacggcttaccttggnc

SEQ ID NO: 2528 - DNA, 284 bp, Hordeum vulgare
ctttttttttttttttttttttttttttttggttgaagcaaaccgaacattctgattttaaccttttcgtactactattaaatagatggatagatagcaatactccgagggagtagtaacgatagcccataacatagtacaacctagttcgtatatccgcgtattatacgaagcaaagacgatcattattcataggtctagcgagtagtggggaaaggaaatttgttataatccctaataatccttgatgaaggagcatactcgagcctccttgtacacctttc

SEQ ID NO: 2529 - DNA, 512 bp, Hordeum vulgare
ctgcaagccgcgaaggcattggcacggtccagtggggcagtcattgcagtatctggagccgttgatttcatcaccgatggtgagcaggtcatcagtgctagcaatggtgtggcaatgatgcagaagatcacggcgacagggtgtgctgtcactgctcttatagcggcttttgtcggggcggatccctcggatgctctgggcgcagcagcgtctgctcttgccatctttggactggccggagagatcgggatggagtgcgctaaagggcctgcctctctcaggatgcacctcatcgatgctctctacggcctcgatgagcagaccgtcacatcagcggtcaaaattgccctagtgccgtaaaacatgcctgccgtggctaccagtgtttagcaaatatatacagtctgtggtcatctgcagggtcctgtaaaaccatgaagcatatcagatcggatttgctgttcccgtctatgtgtacatgcccctatcaataaattgccgggtgaccatcg

SEQ ID NO: 2530 - DNA, 345 bp, Hordeum vulgare
gatggtacccggcaatttattgataggggcatgtacacatagacgggaacagcaaatccgatctgatatgcttcatggttttacaggaccctgcagatgaccacagactgtatatatttgctaaacactggtagccacggcaggcatgttttacggcactagggcaattttgaccgctgatgtgacggtctgctcatcgaggccgtagagagcatcgatgaggtgcatcctgagagaggcaggccctttagcgcactccatcccgatctctccggccagtccaaagatggcaagagcagacgctgctgcgcccagagcatccgagggatccgccccgacaaaagc

SEQ ID NO: 2531 - DNA, 552 bp, Hordeum vulgare
  UNSURE (20): n stands for any base
gtacctccgggcctgcaggnaattcggcacgagcggcttactgattcgcctgccgtccgaccctcttcgcggcagcgatgggccagggcgtcgtcgagatccagccccgcgagctccagttcacctttgagctgaagaagcagagttcatgttctgtccatcttgtcaacaaatccgatgaatatgtcgctttcaaggttaagacaacttcccctaaaagatattgcgtccgaccaaatattggagttatccttccaagggcaacatgtgatttcacagttaccatgcaagcacagcgtactgcgccaccagacattgcaattaaaagacaaatttttggtgcagaccacagttgtgcctcctggtacatcagatgaggacctcattcctgcttttttctccaaagaaaccaatgcatatattgaggaaagtaaattgagagttgtccttgttgatgcatctcgtcctcctgtggagcaactgataaataatgtccctagcacaactgtggcagttgaggttcccgtgttaaaagatacactgaatgttcag

SEQ ID NO: 2532 - DNA, 556 bp, Hordeum vulgare
  UNSURE (16),(20),(21): n stands for any base
gaagcacctttttttnaggnncagttctatacaatgtaaacgctgttctatacaggcagactactggcaataaccccggtatattcaaaaccgtctcaactaattaataacaaccatggtgctgctaacagggatgctcctgcaacatttatgtatatagctgcccttcaactcttgacgaagactgaagcaccccgcggcttggatttccatcaaactccaactcataggcggaagaggtagccgagggacgtgcccagaagcgccacgtagaccacaaacagcaacgggaagcctagctgactctttggggttcccttcttcaaaaataccatctcttgctgcagcctatcccgctcctgggtcatagtcctgctctcttctctcagctttattatcatcttctcagccccttccaactttgattcaaggttgttgagttttgacttcagattctgaacatcctcggtcacatgagataattgatgattctgcacactgaaaaaacctcggtcacttacggtgacagtttcttgcggaatagtttcttccagag

SEQ ID NO: 2533 - DNA, 378 bp, Hordeum vulgare
gccatctccttcctaatcttgctctctcagtttcaaggtctctggaggttagcctggccctgctgcaaccaaagcaatggattccaaacaggtggtgcatatgaatcaaggagaaatggaaactagctatgctcacaactccagttttcagagtgctgagcagaacaggatgaagcccctgatggaagccgcgattgttgatgtatgcagcaacgcaagcaccttgtcttgcagaaacatggtgatcgcggacttgggctgctcctctggcccaaacgcggtagcactggtgtccattgccctcgaggccacctgcaaccactttcttcagttgcaacagtcacctccggaagtcagtctactccttaatgatctccc

SEQ ID NO: 2534 - DNA, 331 bp, Hordeum vulgare
ttttttttttttttttttttttttttttttggatccgccgaattgctatttttatacgttcacagggagaatctatgacaatatcacatcgatatcttcagaccatgtggagcggagttgactcgatatgggaaaccaattcaaaatcagtcccgcagataatgaaaatgatatcgcactcaccaatgctgtaaggcaacaatacaatatattttctagtacattgctactggccatgagctaaagtctgagccgctaaggagaggtcgagaaggctccacagttgacatgtgaagccttggtaactgatacaaccagcataactatcggt

SEQ ID NO: 2535 - DNA, 515 bp, Hordeum vulgare
ggcctcccggggtgctgcttcgttatatgcccctccaggacgaggccgacaaggcggtgaatgcgtatcacaacaagcacacgctcccgggggcggcaagtcctttgcaagtaaaatatgctgatggagagttggagaggctggaacacaagcttttcattggaatgcttccaaaaaatgtagcagatactgaattgactgatttgttttccaaatatggaaatatcaaggatttgcaaattttgagaggttcacagcaaacaagtaaagctggatgcgccttcattaaatatgaaatgaaggagcaagcagtggcagctattgaggatctaaatgggaagcacaaaatagagggttctagtgtgccgttggttgtcaaatgggctgatacagaaaaggaaaggcaggcacggaaagcacagaaagctcaactgcaatctcctaatatgccaaatggacgcccaatgccacagtcctcagtatttggagctttacagatgggatatatgcctcag

SEQ ID NO: 2536 - DNA, 542 bp, Hordeum vulgare
ctttgcctggagagaagtaaataattgaatgaatctgacttctggtgtatacagggggtctgacgctacggctaagctgagataataaaataacacaatgcaacaaatttgcttgagaatgtcaactgaacttagaagatacatggagctcccaggcagattcgctgggcggcacggtgcaccccgcagggccaagaggggaaacaatcagcgtcacggtcaactatctgacaaatatgtaccgggaacaagaccgcattgtcatcacagatgattttttgtcaaaaaggtttactgtgcttgttgttgttgtctctcttgagttgtactttgagtttcttgccacctagctggaaaccgttcatcatggcgattgccgactgtgcagacacagggttgtcatagcttacaaaaccgaagcatttgctggaaccagttgctttgtcaacaaacaccttggcacttattactctaccaaacctctggaaggcatcggagagttcttggtcaccaaattcttgtgggatatgatagataaatag

SEQ ID NO: 2537 - DNA, 352 bp, Hordeum vulgare
ttctcgtccgggcgcacaactctcaacccagcacacctactaccaaacgcagttcagcattgctgggaggggaggggaggggcacggcaggatccatggagcggatcggcgacaaggtgatcagcagggccgagatcacggacgccgcgttcgccgactccaccgtgatccccgacaggtatgtccggtccgacgaggtcagggacggggtcgtcgtgggcgacgacgagagctacgagctgccggttgtagacatggccaggctgcttgacccggagttctcggacgccgagaccgccaggcttggctccgcgtgccgagactggggcttcttccagttaacaaaccacgg

SEQ ID NO: 2538 - DNA, 549 bp, Hordeum vulgare
taagcaacttatttagattcctttctcgacacaggtttggttacatgatcttgagactatccacgaaccttgtcccttcagccagcgccctgaagttccccttgacatactcaacaaggtcgatggccttgtacgtcgcctcccctagctccgggagcggcttcaccattccggcaacacaagcattctgaaacatcaccaccgtggcccgccctttctcgacgtccggcagcaccctgtgctcggcgctcttgtacgtgccattggtgaggatctggagaatgtcgccgacgttgatgacgagggcgcctggcagcgggttcagcgggtaccacctgccgtttttcctcacctgcaggccgggggtgtcgtccacgtgcagcagcagcgtcaggccgaggccgtcgtggtgcggcgtgatgccgatcaccttgtccgggtggcggcacggagggtagtagtggaaggcaacactctgcctcttgccctggaaggtttccatgagcgcctcctgctcaactccgaggtcgctcgccatgaacaccaaga

SEQ ID NO: 2539 - DNA, 434 bp, Hordeum vulgare
acatacgctgctttgcgttgcatgcaaatacatacgcaccaagttatgataagatcgtcgatggcgaagcaaggtgtacttgctcccatgcttgcagtggcgctggtcgccattgttgccctcgcagcatttccagcagtgcactccatcggcgtctgcaacggcgtgatcgcggacaacctgccggcaccgagcgacgtcgtgaagctctaccaatccaagggcatcaaagccatgcggatctacgcgccggagagcaacgtcctcaaggcgctcagcggcacgggcatcggcctgctcatggacgtcggcaacggcgcgctatccggcctcgccaacgacccctccgccgcgcccgcctgggtcaaggccaacatccaaccctacccgggcgtctccttccgctacatcgccgtcggcaacgaggtcatgga

SEQ ID NO: 2540 - DNA, 421 bp, Hordeum vulgare
ttttttttttttttttttcgttaactttttgaccagttttatcagagatataagaaaaaaatagaacataacgcacacacgagtggttgactgaaatgcatgctgtttgcatcacgacgcagcttattcgaccacgaaatatccgtttgtcgaattcagaaagtaatggagtaggccggcgacttgtccggcttgaacagcccaaagttcttctccgtctcctccccgtccttctggttctcgttgaacatggcgaaaatatacgtctccaatggcccgggcctcttgggcgtgccattgccgacgtggttgatcaatccctggttgtacgcctgcgcgttctgcgccgtcgccccgaacccgctggccgacggccacccgctctcggacacgacgagcttcacccccggcttgttggcgt

SEQ ID NO: 2541 - DNA, 518 bp, Hordeum vulgare
  UNSURE (144): n stands for any base
ggttgacccttttttcctagtattctgatctaccttcccatctataggattagttattatgtctaagcatgtttttagaagattagatgattaagcaagctcatttgatatgtaagtggatagtttgaggttttgtttatcatngaaaaacaagggattagcaagtttgagctcggtggtagaattgctcaatgagaccgtgaataggagcatgattcaaccaattgacatcaatgttggtaaatgcatggaaaaatcttattgtatacatgatatggtgattgattccatatgtttctgccaagttaagaaaaatcacttgaattgaagcgataatggtctgtccaaaagcaagatttgaagattatccatcccaaagtacatgacaggtagcagctatgccacaagtcaggtctcttgcaattgttgattcattgtagcttatgctgagtgttcagttctacatgttcgtctgtcctttgcaatcaggatgattcaagaacaaaaaaaaaaaaaaa

SEQ ID NO: 2542 - DNA, 495 bp, Hordeum vulgare
tgaatatcctgattgcaaggacagacgaacatgtagaactgaacactcagcataagctacaatgaatcaacaattgcaagagacctgacttgtggcatagctgctacctgtcatgtactttgggatggataatcttcaaatcttgcttttggacagaccattatcgcttcaattcaagtgatttttcttaacttggcagaaacatatggaatcaatcaccatatcatgtatacaataagatttttccatgcatttaccaacattgatgtcaattggttgaatcatgctcctattcacggtctcattgagcaattctaccaccgagctcaaacttgctaatcccttgtttttcatgataaacaaaacctcaaactatccacttacatatcaaatgagcttgcttaatcatctaatcttctaaaaacatgcttagacataataactaatcctatagatgggaaggtagatcagaactactaggaaaaaagggtcaac

SEQ ID NO: 2543 - DNA, 1076 bp, Hordeum vulgare
  UNSURE (54),(58),(72),(99),(105),(107),(108),(117),(121),(125),(133),(136)..(138),(148),(149),(155),(160),(162),(163),(172),(190),(874),(879)..(881),(900)..(902),(945),(946),(963),(973)..978),(983),(984),(986),(990),(991),(995),(1000),(1003),(1008)..(1010),(1014),(1015),(1021),(1023),(1024),(1041),(1044),(1062),(1071): n stands for any base
ccgtaactgaaggcatccctcacgagggcatcacaagactgccctaaaaagggnaatnggagcactctacanattaatcagcagcaggacaagataggngacttngnnagcactggncagnacanagactccnctnnnaggaactggnnaagagnatatngnnggatagggnagcgaaatagcagatgcngctcagcccgccccccgggatgggctgtccccaaccgccgcccccgatagtgaggacacgccgtgctcttgcctcgcctggcccggaaaggtgggttggacgacttctttcttggtgtttgatatgcccgccgcgtggaggccacgctccgccccccgcgcgcgggggcctgcccccgaagctcacgggtgtggcccgcgcggggagcggcgcctcctcgagaggggggggctccggggcccgccaccgttcaccactcgctagcggcggccgtggatgatgtttatttcttccccccttgggctgctgtaaaccgcccccaacgtctacgcgtgccgtccccgcgccgctggcgggaggggtgctgtgtgttgggggtccgggcttcgcagcgtgcttgtagtgcactcgttccggctatgttcgcttcctcccttcctcgcctcctttgtaagccgaggtggggggtcgtgtgggtcgttgactgagatcgcggcttagggccggacgcccggatcccttaactcgagtgtgcacggagcgctacgccgtctcgttccgccgagcccggtgggaatggcgcgcggccgcctcctctcgtggacgcccctgcctctggcgtgggcctcagccgcgtagtgcaacgcgcgcgtgcaaggacgcgcctcccggggcggcgcgacnccccnnnccggagcctagccatgggnnnggaccaccccccccatttgggtggcccgctcaccgcgggaaannaaagaaagccttttatncctaatagannnnnnctggnncnggannacancatcnatncggtnnntcannagggangnnctccaatgaccctcaanctnagcccacttcccacggancctagatgngacta

SEQ ID NO: 2544 - DNA, 542 bp, Hordeum vulgare
tttattatttagggcctccgcttttccatctaacaatagtttacaaaataatatactgttgctcaggagtactcatcaaagtgaaactagagaacatggctctctctctctctctctaaaaataaaaacctagagaacatagctctctcaataataagagtagttcattttcatttgccctgctagagactaaaatcatgtgaaaaagcttgatacacactagaagaagattacgcccgaggcccatgtgaagggtacatacaagctaccactgcacgcatcaaagctaacgacatcattactacacaaatgctgatagtaccaggccactgaagcgggagagaatcacatcagcagcttacttgctttcttctcgtgagttgcagagtacaccattcagtaaataccaggaacaaccctgtaaggtactctgttgcagtacatcttccagtacttgccgtactttgttgagcatctatcatcatccctcttcgctcggtcaagcagtagaatggtcagaaatatcacatagaagtatggca

SEQ ID NO: 2545 - DNA, 517 bp, Hordeum vulgare
ccaccgccgcccagattcttccgcccaaaccctagcgccgccccacctgccgccgggcgccgaccgaggtgaaggcagaggtgtgggaacacaaccaagatggctgacggtcatgataatgacaaaaacattgagatctggaaagttaagaagctgattaaaggacttgatgctgcccgtggaaatgggacaagcatgatatcgctgatcatgccgcctcgtgatcaggtctcacgagtaaccaaaatgttgggtgatgagtatggaactgcctcaaacatcaagagcagggtcaacaggcagtctgtcttggccgctattacctctgctcagcaaaggttgaagctgtacaatcgtgttccccccaatggattggtgctttatactggaaccatcgtgactgatgagggtaaagaaaagaaagtcacctttgacttcgagccattcagaccaattaatgcttccctgtatctctgtgacaacaagttccacactgaggcactgaatgagctgcttg

SEQ ID NO: 2546 - DNA, 544 bp, Hordeum vulgare
  UNSURE (17): n stands for any base
atacgtttattttattnaaatatggtgacacgcagacacagcagcgtctatatccaatagcaggttcaaatgtagtggtagcatcacaactttggtgcagagaaataaaggatagctgcagctgcagcaacaatgacccacaaacttgacagacaagttcaagactaacacagatgacacggacaatagcttatagctatgatttattcttcctaaataataatgatggtgctaaataggacagtcttctgatagagatcagaaatgcagccttcctccatatcacgccgacaagacttcatgcttcatcgcacggtaatggtgatcacccctgttctcaagtcttgctcttcatcccccttaagttgttttcctcgatgagcttgtggatgcctcggcctcctgccgcggcgcgttccggttccgggccagcacaggctcctcccggaccggattcactggagtttcaattgattgctattcaaagtcttcatcatactcctcgtcagacacatcctcgtaagcattcacctcaacctggtag

SEQ ID NO: 2547 - DNA, 519 bp, Hordeum vulgare
gcacctccccccgtggactaaatgttgaaggagaagcagatagttgggattttggtgttggtgctggattttatttgaatgccacaaatgagaagtggaaaaactggcgcatgtacgactatgttgtgaaggagctgccaaaagttcttagtgacaactttgaacagcttaacacgtcatgtgcatcaatttttggccactctatgggagggcatggtgcactcactatctacttgaagaacactgacaaatacaagtcggtgtctgcatttgctccaattgctaacccaataaactgcccatggggccagaaagcattctcaaactatctgggcacaactaaatcagaatgggaggaatacgatgcaacattcttggtcaagaagtgcaacacggtttcaacttctatcctgattgaccagggtgaggatgacaagttcctggcggagcagctgctggcgggcaactttgaggaggcgtgcaagtcggcgggcgttccactgaccctccgcatgcagc

SEQ ID NO: 2548 - DNA, 549 bp, Hordeum vulgare
tttacgaatagggccacggctattctaccgaatgacgtgaacttacagccaagcgacgcacgcgcgcttcgcacgttatttcacacggttcgtccagtctctcaatctaacacacacagactgcatgggcgcatacgggtgataacacagatttgcaagctgagattttagcgatgacatcgctagatgtgactggcaagtcatgcgctcttgaggaactgggcgtggtgcgcgatgtgatcgtcgatgaaggtggcgatgaagaagaaggaatggtcgtaccccggctgcatgcggagggtcagtggaacgcccgccgacttgcacgcctcctcaaagttgcccgccagcagctgctccgccaggaacttgtcatcctcaccctggtcaatcaggatagaagttgaaaccgtgttgcacttcttgaccaagaatgttgcatcgtattcctcccattctgatttagttgtgcccagatagtttgagaatgctttctggccccatgggcagtttattgggttagcaattggagcaaatgcagacaccgac

SEQ ID NO: 2549 - DNA, 518 bp, Hordeum vulgare
attgggacaaatggtgaaccttcagtacctggagctgtttgggaacaacatcagtggaccgataccagcaaccctcggaaacctgacacgcctggtcagtcttgacctctacaacaaccgtctcaccggcatgataccggcctcgctcgggaacatcgggacgctgcgtttcctgaggctgaatgcgaacaagctgacaggaggtatacctgcgtcattgggcaatctaacgaagcttcaaactttggagcttcaggagaacatgctgaccggcatggtgccgctggatgtcttatctcttgttctttttggggacttgactgaacttagcgttgccaagaacagtctggccggcactgtcaaatcatctaaaccaagagtagctacaatcatccaggacacgctcaagactacacgctgagcagcagtgacaacctgaacttttgtaagaataaactgaatgtcttttccttctgaaactgctgggagaggctgtagccttttatcccgttaagagt

SEQ ID NO: 2550 - DNA, 555 bp, Hordeum vulgare
  UNSURE (136): n stands for any base
gtaaaggatgcacatgaagattcattattacaaagtcgcactgattacaatgtaagtattaaatcacctttcactttttccctttttctctcctgaaatggaggtaagctctggactcttaacgggataaaaggcntacagcctctcccagcagtttcagaaggaaaagacattcagtttattcttacaaaagttcaggttgtcactgctgctcagcgtgtagtcttgagcgtgtcctggatgattgtagctactcttggtttagatgatttgacagtgccggccagactgttcttggcaacgctaagttcagtcaagtccccaaaaagaacaagagataagacatccagcggcaccatgccggtcagcatgttctcctgaagctccaaagtttgaagcttcgttagattgcccaatgacgcaggtatacctcctgtcagcttgttcgcattcagcctcaggaaacgcagcgtcccgatgttcccgagcgaggccggtatcatgccggtgagacggttgttgtagaggtcaagactgaccaggcgtgtcaggttt

SEQ ID NO: 2551 - DNA, 575 bp, Hordeum vulgare
  UNSURE (15),(31),(32),(54): n stands for any base
ggatcccccccgggnccttgcagggaaattnncggcaccgagggagccatcagncaagctcattgcgaagagacgcgggatcacgcgtgtccggatgatcattcacccttgcaaaggggatagaagcctccttggacccaattcctcgtatcatcacgcctacacaaatgatcagctctgcagctggcgttccaactgagaatatactctatcttggaggcccaaacattgcctcagaaatttataacaaggaatatgcaaatgctcgaatctgcggatccaccaagtggaggaaacctcttgctaagtttcttagacaaccgcatttcattgtttgggataacagtgacattgttactcatgaggttatgggtggcctgaagaatgtatatgctattggtgctggaatggtggcagctttaacaaacgagagtgcaacaagcaaatcagtgtattttgctcactgcacgtcagagatgatattcattacccatctactgacagaacagccagagaaacttgccggccctctgctggctgatacttatgtaactctcctaaaaggtcgcaatgca

SEQ ID NO: 2552 - DNA, 543 bp, Hordeum vulgare
agcagcatattattgactcgatcagtactctcttgtacaacatgacagtctaacgaccccacgggctatggccaccggggtccaaatttccaaacacacaagccagcagatctgaaaccaggagacgcctttgctcaacccatagtgatgtgaagcatgacagggttggagctaatccaagccttttttttgtttacaatctaatcatgtacacagggcagccgaggtcacggcttcccgaggagagacgggcggtagaatgtgtggctctgcgccatctcgatcctctcacgagggtcgttcatggtttcgtccctcagggcttggaggatgtctcttaccgggagctccctttttatcagaattctataaagcctcttcagaattgggcacagttcagcaggagccacttgcttgttttcctctgggtgtagaacacttaatctgggttgactgagcagctcaaaaaatgcaccaacagcagaaataccctgaatcatcccctttcctttgatactgtcacccatatcgagcctgagttct

SEQ ID NO: 2553 - DNA, 516 bp, Hordeum vulgare
tccggcgcggcatcatacatggcgcccatcgcgcagtaccttgccccaccggcgcgcccctgctggccaacgtgtacccctacttctcgtacgtgcgcgaccaggcgcagatcgacatcaactacgcgctcttcaagtcgcagggcaccgtggtgcaggacggcgccaacgcgtaccagaacctgttcgacgccatcgtcgacacgttctactcggcgctcgagagcgccggggccgggagcgtcggcgtggtggtgtccgagagcgggtggccgtctgagggcggcacggcggcgaccacggacaacgcgcagacgtacaaccagaacctgatcaaacatatccatgtcgggcaggggacgcccaagaggcccggcgccatcgaggcctacgtgttcgccatgttcaacgagaacaggaagggcccggctgagatcgagaagcactttgggctcttcaaccccgacaaatcgccggcgtaccccatcagtttctagaagacgggacacatctata

SEQ ID NO: 2554 - DNA, 543 bp, Hordeum vulgare
cacgttgcctcttattgtttgtctccgtaaaataatttgagcactttcgcgttccaaatatttgggaccttttccgccatccatgcaaagcatgatgccgcattctacagcataggcagcttattcaagtacaaagcccgcagtagtttaatttagctgagcaaggaaatgttcgttgtcttgctacgtacgtacgcgtatagatgtgtcccgtcttctagaaactgatggggtacgccggcgatttgtcggggttgaagagcccaaagtgcttctcgatctcagccgggcccttcctgttctcgttgaacatggcgaacacgtaggcctcgatggcgccgggcctcttgggcgtcccctgcccgacatggatatgtttgatcaggttctggttgtacgtctgcgcgttgtccgtggtcgccgccgtgccgccctcagacggccacccgctctcggacaccaccacgccgacgctcccggccccggcgctctcgagcgccgagtagaacgtgtcgacgatggcgtcgaacaggttctggtacg

SEQ ID NO: 2555 - DNA, 516 bp, Hordeum vulgare
gtcggggcggtggaggcgacggggacggggtactcgcaggccagctactacacctcgctggggctcttcgtgctctccgtcccggggctctggtcgctcatcaagcgctccgtcaagtccaagattgtgcagaagacgttcgtcagggaggaaggacagccgacagcgccgagcctggtggccggggagatcctgtccttcttcacgcgcaacagtttttccgtctctgaccgtggtgaggtcatcaccttcgagggcacaatgacaccaagcagctctcaggcagcattgctgaccttctgcaccgtcattagcctggggagcgtcgggcttgttctgtcaatcgcggtcccagaaggcggcaacaactggttctggcttatgaccttaagccccttggcgggagtgtactactggacaaaagcgtcgaggaaagaggagatcaaggtgaagatggtcttgtccgatgacgggaacaatgtgtccgagattctggtgcggggcgacgatgtgcag

SEQ ID NO: 2556 - DNA, 553 bp, Hordeum vulgare
ttagatacatactatgtaaatgtatcattgtgaggtgtaattatatacaaacagggtacagatactggaatcatttggacctaggagccatatcgaattcccgacaaaaaacatctctttttctcaaagccaagacacagatttgcccgtggatactgaaacccaccctcaactcccctctcaccttcactttgcatcgcatcacatgaaagcctggtttgaactgcttgcttggtcactatactccagacatcaaagctactggtcatgtctcgaatatccccttcacgtatatcatccccttctcgctcatcttgagctccctcctcatctgctcgacctgcacatcgtcgccccgcaccagaatctcggacacattgttcccgtcatcggacaagaccatcttcaccttgatctcctctttcctcgacgcttttgtccagtagtacactcccgccaaggggcttaaggtcataagccagaaccagttgttgccgccttctgggaccgcgattgacagaacaagcccgacgctccccaggctaatgacggt

SEQ ID NO: 2557 - DNA, 518 bp, Hordeum vulgare
gcgcgacctcgagcaggctatcactgctcttaagaaaggagcctacttattgaaatatgggcgtagagggaagccaaaattttgtccatttcggctatccaatgacgagtctgtattgatatggttttcagggaaagaggagaagcatctaaggttgagccatgtgtcccggataatgcctggccaacggactgcaatatttcagagatacccacgacctgagaaggaatgtcagtccttttctctaatttcgcatgacaggtcactggacattatatgtaaagacaaggatgaggcagaagtgtggtttgctgggctgaaaacattgatttcacgaagtcatcaaagaaaatggagaaccggctcaagaagtgataccatttcgtctgctgcaactagtccaaggatttacacgcgacagagctctccgttaagttctcctttcagcagcagtgacagtctccacaaggatttcaatgaaaactaccggctccgtagtccatatgggagtccaccaa

SEQ ID NO: 2558 - DNA, 543 bp, Hordeum vulgare
aaaatactattgaaaaactatgaacatgtccatttttttcctaacagcaagaatctctttcatgggccaatgtaaatgctagttacaattagcgaaaaccttgactgacaagagagccttcacacactcactgtatgaggcctcaattccacatataatcaaggtttctttttgtgtgtgtttgtgtccgagtcaaaagtcagtgagttgcaatctcacgatccatggccgcaatggatttgtcaaccatgtgaacattgtactgctggtacacccttgccctgttcccctgccaccattcttctgcctgtgtctcactgaacctcttccggctgaaccggactcgcttgagatctctggcccctccaggcaaggcagtgagagtgatataaacacctggttcgtcttgctctacccattcggcctcgtgttgggattctgcatcggacggtatacttccattactggtcatttctggatggcctgccttgttcctaacagaacttaatccattaggaacaagcaatccgttagaaccatctg

SEQ ID NO: 2559 - DNA, 518 bp, Hordeum vulgare
gcactggctgctttgtcccatgcagcattcaatccatctccgcagcagaagcaggttaatgatagtaggcctccaagctcgggtgatggacccactcaacgcgcctctgcactggctgccttgtccaatgcgtttaatccatcctcaaaaccaaaaactccacctccgtcacgttcaggtcaagggtcacaaagagcagctgcagttgctgcgctatcctctgtgctgactgctgagcagtctggatcatctgacaatctcagagctagcaagacgagcacaacatcagaaaagactgatgcggaggtcgtcgtaatatctccatcagaagcatctcctcgctctgaagctggagaatcctctgaatttcagtcagagaaagatgctccagtggatgaggtgccatcccaggtagatgtagcagagcctgaggcgctggaggtgccagaggaacaaacaactgaacatgttggtgaagcaacatttagctacgaccgcttgatatctaaatctactga

SEQ ID NO: 2560 - DNA, 543 bp, Hordeum vulgare
  UNSURE (15): n stands for any base
tctttcaagttgttntagcaatcttcaacagcacaactagacatataggtaacatataattgtccgtgttacatcagaatgacagtgtaaacaaccttccaaaacatacccagggggactgcccatacgcatgtacgtaaaacaaaccgagaaaaaccatacacatatggacaatcacaaaacaagctagagcatactaggaccttgcaagcagcacagcacagcacactcagtccatgtacaaacgaaagaatgacctataaaattcgcaaaaccaaccaaaagccacaggtagccattcgcacaaagatgaccagcaatggatcgtgccaaccaatcatgatgagaggggtaaaaacaagcacatatgattgattgatctcattctgcgggaggaccggaagcagccgcttattcaaaagagatcggctttccgcttctgcagctcttgcttccaccctggctgcaggtagaacacgtccttggtgacgccgaagacagtctggaactcgctctccgataagtacgcctctctgcgtttgt

SEQ ID NO: 2561 - DNA, 1426 bp, Hordeum vulgare
  UNSURE (1)..(4),(13)..(16),(21),(24)..(26),(28),(29),(33)..(35),(39)..(41),(43),(44),(47)..(49),(54)..(56),(59),(61)..(63),(66)..(68),(79)..(82),(88),(89),(95)..(97),(120),(122)..(140),(157),(165)..(167),(194),(202),(207)..(210),(213),(215),(218),(219),(221)..(225),(234),(247)..(251),(328),(336),(337),(376),(414),(457),(459),(989),(1039),(1075),(1214),(1252),(1341): n stands for any base
nnnnccattgcannnnctgancannncnntggnnnttcnnncnncannnttggnnnggncnnncannncctatgtggannnncggggnntggggnnnttttctttcgggacggccccccnannnnnnnnnnnnnnnnnnntttttgtgggggtggtngggggggnnnccccacaaaaaaaatcccctttttttntttttttnttttnnnntantnttnntnnnnncggggggtnttttttttttttnnnnnggggggggggggggccccccccccccccaataataattttttttttttttttttttttttttttttttatttttttntctttttnntttttttttttttgtattttttttttttttttttttttnttgttgtgtgttgtttttgtttgggggggggggggcanaatttttttggtggtttttgggccgcggggcggggcggggtgngngaggtattgttgggggggggttttttctgtgtgggtgccgtcctgttgtgtgttttcttttttttgtttttgttttgtttttgggtgtttctttgtttgtttttttcttcttttttttctgttgtcggtggttttttgtttcttttttttctgtttgtggtttttgttttgggcgtccgctgttgtggtgctgtgcttgtgtttgcgcgttggtgttgtgttcttgttttttgttttctttttttgttgtgtgtttttgcttgtgttctttgtttgttgcttttgttgtgttgtgtatgtcggtgtgtgtggtggttgtgtgttttgttgcgtcgtgtttttcgttcgtcttttcttgttttgttctctgtttttctcggtttgttctgtttttttttcttttttgtgtgttttcgttttttcttttttttttttttggtcttgtctttttgtttcgtttcttattttttgtgtttctttttttgtttttcgttttttctcttgttgtgttttttttattgttttgttcntgtgtttttttattgatgtatcttgttttcgtgtttcttgtgttttctgntctttttctcttttctgtttgctttgttgtccgtgntatttgctcgtgcgtgtcttttgtttcttcttgtcgctcctcttgtgttttctggtctgttgttctctgtggcgtgtgttctctcgtgtttgtctttgtcgtgcttgtcgttgttcggttgttttgttcgttttctgtntgtcttcctcagctctgtctgttctcgtgttcctgttntgtttgtttcttcgtgccccttgttgtttgttcttggtgttgttcttgtgcggctttgtttggtgtcgttccggttccttgttgtctgngtgtgggtgttgttcggtttttgggttgtggtggttgtttgtctcttcgcgcggttcatcggtgctgtgttgcatggcgtcgtga

SEQ ID NO: 2562 - DNA, 544 bp, Hordeum vulgare
gggaaaaaggccattattcacccaagacctcagagttctgtttattatttactgctgcaaaagaatgacttgaaggacctcgatcgtttctcaaaacaaaggaaacaaacaaacaacttctggcgacacttcaatttatactagcactagcatgcatccatgcatgtcgtcgtgttagatcccttcacaaaggtgagtttcgccagatagctactttcagcgaaatcgtgtaggctacggtgaggccgagcccctccttcattctcggtgccgcttgcacctttgttaaccatatttctgcaagcgctagtgtcctgcagaagttggagcatttgctcctcgatggtgccgcgcatggccagggtctcaacatttattggacgggttgcacccattcgatgcgcgcgactaataacttgttcctccatactcctatcccatatgggttccatcagaaaaacatgattcacaaaactcaaatcaagacccagtgctgcggtgccatccatcagtaaagccatgcatgttggatcctctttatact

SEQ ID NO: 2563 - DNA, 552 bp, Hordeum vulgare
  UNSURE (21): n stands for any base
ggtctccccgggcctgcaggnaattcggcacgaggctcacgatgaggctcaggaggaagaagacatttaccgcagttaccaatatgatgatggcgatgaggatgacctttatgaggaatacataagcaggtcaccgagcattcgaattggcaacaggaggtggggtgacaatgggtacgtcagagggggcaggagagaggccaggccagtagtgatccctcctgctgctgatgctgttccatccaggactcccaggaagaaagaggcatcagcatcaggttcaggatcaggttcagtgtccaaggatgtcgcaggacggcgggcaagaagggctcagaagcgggaggctgctgacaaggcggctgcagagaagcacctcaagctcctgcagaggttgggccgtgggaaaacacctgaagcgccgcctgaagcaccagaatcacttgaggttggtcctccagagtcactcgaggttggtcctccagtgatcaggtgatccatctgcctctgtagataacggtgctgtggggaacgctgcagcccctgggagcc

SEQ ID NO: 2564 - DNA, 485 bp, Hordeum vulgare
cagtgtgggataaaccgaccgaccacatcgctgcatctggagcagactgggtagcagctccgatgaccgacctaacgagtgactcgaagctaaatttctgtacaacgcgacaaagttgccaggatacaaggcccggtttcctcttcttcgcaccgggagaattattggaggggctcccaggggctgcagcgttccccacagcaccgttatctacagaggcagatggatcacctgatcactggaggaccaacctcgagtgactctggaggaccaacctcaagtgattctggtgcttcaggcggcgcttcaggtgttttcccacggcccaacctctgcaggagcttgaggtgcttctctgcagccgccttgtcagcagcctcccgcttctgagcccttcttgcccgccgtcctgcgacatccttggacactgaacctgatcctgaacctgatgctgatgcctctttcttcctgggagtcctggatgg

SEQ ID NO: 2565 - DNA, 538 bp, Hordeum vulgare
gtccccggctgcggattcgccggggtcccccagttgaaaaagagtgcactcccactccgccgccgtcttcactgaatcgatcgagtggctcctcctcccccactccccactcactctgccgactcatctccggaccgcagccgcaggatacattggcgagcgagcagaacaccgcgaagcgagcgagcaggaaagaggaacaaggagatcgcgcgccggcgacgccatcgtccttccactttcggaggcggagcgtgatatctagaacatgatcaccagagctactcaaatggatgacggtgttcccctctctttgtttcagactatcagctactgacagcccggtgccccaaacagaggagcatatttttctagctccacaggttggcgtgccatcgcttgttcatgagccaaacttggggaggtggcgcttcaataactcttgagattctacaagttccctggctatgaggttgctatcatccgtggatctgcctcgtcatccgtggatggccatggttatcctccccctcctcct

SEQ ID NO: 2566 - DNA, 541 bp, Hordeum vulgare
cttttcataacagttattcagttaatgcagctactttcaaattgaaatctattagatttcaagtcttcttcctttaaagcctacatcagcagccaccaccaccagtggaaaacaatgatgcggtgcacaaaagcttaatacagtagtattaacctccatatcaatagggcccagcacacatgctgagctacatccaccgcaggaccaaataaccgctacagagatatgccggtcgccatccttcagaaccaaaatatgatatacatgtgcgagagtttactttgatctggtctgcctgcctgttgtctgattgctagcacttccatcaacaactgaagcaaagtgatcaactatctgccatctggctcctcggtgatggtaacgtcattattactgcagatggttacgtcattataactgcacagaacactacccgattcatcttccttagatacccttaggttgaagtatgccggatgtttaggctctggaagaataacattctcgctgtttaacattgcgacgacattcgacatggttg

SEQ ID NO: 2567 - DNA, 517 bp, Hordeum vulgare
caccgcgaggctcgctgccctgcctgcgctctctgtctccgccgccgtcgtcctagctgctagatccaagaagcttccggtcgacttccgttccacttccccaactcaaagagacacaccctcttccggctaggaagccgcaggccgcagcagcgagcgatggcgctggtccgctggtttctgttcctcttccttgccgccgccctggccgggttcgcctctgcggctcccttcgtgtttgacagcgtgttccataccagaaccgggtcgacggggaggaggagcttgctgcagaccaaggactcctgtcctctgaacttcgagtaccaggactacacaatcatcacaagcaagtgcaaagcgccaaagtatcctctcacggaatgctgtgatgctttcaagaaatttgcatgcccatttgccacatatctcaacaacaggagcactgactgcggagacataatgttagcctacatcaaattacatggctcgtacccggcaggtctattagaagagt

SEQ ID NO: 2568 - DNA, 547 bp, Hordeum vulgare
gttcaatccgcctatgcataccggcagagcttcattaccgcaggatcgaacatccgctacagaaatacgctggtcgctatacttcagaacccaaaaatgataggctaactgggtccggtctatctgcctatcttaggcgtaattaagcttgaactaatacagaaatataaagagataaatataaaattcccatgcctgctgtctgctttgctagatcttcattaagaaccgaagcaaattaagtgatcaactatctgccatatggctccacagtgatggttacgccattatagctgcatggagccgactcatcttccttagatgccatcaggttgaaatatgccggatggttaggcttcggaaggacaacactgtcgctgtttagcatcgtgatgacatttgacatggttggtcgatcgtctgcatgctcttgtacgcacattagtgcagtgttaacgtacctcctagcctccgccgcatgcacctcgttagcaaccgatgcttctagaagctcaagacaacgtccaccttcccacagctgccacga

SEQ ID NO: 2569 - DNA, 518 bp, Hordeum vulgare
aaatgggtcaaaaaggtgcaagacaacttatcctccctccgttcaactttttcatgtactagtactcattagcagttaattttataatattgttaaccaattgcactctatttgctggctgatcgatggactgcatgtagaccaatctacgggttcggattcctgtgtcctggagatgcctcagctggttcatgagctggaaaatcagctggccacctttaactcgtcatccaagccgcaggtcgtgcacagttgccatccattttccagttccatcatcatcggcaaggtccgcgacctcacccgcaacgtcgacagcagcgagtacgatcccgaccacgtcgccatcggcccgtaccattaccctcggccccagagcaagaacctgcaccttgccatgaagcacgacaaactggcaagcctcgccctcgtgctctcggcggcgagacccgccatgacggtggaggtctacgtccaggagctggcgtgcctcgtggaccacgccaggaactgctacg

SEQ ID NO: 2570 - DNA, 551 bp, Hordeum vulgare
  UNSURE (26),(32): n stands for any base
gcatgcacattcatttgaatacaggnactagnaacttacaatacataagcgtgacgacattccataactccaatgtgattttagtagtcacgtacaacatgatctaattattattatggcgccatccaattcttagcgaccgacgagatgttttcatcgttgtttgtagtaacacaaaacagagtagactgtttggatgactgcgagaagtaagccaatagcagctgccatgagcccaacggcaagccatgggttcctcaagtacctctgccttagccaggcagtccacctccgggggttgctctggaaccgcttctccagcttcttgcatgtctcccgtaggtagttgcagccggggtcatcagggtcaaacataatccccttgcaaaggtcgacgaagcatttggccacctcttcgttgttgccgtggccgtgcacgatgacgcctctcctcaccaagagctccacgtccttcgtggtgcaggccatctgggacatgaacacgcagtatgccgtgacatggctccccaccgtctcccggttcctctgct

SEQ ID NO: 2571 - DNA, 322 bp, Hordeum vulgare
acctcactagatctgcccgccgtcgtcgatcgccacccccatatcactccactccaccattgccatcatcccactgccaccccatcccacgccggcagcgttagctagcaatggcggctccgaccacggtgctcctcctcctgctcctggtgtcctcctgcgccgtcggggcgtacgcggacgcgctgccggagccggtgaacgaggaggtgctggggctggtggtgttccgctccgccctgacggacccctccggcgcgctcgccgcgtgggccgagtcggacgccacgccgtgcggctggccgcacgtcgagtgcgaccc

SEQ ID NO: 2572 - DNA, 439 bp, Hordeum vulgare
tttttttttttttttttttagaaaaataatgcttctaatctgtcacattttgacatccaaaagccaaaccaaaagcaaaaaagaaaaaaaaatgtagcacgacacactgtacaaaactcaggtgcatgccgggaccttaacacctgattaattttcactagcaaacacgtgacacgaacacagacaatgaagagcatcaatgcacgccggcacgtactactcgcggatctatgcatgcatgcatgcatggacacggtacgtccaactgcatgccaatcagtggatctccctcccctacctctggctggtcgtcgatcgagcccgctggcaggtacgtgcattgacgtgtcagaaaagctgcgccgtgcatccgggcagcgatggggccctgatgacctgcaggatctggaccacctccgccatggacggccggttcgac

SEQ ID NO: 2573 - DNA, 517 bp, Hordeum vulgare
caagaacaccgactgcaagtactgcaagtactcggcgcgggagcaggtgctcgccgaggtgcgcaagctggtggagcgctacaccgggcagggcgaggaggtgagcgtcaccgtcaccggccacagcctcggcgccgcgctcgccgtgctctgcgcctacgacatcgccgagacacgcgccaacgtgtccaccaccggcgccaaggcgcccgtctgcgtcttctcctactccggaccgcgcgtggggaaccctaggttcagggagcggttcgagggtgacctgggcgtcaaggcgctgcgcattctcaacgtgcacgactccgtgcccaaggtgcccggcatattcaccgaggccgtcctccccatgccgttgctgcgggtggccggtgcgctcggcctgcccagcgtctactcccacatcggcgtggagctggcgctcgaccacaggctctcccctttcctcaagaacgtcttcgacctcgcctgctaccacaaccttgaggcgcacctccacctt

SEQ ID NO: 2574 - DNA, 554 bp, Hordeum vulgare
atgcgctcttaatgttactttttattggcatacaatgatttaccgggccataagattaatttttggatgatccgggtgtatataaatttcattgaggctactccaatctaagatagggaaactcgagcgtaactacgtaactagtatagtcattgcaactatatatatacttgcaattaatagtgatgaattgacgacatgtgcaattccggtgcatcgatggatcgatcagacgttggcggtggcggcagcggtggcgttggcggtaacggctgcggcaactccgagctcagcgaggtgcagatcggtgtcttccgggtgaccctcaacatgcctcggacgatggggcaactgacaccgcccgtcctccgtcctgaccaggcccttgttgaactcctggcgccacacgggcggcaccatgtgatcgtccacgaggaagtcggccgacttgttgacgagcgccgggtccctgccaccgagcttgaactccttgccgcgcccctggtagccgttgagaaggtggaggtgcgcctcgaggttgtggtagcaggcga

SEQ ID NO: 2575 - DNA, 518 bp, Hordeum vulgare
cagagcgacgtcgacaagctcttctccggcttctccaagacccgcgagaacctctccgtagtcgacgagctgctcacctactggaacctcgccgacaccgaccgcgtcctcgacgatctcgaggaggcgctgctggtgtcggacttcgggcccaagatctcgttccggatcgtcgacaccctccgcgacgagatccgcgacggcaagctcaagtccgggaccgagataaaggcgtcgctgaaaagatgcatcctcgagctgctcacgaccaagggcagcaagactgagctgcagctcggcttcaggaagccagcggttatcatgattgtgggagtgaacggaggcggcaaaacgacatcgctaggaaaacttgcccacagatttaagaatgaaggagcaaaggtattgatggcagcaggtgataccttcagagcagcagctcgtgaccagctagaaatttgggctgaaagaactggctcagagattgttattgataacgataagaaggcacaggctcc

SEQ ID NO: 2576 - DNA, 549 bp, Hordeum vulgare
aaaactgtaatcgttgaaaaaattgttctaatagttctagcatgttagccaaaatcttgttacatgagaaacactaataacagggtcaaatttatgggaaaatggcttcaacaaatgcctctgcatcaaaaggttggagatcttccaccccttcgccgacaccaacaaacttgactggaattccaagttcgtctacgacgctcaccacacagccaccacgagcagtgccgtctagcttcgtcagaatgaatcctgtgattccaacaacatcgttgaactccttcgcttgctgtagcatatttagtccagttgtgccatccagaaccagcaagatctcattaggagcaccaggcagggctttagctatgactttcttgcaagaaaccaactcttccatcagaccgtaatttgtatgaagtcgtcctgacgtatcacacagaacaatatcaaatccttcacgcttcccacgttttactgcctgcgaaagaactgatggagcctgtgccttcttatcgttatcaataacaatctctgagccagttctttcag

SEQ ID NO: 2577 - DNA, 349 bp, Hordeum vulgare
  UNSURE (345): n stands for any base
aacagaaacatacacacccggatcagcagcggagaagtgctgagttctccgtgaacacttgaacagactcagctgagagagcagtgagtaggggaaagaaaggaacaaggggaaaagatagtggagcagtaagttaattagcagggcagccatgggattctgctgtgggccttcggatgtcaaggtgctcccaaatagcatctcctccttgtcgccgtcctcctcctcttcctcatcggcttctgctaaagattctggcgatggtggcaagaagaaacagcagcaaggtgtgaagaaggagcagaggagggagaagaagaagaagagcaagcttgaccaggccgncgag

SEQ ID NO: 2578 - DNA, 74 bp, Hordeum vulgare
ttttttttttttttttttttttttttttttcttttttttttttttttttttttttttttttttttttttttttt

SEQ ID NO: 2579 - DNA, 520 bp, Hordeum vulgare
aaaaggtttgagggcttattcttctctggtcagattaatggaacaacaggatatgaagaagctgcagctcagggtatagtttcaggaatcaatgcagctagacattctgatggaaagccactaatcgttcttgagagggaaagcagttacattgggactctgattgatgatcttgttacaaaagatcttagggagccttatcgcatgttaacaagtcgttcagagcaccgtctactatttcgatccgataatgctgatagtcgattgaccccttttgggagagagattggtttaatagatgatagacgctgggagatttatcagtcaaagcaagcccgcatcaaagaagaaaaagaacggttgaagcatacaagagtatcgggagttgaatttgctgccgaagttactgcagtatcaaaccaacctgtaaaggagtcatcgacacttgaagccatactgaaaaagccacatgtacagtataaacttctggacaagcacggatatggaaatgagcatttat

SEQ ID NO: 2580 - DNA, 547 bp, Hordeum vulgare
gaaagtagattttgaaattgcttactgcgatattcaaatttgaaaatttatgaaatatatgtacacaaaaaacagtgagcacctttcagcacagccgcggagcacgcttcccacgtgcctactgctctataagcgcagcagatcctctatgatctccttgatggacctagcattctgaataagcgttggtcatccacatgcctgaaactgaaaccgtctcagcaccacctaccatcctgtcaggccggtcgtcgaaaaggggcgtgcgttcaggtacatgacatgcatcctcagcatctcctgaacaattctgctgtgttccagttacgtcgcgagattccgttgccagggtcccaggttcggttgcccgtagtagtcacggccagcagtgcgtgcggttacgcgatcgtggcgctggcacgaaccgcctcgtctggagaatcgtccgccctggcattggcattaacattggccctggccgcggcgacggacctcatcatttcttgttgtcgcttgtactcggccgcgcggcgggtgctctccatcg

SEQ ID NO: 2581 - DNA, 367 bp, Hordeum vulgare
  UNSURE (14),(20): n stands for any base
caagcaagcccgtnatactnccatgtagtaaaggacagatcgtgcgggtggagaaagaaaagtacctgaacagcatcaattacctgtcagtggggcacccacccttctacaaggggctggactacatatatgaagaccgcggcgaggttttggacatcagaatcttcgaagaaaccggagagtatgctctgatcgcgtgggtcgggattcccaccccgccggcatggctcccaacctatatgctcatcaagtcggacaaactcgactacgagaggatatgatcgctggatgagcggttgcgagggaggataatgttctgtgcataaatctattcattatgtggtgacgctgtgacattgctccacgg

SEQ ID NO: 2582 - DNA, 427 bp, Hordeum vulgare
  UNSURE (66): n stands for any base
tttttgaataatttactattgtttcttcatttaaactgttttgttttgcatccgtggagcaatgtncacagcgtcaccacataatgaatagatttatgcacagaacattatcctccctcgcaaccgctcatccagcgatcatatcctctcgtagtcgagtttgtccgacttgatgagcatataggttgggagccatgccggcggggtgggaatcccgacccacgcgatcagagcatactctccggtttcttcgaagattctgatgtccaaaacctcgccgcggtcttcatatatgtagtccagccccttgtagaagggtgggtgccccactgacaggtaattgatgctgttcaggtacttttctttctccacccgcacgatctgtcctttcttcatggagtatacgggcttcttcttgaggatcttc

SEQ ID NO: 2583 - DNA, 517 bp, Hordeum vulgare
gctggccagattaaggagacccgcttgctcctgatgatgagatctcccgtaacattataggtctcgcacgtactaggccagatatttttggaaccaccgaggaagaggtttctaatgccgtcaaggcagaaattgaaaagaaaaaggatgagcagccaaagcaggttatttgggatggtcactctgggagcatcggttggacagccacccaggcaatgtctatcggtggagaagaacagggtgatgctccaggtccagctccacttccccggcctggcatgccgttaccccggcctccccaaccactttccttggtcaatgttccccgatttacacccaatccaatgccttatcatgtccaaccccctcatcatatgcaaggagttccaccgcatatgatgtccaatatgcatccacctctgccaccaggtcaacagcacatgattaggatgtcaggtcccatgggtcatatgccaaatagtatccctccaccgcctccaggccataatactcagtt

SEQ ID NO: 2584 - DNA, 545 bp, Hordeum vulgare
gcggctggcccttgctaattttatagtcttataatatgaatacagagctcttggttcctaagtactccctccgtaaattaatataagagcatttagaacactattttagtaatctaaacatgcttatattagtttacagagggagtacatatcaactttctactcttcggctcaattgctcaaatgcacaaacttattctcagtgtgcattttgccaacctcctgactctcaaagcaagctgcaccagacagcgtctttgcttacataatcccaaatacataggtgcagaaagaacatctagtcggtcgttggatcaacaacattttagaatagaaccatcatcacgacttcatgagtactgaagctcatgcaatctcagaactcaccacagtcaagtaaaacagatggtgatttaagctccttcagtaaaacctccgggctttactgatgcagtgcagaagcatcttaaaaggccaaatgtagaagccaatgcgggcacctgaactctggagcactatcaagtaggcaggtaggtatcgttagc

SEQ ID NO: 2585 - DNA, 548 bp, Hordeum vulgare
gtcccccgggctgcaggatggacggcgagtggtggcggaagaagtgggtggcgtgggcggcggcggcggcgatattcgtggtgctcatgctcgtcacccccgccatcccgcagaacgaggactaccacgacttcgccgaccagcgctccctcttcctcgggatccctaatacgttgaacgtgctctcaaacatccccttcctctttgtcggtctcgcaggactcatcttgtgccactacaagaactacttcaggctatgctcacagggggagctctggagttggacgctcttctatgctggtgtcactgctgtcggtgttggttcatcctactaccatctcaaccctaacgattccaccttagtttgggacagattgcctatgacgattgctttcacgtctatcgtggccattttcatcattgaaagggttgatgatagggcaggaacaaagtcccttgcaccccttgttattgctggtgcactgagcatcctgtattggagtttttttgatgatcttcggccatatgcaataatccagtttgttcca

SEQ ID NO: 2586 - DNA, 548 bp, Hordeum vulgare
  UNSURE (37): n stands for any base
gagccctgattaatttttcctccctgtaaagatttgnatcatggaaaaccacgcacgaatgtcgattagcaggcaataaatacacaaccgtgcacgctggggctcctgatattcagatggatactatttttacacttcggggtacattatgaaaaacacatatctactgttgttcagacgtagttgaaactgcagcataatcatatttgacatctaccgtgttgctatctttggaaccgccttctctccaactgatcttccacatctggagtaagcttaccctgtcaggttcaattgtcctctttgacaacataagagtcaagaaaacaggtaccatcgcagcacatagatgtttaagagtatgtccgctaacaatgtcatgtgtccacctatatataggtttgtctgcagcctcttctactttggcaagaaggtaaaatcctgctgcccacaaccagtagcttgaatgtgtatacattggtggaataactatagccatcacaggtattacaatgcatggaacaaactggattattgcatatggccga

SEQ ID NO: 2587 - DNA, 492 bp, Hordeum vulgare
gggctgcagaattcgtacgaggccgacccgccctacaccgaggacatgccccgcctcgaccaccccaacttctactacgacctcgaggacgtgctcttcgacgaggtctcccgccgcgacggcgctgtcagctggtccgtgcaccgccccaccgtcatcttcggattctccccccgcagcgccatgaacgtcgtcggcagcctgtgcgtctacgctgccatctgccgtaaggagggcgccacgctgcggtggcccggctgccaggttgcctgggagggcttcacggatgcctccgacgccgacctggtcgccgagcacgagatctgggcggccgtcgacccgttcgccaagaacgaggctttcaattgcagcaatggggatgtgttcaagtggaagcagctctggccgatgctggccgaccgctttggggtggagtgggcggggtatgagggagaggacaaccggttttcgctctccgacgccatggctggg

SEQ ID NO: 2588 - DNA, 548 bp, Hordeum vulgare
gtgtaaaaaacgatttaacgctcgcaactcgcaatgcaatgaagacatgacgggcaaagaaaaccgattacaacttgggagctttatttggttctggcttattctagattacaacaattggcacaaataacagcatgtaactaatttcagaagcaaattgataaatgagagataaaatgggatctggtggcatacgctgtaaagaacaatagagtactagacaataagagcatcaaggaacaaccttggaagccttcatcttatcgatccaagcgatgaaggagttgatggtgttacggaagccgaggaacccatgctccttgctcttattcatgttgtccaaatgctcgatgtcgatattgaacatggcatcaacgaacccccagctggtgatctcctcaagctccgtcgtgacaagctcgttctcctggaggatctctgtccacacggcctccttcccagccatggcgtcggagagcgaaaaccggttgtcctctccctcataccccgcccactccaccccaaagcggtcggccagcatcggccag

SEQ ID NO: 2589 - DNA, 254 bp, Hordeum vulgare
acagagatataggaatttccccggccccgaaaagatccctcttttcccgctgctcgacggcggccggcggcagccagcgtagcgtccatgaccacagtcgcctcgctctccctggtgccgcacctgctcatcaagccctccttccgctgcctctccagaaagggggttggcaggtatggtggaatcaaggggtacgcggtgctcagggatgatagcgccgactacctgaaggataaccaccactgggaggccct

SEQ ID NO: 2590 - DNA, 552 bp, Hordeum vulgare
  UNSURE (17): n stands for any base
gtaccctattatgtacngctttgacagtgacattggaggatactttacatgaatgaagggagggggagaaaaagaagaagaaaagcaaatcaacctcagattacaattgcatcagttgatgccgccgctagtgtacaattaacaatacacaattgcaatgatggtgcccatcatccttttcacagggctacgtttccagagtccttctatctgtagcaatatttggccaggcgaacaaccgtgctgcgacgcacgaccaaataatctgcccatacgggtcatctggctgccattgccaagccaaggaatggcacgagagaaagtgactacaggtgatgtcatgtgtttgcctatgatccactctcaatttcgttgctgaacggtaaccgatcgacgcccctctcaactgcatccctccataaccgataccggatgccgagcttgtcatacgacactggccagttccaaacgttagctccattattcattcggtcttgttggccgagcacaagccgcagatcctcattcaagaccttctcagcgaaatgtgac

SEQ ID NO: 2591 - DNA, 518 bp, Hordeum vulgare
ggcctgaccacgtctccggcgtgcccaagtccattaagtgcgacaagggcgagcggatgcggttccggtccgatgtcctgtcgttccagcagatgtccgagcaattcaaccgggagttatctttgtctggaaagataccatctggcctgttcaatagcatgtttgaatttactggctcctggcagaaagatgctgcgagtaccaagacacttgctttcgacggttggtgtatcacactatatactgttgcactctcgaaggcacaaattgtactacgagatcatgttaagcaggctgttccatcaacctgggagcctgctgctttggcaaggtttattcaaaaatttgggacacatatagttgttggtgtaaaaatgggcgggaaggatgtaatttatttgaaacaacagcattcatcaagcttgcaagctgttgatgttcaaaaacgattaaaggagatgtctgacaggagatttcttgatgcaaatgggcaatctgacattagtttcagggatacg

SEQ ID NO: 2592 - DNA, 547 bp, Hordeum vulgare
ttaacagctgaatcttttgacatgcaaaccaaacgtttccctgttgcattttgtatatatacaaataatttgatctgtcatctaacctagtcaactgaagtccacaccacaaataacaaatttcctttttctccctccatttcaggaaacagcactcattccggcgaaaacccataaactgtatacaacagaaaccaacagcaaagagcactgaggcaatgaaaactctaaatctttcgcccgtctgcaccctcatggtcagctgcacataacaaatgaagggatgacgatgatgtctaggtcgtttccgcttgttttctcggggcacctagaattcatcaccgggcacctagaattcatcgtcgagcgcgtactcttcgtcgtcgggcagcatggccgtcagcagtgagtagcgcacccgcagggatatcttgcccctctctaggtgtagcttagcgccggagaccacccagtaccccggcaggtcctgtggcccacgcaccatctccgtcgtgtccacgaacttgagcagcttcgggggctgcac

SEQ ID NO: 2593 - DNA, 162 bp, Hordeum vulgare
ttttttttttttttttttttttttttttcgggtgcaataaaatcaatttataggatataagggagtaagatatctccattctgcaacaagtgaaaacaagacagaatcctcacaggtgccaaagttacatttcagtctaaaacatactcatggtaaaccggt

SEQ ID NO: 2594 - DNA, 397 bp, Hordeum vulgare
ctcctcctcctcccctgctccttgccgccgccgccgccctaggatttgcgcaggcgaccaccgtccttcaccatgccgaagcagatccacgagatcaaggactttttgctgacggcgcggcggaaggacgcgcggtcggtgcggatcaagaggaccaaggacgccgtcaagttcaaggtccgctgctccaggtacctctacaccctctgcgtccacgacaccgacaaggccaacaagctcaagcagtccctcccaccaggtttgaatgtccaggaggtttaagctgcctcaaaccagatcatgcctttactagtagcgggaatgttgggttaagcagcgtctgtgttcagtaaaccggtttaccatgagtatgttctagactgaaatgtaactttgg

SEQ ID NO: 2595 - DNA, 514 bp, Hordeum vulgare
cttcctccttatttccttagataaaaatagtgttctccatccttccaactctccaatagacctcatgcttatctctctatcttcctcagattcccagccatggcttacttgtgtggacttgtccgtgtttaatcgcatgttcatatattccggtctaatctcgatgagtgcttcaatctcttcttattcataaccaattatttatgctatcagcgctgatagctgattcatttgatcgccagtatgggaggggcccttactactcttttgccacttcaatcagaacatgtagcactcgtttttccagtgttgtgcatggtgcaataccatacttagatatccaaggttttcgtttttaagaagtctgttatataattaccaagtagaattcttcttgtcctttttcatgataagactccaatatcatcgttgttgtactctttttccgcttaccatgattgatagtcttcagtcggaacatgcggtacacgccttttcagtgttctacatggta

SEQ ID NO: 2596 - DNA, 552 bp, Hordeum vulgare
aaaatcttagcattttcctgttctctatttacgaattacctaatggtaatgcatgagcagtagtcacaggataacttccgatacctccaagcagttgcaactcataagatgaaattatttacaaagagtggccatgactacctaccctacctgctatctacagttttttttggatatactattcacagttggtgtcgaagagacgtaaccaatctaggaacatacatgggcaaggaatgaccccggaagctaagatgatgaattggaagaggagtcatgtacacaacctacttatagactatatataattttagggccatttctcaaccaacacctatttgacaagggcaagaattttacttcgtattgatgaaacagatatcacaattcaccattacggcattacttacctagttgatgccaaagaaacttaataatatctaagaaactatccacctaaggaatgaccagagaagctgagatgatgaattggaaggagtcaaatacagaacccatttttagattatatgtacaaaattttagggtcattac

SEQ ID NO: 2597 - DNA, 60 bp, Hordeum vulgare
  UNSURE (10): n stands for any base
gagcttcaanaacctgttagcgcctcgacctcggtcacaactgcctcttcacgctcgagg

SEQ ID NO: 2598 - DNA, 482 bp, Hordeum vulgare
acatcgtttcaggttaggttacatatttcaggtgccaaagaaccatcaaaacaaatccagatgcttgcctacaatgactctcatcgcgacaagaccctacagcaggattttactaacagatctcagcctgcatcgtctgtcaatcccaccacgcaccaggcaccactaatcccatcccgacagtccacccgcacccacctcaggcgcagagcacaattgcttaagatccgacgcgtccatagggatgcccttcgccttcttcctcttcttggtgtgatcaatcaccaggcctccaaagaattttccatcggcagcagttcccaggggcttgtccttcgataccggctctggaacgctgccgtctccagaaaacatcaactccgcaaacgacacttcggtgtcatcgattcctcccgcatctttatcttctttgttggcagatttcttcttttccttcttggtctttccttcggtgtcattgg

SEQ ID NO: 2599 - DNA, 511 bp, Hordeum vulgare
ctcgtagagatagcagaccagaatttctccactgagcgcctctagctagctgcaccagtgccaacatcaagggagcagcagattcgatctattctacagacagcctgagccatgatcaccgaacatcagtagcgaagcttgtacttcttccatactcaaggaggcagcatctacactggattctgaggctccagcacccagatctgatggaaagaatcatggtgagcgctgccactggggtgatgaactccctcctcacgaagctcatgcaactgatgagtgacgagtacaagctgcagaaagccgtgaagagcaaaatcggctcactgaaactcgagctgagcagcatcaatgcttttctcaagaagctgtctgacaaggatgatcttgacccgcagactaaggaatggagagaccaggtgagagagatggcctatgaaatcgaggactgcatcgataactacatgcacaagcttgaccgcaagccagataaagtaggtggcatcatggg

SEQ ID NO: 2600 - DNA, 555 bp, Hordeum vulgare
  UNSURE (30): n stands for any base
tgaagcagaattgaatttgaaatcatgtanccgctatcaccatcatggggtacaatgggatcgaagataaacagacataaaaatatattcataccagcaaatattaaccatacgagtataaatagatgctactatgaacacccacaaaattaacatcaacaaaacgaattagtcccacgattgaaccgttgcaaacaggtactctaccacaatccagaatatccttaacattaaactttttcgacttcagtcaatcggcccttggcacaattaaaattgctgtagaggagcatgcaaagcactagatgtttcacgtatcaaatcatctccattttttttaatcaacttaagcattgcgagagcttccaatccccagtctgtagtagaaatgcattgcatttgaagtgtactatgtcaaaaaatagttccctccagtgcaatttattttgaaggtgaattccctccggtaaataactgattcctgtagtgtatagaaccaatcattaatacaatgcattattggcttcatgcttcaactaccctatcaaattatca

SEQ ID NO: 2601 - DNA, 516 bp, Hordeum vulgare
cgatattattcagaagttctatcatgaaaacttacagctgatcgtgtggttctagcagcgtcaggtgttgatcatcagcacttgttagatgtcgcagaacctttgttgtctgattggcacaagggcccccctatggaaacaccaaagtctacgtatacaggtggtgacttcagacgcaaagcagaatcagatatgacacatgttgcgttggcttttgaagtgccaggcggctggcttaaagagagagatgctacgattatgactgtcatacagaccttaatgggcggtggcggctcattctcctctggtggtcccggaaaagggatgcattcacggctttacctgagagtcctaactaaatatcacgacgtccaagcattttcagcattcagtaatctatatgataatactggcctctttggtatctatttgacaacgccaccatattttgttgcaaaggctgttgatgtcgcggtgcaggaattgattgctattgcaacgcctggacaagtgacg

SEQ ID NO: 2602 - DNA, 535 bp, Hordeum vulgare
ctcgcagacaaaatttgcataccaagtttttaaaaaacgtattcctgtctagctgagaaatttcttcagcatctgctgtttgaactaggctactacaaacctaacctcactgattcatcacatgagtgagtattaaaacaaaagattgtccgagcaccatgcccaaatgcaaggagaactggaatcaaggctagagctacatgtcttcatcttcacaagagatcatggtgttcggtcgccctatcggaaacgttgcaaccgcttgctaacaaattcgtacggaggaactttatcaacgtctccatagctagccattgtgggttgggaagataacaacatcttagaaaacgatgtgacgtcatttagggtcagttcatccatacactgaagaaaatgatcgataggcttcctgcaaccataagtcaaaagctgtcgccctatatcttctgcaacaatcacccttgattcaagattcattaacacggatgaaatcgtcgagtttttcgcacgtctcagctcaacctccgtcacttgt

SEQ ID NO: 2603 - DNA, 542 bp, Hordeum vulgare
  UNSURE (3): n stands for any base
ggnctgcaggcaattcggcacgagggttattttggagctgcagaaaagactctttgatcaggtgaatcaaaagaaatgccaattaaataagctagaaaaagcaattcgaaatactaaaaacatggaggaaaggagcctggagcaacatgcaatgaacaaattagtagagagggcatacaaaaaattgctgggtggccgaggtagttctagtcacaagggcggtctcagtaaagctgccagtaaggctgcaaaacagcttgcattggcttttgccaagcgaacacttgcccggtgccagaaatttgaggaaacagagaaaagctgcttcagggagcctttcctctggagtgtgctgtctgcgcctttgccaaagagtgatccggttgatggtggccctccaggatctgcagataggccaaagtctgtaaagcttgacagaagcccattgagccaaggtagcacaaaatggaaaaagggtgagagagaaagggaccagagcagggacgggtctgccaagaactccagctcgaaatcaggccgca

SEQ ID NO: 2604 - DNA, 546 bp, Hordeum vulgare
tttccgtgagcatattatagtcttacatgatactcggactgaaattgcacattagtatatgctgtcacctcatgatgcttaccaataccaattggggttagttacatcagctaaggtggttagtgcggcaaaccagcaaaggcggcgcttgctaacacagcatcaagaatcatccaattatatgcacatatatataatgatatttactatagctctcatctcacatgaaccctagctgggtgagatcatcgtccgggatctcaaggcctccggagaaatcaaagtcctgcagcgagtcgtcaaggccatccgtgaaccaggcactgatgtcgttgccctctggcacgtccaggatgtccaccatggggtccatcggcggcaggttcatgggggcatcctggggctccggggcgacgttggccgcgctgttccttggttgctgggtaggtcttgtgctcagagggttgttccactcgttggattctcgcggcgacggtgatgggaagctggagttggatggctctgtgactctgccaaggacgtttc

SEQ ID NO: 2605 - DNA, 518 bp, Hordeum vulgare
ccttcttttagtaaagtaaggaggatgacagttggacttggcacaacattaccagagaatattctgcaagctcttcctgagatttgcccatttctcgagtctttggttcttaggtttcaggtaatctctgatggggttgtaagaaatctattgcaatcatcaacaaagcttcaggtgctctgcctgcactattgcctcggcagtttgacttcatttagctttcaaacaatggcaccagcattaagaatattacggctccagtgggttactccatggatgacaaatgatgatatgaccattcttacacggaattgtaatttagttgaacttgctctctctggttgcaaactcctagactccagctctcaagagataatctcgtctgggtggccaaacttgacatgcttacaccttgaggaatgtggtcagataacagttgatgggatttcttctattttacactgtaaagctttggaagatgtgttactaaggcacacgggtagaggtatcggaagaac

SEQ ID NO: 2606 - DNA, 548 bp, Hordeum vulgare
gtttacatgtcgtgctgcattttcccggttcctccgtcaaaaaattcggtgattccatcctccttgtataacaaatttgcagaccacctctctacctggacattccccagaaaaataatgcaaaggaaaaaaaataaactgttactccttcaagacatgttgcagttttcctctcgaaacaaagaaacaagttcagctacatgactatatcctttcttccacgacggtggtcgttagttgccggctgctccactccagcacgatggtctccctgtgctgcaccgccttcgagttcgagttcgagctcgagctcgagggggaagcctctccgaagcacgacctcgccgcggccgacttcttgcacctgctcatcctcacgctccgcatcatcttcccctctgggtagttcggggtgtcgaagcccccctcggacgcgtcacagaggtccagcgccaacttcctcaggagcggtaactctctgatagcatctgttatgatggttcttccgatacctctacccgtgtgccttagtaacacatcttccaaag

SEQ ID NO: 2607 - DNA, 517 bp, Hordeum vulgare
ctcgccgccgtgttgccgtgctctcctgccgccgccggggaaggagagccaccgcgacaccttgggcatcgctagcggaaggctgaaggccgccgttatttctgccgcggaagggggcggcgtcaggaggacgccgtggccgggctgcgcggcggctgtgctctccgagtggtggaggacgccgtcgtcgccaaacgccgaggggttactgaaaagtgatgtctcttctaatttcctcctgaataaataatgtgcctgctctctttctcaagcggattgtggtgcgataattgcaaatggatattcagatgattccttctacagttgaggacttggagtccatggtcatcgatgaaagtgcagaaccgaaggcactaccattatcacttttggatgaaatcacatgtggtttctctgaaaagcaggaaattggccgcggtggatttgcggtagtttatgagggaagccttctgaatgtgacggtggcggtgaagaagttgaccaacctgcatatgcg

SEQ ID NO: 2608 - DNA, 517 bp, Hordeum vulgare
aacaatgccagcagtacatcaacaacatgacagaaaggtttcatatgtgcattacatcagtctgaattgtaccaaaagcatcaccaactgttcagcatcaaccaacgtgatagaaaggtttgaaattatcgaagacaatagtttatgaagcaagtgagtagatatcagttgtttccacttgcagttcgatactcccatcctctttgccccaacatggaaaattagttgatttccaagattgccagcccctttgtaaatccgatcacaacactacaagatataaagaattgctcaaaagtttgaaggattgaaaatgacaccacatatattttctgaattccactacaaggcgtatatattgttaggcaaaagaaacaaccactcttgtctgcttgctatagattgatgtaacaaaaaaatatggtacaaatatacaacgttacaaatgttttgaggggttgcagaaaactttttaaagatgtcattcaaggtacggagactaatgttgtccacaagc

SEQ ID NO: 2609 - DNA, 182 bp, Hordeum vulgare
acagatcctcccgtgcattggtttggggtcgtgattctagcaatcaactaaacctgctcgttgagaacgactacatgtatcggtttgtgctctcactgcaatactccaccccaagtgccatccttctcggcgcgatcgcgagcctgaggggttacagcgttaaggaagcatctgcgctcctc

SEQ ID NO: 2610 - DNA, 485 bp, Hordeum vulgare
  UNSURE (45): n stands for any base
tgtacagacccatgtatcgacagtaattaacgacaaaaagtgtantctcctggttctcgaataataatacatgtgatagaaatacaatcactagcaaattatgatacacttcttaaccacaaggaggcatggctgagaattcattcaagcactccttttcctgggaatcacctcgcatgatgactgctataaaccggttttgcgaggcttcagatgtacgacaacagcttgaaatatacgacgaggtagatggaaagagagaacaccgcgcagatgtgctgccagaagaggagcgcagatgcttccttaacgctgtaacccctcaggctcgcgatcgcgccgagaaggatggcacttggggtggagtattgcagtgagagcacaaaccgatacatgtagtcgttctcaacgagcaggtttaacttgtctgctagaatcacgatgccgataccaatgcacgggaggatcagaagccttgcgacgat

SEQ ID NO: 2611 - DNA, 517 bp, Hordeum vulgare
caccagcaaggccccggcgctgaacgagcggatcctgtcctcgatctctcgccgctcggtggccgcccacccgtggcacgaccttgagatcggccccgaggcgccgaccatcttcaactgcgtgatcgagatccccaaggggagcaaggtcaagtacgagctggacaagaagactgggctcatcaaggtggaccgtgtgctctactcctccgtcgtctacccgcacaactacggcttcatcccgcgcaccctctgcgacgactccgaccccatcgacgtcctcgtcatcatgcaggagcccgtcgtcccagggtgcttcctcagggcaaaggccatcggtctcatgcccatgattgaccagggcgaggccgacgacaagatcatcgccgtctgcgccgacgatcccgagtaccgccacttcaacgacatcaaggagctcccgccacaccgcctcgccgagatcagaagattcttcgaggactacaagaagaacgagaacaaggaggtggccgtcaac

SEQ ID NO: 2612 - DNA, 558 bp, Hordeum vulgare
acatctatatttacttacgccggtaaatcgtatacataaggtagttggggaaagaatgccctgtttatctggctgctactactgccttaatgcaaggctttgggggatcaatatcatatactagtagtatatatgtgtatgtatgcaggtaggtaacataaaacaagaatgtatgtatgcttatgactgatgaggtagataacgctcttgacacgaataacttttcgtcaacatcgttcctcgagcaagtggtaactggcgtcgccggatctattatctaccttctcaggccctcgcaaatgtaggtggcatagagatccatggagtgctggatggcctcgtaggcgtcctccgatggcaggaagtcgttgacggccacctccttgttctcgttcttcttgtagtcctcgaagaatcttctgatctcggcgaggcggtgtggcgggagctccttgatgtcgttgaagtggcggtactcgggatcgtcggcgcagacggcgatgatcttgtcgtcggcctcgccctggtcaatcatgggcatgagaccgatggcctttg

SEQ ID NO: 2613 - DNA, 551 bp, Hordeum vulgare
  UNSURE (11): n stands for any base
gtttcccgggnctgcaggaaattcggcacgaggggctggagaagagcaggtacttggccggggactccatcagcttcgccgatctcaaccacatcccattcaccttctacttcatgaccacccggcacgcgtcggtgtttgatgactaccccaaggtgaaggcctggtgggagagcctcatggccaggccggcggtgcagagggtctgcaagcatatgcctagccagtttagctgcctactaaccactacgccctccataaactaaactaatatgaaagcttttacatcaccataactattttagtgtagtgatctaaacacttttatattagtttatagagggagcagatgtttatgagcgcgggtgtgtgcgtgtgtgccggtgatgattccgtttaagagaaagagacatcgatcccgtgggtcatcatcagcactagcccgcttgcgcttctgttggtgcgagcgagcctgattgtgattgatgtacctacttggattccttgctttgtgcactagtatcggtaaataaacaactcgtcaatgctaa

SEQ ID NO: 2614 - DNA, 515 bp, Hordeum vulgare
  UNSURE (11): n stands for any base
gctttgacgangttgtttatttaccgatactagtgccaaagcaaggaatccaagtaggtacatcaatcacaatcaggctcgctcgcaccaacagaagcgcaagcgggctagtgctgatgatgacccacgggatcgatgtctctttctcttaaacggaatcatcaccggcacacacgcacacacccgcgctcataaacatctgctccctctataaactaatataaaagtgtttagatcactacactaaaatagttatggtgatgtaaaagctttcatattagtttagtttatggagggcgtagtggttagtaggcagctaaactggctaggcatatgcttgcagaccctctgcaccgccggcctggccatgaggctctcccaccaggccttcaccttggggtagtcatcaaacaccgacgcgtgccgggtggtcatgaagtagaaggtgaatgggatgtggttgagatcggcgaagctgatggagtccccggccaagtacctgctcttctccagcc

SEQ ID NO: 2615 - DNA, 521 bp, Hordeum vulgare
  UNSURE (2): n stands for any base
gnatcgccttcaacatgggtcgaaggagatttcaaggtcttcgagggcaaatggtctgtccacgaggtcgatggtactaccgacaaagatggggaaatttcggcgggccaggaatttcagaccacgctttcgtatgtggtggagctggagcctaagctctgggttccagtcaggctactcgaaggaaggatctgcaaagagatcaaaaccaaccttgtttgtatcagagaagaagcagagagggtccaaagattgcaggggacgagtgataactaggatgaatcctgaaggctttcttacaatgtcgttcttgattatagttctgtgtacgctccttaacagagggaatcaggtaaacaaaaatcagcatgcttcttgcatcaaggtgttgtggaagggcccccagttgtgttgacatggcaggataacgaatggagggacttcgcctgaaccaagtcttgcagtttaggatttgttttttctacctaatcgaagagtgggcaactctgcatacataattt

SEQ ID NO: 2616 - DNA, 549 bp, Hordeum vulgare
gctgcattatattacagaatgaatttgctacacgtagaatatatcagagacgacattacaacaaacacaactggacagtgtttgctgtctatgcattacagtcaaccaaccatcccgtcaacatcttctaacaaaattatgtatgcagagttgcccactcttcgattaggtagaaaaaacaaatcctaaactgcaagacttggttcaggcgaagtccctccattcgttatcctgccatgtcaacacaactgggggcccttccacaacaccttgatgcaagaagcatgctgatttttgtttacctgattccctctgttaaggagcgtacacagaactataatcaagaacgacattgtaagaaagccttcaggattcatcctagttatcactcgtcccctgcaatctttggaccctctctgcttcttctctgatacaaacaaggttggttttgatctctttgcagatccttccttcgagtagcctgactggaacccagagcttaggctccagctccaccacatacgaaagcgtggtctgaaattcctggcc

SEQ ID NO: 2617 - DNA, 540 bp, Hordeum vulgare
ggtctgcaggcaattcggcacgaggcaaacttcagaaaaatcgacggaggaagcatttcaagcatctctttcgaacggtgactcacaggaccatgtaggaagctcttctgttaatgggagtcttcctaatagcggtcagcttgacggggaatgtgacaacgacaatgggatggtacgagttccaggtgataggacaaattacagtagtgatgcatctggagaagttgctgacggtgggccttctgtctcttctgcccctcaaagggaaaatgtaatgctgccaagattgggtgatgtccgcatgagagggcaatttgttcggcggcaaccatctgacaggggattccctagaatactatcttcctcgtccatggatgcccggggtgatctttctgccatcgagaatcaggtacgcaagctaatcgatgatttgaaaagcgattccatagaagctcagagatcagcaacatcagagatccgccttctagctaagcacaacatggagaacaggattgtcattgcaaattgtggggctataaa

SEQ ID NO: 2618 - DNA, 551 bp, Hordeum vulgare
ttagcaatcctgaataagttgcaacaatagctaacagcatgtacaaaaacaacaaagtcaacttcggccaaatagatgccaagggacgacaagctgtacaaaccgacaaaatacaccatctcgacaacaatgacgacaaccaacgcccacactcatcccgcgcccgacagtacgtagcatgagatggatgatgagcacaatctctctcaatttgactataaacaaacagtacacagcgccagccagtcaacaaatttaaccgccattcaggagaaatgcttcatgtacactacaaaactatgatgctaacatcatcatcataatcatcatctcctcgccgagttcccgtgtctttggctgcggaaatagctaagaagagcctgcgccttttctcttgctcgcggtgtccctgactgtgacagcgcgactagagggggcacggcaccctcttggagaactatgctgcagaacctgttgctgtttgtgcatagctgaagcaacgccgcggcagcgttttctttcccccgcgctgaacccagctcgacgacttc

SEQ ID NO: 2619 - DNA, 522 bp, Hordeum vulgare
caaaccccatacgctcgcttgactcgaggtccaggtccaggaggagctcctccttctcctcctcctcggaagccggccatgtcgtcctcctcctccaccaccaaggtcttcaccctcgaggaggtcgccaagcacgcctccaaggacgactgctggctagtcatcgccggcaaggtgtacaatgtgaccaagttccttgatgaccaccctggaggcgacgacgtcctgctgtcttcaactgccaaggacgcgaccgatgactttgaggatgtgggacacagcacgaccgctcgggcgatgatggacgagtactatgtcggcgagatcgacgcgaccacgatacccaccaaggtcaagtacatgccgcccaagcagccacactacaaccaggacaagaccccggagttcatcatcaagatcctccagttcttggtccccctggcgatactgggcctggccgtcgccgtacggatctacaccaagtcggagtctgtctagtaccgtcatcttatatcagtcata

SEQ ID NO: 2620 - DNA, 557 bp, Hordeum vulgare
  UNSURE (38): n stands for any base
agaattgcatgtctaaacattcacagcaatatggaaanatatagcaagtatctaatccgtttacccgagtatgattaacagcggacgtcttagaaccataacgcaacgacgggtcgagaacagttcccagatttcatgacaggacagtgacgctggtacaaaatatgcaaatccccactaaaaacttattcagctcttgaaccctttccgaatgactgactgatatgactgatataagatgacggtactagacagactccgacttggtgtagatccgtacggcgacggccaggcccagtatcgccagggggaccaagaactggaggatcttgatgatgaactccggggtcttgtcctggttgtagtgtggctgcttgggcggcatgtacttgaccttggtgggtatcgtggtcgcgtcgatctcgccgacatagtactcgtccatcatcgcccgagcggtcgtgctgtgtcccacatcctcaaagtcatcggtcgcgtccttggcagttgaagacagcaggacgtcgtcgtcttcagggtggtcatcaaggaacttg

SEQ ID NO: 2621 - DNA, 976 bp, Hordeum vulgare
gtacccccgggtctgcaggaattcggcacgagggagagagagagagagaactagtctcgagttttttttttttttttttttggcaacccccccaaatttgacctttgggggggtttccaaaaaagacctcgttgaggagctcctttgggtttataaacccccctttcccctcgaagggtgatcctaaaaaattgggcccaaaagtgggcccataaaaaaaaacacttttttgggttaacccccaaaccccctggggattttttttgggggtttacatccagggaagggaagggcccctgttgggttaatgcgggggggggtttacatccaaaaccccttgataaggtagggttttttggggaaagacggatggggaaattataaatttgaggcgggcggggaacccatgtttgttgatttaccacttgccccaggaccaccccaagttggggccccctttgcattgggggaacccgaagccgcctttttccgggccctttttaatggggccgaaattggctttttgggggggggaaacggcaacaagggggggggccccgggggcctttacctgggggaactttttgcacccccccaacccgttgccgcttttgggggctttgccacaaccgaagtttccttccgagaaaaacatttttggggtttctttggaatgggaggggggctttaatgggggtgggatagaaccttcttgcctcgggcaaaattggcacgaggcccaccttagaaagtccggcccacccccccctttttggtttgtttcaaaaaataactgattttgggctgcctccggttattctaaggggttggtaagtgaagtttgctttaattcgcaaaaaatttcttttgaaagtccccaaagagagggtttgcctgtaaacactcggtttttgggccttggggaacaaaatttaaacatttcccggtttctgggaggttccaaaatctttgtgtt

SEQ ID NO: 2622 - DNA, 541 bp, Hordeum vulgare
tatgacacttgtggtggtttccgaagaagtactcgctgatgagctactctcggtttattaacgacccattcacctcgcaagttgatactagcaaatatgggccagaagttggtccataagaaaaaacacatgtataggttaaaccacaaaaccactagagattttatttaggggtttacatgcatggcatggcatggcacctgctgtgctcatgcaggcaggtgcttacatccaaagacccttgatcaggtagcgtttcatggtgatagacggataggtagattatagatatgatgcaggcagtgaatccatgattgatgatctagcagctgcagcaggagcagccgcagctggtgccgcacttgcactgggtgcagccgcagccgccgttctccggcgccatctccatcgcgccgcagctcgccttctgggtggcggtgacggcgacgaggagggtggcgccggcggcctctacctcggggtacatgttgcagccgccgcagccgttgccgcacttgcaggcactgccacaaccgcagtt

SEQ ID NO: 2623 - DNA, 463 bp, Hordeum vulgare
gggagggttcgcaaggaaccttaagggccacgagttaggggagcaggtgttggccatagaggagtcattcaaacacagggtgacaaatgtagtgttcatggggatgggcgagcccatgttgaacctcaaagcagttctggaggcacaccaatgcttgaataaggaactaaagattgggcaaaggatgatgacaatctcaacagtaggagttcccaacacgataagtaagctatcatctcacaagcttcagtcgacactggcagtcagcctgcatgccccaaatcagaggttgcgtgaaacaattgttccaagtgcgaaggcatatcctctggaagcactaatggatgactgcaagaattatttcctcgaaactggacgcagagtatccttcgagtacactctgctagctgggattaacgatgaaaaggcacacgctgaagaacttgcagcgctgttgcatgca

SEQ ID NO: 2624 - DNA, 555 bp, Hordeum vulgare
tactttgcccaaaaggcttcgtccgaatactcttttataacttataagccagtgatctatgtgagcagagcaattcagggcctgtgtgaactttagaatgcagaaattacaacaatctcaatttctacataattgagatatattccatcactaagcaggaacaaggctgggctccgagggcgaagatgactcaagcagttggttaggctcagagggcgtggacgactcaagcagaggattcttctggaactcatttctgagctgcccacaagccgcattagcgtcaagcccacgggtctgtctgacgctgaccgtgatcttccgagattccaacgcatcaacaaaagcttgaatcgcttttctgtacggcctcttgtactcagaaccttctaccgggttatagggaatcaggttcacatgataaccgcctccacatgcatgcaacagcgctgcaagttcttcagcgtgtgccttttcatcgttaatcccagctagcagagtgtactcgaaggatactctgcgtccagtttcgaggaaataattcttgcagtcatc

SEQ ID NO: 2625 - DNA, 528 bp, Hordeum vulgare
aagaagtcccccggctgcagcattcggcacggggattcctacccttccacatttcctcgcacccccaagcagggaccacagggccatgtcgcacactcgtatgctctacttccaagcccaccatccccatgccaactttcaggacaaccatgccagtgttatgaagaaagaagtagcagtaggagcaaaccatgtccaagcgcccaaaaaacaagtcaggtttcaggacaaccatgccaatcctatcaagatagatgatgtgaacacagatgtggattcggtggcctcggacttcatcaagcgtaagcacatgtcttgggcactccagaagagcacaaccatgtatccatcttcttaagagaaccagggttccttagtcgtggtattatctgcttatgctctgtccagcatgaaagttcaaataagaggtgctgcttggaggtgccctagatatcccgaggttgtgttattatggtgttcttatttgtaacatgaataagagtgatgtggataggctgtactgctatt

SEQ ID NO: 2626 - DNA, 484 bp, Hordeum vulgare
ctgtggtagaatagcagtacagcctatccacatcactcttattcatgttacaaataagaacaccataataacacaacctcgggatatctagggcacctccaagcagcacctcttatttgaactttcatgctggacagagcataagcagataataccacgactaaggaaccctggttctcttaagaagatggatacatggttgtgctcttctggagtgcccaagacatgtgcttacgcttgatgaagtccgaggccaccgaatccacatctgtgttcacatcatctatcttgataggattggcatggttgtcctgaaacctgacttgttttttgggcgcttggacatggtttgctcctactgctacttctttcttcataacactggcatggttgtcctgaaagttggcatggggatggtgggcttggaagtagagcatacgagtgtgcgacatggctctgtggctccttgcttgggggtgcgagg

SEQ ID NO: 2627 - DNA, 997 bp, Hordeum vulgare
  UNSURE (1): n stands for any base
ntggcagaactgaaccatgtaccccaaagtgtgcaggccattacagaacgagggcctcgttgcccacacagaacgaggctcgaggccgagcccctgagtcgccgacgacggaacctgcggcacattctttggcgtctacgacgggcacaggggtcccgaaacctgccgcttagtagacgacaacctgttacaccaccttaagaagtttgagacggaacgacagaccgtgtcatgctacgccatacacagatcctacgctgccaccgaggaagggtttttgaaccttgtgaggaagcagtggctaatcaaaccgcatattgcctcacgtctgtacatgctgtttggctggtatcatcaacgaaggggttctctacatagcgaacaccggttattttcgtgatgtcctcggcagactttcgaggggcgcctaagacattaaagccgttcagctatcgttctagcataacgcgagctttgcggctggatcggatgagctttgtaagttactcccggccgatatccatatcgtggtacccaagcacccattgctgagcgtaaagggcattatacacgttttcaatatgaaattcggcttctatctaacaagattcttaattcaatccatgagccttttcgggttcacgtttttatgctttaatagccttttctacaccccattctttttcttttattcatctctttcccaaattcaagcctgcttctcttccccaccttattattaccccgcgttctatggtactttttccgatcgccccgatacaaggagattttttttctctcccccgttttcccctttatttccgttcttcgcgaatcattaaagtctagtttgtatccgttgtttatctccccatccctaccttcgttattccgccgttttatcgcgtccccccttattattcccctcccccatcatctcctatccgcatatttttcccccacccctttatcgcccgtctattactcgtctcctttt

SEQ ID NO: 2628 - DNA, 552 bp, Hordeum vulgare
tcgtcttaatacccatgttttttaaaatactgctcaatttcaggtccatccaccccgcgaaaagagaaacgctagctgatacctgcaaattatgtgcagctgccagtttaggtttctccgagcgacccaacagagggtcatgtcatcacactgatgacgcggccatcgaacaacaacgcttctctctctagctgtacatattagaagtcaaaacaatatggctcctccacgcaccgctctacgcagtgtctgcatgtcgtgtggagagcaccggcccaagatatgaacgatatataggacgatatttccagaaagcatcagtcatggatggtcagtatttctgtgcaaacgttggcatactgccaccgccccttaacgaaagcaatgggccaccgtagagccttctgctgataagcgcgggctccatgaatagtactacaacagtaatatcatcatggaaatgcctcctgaccccgcggtcgatcttcttcaagtctgagtacctcatttctctcttctttgccgcctcccgcagagctgcttttactagtc

SEQ ID NO: 2629 - DNA, 370 bp, Hordeum vulgare
atgcatatggttctttggacctgatgctcaacatctcttcttgtacatcgggtcaaatcctgctaacgacaacgctacttttgttgaagaaaactcactgccatctcttctcaagagctgttaatcagagggacgctgatcttgtttatttttggcacaagtaccggaaattggctgagagctcccctgagaagaacaatgctcggaagcaattgctggagatgatgggtcacagatctcatgttgacaatagcgtggaattgattggaaaccttctgtttggttctgccgatggtccaatggttctcaagtctgttcgcccagctggtgagcctcttgttgatgactggaattgtctaaagtctacggt

SEQ ID NO: 2630 - DNA, 563 bp, Hordeum vulgare
  UNSURE (13),(38),(39): n stands for any base
taggaaattgtangcctctttgtattttcttggtatanntggaattgcgaggctgcacaatctgatcacaaactatcatgattatgtacagaaatgacatgaaatcacctttctactatagtatatgtacattataagctggcacaacgaaggtaatttggtgtattggaatagctgaataacggcataattcttctccatctaattaatgttcgttcaagcactacggagtaatactagccctatgtgaataggaagaaactttggtgtatggtgcaatagctaaaattgtgactaggttgcttcacctatggtttaagcactaaaacctttgtgtgtgccactccatgggttggttgggatgctcgtgcacgcctgagcagcgacctttaccatcgtttcaggaaggatgccggcattgcagatgtttgcaaaggaccgcatgtgcttcatcccatactgcgccaacgagccacattgtgattcaaaagtatgcaccgtagactttagacaattccagtcatcaacaagaggctcaccagctgggcgaacagacttgagaa

SEQ ID NO: 2631 - DNA, 518 bp, Hordeum vulgare
ctcgcccggtacctcgaccccgacgcgtccttggacaaggaccagctgctggacgcggtgcactggatccggcaggcggtggggctcgcctgcggcctgctctggggcgccgtccccctcgtcggcgccttctggatcgccctattctttactatttccaccgtaatagttcatttgtactatgcacatctgctgaagattgatgaggaagactttggaggccatgccgccctacttcaggaggggctctttgcctcgttcacccttttcctgctttcatggactctagtatacagcttggctcacttctgagaagcccgactgcagaactatgatgctggattttcgtagttcatttcattcactcttttgtacaattagctatcatggatgtaatgtcatagtactgtagaacgtcatggagctataactgtaattcatatagaatgccttccacttgttgggtccattcggtcaagctcaaagcaatatcatctccatcattgtttcatgtaaat

SEQ ID NO: 2632 - DNA, 540 bp, Hordeum vulgare
  UNSURE (2): n stands for any base
gnttaaattggcgagattaacatttacatgaaaaatgatggagatgatattgctttgagcttgaccgaatggacccaacaagtggaaggcattctatatgaattacagttatagctccatgacgttctacagtactatgacattacatccatgatagctaattgtacaaaagagtgaatgaaatgaactacgaaaatccagcatcatagttctgcagtcgggcttctcagaagtgagccaagctgtatactagagtccatgaaagcaggaaaagggtgaacgaggcaaagagcccctcctgaagtagggcggcatggcctccaaagtcttcctcatcaatcttcagcagatgtgcatagtacaaatgaactattacggtggaaatagtaaagaatagggcgatccagaaggcgccgacgagggggacggcgccccagagcaggccgcaggcgagccccaccgcctgccggatccagtgcaccgcgtccagcagctggtccttgtccaaggacgcgtcggggtcgaggtaccgggcgagcc

SEQ ID NO: 2633 - DNA, 546 bp, Hordeum vulgare
  UNSURE (16): n stands for any base
gtcccccggctgcagnattcggcaccaggcttgtacgtatagttgtagatcatatatccatcacgtacgttcagggacaaacatgtctccggtgaaggtgttcgggcacccgatgttgacaaacgtggcacgggtgatgctcttcctggaggaggtcggcgccgagtacgagctcgtgcccgtggacttcgtcgccggcgagcacaagaggccccaacacctccagctaaacccgttcgggcagatgcctgggttccaagatggcgatctcgtcctgttcgagtcgcgcgccatcggcaagtacatcatccgcaagtacgggacagccgggctggacctcctcggagaaaacagcggaatcgaagaatcagcaatggtggacatgtggacggaggtggaggaccagcagtactacccggccatctcgcccgtggtgttcgagtgcatcatcaatcccttcatcatgggtggcgcggcgacgaaccagaaggtggtcgacaagagcctggagaggctcaagggtgtgctggggatctacgaggcccg

SEQ ID NO: 2634 - DNA, 534 bp, Hordeum vulgare
gtatatatatagttgctttgactttggatccttgtgatctctagtggtgtactatacatataggacgtacggattagcattgacgagttgtttatttaccggtactagtgcacaaagcaaggaatctaagtaggtacatcaatcacaatcaggctcgctcgcacgaacagaagcgcaagcgggctagttctgatgatgacccacgggatcgatgtctctttctctaaaacggaatcatcaccggcacacacacacacccgcgctcataaacatctgctccctctataaactaatataaaagtatttagatcactacactaaaatagttagtgatctaaaagctcttatattagttaactaatataaaagcgtttatagatcactagactaaaatagttatagtaatgtaaaagctttcatattagtttagtttatggagggcgtagtggttagtaggcagctaaacaggctaggcatatgcttgcacaccctctgcaccgccggcctggccatgaggctctcccaccaggcctt

SEQ ID NO: 2635 - DNA, 552 bp, Hordeum vulgare
gtacccccgggcctgcagggaattcggcacgaggagcaatcgatccatctaaactaggtagcaaagcaaatggcctcaggagtgtttggtacccccatttcggagaagacggtgatagccactggtgagtataaggaacccattactcaaaaggatgttgcagactataccatgaagatgatcaacgccggtggtaaggatgttaacgcgcaaaagttcgtcgacaacctcaaggagaggtacggtaacggaatagctgtaaaatgcctcatctacaatgccactggtgccactttgagcttggctaagtacaacgattggcacggccatatctatgatacaccctacccatcagatattcagaatgggcaatggggtgcattcctccacgtccacccaagtggtgctgcggttggttcagctggtgccgttgtgtatcgtagcaagatcccctccagcaccaggtcctgcgattggttgttttcctggaccgtcccctacattggtgccaacggggtgtacaccgaaatccgagaggaagggcactaccca

SEQ ID NO: 2636 - DNA, 541 bp, Hordeum vulgare
atatcctagtttgaacccggatcttaggaaatgcaccgcaacatcttcgccacacaagcctttgaagaccacaataaccacgcgatgttgataacgagatctagtagggaaactggaaaactccacgggcgttcatggtagagccttcaccgatattagtcttggaaacatatccatagtttttatcggtagagttgagatttgaatttgcaagtttcacatcgtagatataactccagcttcccacacttgggtagtgcccttcctctcggatttcggtgtacaccccgttggcaccaatgtaggggacggtccaggaaaacaaccaatcgcaggacctggtgctggaggggatcttgctacgatacacaacggcaccagctgaaccaaccgcagcaccacttgggtggacgtggaggaatgcaccccattgcccattctgaatatctgatgggtagggtgtatcatagatatggccgtgccaatcgttgtacttagccaagctcaaagtggcaccagtggcattgtagatgaggcattt

SEQ ID NO: 2637 - DNA, 518 bp, Hordeum vulgare
cttgagtgttctatatgccttctcgtctgaggtttcagccaaatcacgcttgctagtatgtgtagacttgtttgtcgagaatgtcacaacagaacaattagcggatataaccattaaatctgaagaggcttctggtagcaaggctggcatggaccaaacaccagaaggatccgcaagcataccaactcttgttcctgttgaagagatacagtcactgcctcccgaacagacagctaagatgcttcttcaggtccactttcatcaccatctcttgcccttgaagttgtctgtcctttgcaatgggaaaaggcatccagccaaactgcacccggacattgcttattttgtacgaccactacccatggacctaaatgcttttctatgcaaggaaaaccagctgaggggaatgtttgagtacgctagaaggtaaccagactctgtcctatctttactagttacttagtttcatgcagtcgcatcgattaggaactgatctgacacataagccaaatcatgcc

SEQ ID NO: 2638 - DNA, 548 bp, Hordeum vulgare
gaaaggataaaaggtgttaaaaagatgtacagcaattgaccgtgttactctaaagccctcggcattcacaataatgtacaatgatttacagtatccacaaaagtagcattcgaaccaaacttgcagaactcaaaaatgccccttcactctatgatagctacaactctgttcaggaggttcaggccgaacaccgtgtcttcagagttcacctttacggtgagatccagtggttctgaggtatgcccatccgccacgacagtgatcaggcagggattcgaagtgctcaggatctcgctgctgaatcgccagcacaagccggaggcgtcatcgatgctgaaggtcaccggcatatccattgacacgaggtgcacattggcgttgctgagtagtttcaatgcgagagtttgggctactagaagattcttgtcggcgttgtggtctctactctcgtcggtctgctcgtgcttttgaagatgatctttgaaggtgcacctgttgcaattcccgacagatttagttccagcatataatcaacactcaacagttca

SEQ ID NO: 2639 - DNA, 1032 bp, Hordeum vulgare
  UNSURE (17),(26),(42),(52),(69),(904): n stands for any base
atttggccgactcgggncttgtggcnccccacgtctgggggnccatacagcncgtgaggcgtccacgtnccatgctcgccggcgtctccggccacaacctccagctcctcctcttcaacgaccgacaacgacaaccactcacatcatcacggccacggccaccacgaccaagagaccgcggccagctgccaggaacaacaacaggcggcggaacagcagctcttctacaccagcgtcggcgccatggacagccacctgctctggaacgacgatgccatgctcgattcctacgcctggggagccaccgccttgccgtccatgatcgttccgccgccttcatcgccggtgtgggactactgctgctcggattcgctctgggggataggcgacgacgaggtcgagtacaagaagatgctcgccgtcgccggtgcctcatgaaccttttcatacaccatccatctttgcttagtcaactacagtagatgccaactagctgaagatgcttacgtgcatgcgtcttgatatgtactcggatttatgcttttgtacatgtaatatccatgtctatgtatgatagagtaataactacacatatgcatgtagtttattattaaaaaaaaaaaaaaaaaaactcgggggggggcccgggccccaattggccttatagggagccggataccaatttcatatcggcctcgtgtggggggctccggcgcgcatctcggtccccttgtcctttgtttcgcttcgtgccttgcgctcttcttttattcttttctttctcccctttcttctctcctacccccccttcataactaatcttcgcccctctccctctatttcgtcattttctaccccctcccccgataatcggatctcctgcgcgccgcgatgccccgttctnttcatccctattatacacctactcccgcgcaccgtcgtccgtaccgcctgattatttcgcgactcctgctgcccaccgtacgtcgtcttagttaatcgactcacgcgttacgctcgaacgcgactgcg

SEQ ID NO: 2640 - DNA, 558 bp, Hordeum vulgare
  UNSURE (11),(13),(14): n stands for any base
tacatgcatantnngtgtagttattacttctatcatacatagacatggatattacatgtacaaaagcataaatccgagtacatatcaagacgcatgcacgtaagcatcttcagctagttggcatctactgtagttgactaagcaaagatggatggtgtatgaaaaggttcatgaggcaccggcgacggcgagcatcttcttgtactcgacctcgtcgtcgcctatcccccagagcgaatccgagcagcagtagtcccacaccggcgatgaaggcggcggaacgatcatggacggcaaggcggtggctccccaggcgtaggaatcgagcatggcatcgtcgttccagagcaggtggctgtccatggcgccgacgctggtgtagaagagctgctgttccgccgcctgttgttgttcctggcagctggccgcggtctcttggtcgtggtggccgtggccgtgatgatgtgagtggttgtcgttgtcggtcgttgaagaggaggagctggaggttgtggccggagacgccggcgacatggacgtggacgcctcgtgccgaat

SEQ ID NO: 2641 - DNA, 1023 bp, Hordeum vulgare
  UNSURE (1),(2),(15),(17),(21),(23)..25),(27),(30),(31),(35)..(40),(51)..(53),(55)..(57),(62),(73),(79)..(83),(87),(88),(90),(105),(121)..(124),(126)..(128),(133),(135)..(137),(140),(151),(157),(159),(175),(188)..(192),(194),(196)..(201),(203),(205),(209),(212),(225),(234),(235),(258),(277),(284),(295),(297)..(303),(306)..(310),(312),(882): n stands for any base
nnaaaatcaaaatancnaagnannncnaanntgtnnnnnnctttatgacgnnntnnnggggnacttgctgatncaccannnnngcgnngntttgttgtaggggcnccccacaaaaaagctnnnntnnnggtgntnnnggntggtggggggntttttntngtggggggggggccgnccccaaagaatgnnnnntntnnnnnntntntttnttnttcgtttttgttntttttgttnnttttttttttttggttgtggttnttttttttggggggggggngtttttnttttttttttntnnnnnnnttnnnnntntttttttttttggggggggggtttttttttttctcccccctttctttttgtgtgtcgttttcttgtgttttttttctttcttttttttttaaataaatcttttctcgcttcgcttctttttccttgtttttggtttctcattctctcttcgctgcgccgcgcttggccccccttttctgtttctttttttcctgtcgttctcttgtttcgctccctttttccttcgtgtcgttctatccctggttttttttttctttgtgtttttgttcgtgttcttttcttcccttctctgtgtgtggcggcgtgtcgggggtggtctgggtggcttggttttttggccggcggcattctgtatttcgttattcgctccttttgtcccccgtctcgatgttccgtggaggcggttttgtgggtcggtgtgtgagttgctggggggcgaggcgggggtgggtggccgggcgtggttgccggtttggggcttccggggtgtgttgggtgtccgtttgtgcttggtggggattcgtcggcgagtcgttctggttcggtgcgggctgttggttttctgccgcnttggcgttttgttgctgtggtgcgtgggcggtgttgcggctgcttaggtgcgccggctttgtgttagctgtgtgcggcttgtggtctgtcggtttgtgtaggtgtctgggctcgtttgtgccccgcgttgtgtgtgcgttc

SEQ ID NO: 2642 - DNA, 492 bp, Hordeum vulgare
cttgataaaattacaatattaggagtattatacatcacccacaatggcatggcaaggaccaaatccaagctgcctacaactgcaacgctagatgcttcactctacagtacagattaatatgaagcactgaggtcaggttgaggggaacagaagctacagatggatgacgagttcgagatggaactctctttgtctaccaagtacactgcccactgcttattttcgttcatgttcagtttgtctaactcagaatttgctcgatgagggccgtctaaactgtgacacaaccaaaccgcatcacatggtgccacccaagtggattttcgtctattgcttaatgtatactccctgtagcagcagccgcaaggcgtggggagcgacgcgtgctagatcccgacataaggggagatgcgattgatcggggaggggcccctctctctgcacacatatcttgattcttgaaacggcttcgggaatggctttgattggtgg

SEQ ID NO: 2643 - DNA, 519 bp, Hordeum vulgare
accaggcctccagatggtgttatgccaccctacagtcctggtcaagctggtgctcctgtcaggtcgtctgttttcatgcatgcttcccagcaatatgctatgccttcacgcccaggagtcacgtttgtacatccacaggattccatgcgaccatttgcacagactcaccaccaacaacaatctgaagctagtctacggttagcccggccccggtgaggggccctgggcatgcctgctcctgccagcacacgctgaacttccaaatcaaataaaatgggatatccgtctcatttctggctggcaggagcaggcatgaaagaaccgagaagcgccgggccgagctagtcatccacctgatcttgtcatgcccgtgcgcttctcggtgttgttgctccctgcacattgagatgcaggcggggcacgtactccttcatcggtcggtggagtaaactgcagacagtcgcgtggacttcgggaagtccatcgcatgaaaagaagctgaggagttgagggcagagc

SEQ ID NO: 2644 - DNA, 535 bp, Hordeum vulgare
tcgtaataaaaagctaacgggatccgagcagcatctcaagttgtaataacataacaacatagtcagttaatagacaagttgggggtcacccaactactactaccatgtatgtacagacacatacttagtactctatactagtaccaggttcgaattgaagaatcttatcttaaagacaacacaaagccaggacttgaaactcttcgtcgtcatcatcatcagcggcggcagttgcctggaggcccctgagagcaagggtggcaatgacagggggcggcagtcgatgcagcttgcctctgctccggctcaaggcacgcaccttcacaccagtgcggcttcatctgctccagctcgagtcccgtagcttcacaccagtgcggcttcacccagacgcaataggagcgcagagcctggtgctccagtcaggcagctgcacgtggcagttcattgtcttcggccagacgcaataggagcgcttggcctggtgctccagtcgagcagctgcacatagcagttcattgtcttcggccagagc

SEQ ID NO: 2645 - DNA, 512 bp, Hordeum vulgare
ctcggcccgcccgaccggtcgccgaggcactggtgcggaaagtcctatctccgcccacgcagaagaccaagttgatcgaggcgaaagagaccgatatcgatggaagagcttattacacttttgagttcacggctcaggctccaaatttcactagacacgcgcttggtacaattaccatagcaaatggcaaattttacacgttggcaacgggtgcaaacgagaggagatgggacaagatgaaggacaggctacatacaatcgtcgactctttcaaaatcgaaacaaaagtgtgagcgatgtttgaggcattgtgctgattttctttgtttttagtttgttcgtttttggagctacagctggcgcgaggttcaaaagtaaatgtcgggaatacagattctactgatctttttcttttctttcaaatactctggtctgcatacatatatcatttcatcctatgtaatgtgatccttggagtaaggcccacggaactcgtccgaaacgacaaaaaa

SEQ ID NO: 2646 - DNA, 506 bp, Hordeum vulgare
  UNSURE (22),(30): n stands for any base
gtttcgggacgagttccgtggngccttacntccaaggatacattacataggatgaaatgatatatgtatgcagaccagagtatttgaaagaaaagaaaaagatcagtagaatctgtattcccgacatttacttttgaacctcgcgccagctgtagctccaaaaacgaacaaactaaaaacaaagaaaatcagcacaatgcctcaaacatcgctcacacttttgtttcgattttgaaagagtcgacgattgtatgtagcctgtccttcatcttgtcccatctcctctcgtttgcacccgttgccaacgtgtaaaatttgccatttgctatggtaattgtaccaagcgcgtgtctagtgaaatttggagcctgagccgtgaactcaaaagtgtaataagctcttccatcgatatcggtctctttcgcctcgatcaacttggtcttctgcgtgggcggagataggactttccgcaccagtgcctcggcgacctggtcgggcgggccgag

SEQ ID NO: 2647 - DNA, 481 bp, Hordeum vulgare
tagaaaacaccacaagcagaagaagaatcgagcagaggaagggaagggaagggaagggaggccagccatggatcatggggacgacgagtttacggttactccgttcgaggagactgacgacagcctgctgcggcagatgtatccgccgccggtggacggcgtcgagccccttgaagtcttgtgcttcaatttcgaccaagacggcaagccgtggacgctgtccgaggaagagctcctggagatcttcggcgaaccgtggtgggcgtacgaggatccatccatagaggatatggaccgtttccccttgctgatgccatcggaaggatcgatgattccgccctagctatgtcctttggacggatcgattccttccttccttccttcagctgtctaattaattcattagctttctttctgcttaatcgaccctagctgtgcccatctataattataatttgtgtaccatcgatggatggattgg

SEQ ID NO: 2648 - DNA, 498 bp, Hordeum vulgare
tctacaattgtctttgctaaacatacacagacgaagccacctcaatccaatccatccatcgatggtacacaaattataattatagatgggcacagctagggtcgattaagcagaaagaaagctaatgaattaattagacagctgaaggaaggaaggaaggaatcgatccgtccaaaggacatagctagggcggaatcatcgatccttccgatggcatcagcaaggggaaacggtccatatcctctatggatggatcctcgtacgcccaccacggttcgccgaagatctccaggagctcttcctcggacagcgtccacggcttgccgtcttggtcgaaattgaagcacaagacttcaaggggctcgacgccgtccaccggcggcggatacatctgccgcagcaggctgtcgtcagtctcctcgaacggagtaaccgtaaactcgtcgtccccatgatccatggctggcctcccttcccttcccttcccttcctctgctc

SEQ ID NO: 2649 - DNA, 967 bp, Hordeum vulgare
  UNSURE (657),(663)..(671),(708)..(710): n stands for any base
tgtcccccgggtctgcaggaattcggcacgaggttttttttttttttttttttttttttaaaaggggtggggtctctttccccgggggtccctttccttggggggaaggggttttttttggcgcccaggggttttcgaaggaaaaaaaaaaggatcggggaatttggtttccccgcctttttttttggaccccgggcccggggggggccccgaaaccgaccaacttaaaaccaagaaaatggggcccagggcctaaaaaagggttaaccttttggtttcatttttaaaggggcccccattggttggggcccggcctttattttgggcccatttcctttggtgggcccccggggccaaggggaaaaattggcctttggtttgggaaatggccccaggccctggtttggggaaattgggggccggggcggggaccccaaagggggaaaaggcttttccatggaaagggggctttttggtttgaaaaaatggggtttttggggggggggggaaagggattttccgcccaaaagccttggaaacctggtgggggggcccggggccggggattttttcctgggggggggggataaggtggtggcggcccctttggggggggggcccgggccccaattcgccttatggggggggatacaacanctcaannnnnnnnncccccccccacaaaataggaaataaaccattcttttnnntcccgcccaaccaaaaccccgcaattccgttctcccgccgcttcttaaacattatgtgttggcgtgtgtaatcgttcccgcccccgcctttaggttctcgctctattggtagtcaccccgtttgggcggtttgtcgtcttctgccgcggcggcgcgtccctgttgtgtttttcggcggagctgttagcgcgtctcgaccgtctggcgccgcgatatggtgggtgtccatggatgtctgttagttcaaccgtactcct

SEQ ID NO: 2650 - DNA, 547 bp, Hordeum vulgare
caggcttgatctccttacttcaagggatacattacataggatgaaatgatatatatatgcagacaagagtattcgaaagaaaagaaaaaagatcagtagaatctgtattcccgacatttacttttgaacctcgcgccagctgtagctccgaaaacgaacaaactaaaaacaaagaaaataggcacaatgcctcaaacatcgctcacacttttgtttcgattttgaaagagtcgacgattgtatgtagcctgtccttcatcttgtcccatctcctctcgtttgcacccgttgccaacgtgtaaaatttgccatttgctatggtaattgtaccaagcgcatgtctagtgaaatttggagcctgggccgtgaactcgaaagtgtaataagctcttccatcgatatcggtctctttcgcttcgatcaacttggtcttctgcgtgggcggagataggactttccgcaccaaagcctcggcgacctggtcgggcgggccgaggtcgcggatgtcttccttggtggtggggatcatgttgatgctgacgctctc

SEQ ID NO: 2651 - DNA, 466 bp, Hordeum vulgare
agaagaagaagaagtggagcaagggaaaacaaaaggagaaggtgaacaacgcggtgctcttcgaccaggccacttacgacaagctgctcaccgaggtgcccaagtacaagcagatcacgccatccgtcctctccgagcgactcaggatcaatggctctctggctcgcagggctatcaaggacctgatggagagggggctcattaggatggtgtctatccactccagccagcagatcttcaccagggccacaaacacctgatttatcattatcatgtgttctatggctgtgttctctagtccagtagactgaggtgttgctgttatattcaagttcactatgtccagggaggcacttgtgccaccagtaatgttgaattgcttttgagttttggtacactttatgatcgttttgtcagcgcaatgaaatctaccttatatattgtgtgctattaaaaaaaaaaaaaa

SEQ ID NO: 2652 - DNA, 392 bp, Hordeum vulgare
gtccaaaactataagctttaacattactggtggcacaagtgcctccctggacatagtgaacttgaatataacagcaacacctcagtctactggactagagaacacagccatagaacacatgataatgataaatcaggtgtttgtggccctggtgaagatctgctggctggagtggatagacaccatcctaatgagccccctctccattaggtccttgatagccctgcgagccagagagccattgatcctgagtcgctcggagaggacggatggcgtgatctgcttgtacttgggcacctcggtgagcagcttgtcgtaagtggcctggtcgaagagcaccgcgttgttcaccttctccttttgttttcccttgctccacttcttcttcttct

SEQ ID NO: 2653 - DNA, 503 bp, Hordeum vulgare
tcgcatcacggcctccacctacgccgccgcaccaggaggaccaacctcgccaccgccaccgacaccgaccctcctccaccccctccacaacacagagacagagacagagcttccccctcttcttcttgtcccaaatcctcctgctccccctccacacttgttcatgtcccagcacttcaatctgccaaagaaggagccactttttagtacccatcttgagagtagtggacgccaagaattagaatccggccctgccgtgccggacggcgatgccgacaatctcaacgtcaacatgtcctgccctgagggcgagagggtcgatttgcctgttcccgccggcaatggcctgcaggtggaaggaggaggaggaggggatgagccccagcaaaccaccatgctctgctctcttcctgacgctgctgctgtcggttcagatgcccttcctgctcctgccgacgccacggcggctgctccttccggcgcttgcaactgcaacgccgctc

SEQ ID NO: 2654 - DNA, 547 bp, Hordeum vulgare
gttcttctaagagaacatatatctctgtttgcttaaaccactttatttgacaagcaccacactagctagctagcaagatggaattaaccaatactactgctcaaccataaatatctctgattaactactaccactccacttacatataagagtaagtagaaagattcatcacaccattttcgtcatcatcatcgatcgaagtcatcatcaacttcttagctaccacactagtttttcatcatcatcgtcatcgtcagcaacatactatgcagcttgtgcacttaatttacccttgctgagcgacagggcttccaccaccaagcatgccgactttcacctgaccaagtggctcactcacgcagcttatcttctgaaataattttacaatggcaaaaaaaaggatgttataggttcaggtaatttcagtggaattcttggttgcaaatgtattgctgtagtaataatcatcattagcattacttagtgtcaaaaacagcagtacttagtgccatcattgtatctaggctatacaacacaatgatgctag

SEQ ID NO: 2655 - DNA, 485 bp, Hordeum vulgare
atagttacagctgttggatttggagtcccaccctgtgtatcgagagagatagctgagagttgcgcaagctatgtcaccactgttgtactgcaggatgacatagttcctaggttaagtgcagcttcgctggcaagattgcgaaatgaaataattgaaacagattgggccaaggttttggagaaggaagactggaagcatatagtagatatcgtgactaatgcaaagctagttgtttcgtccatccaagacgtggcgaacaaacttgccgattacgcgaaagttgtcacaacgtcagctagctcgggggatgctgcaaaagcgccccgtcttcagggcccgacgaaagttttgaagccggacggcgaagaagacgtgtatgtgccggaggatctcttcctcccagggacgctgtattacctccagagggatgtcgagaatataaaaggcgtggaagacgagtcgtacacgctctggagaggcgatgc

SEQ ID NO: 2656 - DNA, 529 bp, Hordeum vulgare
  UNSURE (36): n stands for any base
tcaaagaagagttatacccgtaccctcttgtatatnataaaaaaagaggtatactacacctcgatcagcaccagaaactctagaatgaaacttgagagtatttgttattcctggcaatcccttacataacctaaaactgtacaacaaaacactcaattttgcgaaacccgccttcctacataagctttggaacttagtagtatcaatcctcctgcaggggcagagggagaggcagagtcttgagcacatctctgagcgcgtactgtatgctatcgcatttgtgatcagacatcaagttgccagacaacagtatccgctggaaattctccccagcatcgcctctccagagcgtgtacgactcgtcttccacgccttttatattctcgacatccctctggaggtaatacagcgtccctgggaggaagagatcctccggcacatacacgtcttcttcgccgtccggcttcaaaactttcgtcgggccctgaagacggggcgcttttgcagcatcccccgagctagctgacgt

SEQ ID NO: 2657 - DNA, 519 bp, Hordeum vulgare
gagaaatcctgtgctgtgtcattctgggtggatagccaagcacgagaaaatgctgctgctgatgatggcgcggtgccgctgtacgatcgagaatttacattgggttcaactcctatgggtgattcatcaaatgctgaaggcaagaaagacaaggatgattctcgctgtttcaactgtggttcgtatagtcatgccctgaaggattgcccaaagcctcgtgaccatgttgcaattagcaatgcccgcaagcagcacaacttgaaaaggaacctatctaatgttagtaaccgtggacaaaatcggtactaccagaagaccccaggcaaatttgatgatctgaaggcaggagtcctgggatctgagactagagaatgcttggggctcagggaaaatgacccgccgccgtggctgcacaggatgcgtgaattgggttatcctccaggttacctagatgaggtggaagatgaagacaaaccatctggcatcaccatatttggcggggaaggggaggcgaatgca

SEQ ID NO: 2658 - DNA, 526 bp, Hordeum vulgare
agctgaggctgacagcaatacatagtcttctcccattgctagtaaaaagtaaaaaacttggctaacaaataagtgtttcaaaataacatctacttacacaagtttcaacagcgactgatattgcaagtgctgacttatatgatattctgagcaaatttgatatcatcacaaaattcacgtctttcttcagctacagacacatatgtaacattcacctcctgttgctgctgtagtagtgcctgtcatgcctctccctctccctctccctctctctttccctttccctttccctctccctcgagcccgaccccgagtgctgcctgcttgaatacgcggagtgaggggtaaaggcaccgccgtcatcataaccagaggagcttcttcttccggcgccgggggtcgccggtccatagtcatacgagtggtacctcgatgacgagtattgctcgacgcccggagggggaggagggcctctatccctctgagaatccgacgatggatgctggtgacggcccgaggaggagga

SEQ ID NO: 2659 - DNA, 551 bp, Hordeum vulgare
gtcctcccgggcctgcaggcaattcggcacgagggtgtcacgggcatcaagacacaaagtggagactcccccttgcagcttggtccgaaggttgaggatgtgagcaagccacatgtgaaccccgtcttcgtcttctttcggttcctcattggaacaatatgcgccacatacttcttcctagtgcctatttacatgtggatcaaagacaagattgtgccccaaggcaggcccatctaactaatgatgctccctgacgggaggagacaagattggagtcaatatccgatctaagccatgcaaacaccccttttgttccatgttgtgttgtgtatgtatatatatgtggacgcgcgcgactgtcagaagaccgatctgctattggctccgttcatcaacggatacagaggcaggtgttccaggacatgggaaactgattgatcagacttacttcctgcttatatatctctcttcgagttgtctggatccctgaaaaggtcgagcatttccatctataaataaataaaggagcagttttattcgttgtaacagac

SEQ ID NO: 2660 - DNA, 528 bp, Hordeum vulgare
cattatatactactgtctgtacacgaataaactgctcctttatttatttatagatggaaatgctcgaccttttcagggatccagacaactcgaagagagatatataagcaggaagtaagtctgatcaatcagtttcccatgtcctggaacacctgcctctgtatccgttgatgaacggagccaatagcagatcggtcttctgacagtcgcgcgcgtccacatatatatacatacacaacacaacatggaacaaaaggggtgtttgcatggcttagatcggatattgactccaatcttgtctcctcccgtcagggagcatcattagttagatgggcctgccttggggcacaatcttgtctttgatccacatgtaaataggcactaggaagaagtatgtggcgcatattgttccaatgaggaaccgaaagaagacgaagacggggttcacatgtggcttgctcacatcctcaaccttcggaccaagctgcaagggggagtctccactttgtgtcttgatgcccgtgacac

SEQ ID NO: 2661 - DNA, 350 bp, Hordeum vulgare
acacccggtctccgatcgacggcgacggagcacgtcacccgcaccgaccgccggcgaagcccctccggcccctgatcgatcgatagatttgcgccgcagtccgtccacccacccccggcagcggagggctcgcgcgggggatcatggagctgccggcggccggcgggggccggcgcacgagctactcgctgctgtcccagttcccggacgacgcggggggcggcaccaccggggcctccccggcggttctgaagcggcagtccagcggcggcagcagctacggcgccgggagctcggtctcggcttccagcgactacccgttccacctgcccccagcgactgccgccgtg

SEQ ID NO: 2662 - DNA, 429 bp, Hordeum vulgare
tttttttttttttttttaatacatacttacacaacagtaattactggtcagtcagtcagcccccacacacacaaaaaaaataaattccttttcagggctaactctagttacttacatacaacatattacagcataaatatataaaggtgtctattgggaaactataatttacacagcttaatgaccatgagtttccgatgtttggaacttgttgctagcgtgttttcccgtgtgtgattgcgacacgtcatcgcgggggaggaggatgattctcttgatggtgtgtcttaagccatggaggggagttttgccaggtacagtttacttgaaagcataaatcaagaagtcctccttattcttagcatcgagtaatagtgttgacgaattatccatcataaacagcctaaataccaaaaaattaaaatcctc

SEQ ID NO: 2663 - DNA, 517 bp, Hordeum vulgare
cctcgtgccgcaagaagctacgttgaggagaacatcaacaggtcccggaagaggatggacgtcgctgccctggacatgctgcagttccattggtgggactacgcaaatcccggatatctagatgcactaaagcacatcacagacctgaaggaggaaggcaagataaagactgtagctctgacgaacttcgacacagagaggctgcaaataatcctagaaaatggaatacctattgtcagcaaccaggttcaacattctattgtggatatgcgcccgcagaaaaagatggcagagctttgcgagcttaccggagtcaagcttatcacgtacggcacggtgatgggtggcctattgtctgagaagttcctcgacaccaacatcaacatacctttcgctgcacctcctctgaacaccccatccctgcagaagtacaagagaatgatcgatgcttggggtggctggagcctgttccaggctctgctccagaccttgaagaaggtgtcgctgaaacacggcg

SEQ ID NO: 2664 - DNA, 551 bp, Hordeum vulgare
tatttagacactgtcttgctgtcaagatcctatatattcccaaacagaggagcaactaataacaatgtgcacggcaaagcatcaccatcaacacgatgattccatgaattttatacttgctgcaattaaaatatattatcatgccataatcagatcggtctccaatgccgggatatgctccctgttggccagggagatctgtccaccaccatgatcctcctttcggtggagcacatgatcctccttgtctccatgcctctctgtccatctgtctccatgcctatcgtcgtgggagcacatgcggccatgttaaaatcaccactaggctctgtactcgtcgccgcagtccccgatgacctccatcaggttccggccccgctgcgacgcctcggcgatgctgcccatgtcctcctcgtccagcagcagcgacaggatcgcgttggtgtccctgatgtgctccgacagccccagcctcacgcccaccatcgagcccgccaccgatgtctggttcagtatgtatcttacggcgacggtcgagattgggacgccgt

SEQ ID NO: 2665 - DNA, 515 bp, Hordeum vulgare
ccggcttccacaccgactaacgagccctcgctcgccatcatgcgcaaaccctccaaaacacacgctccagcccccatccccatggacatggacatggagacgcggaggccgaggcccatcacttcgtcgttgccgcacaatcttactctttctggcgtggaaaatctcctcacctctgcatctatgactctgctacaaagacctggagcaacaagccggtggtcatgggttcatcgtatccagaactacacatcacaggcaagacactcaccatcggaggaagcaatggcaccgtggcttgggtggatctctggcgcaacatcgtcttctgcgacgttctcgtcaaacgccccaagcttggctacctgaagctgccgagcgcacccgacatggagccacctttcgagggaaggtctgttcgcgacattgccgtcgtcggcgacaccatcaagtatgttgacatgctgcctcaccccgacgcaagcccctcccttcattggatggccacggcatgg

SEQ ID NO: 2666 - DNA, 556 bp, Hordeum vulgare
ggggggtaatacaaactgacataatatatagtacaattagagttctaataatacaaagcttgtataataaacaagccggtagggtatagtaggcggtgaggcaatgaagaaaggaactccagaacagggtctagagggccataatcctaaaataaataaaagacaggcaaaagaaggggcagaccagcaggcatgatgatctactacccccaccattgatactaatcttaggacatacagcttccatgcaacctcacgaataagaaatcaccatggcgtcgtcttcttcaggatcttcaacatctttaatatgcttcttgctagggcatttcagcaacggcacccctggtcgtttagatgtttgatgtgtacctggagctggttggagatatgcggagatcctgcttgcgtcgtagcccttggctaaacaataagtcctcttagcagggaactccaccacttgctcggcagtctcgttctccatgtcaacagcaagcacccaagctgtgtgttggcttgggctgaagtcaatcttggcgaggaagtaaacaatggc

SEQ ID NO: 2667 - DNA, 519 bp, Hordeum vulgare
cctggatccagtccagcgagatcaaggacaagaaggctctcatggatgcccgcaagcagattgagcgcgagatggaacgatttaaggtctgtgagaaggaaactaaaaccaggccttctcgaaagaagggttaggacaacagccgaaaactgatcctagagagaaggctaaagctgaaacaagagattggcttaacagtgtggttagcgatttggaaaatcagattgataattttgaagcggagcttgaagggctttcatttaagaaaggaaagcaaagacctcctcgattggtacatttagagaaatctattacgcgacataaggctcatataaaaaaattggagtcaattctgagactcttggataatgatgagttgagtcctgagcaagtcaatgatgtcaaagatttcctagaagactatgttgaacgtaatcaggaagattttgatgaatttagtgatgtcgaggatctctatagcacattgcctatggagaaggttgaagcactcgaagacat

SEQ ID NO: 2668 - DNA, 543 bp, Hordeum vulgare
  UNSURE (4): n stands for any base
acangctctaaatttaaatttaaccacaaggttacaacttacaactggggaatttgttccagattccaacagttccattctgaaaattacatgagtcgcaattgagcaaacatttttctcagccctagtgccctagtttggttgtactgacagttcatcctcaaggaagttgtattcaaatgtgaagtcgttcttgatcctttggcaccacccatttccatcatctgcgagatgaaaatcaaagtacacgtacgatccccgctcatactcatccgtcgtgacctgtggctccacatgccgttggaaccaagtattgtacttcctgtgaaatctccatgactgcttttttagttctttagcggccaaatattgttggtacgagttctgctgatagtagaatgcaaagaatagcatatctgtagataatgtatcgctaccgagcctttcccaaaaggcaggatttgtcacaattggtgcctgaatctgtgggtaactggcaggggtcactgaagggtgcctcggaatataagttttcgcacgctc

SEQ ID NO: 2669 - DNA, 560 bp, Hordeum vulgare
  UNSURE (90): n stands for any base
cccgggcctgcaggggaattcggcaccgagggggcatccgagtgggttggacctatcccgcaacaacttagcaggatcactgccacatangctttcaagacaaagaacttcattacctatcgttgtcaagaaatttcattagtggagtaatcccagcagatttttgcaacatgacatcaatggaactgattgacctatctgataacaacctttcaggagagcttcccaactgttggcaaaagaaatcggaactgtatgccatagacttttcaagcaatgacttttggggagaaataccatctaccctgggttctctaaattccctcatgtcactgcatcttagcaagaatagcttatccggagtattgcccacctcattgcagtcatgccaaatgttgatgttacttgattttgcagagaataatttgtcaggaaacataccaagatggataggtgagagtctaaagtctctgatacttgtgagtttagggtccaaccagttttctggtgaaatacctgaagaattgtcccaacttcctgctctgcaatatttggatctt

SEQ ID NO: 2670 - DNA, 550 bp, Hordeum vulgare
tcgtgcttatctctagtggaacttaaagaggtccagtggatcgtacaataatatccagtgggccaagggagttcagttggttattctaaggaaataacatatggctggtccattcatatgatattacaaggcgccttattacatactagcggcagaaggttgttccagctcgtagcaagtgatggtgtcctgactccgtgtccatggaggggtctcttcctgctggcatcatcctgttgatgctaagcttcatctccactgcagtgcaccacagcttgctcagtgccctgtcggtgaaccgaaagtaagccttccttgcgaccgcgctgcatatgaaggtggtgaatacagtggagattccgaacgcaaacccgagcagtgtaaatagacatgtcagcgtgtcaaatctgagttgaagtttatggttttggtgtctgttactctcgggtacacagattctggaaagtggaggcccgcaaagattttcatttcccaagtagctgagattatcaaaagtgctcaattgatttccgtacggtatctgccctga

SEQ ID NO: 2671 - DNA, 550 bp, Hordeum vulgare
  UNSURE (12): n stands for any base
gtctttccgggnctgcaggcaattcggcacgaggcaccggaggagacgcgaaccctaaatcccccaaacaaatccgccgccttccgcctcgatctcccccgccgcccgccgcccgccgcccgacgccgatggatccgaagttggtggaggtgacgcagctgttcgaacgcttcaaggcggcctgcaagcgcagcgatctcgacgcctccgcgaccctcctctcgcagctcaaggtgctcctcaccaagttccccagcctccctccgctcttccagcagacgcccaacgccgtggaggagctcaagctcgcgagggaaatttatgagcatgcagttcttttgagtgtgaaaatggaagatcaagatgcatttgaaagggacttctgccagctcaagccttattacatggacacatgtggcatacttcctccatcttcaatggagtacccaatcatggggcttaaccttctgaggctgttggtccagaatagaattgcggagttccacactgagctggagcttctgcccgccaaagcgctggagaatgcttg

SEQ ID NO: 2672 - DNA, 558 bp, Hordeum vulgare
ggacctttggctctacaaccaattaattgatacacataacacagcgttgtttcttttgcatttacagtattgtctacagcactttggaaacagtgggtgaaacaaacgattgaaccaaaatagtacagctgagtcacagggcaatccaataatccacctcttcatgggaaattcagtccaaagttgaaagaaaagagaggcaaatcacacaatcctttccaattccctcgcgtagccaagggtctggttgatgacgggcgccgccggtatctccttgcagggctgcgactccttcgccttctggaacaagacgcggccgtccttgacatcccactcggggtgttcctctgcgatgtactgctgcagttccttgtcggagctgaacataaacatctgcttcgcatcgcttattgacaggtaatcatatcccttctcgctgcacccagctatctcgtctctaaccgttttggcgagaaggtccatgaagtatacgtaggtctcatgcggtgcggtttgccgagcgctcagcacacggttgtaggcgccctccataaagga

SEQ ID NO: 2673 - DNA, 1200 bp, Hordeum vulgare
  UNSURE (1)..(3),(16),(19),(23),(26),(37),(41),(47),(51),(66)..(69),(92)..(101),(139),(151),(207),(225),(231),(232),(237),(261): n stands for any base
nnnttttcgtattcgnacntagnaantctcattagtngggntcttcncagngagtctgttaaaggnnnnttttctgcaccactcaaagaaannnnnnnnnnttttggggtttggggggggccccccaaaaaaagctttntttttttttttngtgggttgtgtttttttggcgtctcttttttttttattgggggggggggggccccnccccctacaaaaaaattntataanntttcntttttttttatttatttatttttnagtagttctctttttttttactttttcctttttttttttatattgtttcagccattcttttttttaagctgtagctttttccctccgttcttctttttttcgatatggtcacaaactccttctcacccactttttatattattgggggggaccatagccatctattaatacccacgaatctccctccttttttcttgcatttgtccccttttctttttttttttttaatgttatcccttatttacttcgccattatcctcactcttatttatatcaatttgttggtgtgtggttcgaattttttcttttatatcttattttttattttttaattttcatccaatttatccatctatattattcccaatttgatcttatatttttttatcgatttttatttaatatcattcatgaacacatccactactatttttttaatttttctagcccccatttatactcttgttatcatctctttattttcacaccctattttttttatccactcttattttattattatatcctccaccgccaacagatagaatttatatgttccatattacaattttcgttcttcttcgtttctttttacactctatttttccatcaatttatttattatctattccttatttccctccttctcatttttactttgtttgttgtaatattgtatgtatatcttatctctggtattgtattcttcttttcagtcatatcctgaattatttcttcatctttgataatacttttcactagtgtacacgtaacgccaatcgtatcaattgaaacgcctatttatgaatatttctatatactatatattaagtatataatatattgcccatattcactcttatgatttattgtaccattatttatgtgtttagtcttctatctactagtttattatacttctacagcacaataataatt

SEQ ID NO: 2674 - DNA, 550 bp, Hordeum vulgare
cttacatgtttttaacctcgcgcatccagtttgccaaaaacacaagaagaagaaacgcttctagagatgaacatagacaccacatccacaaacgacttagaaatgatgataccaaattaccaatggagatacatcaataccaacacgactcctcaacgttattattacaagcaccgtgcagtgcagtgcagcgcagcgcagcccagccggttattacatcacaagatccatgagacatgtcgcgcattacatacatatgctaccacacgctccaaattaacccaagccttccatctcgcctgcactgcacctgcacgccgccggagcgcggccggaggtcgctcagtcgctgtcgctgctgctgctgctgtggccgtcgtcgtccttgtggccctcgccgtccttcttgtccttcttcttcttcttgtccttcttctccttcttctccttgtggtcgccgtccttcttgccgtcgccgtggccgtcgccgctgatcttgtccttgatcttctccatcatgccctccttgtgctccccgtccttcttgtgc

SEQ ID NO: 2675 - DNA, 516 bp, Hordeum vulgare
acctgctgcagggccccctgctgaagcgatctgagacgctacgtaaatggaacgaaagatggatagtattggacccaacatctggcaagatggaatacaaacttcggaggaatgaaactgccgttaagggagccattctgtttgatgcttcaagcaccattactttgtctcctgtaaattttcatggcatgccaaagtatgacggatgctgtttctacattggaactcctcagaaaaaggattactttctttgcgctgaaactcctgctgctgccaaagcttgggtgtctacattgcatgccactcagttagtactacaagcgcataaagaggcagtaaattctttagctgggaatggctctccttctacattaggcacagttgctactgcagttgctaatgctaatgcaactgctttggaggcaatgaaggagatagacgcagcactgaaggtttcaatgagggcagctcttgggttgggtacaaataattcgaatgcgggtcaacttgatgatt

SEQ ID NO: 2676 - DNA, 536 bp, Hordeum vulgare
  UNSURE (12): n stands for any base
catttgttgaantcagaaacatagttcgaatcaatggcaaaaggagatgacgtgaataataatttacaatcacacgacaaaccgctatcatcttttattgagttgcatacttaaatacaacggacacacaacccggaagcagcgcaaaaaaaagaaaataaaaacacaaaagtaattctcgagaggattcaaatccttgtcagtctcctcaataatcacaagccatccaagaaagcaacttcacagccccaaaggccttcagggatgtgttgcccctccctgcatatgatcattggccggcggcgggttcaccacagggatatccaggctgctgccttccgcctctggggagacctcgcgcacgtcggcaatcagcgcctccgactgctggaagccgccccacaccgggtcgccgatggggcggatgtccaccccatccacggccagctggacctccgtgctctcgctggagaccaggaccgatctcgaatcactcacgcacgccttgtccacgtcgtcgtccgatgcgtcgacgt

SEQ ID NO: 2677 - DNA, 538 bp, Hordeum vulgare
  UNSURE (10): n stands for any base
gggctgcagnaattcggtacgaggcgagtgaaagagaggagttgcagcatttggctaaggacatccgtgctcgtgacgctacaatccaggaaatagcagacaagttaacagagacagcagaggctgcagaagcagcagcatccgcagctcatacaatagatgaacagagacggcttttatgctcagagattgagcgcctgaaaaaagctatggaaacacaaatggaacaatccatgcttaagctacgacaatctgaagagaaggtaattagcctgagcaaagagaacgaccagttgctgaaggaaagagacgccgcatttcaggaagcatatatgtggcgcactgaactaggaaaggctagagagcaagcagtgatacaggaagcagcaattgcccgagcagaggagaaggtaagggtgactgaagcggatgccacggttcggataaaggaagccgttgaaaatttgcatgctgctgagaaagaaaaagaggaacttctagcccttattggtgttctccaatcacaagtgcagagaga

SEQ ID NO: 2678 - DNA, 537 bp, Hordeum vulgare
  UNSURE (25): n stands for any base
acatttgttgaatactgaacatagnttcgaatcaatggcaaaaggagatgacgttaataatttacaatcacacgacaaaccgctatcatcttttattgagttgcatacttaaatacaacggacacacaacccggaagcagcacaaaaaaaaaagaaaataaaaacacaaaagtaattctcgagaggattcaaatccttgtcagtctcctcaataatcacaagccatccaagaaagcaacttcacagccccaaaggccttcagggatgtgttgcccctccctgcatatgatcattggccggtggcgggttcaccacagggatatccaggctgctgccttccgcctccggggagacctcgcgcacgtcagcaatcagcgcctccgactgctggaagccgccccacaccgggtcgccgatggggcggatgtccaccccatccacggccagctggacctccgtgctctcgctggagaccaggaccgatctcgaatcactcacgcacgccttgtccacgtcgtcgtccgatgcgtcgacgtg

SEQ ID NO: 2679 - DNA, 516 bp, Hordeum vulgare
agacgagtacgatgattgcgggcatgtgttgtcctgtagagtgcatgatctaatgcttgactttatcatactaaagtccacagaagaaaactttatcaccgtaatcaaggaaccacctacaggtaatggtgcacacaacaggaatggcggtttcgaatttcgccggctatccctccaacttataaattcagaatgcactcaggtgttgggtaacacggctctcacccaagttaggtctttgaacttttggggtgaacctgaatgtatgccttctctctcaagttttcaacttctgcgagttctgcatcttcatgctggtggacacgaatatcaacactatgatctatctcccatatgcaactttttccagctgagttatttgaagattggaggtgtgcattgtgagaaacagttaagagaattgcataagttacaaaatttaaagacattggagctagctagtggtgtaggatttttccggctagatgtcagcatattaccgtcgacattgtgcca

SEQ ID NO: 2680 - DNA, 542 bp, Hordeum vulgare
  UNSURE (52): n stands for any base
cccatcggaatacagtaggatgtaacaattagtcgccaaacagctgtttaanttcccctcatcaggaaaacattggtgtataaagttactattgtccaagtccaaccacttgggtttagagtacatgccatctgatgaacccgaaccactaaaaaatatttgcaaaacaaaccatgccctccttatgacagagcaaatattctgaagtttctacctccgaaagttcttaagtttttaggttgaagcagtttaactttcttaaccgctgaatcagtttgaagactagtaattttctgcctccgaaagttcttaagttttaggacctaagttaatgtttgaatcagtatatcatagaacagacacacaatttaaaggttcttacacactatatcaagcatgcgacattacattgcttatatatcataacaccgaccagctgagcagccttctccatgccattccaccaaccaatgtttattctggccatggaatggcagtagagcacccattgtaatctgtcccattttgagctctgcacttcc

SEQ ID NO: 2681 - DNA, 518 bp, Hordeum vulgare
ccatactccggctccgatccatctcagtgagcaagcatggcgccatccatgagcctcgccgccaaagggctgctccccttcggagcgctcccctcgagcggcggcgtcgcgcagaggccggtgtccgtgaccgcctccctggagcacaagcccagcgagtctaagaggaggctcctcaagcttgcgctcggaggagtcggcctgcccgccttgctgactgccaacaaggccctcgccgatgaccagggcgtctcttcctccaggatgtcttactccaggttcctcgagtacctcgacaaggacagggtgaagaaggtcgacctgtttgagaacgggaccattgctatcgtggaggccatctctcccgagctcggcaaccgcgtgcagagggtccgtgtgcagcttcccggcctcagccaggagcttctccagaagcttagggagaagaacattgactttgctgcgcacaaccagcaggaggactccggtaatctcctcttcaaccttatcgggaactt

SEQ ID NO: 2682 - DNA, 518 bp, Hordeum vulgare
cagctttgctttatgatgagcaattatcgtcggcatccaacaaacaacaggtagcaatcaccgtcgcacatgaattggctcaccaatggtttggcaatcttgtaaccatggaatggtggactcacttgtggctaaacgagggtttcgcttcgtgggtgagttatttagctgtggaatctatatttcctgaatggaataactggactcaattccttgatgagacaacctctggcctcagactggatgcgcttgcagagtctcatcctattgaggttgacgtaaatcatgccagtgaaatcgatgcgatttttgattccataagctacgacaagggagcttctgtcattcgcatgctacaaagctaccttggtgccgagcgattccagaaagctttggcttcatacataaagaagtacgcatactcaaacgctaaaaccgaagacctatgggctgttcttgaggaggaaactggggagcctgtcaaggatctgatgactacatggactaagcaacaagga

SEQ ID NO: 2683 - DNA, 525 bp, Hordeum vulgare
  UNSURE (24): n stands for any base
taggatgcatataaaagattttgncagcctcccaaagtggccaaaatttctggatcaaactgaacattgatcaaactggattttatagagtgaagtatgatgatgaacttgcagccggacttgaaaatgcaataaaagacaagaaactctctttaatggatatgatcggtgttgtggaagattcttatgctctttctgttgcttgcaaacaaacactgacatcattgcttcgtttactaaatgcttatcgtcatgagtctgattatactgtactttcacatgtaacctctgtatgtttaagcgttaataaaatatcaactgatgctactcctgacttgtctagagatatcaaacaagttttgatcaagcttcttctgttagctgccaaaagagtaggctgggatcctaaggatggtgagagccatcttgatgtaatgcttagatcactgctcttgattgcccttgtcaagctcgggcatgaagagactataaatgagggaattcggcgtttccatatcttcttag

SEQ ID NO: 2684 - DNA, 549 bp, Hordeum vulgare
ggaaattggattcttcttttctgagtatgagtaactctataagtgactcggggttttgaggaaacaaacggtatcgttaatgagaaggcacaccagaaaatcaaatgttgctactcgttagaacagagcctttccaaaacatttattatgcagtcatggcacataatctcttcttcgtacaaaggagcagcttaaaactcctgcagcagcagctgctgcaccgtttgagcaaggctgggctcgctcttgatgctgtcgatccatctagcgctgatccgcaccctctcgaggctctgcttcaacgctctttcgaacgacggcttcacgcgagtggcaaagaactgggaaacctcagcagctttctcctcggaggtgaacggtgaaacggtagaattaacgaagtccgatatgagtgagcttgatggccaagtcttgacgacgtgatcccagttatccttcagccaggcccatgcagcttctcgtccttctaagctaataccaccaaggacataaaatgcatcttgattccgtacctcgtctgtaagcata

SEQ ID NO: 2685 - DNA, 519 bp, Hordeum vulgare
ccgccagcgccggcagacgctcctcgacaccgacgttgagaagtactccaaggcgcaggggcggacggcggtcagcttcaaccccacggatctggtgtgctgccgcacgctgcagggccacagcgggaaggtatattctctggattggactcctgagaagaactggatagttagtgcctcacaagatggacgactaattgtatggaatgctttaacgagtcagaaaacacatgccataaagctacactgtccatgggtgatgacatgtgcctttgcacccaatggtcaatctgttgcttgtggcggtcttgatagtgcatgctctatattcaaccttagctcacaagtagacagagatgggaacatgccagtatcaagagtactgactggacacaaaggctatgtttcatcatgtcagtatgtcccggatcaggaaacccgcttgattacaggctcaggtgaccaaacgtgtgtcctgtgggatgttactactggccagaggatatcaatctttggagg

SEQ ID NO: 2686 - DNA, 548 bp, Hordeum vulgare
aggaaagaagctctatttcttactcacaaacgaacaaattgattgttggttcgaacaattcggcttgtcaagctagtccttctctacagctaaaataaaatagttgtacacaacaagggcagaaaaatatcacatgtgcgctgcttgatttctggtaactctataaacagtacgctcacttgaccaggcacagaaacatcatcacaaggcgcactcagtctcttcgacagacggcattttccattcaacacaaaggcatgattctatgctacaaaacgggcgacgactttcatccccagcaacctgtctgagttggccaaccattctcaacacgcaacgaggaaggcacaacaaggagagatcacacacgcgggggcttcagactatcttgcggtgtccgctgaaagcccagatcttcaaatttttgtcccaacttcctgtacacaatgcactcccatcggatgacagcccaaggcagcttatacggccttcatgagagttttggagagttcccaagttaagcaccacctcggcaagaagcgtgtccc

SEQ ID NO: 2687 - DNA, 517 bp, Hordeum vulgare
ctcactgtcatgggtgatgacatgtgcctttgcacccaatggtcaatctgttgcttgtggcggtcttgatagtgcatgctctatattcaaccttagctcacaagtagacagagatgggaacatgccagtatcaagagtactgactggacacaaaggctatgtttcatcatgtcagtatgtcccggatcaggaaacccgcttgattacaggctcaggtgaccaaacgtgtgtcctgtgggatgttactactggccagaggatatcaatctttggaggcgaatttccatcagggcatacagctgatgtgttaagtctgtccatcaactcgttaaacacgaatatgtttgtctcgggttcatgtgatacaactgtaaggctatgggatctcaggattgcaagccgcgcagttcggacatatcatggacatgagggagacattaacagcgtcaagtttttccctgatggtcagaggtttggtactggttcagatgatggtacatgcagattatttgacatg

SEQ ID NO: 2688 - DNA, 555 bp, Hordeum vulgare
  UNSURE (12),(13): n stands for any base
ggtaaatgaagnnctctcatttcttatctcacaaacgaacaaattgattgttggttcgaacaattcggcttgtcaagctagtccttctctacagctaaaataaaatagttgtacacaacaagggcagaaaaatatcacatgtgcgctgcttgatttctggtaactctataaacagtacgctcacttgaccaggcacagaaacatcatcacaaggcgcactcagtctcttcgacagacggcattttccattcaacacaaaggcatgattctatgctacaaaacgggcgacgactttcatccccagcaacctgtctgagttggccaaccattctcaacacgcaacgaggaaggcacaacaaggagagatcacacacgcgggggcttcagactatcttgcggtgtccgctgaaagcccagatcttcaaatttttgtcccaacttcctgtacacaatgcactcccatcggatgacagcccaaggcagcttatacggccttcatgagagttttggagagttcccaagttaagcaccacctcggcaagaagcgtgtcccac

SEQ ID NO: 2689 - DNA, 108 bp, Hordeum vulgare
gtgctttctcaggggttggcttctcctccccactcagtcctcggttcccccggtccggttcggttcggttcgttagggtttagcggcggggagaaggatggccgacgt

SEQ ID NO: 2690 - DNA, 319 bp, Hordeum vulgare
ttttttttttttttttattgcgaacaaacttttgccctcatttttcatttcacatcatatcacaaccatggcgaacggaacaggggaacggtaacaagtagcacggaacggtagcgtcacatctaacggtagccagagcatctcagaacctaagcgatggagcgagatctagggttactcgggagcgagcgataacacggtacaggtaaacgaaaaggatggatcgataactaggataactggccgacaaggggccccaccattcactccctccagttgccgccgccggagccgccgcggctgccaccgtagccgccgc

SEQ ID NO: 2691 - DNA, 385 bp, Hordeum vulgare
agggtggattgggacaggacgcacccaaaccgaatctcagctgattttggatggcgcttgctccgtgaagtagagtacgtctccatgcaatcaatcatttggtcgctgggatctccgtcttcctctcaccaggcattcgatccgatgtatcagctggaggtcatggacgactccagcttgttcatgcagtgggccgtcgacacgctgcagcacgaccacccgccagcccccgctgctgcctacgccggcggcggcaccttcccgtcactcgaagagctccgccgctcggcgctgcagcacggcacggcacaggacggccaccgtcacttggccgccgacagctggagctccggcgacagcgccgggggcggccacgaaaacacgt

SEQ ID NO: 2692 - DNA, 377 bp, Hordeum vulgare
tttttttcttttttttttttttttttttgcgcgcgtgccgagaagtagtttatttggatggcttgacagtccatccatctctgccggaggttcgccgtgacgaacactctgccagcatgtgtagggtaggagtacatgtgtttctctactcctactttgtttttaatggctccatgtgttcttgaacctcgatctctgcaggaggagcattgttatcccggccctatgacgtgggtgcaggcaacgccgcctcgaccttggcaatgatgtcctccgccgtgacgctgaacccgtcgtccaccttggccatgacggtgatgatgacagtgcaagccgggaactggatggcattggcgtgggtgatgctcaggtgcagc

SEQ ID NO: 2693 - DNA, 525 bp, Hordeum vulgare
ggcacgaggtgaggacggacttggaatcttattatgagcactgtctttgaatattagcttgttcaaataatcagtttagttggctatgtgccttttaatattttgttaagatgttcgtatgtctggtctgtgaccttaatcattttgcactttggtaatgcgaatatgggatttgaggaatttctacaatttctgtatgtctggtaccccagcactcgttgtgaccttaatcattttgcactttggtaattcgaatatgggattgatgaatttctacaatttctctatttcatgagctaatttcttttagtttttactttgaaacattttatgtgttttttttgtagtttttactgtgaatcatttagttttttagcttctgcaccctgccgtagaatgtggtggccgtggatgatggtcgaccagaagtttttaacttctgtagacaagatgcttgattgagcatgatctggagaattgcaagtttcagattcagcatgtcagctgtttcagattgagcattac

SEQ ID NO: 2694 - DNA, 547 bp, Hordeum vulgare
tctaaataagaattattaaatcggtttcaaatccagaacttgtaatgctcaatctgaaacagctgacatgctgaatctgaaacttgcaattctccagatcatgctcaatcaagcatcttgtctacagaagttaaaaacttctggtcgaccatcatccacggccaccacattctacggcagggtgcagaagctaaaaaactaaatgattcacagtaaaaactacaaaaaaaacacataaaatgtttcaaagtaaaaactaaaagaaattagctcatgaaatagagaaattgtagaaattcatcaatcccatattcgaattaccaaagtgcaaaatgattaaggtcacaacgagtgctggggtaccagacatacagaaattgtagaaattcctcaaatcccatattcgcattaccaaagtgcaaaatgattaaggtcacagaccagacatacgaacatcttaacaaaatattaaaaggcacatagccaactaaactgattatttgaacaagctaatattcaaagacagtgctcataatgaagattccaa

SEQ ID NO: 2695 - DNA, 518 bp, Hordeum vulgare
cggtcctgccgccgcctcgtcctcgtcggcctcgcccccatcctggagatctgcaggcttgggtccgtcgccattgattgcttgctcctcttggacggcgccgaggtcccggacgaactgcgtgagctctctggcggcagtgttgtgcatgtcagcgccactgtgatgaagaagatctccgggatgcagtcggttgactcaaccgaggcgattgctgtcatgcacatgcccaggcatttctgtgacctcggtgatgacgagggtggagctggtcttgatgcctcgttccagtctcccaagaggatcctagtccttgatgggattcaggatccgggtaaccttggaacgttgataaggtcagcttgtgcgttcaaatgggatggggtgtttcttcttccggcttgctgtgatcctttcaatgaaaaggctcttcgtgcagcccgtggagcctctttgcagcttccaattgtctccggcacctggtgtgatctgcatgctttggtaactagatatggcat

SEQ ID NO: 2696 - DNA, 514 bp, Hordeum vulgare
  UNSURE (4): n stands for any base
ttantgctgtgtgtgggttgtcacataaataaaaagatacccccagcaacagaaacattcagagattcaaaaataccttccataggaatgcttacaagatcacaagcttggacggtctcttcagagaggccattgccctcacttcctaacactaagcacagtgactcactcaccagtgaatctgcaagttctttggacagcgcgtgggttcttgcggatccatcactgctactttctggatggcctgcaaacatcttcatgccatatctagttaccaaagcatgcagatcacaccagttgccggagacaattggaagctgcaaagaggctccacgggctgcacgaagagccttttcattgaaaggatcacagcaagccggaagaagaaacaccccatcccatttgaacgcacaagctgaccttatcaacgttccaaggttacccggatcctgaatcccatcaaggactaggatcctcttgggagactggaacgaggcatcaagaccagctccac

SEQ ID NO: 2697 - DNA, 516 bp, Hordeum vulgare
caccgccccagactcaccagctgccaagaaatataacatgttcgtcgcccagattggctgtgcagccatcggcgtcctcgccctttccttgtttgggcccggatggctagcgaggggtgcagctctttctgcgtccatagcattcatgaccatcacaggctcttcgcaccctccggctgcgagcttgcctctcttgtttatcgatggccccaagtttcacggcttacaactttggtatgcgcttttccctggggctgccggctgcgccatcctttgcttgattcaagaagtggtggtttacctgaagaagaactgcaagttttgattcaagcggcggcatttcctgattcttgatgatggtttgattattatcaaacctgtgccatacataagttgacgaaccggccttcggatgaagttgataaatgtagatttagtcttcttggttcatttaccaaggaaaagtagtaggaaaagaagctgattttgcttcataattgttattgatcatggttc

SEQ ID NO: 2698 - DNA, 517 bp, Hordeum vulgare
  UNSURE (1): n stands for any base
nttggtatatatatacttcacattttcatggtatgaaccatgatcaataacaattatgaagcaaaatcagcttcttttcctactacttttccttggtaaatgaaccaagaagactaaatctacatttatcaacttcatccgaaggccggttcgtcaacttatgtatggcacaggtttgataataatcaaaccatcatcaagaatcaggaaatgccgccgcttgaatcaaaacttgcagttcttcttcaggtaaaccaccacttcttgaatcaagcaaaggatggcgcagccggcagccccagggaaaagcgcataccaaagttgtaagccgtgaaacttggggccatcgataaacaagagaggcaagctcgcagccggagggtgcgaagagcctgtgatggtcatgaatgctatggacgcagaaagagctgcacccctcgctagccatccgggcccaaacaaggaaagggcgaggacgccgatggctgcacagccaatctgggcgacgaacatgtta

SEQ ID NO: 2699 - DNA, 516 bp, Hordeum vulgare
aacctccttccaaacgcccacccccaccacccaattatcccaatcccccgctaacagcagcaccaataaagaacgcggagaaaaagagagaaattttccgccgcattatcatagtagcataacagttgttggtggttggtgcccgctttgtttacccatttatttttggacccgaggagaagaagcagcagcggaaggaggaagaagcagcaaagatattgtaatcttcggtgggagggatccgattttgtccccgtgccggaggagagagggagagagacagagagaggagcaaagattcaccgattttctttctcctctccgcccctcgcccccctctctctccttccgctatccccaaggtcagctcgtgacagcaatcgttctgccggccgctgcctgcccccacgaggagcgcgccgccgtcagaatcatcctgaatcatcggcgcacgctgatacctctggtggttgctgctgagctggtgaaggagccctgcggagtcctgtgcacgcc

SEQ ID NO: 2700 - DNA, 554 bp, Hordeum vulgare
ttccattcatctttacaaaaattatttaccccacccccacaaacttataatacatttcatgctataccccctctcttctataccaaatgcaactacagctacaatttccaggctttttcaggcacgttattatcatggcctacaaattacagataatcctccccatcccatcttcaccagcaacgagcgttcatttcacttaggccacgaaatcatgcagcagaggcgacggctcaaactgctgccgctgatccaactggttcgtcgattcgtaatccggagaggcggcggcggcgccaccaccgggatgagccgcggtagtgttgtagatatccccttccccgcccacggtgaaacctggccggtgagtgttgtttggagctgaaaggttgttctcagtgtgctgcagtcctagcgtcaacgacacattgctgttctgatatccccccagctccgccagatggtaggccatgaaccgtgcgctctcgtcgccatggaggagaccgccgtccgcctcgcccggtctttggtccttcaacagcaggttcatgaag

SEQ ID NO: 2701 - DNA, 504 bp, Hordeum vulgare
  UNSURE (3),(19): n stands for any base
cgngcacgaggggatatantgccttattaaagctactgctgcttagcgtccgtttttaatgtcattatggattatgggttgtaataaaagtgaactctatattgtgtttcttatgttacaagtacttgtctttgcatatcattatgggattgctagtgatgaaagttgcaccaggtttgtttgtattcccaacgatctgaaggccccttagcctggatcgttgcgatatgggctgagaaagtccctttgaacctgaacaggataatgcctgcgaagggagtgtgcatttctattttcatgtttcccaggatacattcgaccctcgacattctgggaatcgagggaccaagttttcctgaatgtgtggagcgcacccactggatatgcatgtttccttctctgacgcaacatggtaatgtacacgatttcttgaaccagcatacatattggcatttctccaagaggagagaatatttacagtcatagtgttatcatggaacacat

SEQ ID NO: 2702 - DNA, 550 bp, Hordeum vulgare
gtgtttagctggtgcttttgttctgaaagacaagtggcatgtacaaaccattccaatctgttagtctagttacatcttctactatgctacagaaatatgtacatggataggggtaaaaaggtaaaattacaccgggcattgtgaatgctttgcaagatgtaatgggattcctccaaaaaaaatgtgatgggcttatgaagttggactaaactagccacacgtatgactaaattttatgtgttccatgataacactatgactgtaaatattctctcctcttggagaaatgccaatatgtatgctggttcaagaaatcgtgtacattaccatgttgcgtcagagaaggaaacatgcatatccagtgggtgcgctccacacattcaggaaaacttggtccctcgattcccagaatgtcgagggtcgaatgtatcctgggaaacatgaaaatagaaatgcacactcccttcgcaggcattatcctgttcaggttcaaagggactttctcagcccatatcgcaacgatccaggctaaggggccttcagatcgttg

SEQ ID NO: 2703 - DNA, 320 bp, Hordeum vulgare
cgtgcaggtgttcgccgccgccttcgccaagcggtccttgaagcagcccaaggaccccaagcaggacctgttcgacccgccgcacaccagcgccatcgtctccaagctcacgcacacggaccagttccggtgcctcgacaaggccgccatggtggcggcccccgaggaggtgcgctccggcggcgccgccgcggccgacccgtggcggctctgcaccgtgcagcaggtggaggaggtgaaatgcctcatccgcatcgtgcccgtctggtccaccgggatcatctactacgtggccgtggtgcagcagtccacctacgtcg

SEQ ID NO: 2704 - DNA, 360 bp, Hordeum vulgare
ttttttttattttttttacaatgaaagacattcatttacctttcatatgatttggacaacttacaagaaattaaccacctcattgttgtttccttcattttaacaacttacaagaaattaaccagccattgttgcctactatctttcttcttttctttccccacccacttcatctatagattgattgatttcacaacaccagaaccaaaaaattacaacaacaaagtataggacacgccaattaatcacctgaccttattctattgcatcgttgtgcaaagctcaggcgtctctggtgcccttgaacctgtaccacctggcgcagatcatgaagtagacgaagttgaagacgccgatgcc

SEQ ID NO: 2705 - DNA, 518 bp, Hordeum vulgare
ggccgactacatctcgctcggcatcagggagcccgtctacgaggtggtagaagtgaaagccaatggaagcgtgtctaccgaaaaaataagccgccggcagctactgaaatcaagcggcctccgtctacgagatacacgaagcgtcgacccatcactatggctaatgaactcaatgccttccctgctggtacgtgagcaggccatattactcaaccttggttccttgcgagcaattgctatgcatgagcgtgtccttatattcaattataacagcccaggaggaaaggcctttttagagctattacgaccccggttaaatccaaggaacatcaatggtgggcctgcgatgccttttcaactcgaggttgttgaagcagcactgctttctagaatacaaaggctggaacaaagattaatgcatgtcgaacctcgtgtggctgcattgcttgaagttctaccaaatcggctgacaggtgatgttttggagcagcttcgtctaagcaaacaatcattggtcg

SEQ ID NO: 2706 - DNA, 525 bp, Hordeum vulgare
aacagtaacataataagttcatatttttcacttgtcagctcaataaggggataacattcccagcaaagtagcagagaaatacttgctcccaagttggtatcggttaatcggtatcagcaacccaccagcataccatgacaatttcatgagaatccatacatgcctccagacgagatcaaaaccgctttatttacagttctagatttctaggcgattccgcatatggtgcatggtctttttacaatatcttcctatcctttaggtacttgtacatgatgaaaaatccggctactgctccgactgctattccgccagtcgtcgcccaaaatgcccacgtgttgttctccaggtatgatttaaggttcatgccgaatatccctgcaattaaagctcctactgcgacgcagaatgttccgacctgaagaagcaactccactctgcttacttccagtcgtcgggaacttaagttcactgcaattgaatcttccatttctcttgcagaatcaagaagcctctctgcttgac

SEQ ID NO: 2707 - DNA, 1507 bp, Hordeum vulgare
  UNSURE (17),(18),(1042),(1129),(1271),(1315),(1447),(1507): n stands for any base
ctttttttctctccctnnctcctccctttcttctttcattttgccttcccccgcgccgctgcgagatatgtctcgcacgaggatggcggtgggttgtggcttctgtagcatcacgcccacacggttcacgaacgcgtgtactttgtgggatgggttggcgagagcctcactcttgtaggatgagtattcgtataataaatactagtacatccgattcgcatacgccaaccggttttttctatgaggtcagaaagagaactcgtggtgtattttagctggtaatatgataagatcgtaatgcgcgcctattaagttcatttctttgttgtacgcaagatggcacgcacctgccgtgtagtatcgccacagggtgctggtacacatgtatgatatctaacggactccgaccagcatgttatgtaaacattcctgcattgagccaaattttaacccacatggaagattttattgaaaaggagcgtccctgtagccagcttgtttatattatcaccttttgcgccagtgacccgctcagaggtcgcgttcatctcctgccatatttaacttatttcccccccagttctcccaccggtgcaacgctttaatgtttgagaaacatggagagaagagggcccacgccgcgctactgttgattcacgcagtttacaacgacgccggtaatacaacttcggagccagccgccctcgttgttccgaagatccacaaccgcattttgctgcgtctgttttgtcccgcgcgaccatacctccgcgcaggggtgccacgtgtttagttattcgatcgcggaggcccacatagtgggtgattaggggcgccttgcgcggcgcgtttgtgctttgtcttcgcattagcctctctcggacccgttgatgctttagcgttgtgctaccacatgtgtgccagccaattttattttctcacccctcctcgccccgacagcgagtcacttattgtgttcttgattcttgttaccacgcacacactccagtttacttgccatatagacaatacactgttgttnaagcgacactctgtgtcactcttatgttttggtattgaacagcctgttaaccgcgcgcctattgtttattgtctttcatactcagcnctttcagtacgaacgaagtgttaatttcgcgcacagctccgatgtgtgttttctactcctcaggcgtctagcacactacatacacccacgctcgcccatgtactatacatgtgtgtgttatattgtatatgaggcggccacntattgcgtggattgaagccgttattaaaatcacatgtgttctgncccacacaacacgcaattcgctgatatactagttggtgtgttttttgcgcgcgcgtatatcatatcgcacgccaatattagctcgcaccgcacacccttatccttgtgttccgcgcgacgtcactacccgcncacgcacttatctctctatcgtcgctatactctctttcatagtatgtatattactatgtn

SEQ ID NO: 2708 - DNA, 543 bp, Hordeum vulgare
  UNSURE (31): n stands for any base
agcggtgtaaccgcaaatatacgtacctttntatttctgggtgcaacacatacacatacacattacattacacatgcatgtatacatacacgtacacatacacatgcagctcttgcttcttcttgcggtaaacatacatagcagaccaacctgctaaaagaaggaaaaggaacagagttccatggagctctcttctaggagaggcatcgccaatcatgctgctactgcaagctattggtcttttattctcacgcctttgccgtcatagctagcaagacgtatacgcgggcgtatatatagaagcgtgtacacacgcagaagcgccattacattattcttattattattaggtgcgcgacgccgcggacgtcacaccacctcgatgatggctccggccaccgcttcccagcggcggagctgctcgccgtcgccgtcgccgtcgccgccgcccacatcgaggttgaggccgtagcgcatgcacgtttgcacgcaccgttccttccttgtcgggtctctccaatggctacacttcctctcgcaagc

SEQ ID NO: 2709 - DNA, 486 bp, Hordeum vulgare
ccactttgacttttgctattatacaacactcatatcttgtggggttcttggtgtacatacttctcaatcttgccctcgtcttctcttctgtatacatagtcacacaatttgcaccagcagctgctggatctggtatcccggagatcaaaggttacttaaatggagttgatacacatggaatcctcctttttaggacattagttgggaagatttttgggagcatcggatcagttggaggtggattggctctaggaaaagaaggtcctcttgttcacactggagcctgcattgcttctcttcttgggcaaggtggatcagcgaagtaccacttgaattctagatgggtacagatttttgaaagtgatcgagatcggcgagatcttgtgacatgtggatgtgcagctggagttgctgccgccttcagagctccggttggtggggtactatttgctctggaggaagttacatcctggtggagaagccatc

SEQ ID NO: 2710 - DNA, 509 bp, Hordeum vulgare
tctataacatttttgtttacaatcgcctaatttgtcaccaccgcatggggccatcctccccgttgcatcgaccttgaagaatcctgcatatgtagtccattgggtgttgattggtttgtgtaccattcagtggaaggttaactgcttgttatcaaaattgtcttttgagacatcttgttcttctatgtatttactgctcgatcatcagactgtcaagaagaggacgctccaggtgcacgctcccccctgccgttttaccgttcaggtaggctcttacactggtcgactggagctctgttgtcgcagtattgccgtcctcctcgagtaagagatcttttcttgttatcagtcctacgacacgagaaggccgaggaacgacgaagatatgcctcaatcctagttggcggaagagattgtacacctttgccaaagacatgtcctctggcactatgtaaggagacggatttagaaatggggcaagatctaaatacaaaccaagttcctcattc

SEQ ID NO: 2711 - DNA, 532 bp, Hordeum vulgare
  UNSURE (16): n stands for any base
gtcccccggctgcagnattcggcacgggcttgccccccgcgccatcggcgtcgtcgggcggcgacagcgaaatcccggcggtaataacgcgtcgccgtcagccgcagccaccggtccggtcggtctcgccggggcgcgaggcgtcggttgggagcggagggaggagcgatggagcccctggaggcggcgatagcgatcgtcttcaacgcgctgctgctggtgttcatggtgaagctcttcttcgccatgttccagatgaagctcgtggtcatcctcttctacctcgtcgtcgtcctcttcgccctcgccttctccggccgcggccccggcggattctagcaagcctcttccctcttctcgccggtaccgccgccaaggttaggtataggcccttcgtttttctttcctcttgtttccgtcggctcggggatcaatcaggatccatccttcaagctctacagaccagtgcttcatacttcttactgtacatctttgagatcatatatacctacctcggtgcatgtttaaaaaa

SEQ ID NO: 2712 - DNA, 482 bp, Hordeum vulgare
  UNSURE (13): n stands for any base
ggtctatatgatnctcaaagatgtacagtaagaagtatgaagcactggtctgtagagcttgaaggatggatcctgattgatccccgagccgacggaaacaagaggaaagaaaaacgaagggcctatacctaaccttggcggcggtaccggcgagaagagggaagaggcttgctagaatccgccggggccgcggccggagaaggcgagggcgaagaggacgacgacgaggtagaagaggatgaccacgagcttcatctggaacatggcgaagaagagcttcaccatgaacaccagcagcagcgcgttgaagacgatcgctatcgccgcctccaggggctccatcgctcctccctccgctcccaaccgacgcctcgcgccccggcgagaccgaccggaccggtggctgcggctgacggcgacgcgttattccgccgggatttcgctgtcgccgcccgacgacgccgatggcgcgtgggggcaag

SEQ ID NO: 2713 - DNA, 191 bp, Hordeum vulgare
tcctcccaccccccaccgcctcgccgccgcctccgcagccagataagaaaagaagaagaaaagagagagaaggactcgtcgggagggctcgagatctgtgtcgggagaggggggaattcttgagatcggaaccggaacaagtgggcgcgctcgggaaggggttaccataccaatttttcgcaggaaccctt

SEQ ID NO: 2714 - DNA, 493 bp, Hordeum vulgare
aaaagtaccctggatcccagtgtgtacggggaccagtcaagcactatcactgaagatcaaattcagctgaacctggaagatggcctcacagtgagacaggcaatggacaagaagaggctcttcattctagatcaccacgataacttcatgccattccttgaccgcatcaacaagctggaaggcaactacatctatgcttcaaggactttgctgttcctgaaggccgatggcacgctgaagcccttggccatcgagctgagccagccgcaccccgatgggatccagcatggcgcaaagagcacggtgtaccttccagctgacattaactctggcgttgatggccagatctggcagcttgccaaggcttacgcctccgtcgacgactctgcgtggcatcagcttatcagccactggctgaacacacatgcggtgatcgaaccgttcgtgattgcgacgaaccggcaactcagtgtggtgcacccggtgcacaagc

SEQ ID NO: 2715 - DNA, 346 bp, Hordeum vulgare
ctctcgttttccttccacccttccccgaagggcgaccgctcccgccgccgccgccatgccgaagcactaccggcccgcgggcaagaagaaggaggggaacgccgccaagtacatcaccaggaccaaggctgtcaagtacctgcagatcagcctcgccgtcttcaggaaactatgcattctcaagggagtgtttccccgggagcccaagaagaaggtggaggggaaccacaagacctactaccacatgaaggacatcgccttccttgcgcatgaccctttgattgagaagttcagagaaatcaaggttcacagaaagaaagttaaaaaggcttatgccaagaaaaac

SEQ ID NO: 2716 - DNA, 144 bp, Hordeum vulgare
ttttttttttttttttttttttttttttttgtttttctttaaaacagatcaaaattttccattcaagtatctgagtacatccagtcaatgcaaaaacaacataaataccaccacaaggactagtaaaagcgtatcatcaaaacg

SEQ ID NO: 2717 - DNA, 518 bp, Hordeum vulgare
gcactctcgatcaactaattctagctgatcagccctatagctaagcttgttgcatagcaagcaatggggtactccaaaaccctagcggttagcctgttcgccgtgctgctccttgcaccggccgtcctggcatccgaccctgaccctctccaggacttctgtgtcgccgaccttgacggcaaagcggtctcagtgaatggtcatccgtgcaagcccatgtcggaggccggcgatgacttccttttctcgtcaaagctggccaaggccggcaacacgtctacccccaacggctcggccgtgacggagctcgacgtggctgagtggcccggtacgaacacgctgggcgtgtccatgaatcgggtggacttcgcgccggggggcaccaacccgccgcacgtccacccccgtgccaccgagataggcatcgtgatgaaaggtgagctcctcgttggaatcctcggcagccttgactccgggaacaagctctactccagggtggtgcgcgctggagagacctt

SEQ ID NO: 2718 - DNA, 541 bp, Hordeum vulgare
tattacaactgcatgcgagattaaccggaagcttgaatacatgtcttctgctgagaatcattaaattttgctaccatgcatatacagaattatgcattgattatttaaggaaggctcccaggaattaaaacccagcggcgaacttggacttgagaagttccacgacccctgcctccacccggagcgccttggtgagcaccggcgtcgggataggcgggtttgagccgaagagcgtgagcggcacaaagacgatgccagggttttggctgttgaaggagacgaccatggaggcctccgtcttaccgacgttgaactggaagtgcatgaggccacgggggatgaggaaggtctctccagcgcgcaccaccctggagtagagcttgttcccggagtcaaggctgccgaggattccaacgaggagctcacctttcatcacgatgcctatctcggtggcacgggggtggacgtgcggcgggttggtgccccccggcgcgaagtccacccgattcatggacacgcccagcgtgttcgtaccgggcca

SEQ ID NO: 2719 - DNA, 536 bp, Hordeum vulgare
  UNSURE (3),(4),(516): n stands for any base
ggnnctgcaggtcgactttcactcggaggtgggtcaacctgatggagttgaagaaaggaagagagagttgactgacaagctggataccttgaataagaaaaagcatgatctcgtgcagatgctgaagcagattttaaatgccgaagaagaaatcagaagacgcagcatgcaggcttcgctgcgtgctgccatgcctcagccgccagaaaacacagctgatggaagtgttcccagacaggtgcccagaatgaccgttgatgtcaatttcagcgagtttgctggggagtcagatgctggttccaaccagggcactcctggacgtcccttgcatcatgtccacagtatttctccttcaacagcctcctttgctaggtctccatttggttctcgcaaccacaaccctggcaacactccaagaagtccagcagcacctttctctacagcaagcccgtctcgcttcgcaggtaccgggcatcaaggacaccacccctcggcatcattaccagcaagcaactntgtagcatcgtcgccttccc

SEQ ID NO: 2720 - DNA, 551 bp, Hordeum vulgare
caacacgaactcgtagcacttagcgcccagatacaaaattatgcttcagcaggaccttattctccccgagttgctcttcgcattcacataatattgtcaataaagtagcaattcaaagaggagtacaaagagcattcgactattcacagcaactcatgtacgttgtagccttcgttcgggttatgcagaattatgttgaactgggcgggcgatagtccctgaatacggaggaagagccaccggatgcagcaggggaaggcgacgatgctacaaagttgcttgctggtaatgatgccgaggggtggtgtccttgatgcccggtacctgcgaagcgagacgggcttgctgtagagaaaggtgctgctggacttcttggagtgttgccagggttgtggttgcgagaaccaaatggagacctagcaaaggaggctgttgaaggagaaatactgtggacatgatgcaagggacgtccaggagtgccctggttggaaccagcatctgactccccagcaaactcgctgaaattgacatcaacggtcattctgggcacc

SEQ ID NO: 2721 - DNA, 518 bp, Hordeum vulgare
ctctatgacggcgaatgggataaaagcaaaatgaccgggagaggaatgatccagtggccctcaggcgcatcctatgagggcgacttccgtggaggtttcatcgacggaacaggcactttcaagggggtcgacggctcggtttacaaaggttcttggaggatgaacaaaaagcagggaatggggacaatggtttactcaaactctgacagttatgaaggtctgtggaacgagggtttgccggatggatatggtaaatatacatgggctgctggcaacatctacattggtagctggaagtcaggtagcatgaacggccgaggcgtaatgcagtgggtaaatggtgatactcttgactgtaattggctcaatgggctggctcatggcaaaggttactgcaaatatgcgtcaggggcatgttacattggtacgtgggataggggggtcaaggatggccatggcatattttatcaaccaggaagtaaaataccttgtaaccttgaagtttctgagtgtgcaac

SEQ ID NO: 2722 - DNA, 464 bp, Hordeum vulgare
cgtacggctccacggtggcgcattccatagccaatttctggtacatgacatacagaaggggaaatagtcaccggtacaataagtaagttttttggaactgcacaagaactacatgtgttgcctattgagtatttctagtgaatatgttcatcctttacaacaaaaacaacagcaagaaaacaaaaatacccattactgctatgtactgttcacggcctctctaattttagtcttgctcagggaaaaccctctccaggaaactaacgaatcgtttcgaatacaagtttggatcaacggacgatatcgagagagggtcgaacttgagcgatttgaccgcatgctccaccctcttggacgcgttgtactcctgcagtatgtctatgatgccgaggtagagcaccacgtcgtactcctcgaccgcgtccgtgctttccagcaatttccgggctcgggccggcatgttc

SEQ ID NO: 2723 - DNA, 518 bp, Hordeum vulgare
ctgatgcttccatctgatagtgcaaggaactggcatgtgcatgagttggagcttgttgaggtcgtcgccgatcaggtagcagttgcactctctcatgcagctatccttgaagagtccatgcgtgcgcgtgatttgctaatggagcaaaatgttgccctggatttagctcgacgagatgctgaaacggccatccgtgctcggaatgatttcctagctgttatgaatcatgaaatgagaacaccaatgaatgcaatcatagctctttcgtccttactcttggaaactgaactaactcctgagcagcgtttaatggtggaaacagtattaaagagcagcaatcttctagcaacacttatcaatgatgtgttggatctttccaaacttgaggatcgcagccttgaattggagatcagagcattcaatcttcatgctgtcttcaaagaggtgatgggtttcatcagaccaattgcagctatcaagaggctgtctatgtcggttatgttagcaccagatttacc

SEQ ID NO: 2724 - DNA, 547 bp, Hordeum vulgare
ctatttttaagaacccgttgaaacctttacacatggttccttccacggagagtagtttcgatctgatataaccggggtcacgcgcacacggaatatgcaaattcgctggacagcatatgctactgaacgcagcgagttgatgctgcgcccaggaacataactgcaatctgaagtcccatttgctatacacattatttgtacaatatatgccagctacagcaagactaggcacaaaattagaggggggactcacaaaactagctactgactccctactcgacaccagcaccgtcgaccgtttacactatacctcatacgcttctctggtaacgaggcttcagggaagacggcggccacctctcctcgtgaagcgcctttggaccggatgattcggcattgcactgcctggccaggcgagaggggtcagctgctgccggtatgcgtctgtgttgtcggacacgccgagcctgacgatgaatgtggccgtgcagcctcttcctgccccttcactgtccagccagatgtggcctcccatcagagtcacaaa

SEQ ID NO: 2725 - DNA, 518 bp, Hordeum vulgare
cctcgtgccgaatcctcgtgccgaattcggcacgaggcttgacctagcacatgcatttcatgtcgataaatcatggagggaagcgcttttcaggcagatagctcttgatagcatgttcctggaatcccaatcgattattgactatagcatgctattgggaatccatttcagagcccctaatcacttgaagactgccacgtcacatcaggatacacacgaaagcagtgggattacatctgcaatggattgtagcgtgccactgcattgtgaggatgcgaattcctcaaagggatttcttctagttgctcacgaaccaggtacaacagtaggcggttcccacatcagaggaagcatggttagagcatcagaaggtggttacgaagaagtcgatcttgttctgccgggcaccggaaggttccgagtgcagctaggggtgaacatgccggcccgagcccgaaaattgctggaaagcacggacgcggtcgaggagtacgacgtggtgctctaccttggcatca

SEQ ID NO: 2726 - DNA, 549 bp, Hordeum vulgare
  UNSURE (69): n stands for any base
ataagtaagttttttggaactgcacaagaactcatgtgttgcctattgagtatttctagtgaatatgtntcatcctttacaacaaaaacaacagcaagaaaacaaaaatacccattactgctatgtactgttcacggcctctctaattttagtcttgctcagggaaaaccctctccaggaaactaacgaatcgtttcgaatacaagttcggatcaacggatgatatcgagagagggtcgaacttgagagatttgaccgcatgctccaccctcttggacgcgttgtactcctgcagtatgtctatgatgccaaggtagagcaccacgtcgtactcctcgaccgcgtccgtgctttccagcaattttcgggctcgggccggcatgttcacccctagctgcactcggaaccttccggtgcccggcagaacaagatcgacttcttcgtaaccaccttctgatgctctaaccatgcttcctctgatgtgggaaccgcctactgttgtacctggttcgtgagcaactagaagaaatccctttgaggaattcgcat

SEQ ID NO: 2727 - DNA, 450 bp, Hordeum vulgare
  UNSURE (427): n stands for any base
acacacactcacgcaacacacatccatcttcactgaaaagtgaaaaacagtgtgctggtgccattggttggagcagtgaaagcgaggagaggaggccaagaacaagatgctgctgggagggctgatcgacaccctcacgggggcgaacaagagcgcccggctcaagggcacggtggtgctcatgcgcaagaacgtgctggacctcaacgacttcggcgccaccatcatcgacggcatcggcgagttcctcggcaagggcgtcacctgccagcttatcagctccaccgccgtcgaccaagacaacggcggtcgcgggaaggtgggcgcggaggcggagctggagcagtgggtgacgagcctgccgtcgctgacgacgggggagtccaagttcggcctcaccttcgactgggaggtggagaagctcggngtgccgggcgccatcgtcgtcaa

SEQ ID NO: 2728 - DNA, 397 bp, Hordeum vulgare
ttttttttttttttccaggggaagcaaatctgctttatttattcggcttaaagagcaactgctgacatagtactgtcacagacacacactacaccaatctctcgacaagtttcgtacgtggcgaacgccctttattcatccatggttgccgatggcttaaattagatggagatgctgttggggatgcccttggcggtaagcccggcagcggcgcccttgtggtcggaggtgttggggtagagcagcatgtagggaaacttagccgggccgttgcggttcttgagctccgggtcatggttcatgcccaccaccttgctctcgatctccaccagccggtcgctgaaccgcttgaacacctccagggcctttgggtccgaggtccactccggcgtgtccc

SEQ ID NO: 2729 - DNA, 516 bp, Hordeum vulgare
  UNSURE (3): n stands for any base
ggnctgcaggaattcgtacgaggcctgccctagcgcgcactgcacggcacagcccaccccacccgcaggaccgccgcgcccgccccgccccgcccgaggtctttggtttggtgccctccaacaccgcgctgcgaaatagcctcttggtaacgcacccaaccaagagacaatcatggccgattccatggcggattcgatggtggcgagcttctgggggcctgttacgtcaacaactgagctgtgcgaggagaactatgcgcgctcgtcatatatcgcggagttctacaatactctctctaatgcaccctgcattcttttggcgcttattggactcgtgaatgctctccgccagcgtttcgagaagcgcttcagcgtcctgcacatatccaatatgatactttccattgggagtatcatcttccatgcaaccttgcaacatgtcttacagcagagtgatgagactccaatggtgtgggaaatcctcctatatctgtatgtcctttattcaccagactg

SEQ ID NO: 2730 - DNA, 542 bp, Hordeum vulgare
tgaccacgataaaagaataaccgtttaccacgaacatgaatctaccaccgctccagcagtaagttaaaactaatacaattcaaccccatttcaagtcaaatccaaagaataaaatatcaagtcctataagttggcaaaagacaaactgctgcggatcaaaagtacgggacgaacactccagctaatctctggttgaaatcaagtatggtacaaaacagggcgttagttaaaaagttaccaaaatcaattgagacatcactgacgacgacattcatttgtagtccgtaatcacttggaagcccatttacaaaaaatgccaccgcttgttttttttcgcgcgcttggtgggcattagattttctggtcctggagaacaccgctgatcgacagacaacttactccctctttctggatttctgaatcttgacgtagggcaacaatccaaataggtggatgatgcgcggctcccacccacgctgctgagctcggcagaacatcaagaatgtgtttgcaaagtaagagttgaagcccatgagcatatg

SEQ ID NO: 2731 - DNA, 432 bp, Hordeum vulgare
  UNSURE (3),(11): n stands for any base
ggnctgcaggnaattcggcacgaggtcctcccctacatgagtgttgttatgccccctctacttcagtctgctcagcttaaaccagatgtgagcatcacttctgcagacgaggatggtgaatctgatgatgatggtgttgagactattaccctgggagataagaggattggcatcaggaccagtcttctggaggagaaagcaacagcatgtagtatgctatgttgctatgctgatgagctcaaggaagggttttttccatggattgatcaggttgcaactactctggtacctctcctcaaattttattttcatgatgaagttaggaaggcagctgtttcagcgatgcctgagcttctgcgttcagctaagttggcagtagaaaaaggccaagctcaagggccggatgattcttatcttaagcaactatctgat

SEQ ID NO: 2732 - DNA, 409 bp, Hordeum vulgare
taacgatcaaaattgttgttaatttacaactgtttcgactcaactacatcactagccaaatatgtaactttacaaccttgccacggcgatgtggagacatcccagactcacacacatcactccgcaataaaatatacacacctgatgcaaaccttgcccttggtacaaaagcccagggcatttgtgtgctggacacaaaccccagcaacccatgcacaaaaaatgtggatggaacacaagaagaaagggggggaaaaggtaagctttgaattgatatgtgtaacacgattgaggtcattctggttagctatgatgtcaatacagattgtaacgcaagttgttgctgtggctgaagggtagaccatgtcgaggcaagtactgaaggaggcagggtggtctgaagctgtct

SEQ ID NO: 2733 - DNA, 541 bp, Hordeum vulgare
ggtctgcaggcaattcggcacgaggcccgcgccgcgccgccacccccaagaacctcatcggctccggcctttgatctcctcctccggccggcagaggcatcgaatcccccacgccacatcctccaatggctaccaagtcccaaaagaagaagaagccctccgcccccaacccctcaatcgacgccaagaagcccgaccctcaggaacccacggagacgcgagagacggcggcggcggcggccaagaagaagacgccgaagaagcagaaggagagcaaggaggtctccgccaagaagaagcagcagaaggagggcaaggaggtctctgccaagaagccgaagccgaagaagcagaaggagagcaacgagatcgacgagatcttcgaggccaccaagtccgacaagaagcgcaagctgcaggaggaggaggaggaggaggggtccgagggggctagcaagaagcccaagaagggcaaggccgaggggggcagcaagaagaagagcaagaaggaggccgggggcagaggctgggagcccggcca

SEQ ID NO: 2734 - DNA, 458 bp, Hordeum vulgare
tagttatcgaatcaaccgagcattacaacaaacaccacgacgacgaatgtcacctgagtacatcacctcaggcagggaggacccctgaactgaaaggctcagaagcagcagtcgcagtcgaaggggcagagggcggtgccgccggcgtcggccttgccgaacccgagctcgtcggcggagtatatggtgagcccgtcgttggtgcgccgccgcggccgcttctcctcgacctcgtcgtggccgggctcccagcctctgcccccggcctccttcttgctcttcttcttgctgcccccctcggccttgcccttcttgggcttcttgctagccccctcggacccctcctcctcctcctcctcctgcagcttgcgcttattgtcggacttggtggcctcgaagatctcgtcgatctcgttgctctccttctgcttcttcggcttcggcttcttggcagagac

SEQ ID NO: 2735 - DNA, 395 bp, Hordeum vulgare
gccgctgtgctgtgctgtgccgtaccttagcgtcaacgccgacgcctccctcccccagacacacagccccctccacggctccgcccgccgccgtcgccgtcgccgtcgccgttccacctcgtcgcctccatccccgtccgcagtctccgtcatcggcttttgaggtgaactgagcacccaacttttgtcaagatgtctgacagtcatgaaaccgacaagaatattgagatgtggaagattaagaagctgatcaagggacttgagtctgctagaggcaatggcacaagcatgatctctctgatcatgcctccacgtgatcaagtctcgcgtgtgaccaagatgttgggtgatgaatatggtactgcttcaacataaagagtagagtcaatcgtcaa

SEQ ID NO: 2736 - DNA, 268 bp, Hordeum vulgare
tttttttttttttttttttttttttttttggatcccaatccaattcaaaccttcccgcatgacaacaataataagtaccttacaacaactcaaatttagggcagacatttgccatgttccaccattagggaagacaagttgctaattcgaaccttaaacacagagtcagttcagacaacggcagacaaggggttcccggggaaaaaagattggcaaaataagaggcaacaaaaggttcggtacacggttatcattgcgatttagggta

SEQ ID NO: 2737 - DNA, 516 bp, Hordeum vulgare
cgcgaggagttcctgcacgacgcctcgagggtcgagttctacaagacctacctcgccgagctgaagaaggcgatcgacgacggcgcgaacgtggtcggctacttcgcctggtccctcctcgacaacttcgagtggctgtcgggctacacctccaagttcggcatcgtgtacgtcgacttcaccaccctcaagcggtacccaaaggactcggcctactggttcaagaacatgctgcaggcgtcggggcccggctcgaaagatggcacggtcacttctggcagcacccaagctggctctggcagctcgagcggcaacctggcggctggttcggccacctcgagcagccccagggttctgctctccctgctggtctgcttgtatctggctcttccgtccatcttcgtgctctccttctagtggtgagtttattttccattggtgtggccgttagcagtgcttgttaagcagtggacgccagcagcatattcgttttgagaatctgatgcggcgaagagt

SEQ ID NO: 2738 - DNA, 536 bp, Hordeum vulgare
cacacaataatgtgaaactgagctcaggaccgacccttcagatgttcttccacacactcttcgccgcatcagattctcaaaacgaatatgctgctggcgtccactgcttaacaagcactgctaacggccacaccaatggaaaataaactcaccactagaaggagagcacgaagatggacggaagagccagatacaagcagaccagcagggagagcagaaccctggggctgctcgaggtggccgaaccagccgccaggttgccgctcgagctgccagagccagcttgggtgctgccagaagtgaccgtgccatctttcgagccgggccccgacgcctgcagcatgttcttgaaccagtaggccgagtcctttgggtaccgcttgagggtggtgaagtcgacgtacacgatgccgaacttggaggtgtagcccgacagccactcgaagttgtcgaggagggaccaggcgaagtagccgaccacgttcgcgccgtcgtcgatcgccttcttcagctcggcgaggtaggtcttgtagaac

SEQ ID NO: 2739 - DNA, 548 bp, Hordeum vulgare
gtacccccgggcctgcaggaaattcggcacgagggatgatggcaaggaaaagaagttacaatcgattttgagccattcaagcccatcaatgcgtccttgtacctttgtgacaacaagttccacactgaagccttgagtgagctcctggaatccgatgacaagtttggtttcattatcatggatggtaatggtactctttttggcacactcagcggcaatactcgtgaagtgcttcacaaattcactgtggatctcccgaagaagcatggaagaggagggcaatctgctctgcgttttgctcgccttcggatggagaagcgtcacaattatgtccggaaaacagctgaacttgctacccagttcttcatcaaccaagctaccagccagcctaatgttgcgggactaatattggctggttctgctgattttaaaacagaactcagccagtctgacatgtttgatcagcgccttcagaccaaaatacttaatgtggttgatgtttcgtatggtggtgagagcggtttcaatcaagccattgagttatcagc

SEQ ID NO: 2740 - DNA, 549 bp, Hordeum vulgare
caatccaattaaactttttccgcatgacaacaataataagtaccttacaacaactcaaatttagggcagacatttgccatgttccaccattagggaagacaagttgctaattcgaaccttagacacagagtcagttcagacaacggcagacaaggagttcccggggaaaaaagattggcaaaataagaggcaacaaaaggttcggtacacggttatcattgcgatttaggataacatctcgacatcttttgatagaggaattgtggctgtatcgtctcagacttctaaagcatggtatgaagctgacccgagcgcatcagtcactggatagcttctttgaggtgccccggaacaaatagtcgcgcaaaattcagatttaaccgcgactgcttcaggcatgtgattgattggttgctagtcagaatcttcatagacaccctcatcgtcatcaagatcatcaaaggaacgaatgtccagctgatagcgcaggataccaccaatgccaccaaaccctctacagaactgtgatccctcctgagatttattggt

SEQ ID NO: 2741 - DNA, 519 bp, Hordeum vulgare
ggcggacgttactacggatcaataccatcgatacaaggaagatgttaacctcatgaaaggattgaatttcgatgcctaccggttttctatctcatggtccagaatcttcccagatggtgacggaaaagttaaccaagaaggtgtcgcgtattacaataatctgataaactaccttcttcagaaaggcattactccttacatcaatctttaccactacgatctccctcttgcacttgagaagaagtatggaggctggttaaatgcaaagacggtgggactatttgcagactatgctgacttttgttttaagacctttggcgatcgtgtaaagcactggtttacattcaatgaaccaaggatagttgcgcttcttggttacgacgtagggtcgaatcctcctcaaaggtgcagcaaatgcactgccggtgggaactcagcaacagaaccttacattgttgctcacaattttctcttagcacacggttatgcagttgcaagataccggaccaagtatcaggc

SEQ ID NO: 2742 - DNA, 555 bp, Hordeum vulgare
  UNSURE (22),(65),(66): n stands for any base
gctcacatcgtgccatcttttntattatttccaattcaattggtatctctgaagtctgaatcatnnggttccattcgaacaacagtaggcagaaactcagcaagatcatgatcatgatgatgatgacagcatcaggttggttgattcagaggtgctccatccatattcagtgtcgcagaaggtctctgaaccagtaggccgacgccttggggtgccgatccaggttggggctgttgaagtcgacgtagacgatgccgaacttggacgagtagccggacatccactcaaagttgtcgaggagagaccacgcgaagtagccgagaacgttggcgccaccgtcgatggccttcttcagctcgctgaggtagctccggtagaaccggaccctcgtcgtgtcccgcaggtactggtcgcgcgtgagcccccccggctgatccattccgttttcagttatgacgatcggcgggttcccgtacttctggctgaggtagtgcacgcacccatacatccccgatgggacgatgtagagccagttcgaattcgcctttggtccaa

SEQ ID NO: 2743 - DNA, 519 bp, Hordeum vulgare
gctctcaccaacagaccggtgttcaacaactagaacaaataaatgttcactaagctcagaagagtcagactccataaacagttatttagcagccgacggtagcaagaatggtttggatggtcctcatgtcaaagtgtctgaaaggatttatgatggacacgtcgaaccttcacatgattctgttcagggaaatggggaagtatttgccgaccatccagaaaaagatgacagcgcaagccgagagctgaaacatgaattcagcactaaggatcacatggactcttgcaaatccgacgaacaggatacaactgaaaacaacagaaatgctcggggcacagggaacgatgctccaaaatctgggaatggggtgctgaagtcagttgctggagggataacgctcatcggcgcggtgttcttcgtagctcatctcaggaggagcaaggggataagctttacaacaattttgccttcactttctgaaaaatcaattcagagcgattcaagggcgaagaatgtgga

SEQ ID NO: 2744 - DNA, 556 bp, Hordeum vulgare
cagtaaaagaacggtaatatatatatatatatatgcgcatttaactttaggtcacttgacgcagctctataaccaaattaggatactgctggtatagatcgctcctttagtacagtacatatggatagacatcagatataacctttcaaattgcgcccgattattcgtcatgtccatcctgtcaaaccttcagccatccgcctggatacacctcggttgtctttccgttgtccacattcttcgcccttgaatcgctctgaattgatttttcagaaagtgaaggcaaaattgttgtaaagcttatccccttgctcctcctgagatgagctacgaagaacaccgcgccgatgagcgttatccctccagcaactgacttcagcaccccattcccagattttggagcatcgttccctgtgccccgagcatttctgttgttttcagttgtatcctgttcgtcggatttgcaagagtccatgtgatccttagtgctgaattcatgtttcagctctcggcttgcgctgtcatctttttctggatggtcggcaaatacttcccc

SEQ ID NO: 2745 - DNA, 520 bp, Hordeum vulgare
gttcaatcaattccttactttgcttctggcctgaagggagttgccaggagcatgccgacatcagctgcacttgatgtagttgcaaagaatctaaatctcaagttctttgaggtgcctactgggtggaaattttttggaaacctcatggatgctggaatgtgctcagtttgtggtgaagaaagctttggcactggttctgaccacatccgtgaaaaggatggtatttgggctgttctagcatggctatctattctagcttacaagaacaaggacaaccttggaggagataagcttgttactgttgaagacattgttcttcagcactggggtacttatggtcgccattattatacacgatatgactatgagaatgtcgatgcagaagctgccaaggaactcatggctaacctagtcaagatgcaggcgtccctgcctgatgttaacaagtcgatcaaagagatccagcctgctgttgcagatgtggtctcggctgatgagtttgagtacaaggatcctgttg

SEQ ID NO: 2746 - DNA, 552 bp, Hordeum vulgare
aaggacacgtcaatatattgcatgaagaaacgcactcttgattcaatcactgtgacaagattacggccgtatactgtaccggcagcacagcagagtatgcagtataggcaacgaaacggggacggtctggcacatacatttattcagatgtaagggagatgagatgtaaaaaaaggctatcgaacaggggaggccaggaaccgaacttcatacgcggcctcggcacatatctaggtcaaaatttatgtgatcactgtgggggcggatcggccggtgtactcctgaatcttggaaagcttcagggccacatcaaccagtggagaaagagcgtcacttgactccctcccggttttggaagaatccttctcatactgctcaatgtaaatacggatagtagcaccaactgaaccagttccagaaagacggaacaccagtcgggaaccatctccaaagagataccggataccctgatgcttggagacagaaccatcaacaggatccttgtactcaaactcatcagccgagaccacatctgcaacagcaggctggatc

SEQ ID NO: 2747 - DNA, 552 bp, Hordeum vulgare
gtacccccgggcctgcagggaattcggcacgagggtttctggggcagatgaccggcaagtgaagctgtggagaatgaatgataccaaggcttgggaagttgatactttgagggggcacatgaataatgtgtcctgtgtgatgttccatgcgaagcaagacatcattgtgtccaactcagaggacaaaagcattcgcatctgggatgccacaaagcgaaccggcattcagacatttaggcgggaacatgaccgtttctggatccttgctgcccaccctgaaatgaatcttcttgctgctggtcatgacagtggcatgattgtgtttaaattagagagggaacgcccagctttcagcgtgagtgctgatactgtgttctatgtgaaggacagattcctccggttctttgagtactccacccagaaggaagttcaggtggctccaataagaagaccaggatccgtcagcttgaaccagtcacccaggacactatcttatagtccaacggaaaatgctgtgttgatttgctctgatgtggacggcggctcatatga

SEQ ID NO: 2748 - DNA, 525 bp, Hordeum vulgare
aacctgtactattataccttattccttacacaatcagtaaacctcctggtaaaatataagacaagacaggctttacgagactagaaagaatataggggagctctaacgactagcctcttccgctcatctcgtctgtgtaggggagcacaggaggcccgaggcgtccgcgccgaccaccgccagctcgcatatggtacaaagctgcccttccgtggcaggaacaaaccgggatccgcagtaagggcacgagacgtccttttggccgcggtagatggggacatacgtcgagccacagacgacgaacggatttctgtagtcgtagttgagctcatggctgtcctgcttgccgttgcactgctgttgcacctgccgagccttcttcgcctggacctcgttggggctgttctcgaggagcagcctcgcaaagtgctcggcggtcgcgaagttcttctgcttgtagcatagagccatggcgttcgagagcacgagtctcatgtgaaccctctggagcttgcagttggtgaa

SEQ ID NO: 2749 - DNA, 468 bp, Hordeum vulgare
agaggaggaaggtagacgacgatggcggtgttggtggagctgaccaaggagtacggctacgtggtgctcgccgtggtcgcctatgccttcctcaacttctggatgagcttccaggtcggcggcgcccgcaagaagtacaaggtgtcctacccgacgatgtacgccatcgaggcggagaacaaggacgccaagcgattcaactgcgtccagagggggcaccagaactcgctggagatgatgccgctcttcttcgtcacgctgctgctcggcggcctgcagcacccggtcgtcgccgccgcgctgggggtcatgtacaccgtcgccaggttcttctacttcaagggctacgccaccggcgtcccggagaaccgcctcaagcttggggggctcaacttcttggcgatcatcgggctcatcctctgcacggcgtcgttcggcatcaaccttgtcatcagggaggcgatctaa

SEQ ID NO: 2750 - DNA, 533 bp, Hordeum vulgare
gcctgtactgcaaaagctaaaaccttgatcttacattacaaaccgtctccacctcagtcttattctgtgagagtaaaacagacgcacacacattttttgacactataaaagacatcatcaccacgcctacatgactctagtcacaacgcctatcaagtcaggcatcagttcgggaaccttagatcgcctccctgatgacaaggttgatgccgaacgacgccgtgcagaggatgagcccgatgatcgccaagaagttgagccccccaagcttgaggcggttctccgggacgccggtggcgtagcccttgaagtagaagaacctggcgacggtgtacatgacccccagcgcggcggcgacgaccgggtgctgcaggccgccgagcagcagcgtgacgaagaagagcggcatcatctccagcgagttctggtgccccctctggacgcagttgaatcgcttggcgtccttgttctccgcctcgatggcgtacatcgtcgggtaggacaccttgtacttcttgcgggcgccgccgacc

SEQ ID NO: 2751 - DNA, 518 bp, Hordeum vulgare
ggaacagggaagatgtctaccgctgaggcaacccgtgaggagaatgtgtacatggccaagctcgctgagcaggctgagcgttacgaggaaatggtcgaattcatggagaaggttgcaaagaccgctgatgtcggtgagctcactgttgaggagcgcaacctgctgtctgtggcttacaagaatgtgattggtgcccggagggcatcctggaggatcatctcctccattgagcagaaggaggagagccgtgggaacgaggcctatgtcgcttcgatcaaggagtaccgtaccaggattgaaactgagctcagcaagatctgcgatggcatcctcaagcttctggactcccacctcgtcccctctgccactgcagcagagtccaaggtgttctatctgaaaatgaagggtgattaccacaggtaccttgcggagttcaaggccggtgctgagaggaaagaagcagctgagaacactcttgttgcgtacaagtcagcccaggacattgctcttgctgactt

SEQ ID NO: 2752 - DNA, 542 bp, Hordeum vulgare
tacatttataattaagctaagggaagaatcctagaacttaattattttgagagggaaagtagacaagaaaatctcagttgttgcctcataagaaaggcacaagctttgggggcgccttacgcgaagtatgatcaatcatcaacaagccatgaaaattgctaatacagcaatactaataatgtgctgcaatacaggaaatagtttgaaatctgctaatgaactaagaagcgacgatgtccacatgaccgtcctcatgactgtagtccactaggtacttcagctcgacacgcttcgcatagcaccatcctaccacatcttatgattcacatagtgcaaccgaccctagtacatcttatgatccgaatgatacaggtagctgcgtaaatggactcagaaataaacttgggcacactcttgagggccaatcagtgcccctctccctcaggctttgaggcagcttccttgatctcatcaccaccctcctctgcgttatcggaggtccagagggtcaagttgtcacgaagaagttgcatgatcaaggt

SEQ ID NO: 2753 - DNA, 510 bp, Hordeum vulgare
cctctgaagctgggcgagcatcctttatcgcagccttcacggtgatagttgtgcctctgattgatggcttttttggagcctccatccccatgctgacttggttcggggccattgtatcgattataggggttggcctgctagaatgtggtggctctcctccttgtgttggtgacgtgctttatttcttgagtgcggtattttttgggatccatatgcttagaacggagcaaatatcaagaagtacagacaagaagaagttcatggctcttcttagctttgaggtccttgttgtggctttcacctcgatactctggtttttgctcaaagatgcctttgttgaggtccaagattccggctttgaagcatggacttttggtacgctatgggattcggcggcttcttttccttggataccagcactgtacactggagtcttttcaacggggttatgcatgtgggcagagatggtagcgatggcccatgtttcagcaactgaaactgcaattgttt

SEQ ID NO: 2754 - DNA, 546 bp, Hordeum vulgare
tccattttgcttgttaattatttatttaatggaatctacacaatgttcccatttgcagttatcactttacaccggcgtgctgtgacagggtaaacctccaacccggagttccagccagtaatgccacattttctagtatgtactaggcattggattatctctagtcactagttagtccagttgatgcccctaaatggcaactaacctccgaaatcatgggaataacaagcattctttgtcacttgcatctacttgatgaaccaaagcatgtgccacctgatgtgccagatataaggccccttgttttggtttacatacagtttcgatcttgaccctgtctttggaggatgcattactgccttagtcttgggctacaatgttttatccttcctctctaattggctccctatgttcttcctggaatcaacggggatagcagacagggataagcgctcctgccttttcagtggggattcaaatgtattcctgctgtgcgattcaactttctgggacttttcaggagctgtcccgaatagctgcacagta

SEQ ID NO: 2755 - DNA, 406 bp, Hordeum vulgare
ttcatcgtgcctctccgtgcttactactacagcaaagatgagaagctgcttgtgtacgacttcatgcccatggggagcctttctgcagtcttgcacggcaacagaggttctggccgcaccccacttgactggccgataagatcaagcattgcccttgctgcagcccgtgggatcgagtacatccactctacaagctcatcgacttcgcacggcaatatcaagtcatccaatatcctcctgtcgaaggcgtatcaagcacgtgtttcagacaatggccttgctacccttgttggttcatcatcatctggaccttctcgcgccactgggtaccgtgctccagaggttaccgatccccggagggtatcccagaaggctgatgtgttcagctttggtgttcatcctggct

SEQ ID NO: 2756 - DNA, 552 bp, Hordeum vulgare
ctcgaatccgatatttcgctaaaaggaagagatgaaaaaacagccgactccgtcgtcgaagaagatagacagcattcgtcaagtctatgaacggaatgaatgtgggccacggcgacgagcagcctgctcctctctcaggccattagcgatcatggcgacgaggggccctcgaccatctcatcgccctgattcaggacactctgttgttgatcagtttcttcggcgccttcacctgacatcttgatctcctcgatccgcacgacgacatgagacatggtcggacgggcgtctgggacctgggcgacgcagtctatagcgagctgtagaagctgaaccatctgttcttcggagctctggttcctcaggagctccatgtcaaacacctccgaagtccactccgagcgtacaacggactgcacccacctgggcaggtcgacgccctcgtcgttaagagcagactgactgggggccttgccggtgagcagctcgagcaggagaacaccaaagctgaacacatcagccttctgggataccctccggggatcggtaacc

SEQ ID NO: 2757 - DNA, 518 bp, Hordeum vulgare
cctcgtgccgaattcggcacgaggcgccgctcgaccgcggcgccgaggccacgcccgaggacaaggaccgcgtcgaccagatcgcgcagcggctggaggaggtgagcccgaccaaggagccgctcaagtccgagctcctcaacggcaagtgggagctcctctacaccacctccacttccattctccagccacagaggccaaagtttctgaggccatacgggacgatttaccaggcgatcaacaccgacacgctacgagctcaaaacatggagacactgccttacttcaatcaggtcactgccaacttggtgcctctcaactctagaaaagtggcagttaggtttgattacttcaaaatatttagcctgatccaaatcaaagcacctggaagtggcaaaggtgaactagagatcacatatcttgatgaagagctcagggtttcaagaggagacaaggggaacttgttcgtgctgaagatggtcgacccattataccgagttccgttgtaataaccgtag

SEQ ID NO: 2758 - DNA, 542 bp, Hordeum vulgare
ggataggactaatggcaatgctatacattttgctgtcccatctgagttctgtcagttcaaatgtgccatgtgctgtatagactaattaaactcaaaccttaatatttacacgtcctgtatttggcccgggccgatttttttttgaacattttggattgttggcacctgattctcgtagcggtggacactagcatttagctacggttattacaacggaactcggtataatgggtcgaccatcttcagcacgaacaagttccccttgtctcctcttgaaaccctgagctcttcatcaagatatgtgatctctagttcacctttgccacttccaggtgctttgatttggatcaggctaaatattttgaagtaatcaaacctaactgccacttttctagagttgagaggcaccaagttggcagtgacctgattgaagtaaggcagtgtctccatgttttgagctcgtagcgtgtcggtgttgatcgcctggtaaatcgtcccgtatggcctcagaaactttggcctctgtggctggagaatggaag

SEQ ID NO: 2759 - DNA, 518 bp, Hordeum vulgare
ggttcgtttccccccggagccgaaaccctagccgccgccgccgccgatgggaggcaagtgcccgcaccgcaaggtcaagaagcgccgtctcaactgcaagacggtgcgccgcggcaagttcctcgtcaaagccgacgacgccgtctacgacgagctcgtcaagctggccgaccagggcaaggactgcgagggaaagccgctgcccgtcgacgaggacctccctggcatgggccagttctactgcctccactgcgatcggtactttgcggacgaggccgtgaaggaggatcactaccgctcaaagcgccacaagaagagggtcaagcagttgtctggaccagccccacacacacaaatagatgccgatcttgccggtggaatgggaatgccggacaatggcttgaagctcatgtcgtcgtgatcgttgtttgctatttttattgctgctgctatacatctgtaccaactttgcttgatttgtaacttgcaaatagttgctttggtccaagaggttagga

SEQ ID NO: 2760 - DNA, 901 bp, Hordeum vulgare
  UNSURE (730),(791)..(901): n stands for any base
cggtaaaggggcctgcagatagcttgtattcaagctgatgagaataccactatggagttccaattcacagcacataatctgctgccaaatcatttgatgttttatcccagacgcagataggtaactcgttctcaatttagataaaagctggcaagcatgaggcaggcagatacagcaatgtataatcctaacctcttggaccaaagcaactatttgcaagttacaaatcaagcaaagttggtacagatgtatagcagcagcaataaaaatagcaaacaacgatcacgacgacatgagcttcaagccattgtccggcattcccattccaccggcaagatcggcatctatttgtgtgtgtggggctggtccagacaactgcttgaccctcttcttgtggcgctttgagcggtagtgatcctccttcacggcctcgtccgcaaagtaccgatcgcagtggaggcagtagaactggcccatgccagggaggtcctcgtcgacgggcagcggctttccctcgcagtccttgccctggtcggccagcttgacgagctcgtcgtagacggcgtcgtcggctttgacgaggaacttgccgcggcgcaccgtcttgcagttgagacggcgcttcttgaccttgcggtgcgggcacttgcctcccatcggcggcggcggcggctagggtttcggctccggggggaaacgaacccctcgtgccgaattcctgcagcccggnggatccactagttctagagcggccgccaccgcggtggagctcagcttttgtcctagggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2761 - DNA, 517 bp, Hordeum vulgare
tgggcacggtgcgcgccgtgcggccgaggatcgtcaccgtggtcgagcaggaggcgaaccacaactccggctcattcctggaccgcttcaccgagtccctgcactactactccaccatgttcgattctctcgagggcggcagctccggcggcccgtccgaggtctcatcggggggtgccgctcctgccgccgccgccggcacggaccaggtcatgtccgaggtgtacctcggccggcagatctgcaacgtggtggcctgcgagggcacggagcgcacagagcggcacgagacactggggcagtggcggaaccggctgggcaacgccgggttcgagaccgtgcacctgggctccaatgcctacaagcaggcgagcacgctgctggccctcttcgccggcggcgacgggtacaaggtggaagagaaggaagggtgcctgactctcgggtggcacacgcgcccgctgatcgccacttccgcatggcgcctcgccgcgccgtgatcgcgagttttgaacgc

SEQ ID NO: 2762 - DNA, 550 bp, Hordeum vulgare
gtccggcccgtgcttatttaatatgagcgattggaggaattacacatagcaatagtaatagacatttaaacataataataatagtaatagggcttaataaggagttttacgggtgatggtgaactgggaacgaaggagggattacattacatgccggcggtctggtcggagttggtcgtgtccatgtcttcacgccggacgcagaaccaaaccgtagagtggtaacccgatcgatcctagccggtcgctgcaattcagcgtatcactgacatttagcttcttcttcatcttcttcttcttcaagtgcgtgtgcgtgcgccggagagccggggcgggcgggcggccggggttgtgtcgtagcgctccatgctctcacgatgtctacttacagcgttcaaaactcgcgatcacggcgcggcgaggcgccatgcggaagtggcgatcagcgggcgcgtgtgccacccgagagtcaggcacccttccttctcttccaccttgtacccgtcgccgccggcgaagagggccagcagcgtgctcgcctgcttgtagg

SEQ ID NO: 2763 - DNA, 495 bp, Hordeum vulgare
cggcggcctcgacgggcccggcgccatggagtacctcacgggcgtgctcgcctccaaggtctacgacgtggccgtcgagactccgctcgagcgcgccgccaagctctccgaccgcctcggggtcagcctccacatcaagcgcgaggacctgcagccggtattttcattcaagttgagaggtgcatataatatgatggcaaagctctcccaagagcagttgaacaatggtgttatctgctcctctgctggaaaccatgctcaaggagttgctctttctgcccggaaactgggctgtgatgccgttattgtcatgcctgtgacaacaccagaaatcaagtggcgatcagtggagagattgggtgcgacagtcgttctgatgggagactcatatgacgaagctcaatcatatgcaaaattacggtgtgaacaggaaggccgaacattcatacctccttttgaccatcctgacatcattgctggacaaggaactgttgg

SEQ ID NO: 2764 - DNA, 499 bp, Hordeum vulgare
caagcttacaaaacgagagatttggccccgcaagcgcagagcaaatacaccacacattactacaacaaataacttgtcgacaaatggcacactaacaattctacgcagataggtatgacaagggttttattccaacatgagagagcaagccacgctaacaatcctacctagcgttgggccttccttggtaagccacactaaccattggttggattggtgagagtcagccgcaccagagatcagaccttattggggctgcgcaaaaggagatgatagatctcgttgttcatctcagacatgtattcatacccaagattgtcggcacgactcctgaattcatcaacttcctccggcggcacttgtatgccaactaacacgtttgctccggtttcgccctgcgcacggtaatggaaaaggctgatattccatcgggggctcaatgtatccaaaaaattcataagagcacctggcctttctgggaaaataaaccggtaaacaa

SEQ ID NO: 2765 - DNA, 532 bp, Hordeum vulgare
tcggcacgaggcgcctacgtcggtgacgaggcgcagtccaagagggtatcttgactctcaagtaccccattgagcacggtatcgtcagcaactgggacgatatggagaagatctggcatcacaccttctacaacgagctccgtgtcgccccagaggagcaccccgtccttctcactgaggcgccgctcaaccccaaggccaatcgtgagaagatgacccagatcatgttcgagaccttcaacactcctgctatgtatgtcgccatccaggccgtcctctcgctgtatgccagtggtcgtaccacaggtattgtgctggactcgggagatggtgtcagccacactgtccccatctacgaaggatacgctcttccccacgctatcctccgtcttgacctggctgggcgtgatctcaccgattacctcatgaagatcctcactgagcgtggttactcattcaccaccactgctgagcgggaaattgtgagggatgtgaaggagaagctgtcctacattgcactggactacgacca

SEQ ID NO: 2766 - DNA, 550 bp, Hordeum vulgare
atgacaaatgaaataaaaacaccagccgatttctctagtgcctaccaggcatctgattaaatttgattgaataaaccgaactcatgtgtccaaaatcacgagggacaagcacaagtagcaatagatattacagtctttgaataggagaaaacggtaaccggtaggccagccgaaaactttgtccacgctaacgaagaaacagcaacaaaagagggaggcgaagcggcaggagggtcgcgataaaggctcctcctggctttcattcttgggtccgaagaattagaagcatttcctgtgcacgatggatgggccagactcgtcgtactcagcctttgcaatccacatctgctggaaggtgctgagagatgccaagatggatcctccgatccagacactgtacttcctttcaggaggagcaacaaccttaatcttcatgctgctaggagccaaggcagtgatctccttgctcatcctatcagcgattccagtgaacatagtggtaccaccactaagaacaatgttgccgtacagatccttcctaatatccacg

SEQ ID NO: 2767 - DNA, 545 bp, Hordeum vulgare
  UNSURE (16): n stands for any base
gtcccccggctgcagnaattcgcacgagggagcatttgtaggcctttgtgttcttatcaacagcgcgttagccggtgaagaacagaaaggctccatttggcttcttcgaccgaagcgggaagtacactgagtgccttctatcagtgaacagcagggcaaatgaggatggtctcatcactggagtattctgttttattcatattcctagtcatgagctgcaacaagcactgcaggtgcagcaggcctcggagcaggcgtcactaagaaggctgaaagctttctcctacatgagacatgcaatcaacaatcctctctcaggcatgctttactctagaaaagcactaaagaacacagatttgaatgaagaacagatgaggcagatccatgtctcagataattgtcaccaccagctaaacaagatacttgccgacttggatcaagataacatcatggagaattctagttgcttggatttggagatggctgaatttgtgttgcaagatgtggtggtggctgctgtaagccaagtactgatagcctgccag

SEQ ID NO: 2768 - DNA, 527 bp, Hordeum vulgare
ttacttcttatgacaacagtttgcccaagtacatatcacagccattaaacacttacgacgaagcatcaaacttgaaccttacacatacatattacatagtaggacggacgagaagaacacaacaacacatcacaagtacgtaaccaaaccgtgccacacaaccttcctttaccctagactgataactgatcctacaggccaacctttgcttcttcctttctgcattcacttaacactctaccacagcctgctgcaaccgcgtcgcatcttccccgcaagtcatcaccgtcgttcgctcatggttctttcgaaatgaagcatctgatgaccatgtgttgcacttgcttcttcatcactgcctcattgccgttggagcacaagcaagttcggcggtgaggatgaagattgacataccggcttcccttaggtgacgaacatcgccgttcatgagcctcaacaggtttctagaaactaggaggcccaagccctcctctgactgctccgtgttctcctcctcaaacatttgc

SEQ ID NO: 2769 - DNA, 994 bp, Hordeum vulgare
  UNSURE (37),(748),(829),(903),(908),(946): n stands for any base
tttgctacctgaaccttggacccccgggtctgcaggnaattcagtacgagggccgttgcatccagtgtacaaggtgtgtcaggtttgcatctgaggttgctggtgttcaagacctgggcatgttaggccgtggcagtggtgaagaaatcggaacatatgtggggaaactcatgacaagtgaactatctggaaatgttattgatatctgccccgttggagctcttacatccaagccgtttgcatttaaagctaggaactgggagatgaagggcactgagactattgatgttactgatgcagtagggtccaacatccgtgttgacagcagaggtcctgaagttatgcgcattgttcctcgcctcaatgaggatatcaacgaagaatggatatctgataaaacacggttttgttatgatggtctgaagaggcaaagactaaacgaccctatgattcgtggtcctgatggcaggttcaaggcagtgacatggcgtgatgctattgcggttgttgctgaggttttgaatcaagtcaaaccagaagaaattactggagtcgctggcaaactttctgatgcagaatccatgatggcgctgaaagattttgttaataaaatgggttccgataaggtgctctgtgagggaaatggtccgaatccaccagcagatattcgatcaaactacctaatgaatactagcattgctggtcttgagaaagccgatgtcttccttttggttggtacgcagcctanggtggaagctgctatggtgaatgcaaggattcagaagactgttagagcaacacaagcaaagggtgggctacattggtcctncggcagacttcaactatgacactcagcatctttggcacagggccagagacccttgttgagatagctgaaggccngcatnctttctgctccatactaaaagtctgcaagaacccagtnatcatcgcttggagctgggttattttgaacggggagaaccaggtgctc

SEQ ID NO: 2770 - DNA, 553 bp, Hordeum vulgare
tgtgccattaacacacctgtgaatgataaaatggggtataccttaatttgcacatacagctacattgcatttgcctgcctcctggaatcggggaaacgagcaggcgaaaacccgaaatacaacaaaattatttgcttgcagctgccgtctaattcgaaaggacaacaagcttattaagtatgctccgcttctcacacgttacagaaaaatgcactgctttcaagtttcgctgctcctcagatctagctagggtggagacagtccaaatttatactcccagccaaccaagcaacaacaactggtgagcgaaatggaaaagggcaactaaaatcttgtctgccggttatcacgtagagtagggcctcacttcttcaacaaggttgcactgcactgagccattatttttgaagcccgtgtgattgcatcggtcatgtagaagttctccacggcagctttgaatggagccgggctcacttgctgctttaccggaggcttcacctcagcagaaatcacagatgtctccctctcgtcgacgcgcacaagatttggggcc

SEQ ID NO: 2771 - DNA, 520 bp, Hordeum vulgare
ggctccagtcctccagcgaatccaccccaccgtcggcatccatggcgcccaaggccgagaagaagccggcggcgaagaagccggtggaggaggagcccgcggcggagaaggccgagaagacgaccgccgggaagaagcccaaggccgagaagcggctgccggcgggcaagtcggcggccaaggagggcggcaaggccaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctcgcccgctacaacaagaagcccaccatcacgtcccgggagatccagacctccgtccgcctcgtcctccccggcgagcttgccaagcacgccgtctccgagggcaccaaggccgtcaccaagttcacctcttcctaggctgttcctgctcctgtgttccgtag

SEQ ID NO: 2772 - DNA, 541 bp, Hordeum vulgare
  UNSURE (538): n stands for any base
ggtgtcatgtgacagcaaaattaacaacgaaatacaacacgcacaaaagaaaatggaaaagcagagactctgaccgctaataagagcacatgatgctcaggggggaatgaagagaattagcactttgattcaaagtccagaattcaagaccagaacaaagcaacatgatccacgaactgaacatgaggcaagcaccgttactatttctcgagatccagaaacatggcgatgcgattcttgcacgatagcacggccacaaacacacacagacggggcacctaagactacggaacacaggagcaggaacagcctaggaagaggtgaacttggtgacggccttggtgccctcggagacggcgtgcttggcaagctcgccggggaggacgaggcggacggaggtctggatctcccgggacgtgatggtgggcttcttgttgtagcgggcgagcttggcggcctcgccggcgagcttctcgaagatgtcgttgatgaaggagttcatgatggacatggccttggaggagatgccgatgtcggngtg

SEQ ID NO: 2773 - DNA, 518 bp, Hordeum vulgare
tctcgacgctatcctcaggcctcggccggcagcagctcacttccagaaggctacgcggcgtggtcagggcgtcctcctcgtccccgtcggagtctctgccatcttcttcgccgatcgcgccgctgcaaatggagtcgccgatagggcagttcctctcccagattctggtcacgcacccgcacctgctccccgccgccgccgagcagcagctcgagcagctccagaccgtccaagattccgcagaaaagaaggacgcgcaggcaccgccggctgccggcgacatcgtgctgtacaggtaaatgatgtttggaatggtgacttcgtccctcttgttatttccgatacatccggctgtaagaaggtagaattttggtaaataatcttaagaagggggcaggccaattgtagaaccatcatcaagctagcttgaccagctggcatgcttgcctccaagcacacaaaaatctttttatgggccgttgccgatatgggtaaaaaatacacaagtttacataaca

SEQ ID NO: 2774 - DNA, 534 bp, Hordeum vulgare
atagattcagctggactcctaaattaattttgtgaggagaacaaagtcatacaaggcagcaactaaacacccctgccggagcaaatgctaacaaagcttagtatctagagatatatcatgctaatggcactccctttacaatgaccagatgccaggatcatactctccagggcatgcagcacggggtaattgtacaatagtcttcagtgaagcccatgaacttcagaccaaatatcatacatgccatgaatctaccctatctggatccagttagttggtgacaaaatggtacctggagtccacatagctctcgacatcccagaggaaggatccgaatgtgacagcctctaagatcagccttctcaacccggagaagcttatcctgacatactcatccttggaagaatccactgttccttccggggtgatcacaatctctggtttcccgaatagcgcctctgtgtgcttctcgatgatgccaaacgccaccttcgaccgaattgtcgcgtaagtttgtaacgtgtctgaatcgaa

SEQ ID NO: 2775 - DNA, 338 bp, Hordeum vulgare
gtcccccgggactgcaggggggctgggcaatgaactggcgcagcggctgggcgacggcctcaacttccaggacatcaccctctgcattcgggcaggcaaccttgcgcagcccaccattctgctcaccgacctgccccatagagacgaccccgttgacatcgtggtgttcagagttggcacaccagggcatgaccgactgctgtttccagatcttgatgctgaatagaagagacggataggatcagacaagaatgaattcttcccctggacagtactgtcaacgcctccacaattttacagcagagtgatggcctgacaaggattagcagtttaccttc

SEQ ID NO: 2776 - DNA, 548 bp, Hordeum vulgare
cggaaaatctactataggcacttcaacatattttgttcctacaagccagcaccactgtttaatttctctgaagtttcagaaacaccaaacaaatagcgtcgtctcctggtgttccaaatatgaagtggcaaagaagagcgcatcacttgcactttcctggaactgggtgactattctagaggaaaccctacacactgtattgtatgaactgctataagaaggtaaactgctaatccttgtcaggccatcactctgctgtaaaattgtggaggcgttgacagtactgtccaggggaagaattcattcttgtctgatcctatccgtctcttctattcagcatcaagatctggaaacagcagtcggtcatgccctggtgtgccaactctgaacaccacgatgtcaacggggtcgtctctatggggcaggtcggtgagcagaatggtgggctgcgcaaggttgcctgcccgaatgcagagggtgatgtcctggaagttgaggccgtcgcccagccgctgcgccagttcattgcccagccccctgcagcccgg

SEQ ID NO: 2777 - DNA, 448 bp, Hordeum vulgare
attgaggagacatttgacgactacttgcatgagagtgcagatattgttttgcgaaggcccggcatcaaaacaaagctaaataatctactcattcagctgagaaaaaattgtggccaccctgatcttttccattctgcttttgactcaaacagtctctatccacctgttgataagcttatggaacagtgtggcaaatttcagctgttggacaggttgctggatgctttaatcaaacgaaatcacaaggtcctaatattttcgcaatggacaaagatcttggacatccttgactattatttgtctgagaaaggcctgaaggtttgccggattgatggtagtgttaagttggaagacaggaggaaccagatagcagcgtttaatgacttaaacagtggtatgaatgtattcattctcagcacacgtgctggcgggcttggtatcaacctta

SEQ ID NO: 2778 - DNA, 543 bp, Hordeum vulgare
  UNSURE (47): n stands for any base
taacagtctcatttcagactccttcagcagactactactaccataancagtcttaacatagctactagggtggttgccttggatgaaggcacgagctcgagttacatcgcaacacagctcgccaaaggatcgatcagctcctaatctagggggtgcggtatacactgcaacgccctgtcgtccataattacttaggggggataggcctttgacatgtccacatcatgtcacaaaaacacaggcggcgaacacaaaaacactggagggtgtcggtgtggtcgtcaggcgccaggcctgccgcccgcacgaggttggctcagctggtgagcgtcgagagcatgccgccgccagcagccaacacgacctcccagccaggccctttcagggggaagtgcgggacggcatcagcagccgcacgcgcaccggtgaggtccctccggtccatcaccttcaggaggtcctcgtcgctgatgtctgtctggatcatcctgtcttcctcgtcctgctcgtccctcagaagcgccagcagctctccctcatcta

SEQ ID NO: 2779 - DNA, 482 bp, Hordeum vulgare
tcttcgtactcgcctctctctcgcgtctccgagctttggcctccgtcctccctccctccctgccctcccgcccgcttccggtttctccaccgccgtagcgcccgccgctccgatccgccggcgacatgagggagtgcatctcgatccacatcggccaggccggcatccaggtcgggaacgcctgctgggagctctactgcctcgagcacggcattcagcctgatggacagatgcccggggacaagaccgttgggggaggtgatgatgctttcaacaccttcttcagtgagactggtgctgggaagcatgtaccccgtgctgtgtttgttgaccttgagcccactgtgattgatgaggtgaggactggcacttaccgccagctcttccaccctgagcagcttatcagtggcaaggaggatgcagccaacaactttgcccgtggtcactacaccattggcaaggagattgttgacctatgcctt

SEQ ID NO: 2780 - DNA, 540 bp, Hordeum vulgare
  UNSURE (7),(29),(32): n stands for any base
aacatgncattattaagccaaggatgcgnaancaggattcaaacattaccacaggctcttacaacacggttgtaaaccaaccaccacaaagcaaagcaaacattcaaacagataaacccacttgaagccagtggggcaccaatcgacgaactggatggtgcgcttggtcttgatggtggccacagcggcattgacgtccttgggcacaacatcaccacggtacatgagacagcaggccatgtacttgccgtggcgggggtcacacttggccatcatggaggaaggctcgaaggcgctgttggtgatctcggcaacagagagctgctcatggtaagccttctcagctgagatcactggggcgtaggaagaaagcatgaagtggatcctcgggtagggcaccaggttggtctggaactcattcacatcgacgttcagagcaccatcaaacctcagggaagcagtcagggatgagatgacctgagaaacgagcctgttgaggttggtgtatgttgggcgctcaatgtcaagggagcggcggca

SEQ ID NO: 2781 - DNA, 130 bp, Hordeum vulgare
ctggtactggggaagcggcgggagaagctcagcgagcggttcatcgcgctgtccaagatcgtcccggggctcaagaagatggacaaggcgtcggtgctgggcgacgcgatcaagtacgtcaagacgctgc

SEQ ID NO: 2782 - DNA, 393 bp, Hordeum vulgare
tttttttttttttttttgcaaccaagagagagatccatcaagttaacaaccgagcatattcatttattctttatacttgtatgcaagcaaacaagagggtacagagctacaatcttgatcctgttacaacaaaacccataagaaaaactacaagcaaaggggttcatccaagctgcttgggccaaccagcttgcactacccctgaaaaacaggcacaccctactactgcacttctgaatcaaggcttgcaaaagtccccttcgatgccgaaaaaaagaagacgccatttttgtccacagatatttgaagccttttgggaaacagcatggtgggatttgagaggacggcaaaggtaggtgtttgggtttgaaaaaactcgatccggcctctcgt

SEQ ID NO: 2783 - DNA, 394 bp, Hordeum vulgare
tggcattgagtgcctcaaaaagggagatcacagagttcttctctttctctggtgatatagaatatgttgaaatgcaaagcgaaactgattggtcacaacttgcgtacgtcacgtttaaggactcacaaggagcagacactgctgtgcttctctcaggggcaacgattgttgatcttcatgtcatcataactccagttgagaactatcagttgcctcctgaagcccgcaaacaattactgggagaaaattctccctctgctgaatctgcagtcaggaaggcggaggatgttgtgagcagcatgatggccaagggttttgtgctcagcaaggacgcactcaacatggcaaggtctttcgacgagcgtcacaacatcatgtccaccgccaccgccac

SEQ ID NO: 2784 - DNA, 344 bp, Hordeum vulgare
ttttttttttttttttggcgaggggcaaagtaacttcaatttcccacacttgatctcagcgtcaggtagtatattacatccaacgagcagaattgcattctatggtagcagagaaaaacaataatgagaaaagaaaaagaaaaaacctttctaacagtataacaaacctgatagggacacaagcgcagcaatctaaaatttacaatacactacaggcgctgatagacaggcagcaccctgtttctgcttcagcgccgcagcggcggaaaaaaaggatctctctatatatatgtcggacattgacaggaagtaacaatcaacaaatgccacacaccggtcgaagc

SEQ ID NO: 2785 - DNA, 551 bp, Hordeum vulgare
  UNSURE (20): n stands for any base
gtctccccgggcctgcaggnaattcggcacgaggccgcagttctgcaaagtgtgagagaaatgctattaatgtcagtaagtctgccttgttgcatcctctgccatccagctttcaaggtctatctacactgctggttgataaaagaccagtaagagcaactgtaactgagtatcatttgcaaaggctgggcattgcctcgaaatctgtacgtaccattgaacaggcacttagtgttttgctcgggagaaatggcacttcgctaaccagcatgcccaggaaacaactttccatgttattagttgagagtgactcatgggacttaaagagggacatccccttacgtactagattttcagagatgaaacagaatgggtgtgaatcggtgttccctcaagttatcctccttgcattggctgattcagacaaaatgaaagcggaatatgccatcgattctgtcatcacaaagcctctgaaagcaagcacacttgcagcttgtctatttcaatcacttggtatcagtatcacacaggcaaacaatgagaagaaacat

SEQ ID NO: 2786 - DNA, 552 bp, Hordeum vulgare
  UNSURE (128): n stands for any base
tcaaaagctatgctctcctagatcacgcgtacagtacagcacacaatgctgctccccggcagcgcccaacgcagtgctcgccctttggcatatgtttctcctagtagattatggtaataaaacagggncctgccaatacaatacatgtacggcctccgttacctctccggctgcccgccgcctcacccacggagcttgatcgtcgccgccgactccagagatgccgcgaccgcaggcagcaccggaatcatagtgcatcctcagttaaaggatcgcacgaaacatggctgcctccgttcagtcagagtttctcccagtcaatgtacacaccgggatgcacgcgctggttgttgtcagctggatgcgctaggtcccaagaacttctgcactgccttgaacaactgcttctcctcgaagggtttcgagacgtagccgtccattccattctttgtgcattcctcatgggtggcctggatgacatcggcagtcattgccaggaccggtagatgccatccggtcttctttgctgtactacctggttctgaattatca

SEQ ID NO: 2787 - DNA, 518 bp, Hordeum vulgare
gccgtgcgcgtgcgcgtgcgcgagccccaacccgaatccactcgccccctcaccgccaccgtcgcgcctcatttctttatcaatcaccagcccccctccccagttcttccaaacaaacaatccgcgtttagatccgtccgcccgctcgggggccagtggggggagacaggaggatttaggtgagcaagcatcttgattttgaccggtcccagctcgacccgcccgcgcgtctctccttaaatctcctctcctgcggtggagggaggaggggccgtggccggaccaagaacggcttcttgattcctgctatcccaaggaaggtttcaggggttgagataacaggttgctctgttgcctcgatagactaattaataatgctgaggcagagctctagtaggaaccacagatcgaaaggtctgaagctaaagaaagctcttcagataagtcttttggttcttgtatctgtttggttgctctaccaagtaaagcattcgtacgagaagaaggcagcatataat

SEQ ID NO: 2788 - DNA, 551 bp, Hordeum vulgare
tattaatagttgggcagttggcattccagcagcaaagcttcagagctaccgaatggggggtataatgtctcttccaacacaagcttcttgctcgtcacatgcccccatacatgccgtgatgtactctaggcaaacacaaagcaggtccctacgtaccaaacttacacgaaaagcggggcactcgcggcactcatcctggatggaagtcctacaaacttacaggtcgtgccggaagcggctaacaagagaggcaggggatcttcattccaggagaacttcaccttcgccgatcgctttgttcatgattttcgtcgagacgtctgcgtcttccttctgggtgtcgccggcttcttctttattgctcaccagagtggaggatgtgtcgctgttgttaccaccgctgtctccgtctctggatgcggccttttgggcatcggctgagcccgaaaccaccgtggtcccatttggtggagaattcagctcggcggaagtcaggtcagtgaatggttttgtttggttgtccaatgctgctgttgaatttactggctgct

SEQ ID NO: 2789 - DNA, 550 bp, Hordeum vulgare
  UNSURE (20): n stands for any base
gtccccccgggcctgcaggnaattcggcacgaggacttgatcttatctcctattggctggattctggggccagtgcttggtccggaagatcgtgcttgtgctcaagagagcgtcgctgatcgtcttcatcctctcctccgtcatcttcgccagtgctcttaccatgggtgttgtcgggacggagaagagcatctcgatgatcaacaagcacgaatacatggggttcctcagcttctgcgggtaaaccaaccaagcagacgaccacaacatcgggggagagaacccaggccaatacctaattgacctcacctctccccactccgttcaagttcacttcagttcaaggatacaaaaataaagaagccgcggcgtgtgcccctcgccttgttagctcctcgctaacctgcaagcacacgcccggcgaaggaaccgtagcagcagtagtagtggtagcatcattcatgcgcgcgttagctcctggctggctaacccgcaattggtcttgtggcgtctgtgtcgtgtcgtgtgtgtgccggatgttttttgtcat

SEQ ID NO: 2790 - DNA, 551 bp, Hordeum vulgare
tgatgaacagcaagctatactgacagtgcagcaagcagccaatttggctggcaggctgatatatttacagcacccaatacaaatccacgtttgcacggtaagctagctagcaaatggagctagctaaccatcacgcgaatgaatcgacgtaaccccgtgcgacgaattcttccctgcaggccagccaggaccgagctaacccgcccatgacaaaaaacatccggcacacacacgacacgacacagacgccacaagaccaattgcgggttagccagccaggagctaacgcgcgcatgaatgatgctaccactactactgctgctacggttccttcgccgggcgtgtgcttgcaggttagcgaggagctaacaaggcgaggggcacacgccgcggcttctttatttttgtatccttgaactgaagtgaacttgaacggagtggggagaggtgaggtcaattaggtattggcctgggttctctcccccgatgttgtggtcgtctgcttggttggtttacccgcagaagctgaggaaccccatgtattcgtgctt

SEQ ID NO: 2791 - DNA, 543 bp, Hordeum vulgare
  UNSURE (3),(11): n stands for any base
ggnctgcaggnaattcggcacgaggcgatgggtcaaggcaaggttgctggtttggagcccatgaactttataacttttgcaacaccacaccttggcacaagatcacataaacagatgccccttctccgtggttcctatagattggaaaagatggcttttggtatgtcttggcttgctgggagaagtggaaaacatctttttataaaggatgttgaagatgagaagccaccattacttcttcagatggttactgattacggagatctccatttcatatcagctcttcgttctttcaagcgctgtgttgcttactcaaatgtttgtggagacttcgttgttggctggaagacatcttcaatacgccgtcaacatgaacttcccaagaaagaagattttgtggatgatgttagatatccacatgttgtatatgtggaaaaaccaaaagctcgggatgttgatttttcggatgaaatgatttatcaggcaaaaacaacaagtgaaatggaagaggtaatgctcaaaagcctgaatagaattccttgg

SEQ ID NO: 2792 - DNA, 541 bp, Hordeum vulgare
  UNSURE (9): n stands for any base
cacagcggnatcttattttattacactgatgaacaacagcctgtggctgtggtccattaaacatttacatgcatgcacactgaagcatcgatgcaagagagaaaaactgaaaaggaacctacgagccccagacagactttacaggaaacatacacaggcccagcactccttttaccatgggtggatctacctgttccagtgtagtatctccaataactttttgcactatccttttcctatccaattgaaattggtatccaaatacgaagaatagaagagaaagaaactgggaccgccacgatatcgctccatgttagtaaagaaaatggtcgatcatgtggaagatcacatcggccccatcagagttgaagaaataagtctttacctgaatggtgctatgggcaaaaatcctttgtctgctcctcttgaagctaacatctaccctttcccaaggaattctattcaggcttttgagcattacctcttccatttcacttgttgtttttgcctgataaatcatttcatccgaaaaatcaacatc

SEQ ID NO: 2793 - DNA, 550 bp, Hordeum vulgare
gtcccccgggctgcaggcgctgctgaggcatttcggatgcttctgctgctgggagctggcctctgacctaaagaagtccatgccgaaattcgagtccgcgggagctaagttgatcgccatcggcgtcggcacctctgacaaggcacgcattctcgccgacgggctgccatttcccgtggatagcttgtacgccgaccccgagcgcaaggcttacgatgtcttgggcctgtaccacggattaggccgtacactcttcagtccagctagtgctaaaatatactcgaggctcgactccatcaaggaggcgaccaagaactacacactgaaaggcacaccggcagacctgacgggcgtcatgcagcagggtggaatgtttgtgttcaaaggaaaacaactggtgtacgcgtggagagatgaaggcaccggcgatcacgcacccttggatgatgtcctccgcatgtgtcgccaagttccgattgcttgacgttttatcaggcagatcgatctatttgacgtgccggactgacaggaaagccattcttgggagata

SEQ ID NO: 2794 - DNA, 543 bp, Hordeum vulgare
taactctgcgacagatgcccgagaatattttacaatagatatttgacttttttaacatttactaaaatatttctgacgagcggcagcaaatgctatccggagcagaacttgatatctcccaagaatggctttcctgtcagtccggcacgtcaaatagatcgatctgcctgataaaacgtcaagcaatcggaacttggcgacacatgcggaggacatcatccaagggtgcgtgatcgccggtgccttcatctctccacgcgtacaccagttgttttcctttgaacacaaacattccaccctgctgcatgacgcccgtcaggtctgccggtgtgcctttcagtgtgtagttcttggtcgcctccttgatggagtcgagcctcgagtatattttagcactagctggactgaagagtgtacggcctaatccgtggtacaggcccaagacatcgtaagccttgcgctcggggtcggcgtacaagctatccacgggaaatggcagcccgtcggcgagaatgcgtgccttgtcagaggtgccgacgccga

SEQ ID NO: 2795 - DNA, 180 bp, Hordeum vulgare
tcacaatcacaatcccttcgaggtgacgagctcgaggccggattacgggctggtctcatccgactcgctgatgacgagctcccctcacagctccttggagaacgtcaacctgctcacctcgcagcgagcgctctcgaacgagcagcagagctcgctctccctgcagcacttcgcggactg

SEQ ID NO: 2796 - DNA, 468 bp, Hordeum vulgare
tttttttttttttttttttttatcaaggcattgcaacattaattggacattatcagatgatatgcaacaacgtagtagtaccaccaaatccatccacagacacacaacacatacaacgtcaaatacccagcgaattctaaggttacatcgaaaaaggaatagaaaaccccaacatccagaagcagagaagacaacaacagattagtcccaaatgacaagccacaacgtaaaatgcttctggatacgatgttggatatgtaacaaggtccgtgaagaaggcttgcccaagttcgttcattgccggacttcgttgccggccggccagcctccttcttccagctcccatggtcagaactcagaagcagcagcagctcacatcagccggatgctggggtgattcacgacgatggagccgagatcatcccgcgggacaccgtcatacacgccgtggtattcctgcctggggct

SEQ ID NO: 2797 - DNA, 472 bp, Hordeum vulgare
caacacctccggcgcgtgctcctccgccccttgcccgcctccaccccgaccccgaccccgattcgccccctcgtcgcccacctcgccgccgagcttgctcctccgccagaaccgccgccgagagcagctaaggaaaacctagaataggtggtgttatctggcttcgaattgctgcctaaacatttcttggtcttcacacatcagaaacttaaatcatgagctcccatcgcgtgaagtggaatgaggacaatctgtatgaaattgaatcaaacaagccagtgaggcagaagataaccgagcccaagacaccgtatcaccctatgatggatgaagatgggtcactatcaccaacacgccctttcgacaagtgtctagatgagactgttagtgctgaagctatattcactgctttaaatggtgtggcctcttcaagtaaaaatgattcaaaggatgatgagtgggcatcctcaga

SEQ ID NO: 2798 - DNA, 552 bp, Hordeum vulgare
taggattgttactataactcagttccatattataagaagtgcctgagacaaattctagcctcttgactgaacgtgaagtagctagttcaactagaattctctaccattttaggaccacaacatctcgaaataaaaaagaggaacaggttctttgcgtacagaaaaccatccaatctggtatgaaaacaaggatcaaacaatacacacagagcaggcgcaactgcgtgctcccgcttagttgaacttccctaggcttagcgaccacaggattcactttgctgtggctcatacttgaggtgacgctgacgattcgctcttgtcgcctgttgcctgttctcctcccgcggttttgtcttggatgttgtttgcacctcgctcattcgcatgggcctcgtcttcaaccagggatccagtgcgcatcagttccttaaccttgcggtattcatcgtagtgattgcggcgatgctccttgaaactcactgatgatttgtcagcttctgagtcaccatcctgttccatggcatctgcatcatcatctgaggatgcccactc

SEQ ID NO: 2799 - DNA, 1139 bp, Hordeum vulgare
  UNSURE (1)..(6),(15)..(17),(19),(23)..(25),(27),(28),(30),(31),(34),(36),(39),(44),(45),(52),(62),(1029): n stands for any base
nnnnnnttgggaacnnncntgannncnnanntgntnggnaacannagacggntggtgaggtnttttccgaaaaaaacctctcgccggtgcgattttggcggaagcgaaccaaaaacaacaccctttgttggagatgccgtcggggacctttttgtcgtcgatggtgacgtggtcttgtgatttcgtcgttttctgttctttcggcggttttttcttccgtgcgtcccccccaccttctcggttttggtttttttttttctttcttcgcttgttgtgggggggggggtgttttcggcctgtcggtgcgtattgctattccggtcgttgtcttttctttgtttttttttttttttctctgcattctctctctgatcttcgctgttcgcttttttgttttgtttgttcggtctcgtttttccccgtttcttcattcctttttttccgtttttttttgtgccgttttctgcgcgtgcgtttttcttttgtttttctttttccctttttttttctccgccctcgtctttttttccttcctctctcgttggcttttcttttttgctatcatgcctacttttttttcttgtcttgtgtttcttttttccttttgtttttcttttgtaattttgtttatcttcttttttttcggtttttttttcgctgtccctttcacctttttcttcttgccttcgttttgttttgtttgtccttgtggctcctccttgtggtctattttcctttatttttctcgtcgcttcggattttgcccccccgctcccctacttttcttctttctcttttgttttttgtcccggtttccgttcgccgcgccgtcttttttgttctgtttctttgcttgtttccgtggttggtggtttttttgccgcgccgcgttgtttctctctgtttttttctttttgccgttgttcttttgtttttcttccggcttcccgtgttccggttcgcctgtacattgatttgctttgtctgttctgttcttatcacttgcccttgtgttcgtttttcgtgttnatccttcttcttttctttcccttgtttcgttctttattttttatccgtgttccctccttgtctgttcttttttctgcgccgcctctttttgtccctcttcagtctttttg

SEQ ID NO: 2800 - DNA, 540 bp, Hordeum vulgare
taacagcattaactggacaacatgaaccaatgagctatctcttcgtgaagaaacagaaaatgaattttctctacagaaaacaagttcgccaaactaaattccatttgtgttaaatgaataagagctgaactgggaaatgtgatggaacatcacgtcgagctcggacagtgtggtgaatgaacagattatgtatttgaatggaacagtagtatctttcctatttcctcctatgtttctcctggctccagttgcaagttggaactacgtcttctccttggctgctctgaatagtttgatgacattttcatacaccacaaacgtcacagaagccgctggaaggttcttcaacaggttggacgtgatgcctcggtaaaacccacggacaccttcgtaccttgcagtttccttcactacatgccaactgtctgagtactttgggataccatcactaccaggccgttgctgtaggcgggctcggataacctgataaggataagtaagaagaatggcagataattttgaaccagcgccaagtgccgc

SEQ ID NO: 2801 - DNA, 552 bp, Hordeum vulgare
  UNSURE (20): n stands for any base
gtctctccgggcctgcaggnaattcggcacgagggacaagcagaaggcagttcttctcgcagacatggcacatatcagtgggctagttgctgctggtgtcattccctctccttttgagtatgccgatgtggtgactaccactacccacaagtcactccgtggtccacgtggagccatgatctttttccggaagggggtgaaagaaataaacaaacaagggaaggaggtattgccagagatacaataaaatgaagatacaataaaatgatagtagcatagagtgttgaagatgtttgttctctactgagcttaacctgcagtactcatattacctgaagaatgcaaaggcctaacaatctattttgatataggttaagtatgattttgaggacaaaatcaatgctgctgtcttccctggtctgcaaggtggaccacataaccatactattactggcctggccgttgcgcttaagcaggcaactactcaggagtaccgagcttatcaagagcaagttatgagcaactctgctagatttgctgaggtattttgtg

SEQ ID NO: 2802 - DNA, 556 bp, Hordeum vulgare
ggtaatgcttatcccaagaggatggtggttcatatagcatatcagcgaaacatcttacagtatgtgcctgcaataagaaactattgacaaagttcccatattctgtaaaatgcttggattccttttacataagatggcgcttcatcatggatctattgtttacatggacttgtcctcagttgtgcttcctgtttgcttcctgcaagaaaaaggaaaacaaaagcaaaatatctgtgattgcccgaaaaacagcattcatcgtctatgtgcttatgcgaagaggaaagggtgatgggccaaaacaaaaaacaaaaaaactactgcaggtgtaagcttggcgcaagatctaaaacagcagacaacacaggactggagcaaacgagagagtcaaggggattccttctcctgataacaactgaattgatatattgttcttaaggattggaggagagataatttgtttctcggggcacaccttgctgttgaaacacagcagtgcttagttcttgtacttcatggtctctttctcgaatccgattgttgggaattgttttgc

SEQ ID NO: 2803 - DNA, 519 bp, Hordeum vulgare
ctctgatcagtcgctgttctacaattccaccagctactgggatgagtttgtgtggggtggcgcgtggatgtacttcgccacggggaacacatcatacctcacgatcgccaccgctccagggatggccaagcacgcgggggcgttctggattggtagtccaaactatggagtgttcacctgggatgacaagcttccaggatctcaggttcttctcagcaggttgcggctcttcctaagcccagggtatccttatgaagaaatattaaggacattccacaaccaaactgacaatgtcatgtgctcatatttaccagtattcaattcattcaacttcactaaaggaggactgatacaactcaaccatggagggcctcaaccacttcagtacgtcgtcaatgcagcattccttgcctctctgtatgctgattatctggacactgcagatacaccagggtggtattgtggacctaatttctataccacagatgtcctccgcaagtttgcaaagtcacagcttga

SEQ ID NO: 2804 - DNA, 553 bp, Hordeum vulgare
  UNSURE (21): n stands for any base
ggtacacatttctttactgtngacgaataagtcactcctataaaacaaaatgacttacaaaggtaccatttctacaaaaagaacttcacacgtgaacttgggatatgaagaacaacaaggacctcaaaatttagtttcacaaatcgcacacaacttccagtccatggttgacagatgatttataatgatccgtcataccgatacagaagtagaaactctgtaagcttatgttgtctgctttctgtttatggtctttgctgtatatcaaacaaccatctgttgctccctccatttgatgcttatgaaatgttcaggaatctgattcttcaaggtttccaagctgacggcggtggtgggggtgtcgggaacattgggggaactgctgagaagatggtgttcttatcaattgaatatctgccagtatcgatgtcagctaaagaaatcaatgctgcaaccaggccagcatttgctgcaagagtaggctctgtgtaattgtaatttgtgcggatatctttgaagccatcatgcttgtcaggcccagcaaccattgctc

SEQ ID NO: 2805 - DNA, 377 bp, Hordeum vulgare
caactggttaaagaaagcccctcaggcttagattgtcaactgtgccgcaaccaaaacaagctgaatgaagctcccgaatccaagaccaggccggcgcgtgaagaattgaagatactgaggataggacaattccagtgagagctttcaatttttcattttatgatgttcaaatgtaaacacatccactgtaggccattgtatgccaacttttgtgccgtggaaaaaataaatagagaaattgtttgtaatttatgacctttttaaccatggtacttgctgtttgcgatcttggaatattctcatctttggttggcttgtgtactcactgtagaagacatatgtcgtgttaatataattttatttgccaaaaaaaaaaa

SEQ ID NO: 2806 - DNA, 339 bp, Hordeum vulgare
  UNSURE (37): n stands for any base
tattgtcttctacagtgagtacacaagccaaccaagnatgagaatattccaagatcgcaaacagcagtaccatggttaaaaaggtcataaattacaaacaatttctctatttattttttccacggcacaaaagttggcatacaatggcctacagtggatgtgtttacatttgaacatcataaaatgaaaaattgaaagctctcactggaattgtcctatcctcagtatcttcaattcttcacgcgccggcctggtcttggattcgggagcttcattcagcttgttttggttgcggcacagttgacaatctaagcctgaggggctttctttgaacagttg

SEQ ID NO: 2807 - DNA, 517 bp, Hordeum vulgare
cccctacctcgccaattacactattgagcaatttaagcatatgctgggagtgaaaccaacacctccaggtttactggctggtgttcgaaccaaaactcatccaaggtcagagcagctcccaaaggagttcgacgccaggtcgaaatggtccggttgcagcacaattgggaaaatacttgatcaaggtcactgcggttcctgttgggcttttggagctgtggagtgtctgcaagatcgtttctgcatccatcacaacatgaacatttcactttctgccaatgacctagtggcttgctgtgggtttatgtgtggtgatggttgtgatggaggatatcctatcagcgcatggcaatacttcgtccagaatggtgttgttactgaggagtgcgatccatactttgatcaggttggctgcaagcatcctggatgcgaacctgcttatcctacacctgtgtgtgaaaagaaatgcaaggtgcagaaccaagtttggcaggaaaagaaacatttcagcatcgat

SEQ ID NO: 2808 - DNA, 546 bp, Hordeum vulgare
aaaaaactgcttcattgttattgacgggccatcctagctgtgcacagaatacatagtcctggaaccatcaatgctagtttgcccgcttaatttgacaggcaaatagctaattccagctgcatcagaggacgaggcgctgctcaaacttcacattgcaaaggcgctaccggcgatgttcttcatcgagggcataccggctgtaacatcttcttcgatgccacattcattcttgccccttatgatcttgaagtatccgtcatcaccccagcctctgttccactgatttgcaagaagccagtaatcctcgccagcatcactggttccccaaccaatcaacttgacggcatgacctcccatgacgccacctgtgatgtgcttgtacactcctgacttgtagtgtgcgaagtcctcataaactgtgaaagcaacttctacagggccattcttgtagacctctgccatgatgtcatgtggatcagagtttacttggtatgcatcgatgctgaaatgtttcttttcctgccaaacttggttctgcaccttgca

SEQ ID NO: 2809 - DNA, 518 bp, Hordeum vulgare
ctttgatttgtttgacacaaaacacaacggaattctaggatttgaagaatttgcccgtgccttatcagtatttcatccaagtgccgctcctgatgagaaaattaacttctctttccaactttatgatctgaagcagcaaggtttcattgaaagacaagaggttaagcaaatggttgttgctacacttgctgaatcaggaatgaatctttcagatgaagtcatagagagcatcattgataagactttcgaggaggcagacacaaaacatgatgggaaaattgacaaagaagaatggcacaatctagttcaaagacatccctcattactgaagaacatgacactccaatatctgaaggacatcaccaccacatttccaagctttgtgttccattctcaggttgccgatacctaaagtcctgagagcttcttcacttcgatggaatatcagaagacagtctcactgctttgctaagcctttccaatggccgtccgatggttcggaggaagctgtcgtagtg

SEQ ID NO: 2810 - DNA, 527 bp, Hordeum vulgare
  UNSURE (31): n stands for any base
aatatagcagtaggaaaggttccccacacanaatacatacacagttaactaaagggtcaaaccagctttttttgtacaaagaccaaagaaactttgaacattctgatctactagcagcccaccctaagctaaaaaagaaaaagaaaaacgttatgaacacaaagaaaccagcggaataaccgaatacagtatgcggtatgctttggaacactacgacagcttcctccgaaccatcggacggccattggaaaggcttagcaaagcagtgagactgtcttctgatattccatcgaagtgaagaagctctcaggactttaggtatcggcaacctgagaatggaacacaaagcttggaaatgtggtggtgatgtccttcagatattggagtgtcatgttcttcagtaatgagggatgtctttgaactagattgtgccattcttctttgtcaattttcccatcatgttttgtgtctgcctcctcgaaagtcttatcaatgatgctctctatgacttcatctgaaagattcat

SEQ ID NO: 2811 - DNA, 517 bp, Hordeum vulgare
  UNSURE (485): n stands for any base
tgttcttgcactaaaacagggcgatgttgatacgcttcaattttcagctatctatccacagaagtctgtcccaagtatatctgtcatcggactgaatggtgctatgctatggaatcatgaggggtatattagcccagaagatcttaaggaaagcattgagaaagcttgggctgcccttcatctgcaggagacagcggccaccctgttaactgcatcacttgcttcaagaatggctgaacctgcaaatactgcttcttcaaccatgcctgctcaagaaggttcatctacttcagaaaatcattccaattcatcaggtcaatcctcagaatcttctgcagtccgtggatttgctaattctactaatttggtagcacaaccacctagtagcacaagccaagctgaacttctcaagacaagtgaaatccccaaatcagattcagcttcatgcaacatagctgttgaggaaaagctagattcagcatgcncaggctgtgttgccagatttttcagcgagctc

SEQ ID NO: 2812 - DNA, 537 bp, Hordeum vulgare
gaaagaaattaccctattatatgtgtgaaaaggtcattcctggggctgaacaaagtaatttctaggattgcacatgccatattaatacttatgtataagggctataatttaacacctcggtttgttcccagcatatgtataaacactgttgttcaacacctcagttgttcccaacatatttatttcccaacatatttaactccaacagtcccgtcaccccctatttcttttcatcgcctccaaactctgtagaattcccattccagaagacgtttctattatcagatggatcttgttcttcactgtttagagtgtgaatgttgccaccgaactgtcggggccgccttctcaaggtatttccagagctatgagtagctggttgttgacttccatcaccacgaagaggttgggattcagagcttggtttgtactgctgcgagccctcatttcccagttgatcaagatttgatggggtgggatttcctctcaagtaggacaatggattcacatatgataacgctgcccccagaaaacccc

SEQ ID NO: 2813 - DNA, 517 bp, Hordeum vulgare
gtgagaggaaaaagtagagaggttggttgaagtgattgataaggagccaaacaggaacttcgtagttgagaagggtcgtggtactcctttaaaggatataccaagtgtggcacagaggttaacgaggaagaaacctgctgatcttaaatttcttcacaatgttctttttgggaggaagggcaagactgtcgattttaaaggccatatacttcagttctctggatttgtgtggcatgagagcgatgaaaagcagagagccaaggcaaaggagaagcttgacaagtgtatgaaagacatgctggtggatctctgttggcttcttgctattccggttcccaaaacaaacatcagaaaggaagatattgtggcaaagctgttggacttcattgccgaacctcatgttatgcctgattctggcctttctgatgaccaggggtcaaattataggaaacgcaagagaggaggtggtagttcaagcaagacttcggatatcactcccaagaggtctaagaagaaa

SEQ ID NO: 2814 - DNA, 508 bp, Hordeum vulgare
attaagtacaaaataataacactgggcgctaatgctatggtgtttacaacgcttcaaccagtgacctttgctctatgccgtgactgtttcttcttggcatctacacttttatcttgatcatcatcctcctgctccgataactttgtcagctcttcttgaatcataattttgatagctcctttttttgaggtcagatcaatcttgtaatggtcatcgagcttcttaagaatgtcgctaaaagtagacgtgttgaagtcaacttttttaaggattccgataatggtctttttcaactcagccttactgggtagacccccttctgctgattcgcctttgctcttcattgcctctttacctgatgacttattttcttctatcaccttttcagagcttggagtacgctttgatataatgggtttcttcttcctagagaagacctttgcactctcatcaaggctctccttttccttggaacctttggatggtgatgttttgcctgcagtcttgc

SEQ ID NO: 2815 - DNA, 174 bp, Hordeum vulgare
gcttgtgatcctggcctggctgatcaaggcgcttgacaattgttgtagagctttatctagaaaaggacggaagcagtcatgggaggtcactgcctggtagcctgggacagagttgcttcacttgatcttgtgagattatgcttgggtggtggattcctagctgttggggcctta

SEQ ID NO: 2816 - DNA, 550 bp, Hordeum vulgare
ggttacccagtaagactaagacagataacaatatttatcatacataaaggcaacaattggatgtctttagtgctcgctcatacaccattcccatgaaaaattgctccttacctagtacaataaccaataaaaaccacatcacagttcacagaggtctcaatcatactgtcttgccttagggctggatgaagccagccaatcatgcctaccttatgacacctctcctgcagaagaaaacgtgtgggtaaccatctcccacccaagtcttcttgaccattggagtggagaaacgagaaacccctcggcccggataaatgcagtgcacacctccagctgcctccaaacccatctgctgggaaggacacctcggcatcaaagcatccacttgccttggggctgctatcacaactctaaccagttttatgaaggccccaacagctaggaatccaccacccaagcataatctcacaagatcaagtgaagcaactctgtcccaggctaccaggcagtgacctcccatgactgcttccgtccttttctagataaagct

SEQ ID NO: 2817 - DNA, 522 bp, Hordeum vulgare
aggggcggccgcctccgcctcgcccttcgacgagctctacgcgcggggaaggcccatcgacggcgcctccaagaaatctaccctgtggaatttgatccaagacatagagcctttggatcttagtgtcattcagaaagatgttcctcttgaaacggttgatgcaatgaagaggaccatctctggcatgttgggcctacttccatccgatcagttccgtgttgttgtagaagccctttggaatccatttttcaagttattggtatcttcaatcatgactgggtatactctacgtaatgctgaatgcaggctctcttttgaaaggaacctagaactttctgaagaagatgctgaatgtgagaaaagagacatgactgaagataatcttcatgacatcaatttgggtaggcctattacaattttcagattatcagaagacgaaatgccccaggactctggaaaaagtgacggagaatcatctggtgatagtatgggagaaatgttaagtaacttaacaccccaagc

SEQ ID NO: 2818 - DNA, 546 bp, Hordeum vulgare
  UNSURE (16): n stands for any base
atataacacaagtatncattaattctgataaacattagacaaatacatacaacctacgagtacagaggatgcctgtccagtatccaccatgctactacgagattagcagcaacaacatgttatttcttataccacaatataaataggacgaaaattaaaccaattgttcacattgatatgtaacactaattttacacccatgccttccttttgactttacaagaactacaacaggagctatgacctggaactccctgtttccttgacaggaaatgcccaaaacagcaacttctgcggcctcttggcgagcacattttcatcctcttcactgatggatctcacgaagccagtgaagctttctcaaataaaatgatcgtcgtcaatggggaaagaccccacgtcgctagatattctgagaaggtgtgccagctctaaccgatattccagacctcggatgtagtgacccagcaacatgcaccagaatagcaagcgtgcaagataatcacgtgggacagatattagaggctgaaacgggagggaagtatt

SEQ ID NO: 2819 - DNA, 518 bp, Hordeum vulgare
gagcgcatctgcaacgccggcaggttcagcgaggacgaggcgcgtttctttttccgcagctgctctcaggggtcagctactgccactccatgcaagtatgccatcgtgacctgaagctggagaacaccctgctggacgggagcacggctccccgtctcaagatatgcgactttggatattccaagtcgtcggttcttcactcgcagcctaaatcaaccgtcggaacccccgcatacattgctcctgaggttcttctcaagaaggaatatgatggaaagattgcggatgtgtggtcgtgtggagtgacgctttatgttatgctagttggtgcatatccctttgaggacccggatgagcccaagaattttaggaagacaattcagaggatattgagcgtgcagtactcgattcccgattacgtgcacatatcttccgagtgtcgagatcttattgccaagattttcgtcggcaacccagctaccagaatcacaatccccgagataagaaaccatccgtgg

SEQ ID NO: 2820 - DNA, 549 bp, Hordeum vulgare
tgggttacattccaaaaggcaggctaaaccgtttcagaacatcggaagtacagggaccaacaacaaaaacaacaacaaagtaacatttgtgggctatcaagcatgagcagccgaacttcagcggtagcctcaagatatctatcccttcctcgagtatcttggccatctttcggtcaacttatatgtgagagcctttgcagtgtcacatggcatatacgatctccccgctgctttccacgtcgaggtcggcgtccgaatcaaggtcgtccatgtcgtcgtcaaggtcgagaccgtcgttcaagaactggttgatccgagaaccagccgccgggatggtggcctccgccaggatctgcatgatctcgtccatgctctgcatcggctgttcaggctcctcgtactggctgctcatggtgctatcatccaccaggtcagctgggaggttcttcaagaaccacggatggtttcttatctcggggattgtgattctggtagctgggttgccgacgaaaatcttggcaataagatctcgacactcggaagatatgt

SEQ ID NO: 2821 - DNA, 190 bp, Hordeum vulgare
  UNSURE (125),(135),(139),(147),(148),(157): n stands for any base
ggattgtcgctgccggacaccagagagcgcggttcccgagcaagccctagcctcccacgatggtgctgcagaacgacatcgacctgctgaacccgccggcggagctcgagaagctcaagcacaangaagaagcgncctncgtccagnntccccccanactccttcttcatggacgtcaagtgccagggct

SEQ ID NO: 2822 - DNA, 521 bp, Hordeum vulgare
  UNSURE (17): n stands for any base
gacaacccatatattgncacggtactactagtctgatctcacaacccaaactgaacatagtacagtgtcataatattgcttcagctagatatcaaattaccaaagatgggttcactttgccgacattgcaaaattttcagaccaacacccttgaaaaaacctcagttcaataacggcttgcttttccagttggcctcaggtttagtcgcccttgcgacggaaggagcaaccctcggttagcctggccttgccacccgttggctggcagagcaccgtctggcagcctgggcacaccacaacagtctgggaatggctgaacacagtagtgatgttgaagcagccctggcacttgacgtccatgaagaaggagttgggggactggacgaggcgcttcttcttgtgcttgagcttctcgagctccgccggcgggttcagcaggtcgatgtcgttctgcagcaccatcgtgggaggctagggcttgctcgggaaccgcgctctctggtgtccggcagcgacaatcc

SEQ ID NO: 2823 - DNA, 503 bp, Hordeum vulgare
gtacacggtgaggaggatgtttccacttctgatcaaccaaatgataaacattcagaagaaaatctcaaccgtcagatgcaataggagagcatgtttctgaggaaagcactggagatatggggcgcggcagaggccgaggacgaggacgtggaggcagaggcagggggcgtggctaccataacaaccataacaacaatcaataccaccataacaaccatccacagcagcagcaccactaccaccaccaaaacagcaacaatcaaggtaacaaccggagtggcgcccatcctgtcggaacgccaccttccagccacccagtcaaggctgagcaacaacagacacagtcatcgccacctgcgggagctaacaagcagcttccagggccccgtatgccagacggcactcgtgggttctcaatgggcagaggaatgccgcaaacatcgacgcccagcgtatccactagtgaaccttgaacttgattcgcgccacaggacagacgagac

SEQ ID NO: 2824 - DNA, 508 bp, Hordeum vulgare
ttcagaaaaccactggcgctacctggttttaaagtacacacagcacgtgcaaaaccatattatggtctgtaaatcagaaagcacactccaaaagacaagacttctaaaagacagtctctcagcatctctctatcaacatgacaaatcagcagcacaagctgtgtctcgtctgtcctgtggcgcgaatcaagttcaaggttcactagtggatacgctgggcgtcgatgtttgcggcattcctctgcccattgagaacccacgagtgccgtctggcatacggggccctggaagctgcttgttagctcccgcaggtggcgatgactgtgtctgttgttgctcagccttgactgggtggctggaaggtggcgttccgacaggatgggcgccactccggttgttaccttgattgttgctgttttggtggtggtagtggtgctgctgctgtggatggttgttatggtggtattgattgttgttatggttgttatggtagccacgccccctgcct

SEQ ID NO: 2825 - DNA, 488 bp, Hordeum vulgare
gagaagtggttgccgaaggatgagtgggagccgataaacccgctactggttggatttggtcagacaatctgtactccgttgaggcccaagtgcggcagctgtggcataaacaccatttgcccatcggcttttaaggaagcatcaagtcccaacccgaagcaaaagaagcgaggtctaggcagaagctaatttagggggtgctttctgaaccttttaaaggtgcgttagttactgatgtggtatggaaggtatactttcctgggttcttttggctggtctatattgtttggatagcctccttttgcagcgccaatttgtatagaagtaggatattcaagatattgcgaagcaatatatcgacctttgtcaagttgcagtatgatgtccatcaactgaaagatagcacggaaaatcatcggagttttaatcccatgatgatgatcttgtattgcttcaaaaaaaaaaaaaaaaaaaaaaaaaaaaaaaaa

SEQ ID NO: 2826 - DNA, 435 bp, Hordeum vulgare
atatgggattaaaactccgatgattttccgtgctatctttcagttgatggacatcatactgcaacttgacaaaggtcgatatattgcttcgcaatatcttgaatatcctacttctatacaaattggcgctgcaaaaggaggctatccaaacaatatagaccagccaaaagaacccaggaaagtataccttccataccacatcagtaactaacgcacctttaaaaggttcagaaagcaccccctaaattagcttctgcctagacctcgcttcttttgcttcgggttgggacttgatgcttccttaaaagccgatgggcaaatggtgtttatgccacagctgccgcacttgggcctcaacggagtacagattgtctgaccaaatccaaccagtagcgggtttatcggctcccactcatccttcggcaaccacttctc

SEQ ID NO: 2827 - DNA, 555 bp, Hordeum vulgare
  UNSURE (20),(42),(43): n stands for any base
gtctccccgggcctgcaggnaattcggcacgagggccaaggnngcatgctcccgaacgagatcactctgatcagcttcctgccgtgcctgcaggggcaggaatgtctcgccgccggggagatggttcatgggttcgtggtcaagctggggttcgatgcgaatctgccgctggtgaatgcgctcatcgcaatgtatggcaagtgcgggagcatcgcggcggccaaagagttgtttgatggaatggctgcgcacactgtggtgtcctggaacacgatggtcgccatgtatgagcagaatggtgatggggttcgggcgatcaagttctttcacaggatgcttagcgagaaggtggggttcgacgccgtcactctggtcagtgtgctgtctgcttgcacacgccagggagcccttgagacagggaagtgggtgcacgagctcgccaggagtcgtggactcgacaccgatgcgaggatcggcaatgttctcgtggacatgtacgcaaaatgtggtgagattgcctacgcaaggcaggcttttgacggtttgcgtgagcct

SEQ ID NO: 2828 - DNA, 548 bp, Hordeum vulgare
gttaaaaggtggaaatactacagaacaaacatttgtgttcggtttatcacgagcctacgctaatgcctagtttcaacatctaaagaggagtttaggggaaggaaacatgtgaaaatagttgattacaaacagcctaacctaaaaacttgtatctagaatgctacttcatgatggctcttcttcccctactggtacaaaccaagctgtgcccagccgtcttcttgagctccatctccttcatggccctcctcgtcctctctgcgtcttccagcattccagcctcaaagtacatgtttgccatcaaaacatagaacgtcacatcgttagagcccgactggaagagatccttggcaacaaattcagctagctccaggttgccatgaagcctgcaaccgccgaggaacgcaccccaaatgcacttgtctggctgcatcgacattcccctaatgatttcatacgcttcgacaagtctgccggcacgtcctagcatgtcaaccatgcaggcatagttctcaagtgttggtgatatatggtagtctctgacaatg

SEQ ID NO: 2829 - DNA, 519 bp, Hordeum vulgare
caattgttgacaaggacaagtcacaaagtgcacttgaaaagatatatgctttcaacgtaatgaagttcaaggatggtaacaggggagcaataaatgggatgtggccagatggtacattggacatgtccacaatgcaatctagggagatatggccaggcgtgacatacgcccttgctgcatctatgattcaggaaggcatggttgatgagggtttcaaaacagctgaagggatctataatgctgcctggtctacggaagggcttgggtacgcattccaaactcccgaatcttggaacaatgacgatgagtaccggtccttgtgctacatgcgcccactcgccatatggtcgatacagtgggcactctcaaacccaaagctccacaaggcgcctcagacagacataacacaagattcttttccaaagaaccagttctcatatgcacgaatagcgaagctcctgcagttacctgaagatgaatcgtccaagagtctccctcgggttatctatgagatagttc

SEQ ID NO: 2830 - DNA, 555 bp, Hordeum vulgare
ccaactcatcttttattacaacttaactcatacacgataacatgtttccgcaatgaacaatcaaaataaacattgttgctccaatagtacatttaacattcaggcaatgtcgcgtcccatagatcatgaactaaacctgttccgaactatctcatagataacccgagggagactcttggacgattcatcttcaggtaactgcaggagcttcgctattcgtgcatatgagaactggttctttggaaaagaatcttgtgttatgtctgtctgaggcgccttgtggagctttgggtttgagagtgcccactgtatcgaccatatggcgagtgggcgcatgtagcacaaggaccggtactcatcgtcattgttccaagattcgggagtttggaatgcgtacccaagcccttccgtagaccaggcagcattatagatcccttcagctgttttgaaaccctcatcaaccatgccttcctgaatcatagatgcagcaagggcgtatgtcacgcctggccatatctccctagattgcattgtggacatgtccaatgtaccatc

SEQ ID NO: 2831 - DNA, 385 bp, Hordeum vulgare
tttttttttttttttttttttttttttttagtggaaccagaatggaaataaagtttgcatgggaacagtggattcttaaaaaggaaaagaaacttctataaacatagagggtgcactctaattccaatccagatcctgactagagggcgcgccacagtattggcccctatacagaattactacaggtcacagaagatgtttaaatagctaatgataggctaagcgcttcagctgacctaatctaataatccacaatgaccggttcagagagaaaaacatagaagttagccggagctcttcgattctggtgcttcggctgcttctttggagagctcaagtgaaacaggacagtgatcacttccataaaatccttccagttcaattc

SEQ ID NO: 2832 - DNA, 377 bp, Hordeum vulgare
tcgtgtcatcattgtggaatttgaatcattcttgttactaaacacatatgctccaaacaatgggtggaaagaggaggaaaattcatttcaaagaagaagaaagtgggataaaaggatgttggagtttgttcaacaagtagacaagcccttaatctggtgcggagacctgaacgttagtcatggtgaaatcgacgtcagccatcctgatttttttagcgatgctaagctcaatggatatatccctccaaataaagaggactgtgggcagccaggattcacccttgcagaaagacagcgctttggcaatatattgtcacagggaaagctagtagatgcttacagatacctgcacaaagaaaaggacatggagtgtggct

SEQ ID NO: 2833 - DNA, 473 bp, Hordeum vulgare
  UNSURE (14): n stands for any base
ggtcttgccaaggnaaaacgtgtcaaagatgagtaccaatcctgcactgaagagcaatagcctagaaactgtatcgagtcaaaaactggagaagaaactggatctcactgacacaataaaggatggagcacggctgttccttatcgattctgggatcaggagacaacttgtaatggctttcaccgaggactccaggttgcacgtagatgagcttgttgatgtatacaaactggtggaagatcagatagacataccttctgttgctctcgaggttctccaagatttgccgtcggtcgcacgcgatttcatgctttcgtggagcgattccgttctatcggatcgctaaaactaacccagccaaactgctggacagcaagcggtgacctgctagttaggaacagcaagcaacttacctcgagttaatctgcatagagatatagatagatagacaagattcttctcatattctttgg

SEQ ID NO: 2834 - DNA, 549 bp, Hordeum vulgare
tatctatctgtatgccttttcttccgaatatacaaactcaagttatatacaagtccctgttccactatacaagtggcatgtgcagatcagccgagcaaaccttgctatacaggagtgccccaccaaagaatatgagaagaatcttgtctatctatctatatctctatgcagattaactcgaggtaagttgcttgctgttcctaactagcaggtcaccgcttgctgtccagcagtttggctgggttagttttagcgatccgatagaacggaatcgctccacgaaagcatgaaatcgcgtgcgaccgacggcaaatcttggagaacctcgagagcaacagaaggtatgtctatctgatcttccaccagtttgtatacatcaacaagctcatctacgtgcaacctggagtcctcggtgaaagccattacaagttgtctcctgatcccagaatcgataaggaacagccgtgctccatcctttattgtgtcagtgagatccagtttcttctccagtttttgactcgatacagtttctaggctattgctcttcag

SEQ ID NO: 2835 - DNA, 517 bp, Hordeum vulgare
cctggatacgagttcgggatatatatcgcgggggccatttgctcctccgtgctccctccctccttttcctttccaagaatttcgcaccgcccgcgccctagtaccatcatgccatgccttcctcggcttctcattccgtttcgcgtggctctagcttgtcatatcgtgtatcgcttgctgttgctgcgactgactgccggggttagggttcttgggggtgtatgaatcgtggccggcggttatccgacttattatgtcgcctcttagttttttattattatccttgcgtctcatctcccttcacgcctatcttatttctgtatgctttatttatgctgctgctcttgccgtgctaaaacctctcgcgattcgtagccatggataggtaccaaagggtggagaagcctcggaatgagacaccgattcgtgagaacgagatcaggatcactgcgctcgggaggatgaggaactatatcggctacgggatgtcgttgcttgaggaaaatgggcatgatga

SEQ ID NO: 2836 - DNA, 542 bp, Hordeum vulgare
agctctacttgagcattcacatcccacagaggtaactgaacgagagactgaaacacatttcacacgttctactaggtgttgaggttcttcgctggctggcctaactaaataaaccacaggtgagccacacaaaatttgcccggcggcaagtcgtacagcatcagagagcataaagatccacgtcagagagcccaacacatggagcaacacggtaagcaaaaattatcaggtaattaagcacagcagtgccggcttcatggtttgcacttggcatgtcccagttcaatctagcatcggaccacgcccacggcctcgggcgccccatggccctccccttcttcccatgccacgaccacggcctggaggggggtattcataaggttcgtcgaagtattcgctctgctccatccatcttcccctgccacgcccacggcctggagggcgatactcatccggttcgccattgtagtactcactctgctccattcttcttccccacggcctggaggaggttgatactcatctggttcaccattgtagta

SEQ ID NO: 2837 - DNA, 326 bp, Hordeum vulgare
  UNSURE (43): n stands for any base
aggaacttcagcgtccgtcgagaaatgtaaggcatctcaaganaataccacagctacatatggaaggattgaggatgggtgcaccgtaggttcatgccctgtggacaaggcgtgaataagcggcaggttcaaccacagaccagagttttgaaggcagcaggaattaggctgtggcctttgacctgaacattggaaccgctgacctgaactatgtaaccgctgacctgaactatgtaaccgctgacctgaactatgtaaccgctgacctgaactcggtaaccgctgacctgaactcggaaccgctgactgaactcgcaccgctgact

SEQ ID NO: 2838 - DNA, 503 bp, Hordeum vulgare
aggccacaggagacgataaagtagttcagttgtttattttacaggtggaaatttctacattccaagtagtagagcaactaatgccttgttcttcatgaagctacttctcatcaggtccttactgcctaccctgccagttcccttgtccttcacctgggccaggatactgatcggaagccccttgtaagttatctcccccatatgcaggtgctgcaccctgtctgttgtctccaccataagcaggaccccctaggttacctccaggatatctcgatccagacggttgcccataagctggcttcccgtaggatccaggtgcaggcggttgaccgtagtttccaggtgcaggcggttgaccgtagtttccaggtgcaggcggttgaccgtagtttccaggtgcaggcggttgaccatagtttccaggtgcaggcggttgaccatagtttccaggtgcaggcggttgaccatagtttccaggtgcaggcggttgaccatagtttcca

SEQ ID NO: 2839 - DNA, 274 bp, Hordeum vulgare
gccttatggaggctttacagcttgagaagttgtcatttccatctaaaggtcgacagatggcctctgtttcagagcttcgttctatggtgcaaatgctctgtcaacacgagctgtccttggtaagaaacataggggttattcagttggcactagctgctgaaatggctcttcatttatcctcaaagtactcgctgggaagcctttacaagtgctgagagaatattaagtgtaacatcaggctgagacaactcaaagtcttgccagcgaaatccgt

SEQ ID NO: 2840 - DNA, 540 bp, Hordeum vulgare
tgtacttgcattgctgacatatatgaatatagtccaaggtatagtctaaatactgggctgaaggggtggcagggatcttgtattctgatacaagctcctgagcaatgtgggtggaaattatacgagtttacaacattgtgacttaacaattctctaagccggcaaatattcaaaaatcccatctcagaagcaaaacaatgtacagattaaatttacatgattgctactgtaccgacaagcagtacctggaagcaagaatctatgtctaattaatgtctaagtaaagctggatgagcctaacattaactcaaacatgtcatctggggtgagaagggttgtaccaccaagaatgagctgcacatcaggtctgccgctctctgagattgccttcatgacttcccggacctcaagagtattgatgcctcccacaacaaaaacaatgagaaaactttgatcgccaaaatttggtttggactgtccaaggccaaacctacccaatccgcttttaaataagcgaccaacagctgatgaatgatactc

SEQ ID NO: 2841 - DNA, 445 bp, Hordeum vulgare
gagagggcgtgactgatgttgcccctggtgaccacgtcctccctgtgttcactggggagtgtaaggaatgcccacattgcaagtctgcggagagcaacatgtgtgatctgctcaggatcaacaccgacagaggtgtgatgatcggggatggcaagtcgcgcttctctattggcggcaagccgatttaccatttcgtagggacttccaccttcagtgagtacactgtcatgcatgtcggttgtgttgccaagatcaaccctgaggctccccttgataaagtctgtgttcttagctgtggtatttccactggtcttggcgcgtcaattaatgttgcaaaaccaccaaagggttccacagtggcgatatttgggctaggagctgttggccttgctgctgcagaaggtgcaaggattgcaggtgcatcaaggatcattggtgttgacct

SEQ ID NO: 2842 - DNA, 531 bp, Hordeum vulgare
  UNSURE (38): n stands for any base
ttttttctaggcccgtctttttaaaacggtgaaaacanaaagcacactacatcgcctgaactttcagaccaagtagtaccttcagttccaaataccataagcacgtcccagaagattcagccaagcagtaggaaatacatactcaataagcaacgcagcaagaagacacagaatatggaaacatcaggttgagaacagactgattcaactgaaactcatggccatagcagcagcagcagcagcagcatacattgctgccgaaaaagagctcgtagtacaaccacttctccggtaaggtaattacagatatacataactaatattacgctactttggccaaggaaggcgaaaccgcagacgatgatacatggaagtgtattaccatcaccgatgatctggttcagaagccggcccccagcgcttattacatcggagcgatcagaagcacttgaggaggacgcctagttgtccatgcggatgatgcaacggatgccctcccccttcgccataaggtcgaaggccttgtttatc

SEQ ID NO: 2843 - DNA, 517 bp, Hordeum vulgare
gcctccacaagacatggacaaaggtggtggcgatgcggaacagccaggagcggagcaaccggttggagaacctgtgctggaggatctggaacgtcgcgaggcagaagaagcaggtacggttccgttcccggccgccgcgggccatggatggcgatgccgtccgtggccggagcacgcgtgtggctggccttcacacgccctgcttttccttccgttcgccatcgggtttccctctttttgcttcaaacggaaaaaacaaacctcgtgttcaatgtcggcggcctgcttggcctggcccatagggcactcaggactaattgtccgtgtgtgtttatggtaatttattaagggctgggtatattctagcctcgtctggaatttttactgtggggttacctttggcccacaaggatgctacacgtaagtacggagtttttataaaagatttacagattgcttatcactgattgaccgggaattcattaaggcacacggacccatcgctgaaattcaggag

SEQ ID NO: 2844 - DNA, 526 bp, Hordeum vulgare
cccccgagaggtacaaactagggtgaagcagtactcactccttgccattgatgcagccatccggcaataatgcttaacatacagacacattctacaggattttacggaccgggtactgtaagctcttttgattagccctcctgaatttcagcgatgggtccgtgtgccttaatgaattcccggtcaatcagtgataagcaatctgtaaatcttttataaaaactccgtacttacgtgtagcatccttgtgggccaaaggtaaccccacagtaaaaattccagacgaggctagaatatacccagcccttaataaattaccataaacacacacggacaattagtcctgagtgccctatgggccaggccaagcaggccgccgacattgaacacgaggtttgttttttccgtttgaagcaaaaagagggaaacccgatggcgaacggaaggaaaagcagggcgtgtgaaggccagccacacgcgtgctccggccacggacggcatcgccatccatggcccgcggcggccg

SEQ ID NO: 2845 - DNA, 519 bp, Hordeum vulgare
tggcaattgacctaatcgttcagcatattcgcactaaacttggtcaaaatgatctatgtaaaatacacccaaatttatatgttattcagactacttaccagatacgaggcatgcacacaataatacgggatgctgccacgacgacacatgatttcatattttatgctgatcggttgattcgattggttgtcgagcatgggcttggtcaccttcctttcagggaaaagcaggtcatcactccaactggatctgtttacactggtgtggatttctcaaaaagtttatgtgggatatcagtgattaggagtggcgaaagtatggagaatgctctgcgggcatgctgtaaaggtataaagattgggaagattcttattcacagggaaggagatgacgggaaacagctcatctatcacaatttacccaaagatatcgcaaaaaggcatgttctgttgctggaccccatattgggaacaggaaattcagctgttcaagctatttctcttctcttggagaagcgtg

SEQ ID NO: 2846 - DNA, 544 bp, Hordeum vulgare
atgatattgtacctttttatgtaaagtggatgtccgtttggaacttctcatgatatatcagttttccggtagtgaacacaacagtattggcatctgagagtttgggaatgtaaaaataaaatttctccaaaagaatttgaataatgccgtaggcaggaggtggcatgtctgggcaattttctcacaaaagccctacacgatttttgtcatcggcaaagaagggcgttgatgactgataatcatctgttccaaagtacctatccccaaactcacccatcccagggatgacacggaaatcatcattcagaccaagctcaatctctgatgtcacaatcttgacccttgggaatctcttactgactacatgcaccccttggggagctgatataagattgagaaatataatatttgcttcttgtacacgcttctccaagagaagagaaatagcttgaacagctgaatttcctgttcccaatatggggtccagcaacagaacatgcctttttgcgatatctttgggtaaattgtgatagatgagctgttt

SEQ ID NO: 2847 - DNA, 553 bp, Hordeum vulgare
gtacccccgggcctgcagggaattcggcacgaggtgagaagctgcggtctgattatgactttggccacactgtgcatgccaaccatctcccacgtggtgatgcagcagtggagaggccagtggtcaggctattcaagccatttgatgagctcgttgttgatagcaaggattttgatgtttctgctttggagaaattcattgatgctagcagcaccccgaaagttgttatttttgataagaaccctgacaaccatccgtacctcttgaaattcttccagagcaatgctcccaaggccatgctctttttgaacttctccactggaccgtttgagtccttcaaatcagcctactatggtgctgtagaggagttcagtggcaaggatgtcaagttcctaattggtgacattgaatcgagccaaggggctttccagtactttgggctgaaagtcgaccaggcaccacttatcctcattcaagacggtgactccaagaagtttttcaaggaacatgttgaggctggccaaatcgttgcttggttgaaggattactttga

SEQ ID NO: 2848 - DNA, 544 bp, Hordeum vulgare
gaagatttgttaccagtatttctcgcaacgggatacagtatcaggcaaaaccggggccaacacatccaacaaccaactctcgacccccctcgcaaaatctggcgttggaatctgccttgccaaaacatgtttccccatcctctacctgtctgctgctagaaagactgttgctcagagctcatccttcaaaggctcggtggcagccggttccgccgccttctcggtcgccgccgccgccacctgcccagcagtctccttgttcttcctgatgtagtcgacgatctcgtcggccgtcctgccaccctcataagagaccttcttcccgctgggagtgacgaagtacagggtcgggtaaccctggacatcaaactcgcccggcacgtcattctcggtggcgtccatcttcgcgatcacaacgtcctcttcgctttgaagagtggcagctgcctcgtccaagatgggtgctagcttcttgcagtgtccgcaccagggcgcatagaactcaataagaacatttttgccagatttgaagaccacgtcatga

SEQ ID NO: 2849 - DNA, 447 bp, Hordeum vulgare
aaaactcccccgtaacctcaacttgtagtcatccctcagaagtactgcacggctgccgcctcatggcggcatccacagcgtcgtctagccccttgacgcccttcctccgtcggcacgacgcacgcagccgtcgccgtgcaaggttcgtcgtggcggcgagcacggcggacgcggagccgtccccggaggctacggcggcagggccggggaagaagaagacggtggacacgaggatacactggtccgacccggacgaagggtgggtgggagggaaggcgaagaaggaaggcgacgggcgcaaggagaagccgctgggacgaagcttcgccgacctcatcaacaacccgtccgagtcacactaccagttcctaggagtagcgcctggcgccgacttggaggagatcaaggcggcgtaccggcggttgtccaaggagtaccacccggaca

SEQ ID NO: 2850 - DNA, 556 bp, Hordeum vulgare
  UNSURE (39): n stands for any base
aattatagggattgtctgagataataactatgagatganttcctagtcctgtatttacgcgttacattatacgctgtatgagacatataatctgctataccttgcatatactataccgtttgtgtctatagtccagtactagtatcttctcttctcttctatcaatattgctccttgaagaagatggcgtagatgatgcagcagatgctgaagatgatgatgccgatgtcgaacgtgagggcggtcatggcctggtcgctgagctccatgttcttcccgccaaggcgatcgaccgtgtccggcacgggcttgtaattctggaggtcgagctcgtaggggtcctcgaggcgggacctgagctgctgcagccgacggctctcggcctcctgcgccagcgtccagtcgtagaagcggcggctctcctccttgctaagcaccttgtacacctcccgcaaccggatgaacttctccgacgccgacttgagcggcagcctcgtcgtgtccgggtggtactccttggacaaccgccggtacgccgccttgatctcctccaagt

SEQ ID NO: 2851 - DNA, 1001 bp, Hordeum vulgare
  UNSURE (1001): n stands for any base
ggacccccgggcctgcaggaattcggcacgaggtcgagttttttttttttttttttttttttgggggtaaaaggggggtggccaaaattttggattggttctttccccaaccaacggggggcccctaacggggggaatttttgggggggggccccggaaaaaataataccggaggggggttggtttttctttttaaaccccttcttaaaaaacaaaaaaggccaaaatgggggaaaaactgtttggtggttaaaaaaggggaaaaaaagggtttaaaaaaaaaggggcccccggtttgaaagccccctttacccggtttttaaaaactggggggttttcccgggaaactttcctttgggggaactaaggttggacagcaccccttttttttttttttaaagggggaaataattttcccttgttctttttccgggggggggcgggggtaatcctttcaccttaaatttcccaaaccccttttttttccaccggcaaagggggaaaaaaccccccaggttaggttccttataaataaatccggccggaaatggggcggggaaaatttttttggggcaagggaaattcctttggggaattttaaagtttttgttttaaaaaggaagcttttgctttggggggggattataacccttgggaagggaaaagggaagggtttttttttccccccaattttgtttttttagggaaaaaaccttgtgggaaaaggcagtttgaatagcatgttttgttccccgggaaaaaaaggatggcccaatcttgaaataaggtccttttttttggagaaggaaaatgtcccaaaaggagggtcaaaaaacccaaatactcggaaaaattggggggggttttggcgagcccattctggaaattaaacccggggttaattggggcgggggaaaccccctaatatttggtgggaaacccgcggtttaaagaggcacgggcctttttaaaaggttattggggggctccaccgggacaan

SEQ ID NO: 2852 - DNA, 553 bp, Hordeum vulgare
ggttcatcaagctgtactgccaaaacttatgaattgatacttacacagacaacagttggtacctaactggcagcaatttatgaggtaggtacaagtaaaaataataacagaatgaagtttgattttcctatataacaccttcctaaaaaatcagataagctcaaattgcagcataactgcttgactgtctaaaaatggagaaaaaatggtataataataaatgatgccactgtatgtaagtacacttcatccggttttctagaacttgttggtattcccgagtaactatcccttgactgaactcatgtttgacagcatccctcatttctccttataaaaggtgaaatcatcatccctcgttcctcatccaggaaggagcaaggataatactatcaacttataatttccataacctcattctatccaacagcaaagatgagataaaacctccaagttcagttcctcatcaactaatcctgcctgaaactgtgcatggcaaacttcgcttgggcaaaggaatatccattaggtcatattcaagtctttgtatcta

SEQ ID NO: 2853 - DNA, 549 bp, Hordeum vulgare
  UNSURE (32): n stands for any base
gtacccccgggccttgcgggaattcggcacgngggaagcaaaccttgaaaaacctccgttcctcaccctaccaaccatcttccttccttagcgacgaggccacccagagctccacacgaaggaaagcgcgaccggaggaggaggaagaagaggagcaagtatgtcgtcggtgttcagcggcgatgagacggcgcccttcttcggcttcctcggcgccgcagccgccctcgtcttctcatgcatgggggcggcctacgggacggccaagagcggcgtcggggtggcgtccatgggggtcatgcggccggagctcgtcatgaagtccatcgtgcccgtcgtcatggcgggagtgctcggaatctacggcctcatcatcgccgtcatcatcagcaccgggatcaatcccaaggccaagccctacttcctcttcgacggctacgcccatctctcctccgggctcgcctgtggcctcgcggggctcgccgccggcatggccattggcattgtcggtgatgctggagtcagggctaatgcgcaacaaccaaagct

SEQ ID NO: 2854 - DNA, 541 bp, Hordeum vulgare
taatataatcctaaatttattatttagctcaatgcgtgtttttattcaccaccaataggattaaaacccatattcccaggagcagcaatccagcctaccccaaaatcctctgcaccaaacagcaaacgcccaccacaacccaaaaagaatgaaaacggtactggaagtgtcaccttccttaataatctacaaatatctccttaatacatcaaaattagaacttttcaaagcttccaacttctcaagaatgtagcctgcatagcaattgtggaatggtagagcaaggcgcctaatccgcgcgggactggccggcacgggatgagaggatgatgcccacgatgagaccgtaaagggcgagcgcttctgcgaaaatgagaatgaggatcatacccacgaacagctttggttgttgcgcattagccctgactccagcatcaccgacaatgccaatggccatgccggcggcgagccccgcgaggccacaggcgagcccggaggagagatgggcgtagccgtcgaagaggaagtagggcttggcctt

SEQ ID NO: 2855 - DNA, 431 bp, Hordeum vulgare
gctgccgctcaagtcggcgtcggagaagttcatccggttgcgggaggtgtacaaggtgcttagcaaggaggagagccgccgcttctacgactggacgctggcgcaggaggccgagagccgtcggctgcagcagctcaggtcccgcctcgaggacccctacgagctcgacctccagaattacaagcccgtgccggacacggtcgatcgccttggcgggaagaacatggagctcagcgaccaggccatgaccgccctcacgttcgacatcggcatcatcatcttcagcatctgctgcatcatctacgccatcttcttcaaggagcaatattgatagaagagaagagaagatactagtactggactatagacacaaacggtatagtatatgcaaggtatagcagattatatgtctcatacagcgtataatgtaa

SEQ ID NO: 2856 - DNA, 550 bp, Hordeum vulgare
ggcactactgttttattgttatagaacattaatgcaatcttttgtttacatataggttcgttctgcaatgaaagtaaaagctgctgcgattgttgtgttcaccttctcagggagagctgccaggtgctttataccacacaagatcaatacttgactatatgttctgtcatgcaaatgccatcatcttacttgatacatcgtcttctgcaggttagttgctaaatacaggccaccaatgccagttttagcagttgtgttcccacgcgagggctctgatccatcaaagtggcgttcttatggcacaacgcaggtaagtaacatgcatatctatctatctgtacatgattttctttgaagggatccatatacttacatttactgactgttacaggcgaggcaatgtttttctgtgagaggtgtgtaccctttgatggggagtactgacgaggtatgtatgcatttacttggcaataccagagtcaccttgaaattctgctatttccaatgttaaatgtactccctcggttcctaaatataagtcttttaagag

SEQ ID NO: 2857 - DNA, 517 bp, Hordeum vulgare
gtcggagctagctgcacatcgcggcaggcgtgaagaaggaagagcggtggaggcggatggaggaggaggggaggtcgctggcggagacgccgacgtggtcggtggccacggtcaccacgctcatggtggccacatgcttcctcatcgagcgctctctctcacgcctcgccaagtggctgcggaagacgaagcggaaggccatgctcgccgcactcgagaagatccgcgaagaactgatgctgctcggtgtgatatcactgctgctgagccagacagccaggtggatatcggagatctgcgtgccatcgacgctcttcaccagcaaattttatatgtgcacagagaaggatttcgacgatctggatcaacatggagagcacaccgctaacaacacccacattgctagaatcctagttggtggccagtcgatgcatgtttgtgatgagggtcatgaaccttttgtttcatatgagggtcttgagcagctgcatcgctttctgtttattcttggttttac

SEQ ID NO: 2858 - DNA, 550 bp, Hordeum vulgare
caaaagctcctttgcgcgtagttgtgaattctgaagatttagtacaacgttataagtcaatacaaagatgatagtatcatcttgaagtggaggcgtcctatggacacaacattactttgcacagagtggccatgagacatgaggagcaatcacttgcagttacacacatatatactgggtaatccgcaggtccttttctgcagttactatgaagcttaggcaggaatggacactgttcttcaagttcagtagagttttagctgtgcatatttagtccggtgaagaacagggctaatctgagtaactaagtgtgtcgggtatcttcctcgatgtgagagatctcctcctcgtcatcgacagtgatcgcggtcagtgcctcgtccagggacgatgccgacacagtccttgacagcgtgcacaccgtgttggtctcgtggtcggtctcatagatggtcgtgtcgagggagcagaccgacctcgacgtgagtgtcccgttccgcatgaagagcggattgtgcctcctctctttgatcctcttgcaccagctgtg

SEQ ID NO: 2859 - DNA, 450 bp, Hordeum vulgare
acagagaacatattcccctcccctccaccttcggtgtgaagctcacgcctctcgcctccattttcatgtgaagcttctcaagattcttgcatgcctttgccgttccctctatctacccatctacctctctatcacaacatccatccatccatccgcctctccaggtctctataagcttgctcaaacagcaggaatggcattgccaatggcagcatgctctagctagtttgtcgccacaattcgcaagcagcaagaattataggccagatggaggctctacatccttttgccttgctccccttcttggtttttcttctgctatccatcggtggtgccagtggcaatggacatggcgaggcgttgcatggagatgcgctggccttgctctccctcaaggcctccctcagctgccgcccccacgtgttgcgctcgtggttgccggggcatgtt

SEQ ID NO: 2860 - DNA, 366 bp, Hordeum vulgare
tttttttttttttttactagaccctcacatgacaaaattgcctcaagtaatacaaaaagctgtggagtagtattggtagcacacatttcagcataaacaactagcgtaaaggagatgacaatggatggtggctgaagattaccaggagattacaaagggccaaagctatgatggagatgactgtatcacaaacccctagatggtggtagcatatgatcaaaccctatacacctttgatgaaaagaaaagaaaatatggaacatgagacgggaaaaaaaacaaagttacaatgtcattgctcttccccatctcctgtcaccgtcactgtcgatctacccaagaactgtagaatgctagccccaatta

SEQ ID NO: 2861 - DNA, 1472 bp, Hordeum vulgare
  UNSURE (1)..(10),(18)..(24),(898),(1031),(1269),(1355),(1415),(1422): n stands for any base
nnnnnnnnnntttttttnnnnnnnttttgaaaatatatattgctgtgtatttttgcgtggtgggaaagaacctatattgtttcgttggtggcctgaacaaaagcccctactgcatgacgccgtcacactcgcgttatttcttggcactgtcttgactagcaagagaaacgccccatgtcatcacagttagataggctcgcctgcacttaatcctgccactcgtatgggcactacgagcttcatacttccccaccaaattcccttcccccaaccaagttatattttattctgtcgggaactagagtcctgtggaactatcctacggtcatagagccttcaacgaccacacaatctttcatttgtttgggggggggttcgtccatcatccttttgtttaatcatgatacccccgcactcgccgagaagcggttctgtgtgctacccattatcgtcccaacacattcactcaggctcctttttgcgtgatcagtgtttggtcctgtttgatacctcaatccatcccttcgcgtcccgactgttgtgtttgcgtactctcacttaggtttctcaggagcaagttttctcaccgagaaacctgcacgccccggcgcgcctcgtctgaaagttgccctaactgcctgaaccacaacctttcctgtgagggtctctccggtatactgcgctctcctttctatgttattcgcccgacagccgcatttatttatgccatgcgtgttatttcagttatctttacaattgcgcccctgtttttgtatatcacgacattgtaccacctattgcgttatttcgtgtgtagtgtcattgtcggcggccgtgttctatctcggtcctcatcgctgtcacctccatgtcagattatgtcgtcgagcgatcaagngaattgtaaatcgcgtataagttaacggcgccgactagtgtgcgtttacttattccagcttcactgctacagtgatgccgcgccctttcttgtctccgccaagtagatgcgtgtgcggctacgttcgtcggangacgatatatagtatcgcgactccatacacactgtccctctactttgctccctctgcctccacgcgtcatccgtcacagtacgtcattataacctcagacgcgcacgaagactcagtcactttccggccatctacaccaccactcgctcggctatgttaatgcgcactcattcttttttcgctttgcgccgtgttgtcgtctgcgtcagtcctctatatactacaaccgcgctctgtngtcagccacccatgtcggccaggcgagagaccctatactgagagctcacatatattaccgtttcctctccttcttcattcctccgnctgactcttctttgtctctctacattattttacaaacacacacatactcgtgtgcctcgngcgttanatctattgtccctcttcgggacagatctggtagcatcatttctatctatt

SEQ ID NO: 2862 - DNA, 553 bp, Hordeum vulgare
  UNSURE (52): n stands for any base
gtctccccgggcctgcaggcaattcggcacgaggtgcaatcgcaaggtgtgntcgaagaagagggtagcatctgatctgcttcccttcagaaacaatggcgtctgctaccctcctcaaatcgtctttccttcccaagaaggccgaatggggcgccacgcgccaggccgccgctcccaagccgatgaccgtctccatggttgtccgtgccagcgcgtacgccgatgagcttgtgaaaaccgcgaaaaccatcgcatcgcctggcaggggtatccttgccatggatgagtcgaatgctacctgtggcaagagacttgcctcgattggccttgagaacaccgaggctaaccgccaggcttaccggaccctccttgtcactccaccaggcttgggaaactacatctctggtgctatcctctttgaggagaccctctaccagtcgactgttgatggcaagaagattgttgacatccttgtcgagcaggggatcgttcccggtatcaaggttgacaagggtcttgtgccacttgttggttccaacgatgagtcatggtg

SEQ ID NO: 2863 - DNA, 544 bp, Hordeum vulgare
  UNSURE (44): n stands for any base
gtcccccggctgcagaaattcgcaccaggcttctttctgaccanccaaaatcttcaatgatctcagatggaatgtcactagaccgcagggatttgaggctgtcatgcgtgtcaggtgcagtcaggggcttcaagttcaagactattctggcaacttctgcaagcgtgttcctactgatattgatttgcctgctattgactctgacaaaaccataatggttaccttcaagcatgatgataagtttcaggagaatacagagtgtggttttcagtgtgcacttctttacaccacggtttatgggcaaagaaggatacgggtcataaatatttcacttccatgcacaagcacgctcaacaaccttttccgatatgctgatctggaagcacagttcacatatgttgttaagcaagctggaattggcattccatcaagttctctgtcccaagtaagggaccaggtaacaagtacatgcatcaacattctccaggcctaccgaaaacattgtgcatctgtgagttcttctggacagttgattcttccggag

SEQ ID NO: 2864 - DNA, 555 bp, Hordeum vulgare
tatggaaaatctcagtacaaacagggtaattaagtacgagtacaaactcttttcagaaagaaaaacggtccatttaatctttgtatacccacatgcgggaatcgataatctctaccaaccaaaatatcacaccaatgaagcttcaggtcatcttgctctggatttgcctgtgaacatgtacgaggaactccacataggaaaggccaccaggtgctttgtcctccaccaacagcgaacggaagaaatctccagacgggtcgccctttcggcacagtctcagtctcaagtaagagcatctctgtcgccttatttcattcacgacttcattcactttcctggacaatgcattatcaaattgctccaatgccaacagatttggtgcaccagccaaggatgagagaccaaatatttgctccagggtggccgggttcaccgcatttccgacatagataaaaccatcctcgccattttccaataaataaatcccatcatcctgtatattctcactattgagagtaaggggatttggaataagggaatcctcatcatcccttg

SEQ ID NO: 2865 - DNA, 382 bp, Hordeum vulgare
agagtagaggtgcatttaagcctctctaccttacatggaggctgcggcaatcttcccagctcaggaactgcagatacaatcacaaaacgacaccctggaagaaggagagtggacacgcatgtaagaacaagaaaatgaggaagccggtatccccaagtttcatattgttagggtgcaatgacggttcccgagatgccaagagggtgatcgatggttggtgcgaaggaaacacaagcaacaacaagttgttggaggactacctactgaaatgcggaattgtgtcctgctttttgatgtgttggacaaggtctcagaaacatgaagaggatttcggaaacattaggatcacgggcgaatcccgcgcgctcgctgtcgtcggcat

SEQ ID NO: 2866 - DNA, 320 bp, Hordeum vulgare
tttttttttttttttttttttttttttatttttttttttttttttttggtgccacttccaatctgctcaacctttatttatattattgccctagccatgcatctcctattcaaacaaaaaataaaataaaaataaaatgaacacattcccttttgtcattcttcctcttcagcctcacctggcccaatttgccgtcgatgccaaccgtttcgccatcacgtgcacaattttacaagcctagggcgacaaccactcctcaagggacgagctaaccaacttatccctccatcttcttccaagatttcacttctctttttttt

SEQ ID NO: 2867 - DNA, 419 bp, Hordeum vulgare
  UNSURE (390): n stands for any base
gagcctcctgtgcataaaaaccatccagcatccaggcaatcgagctcggcggactgccatggacataaccagcatcaccctgaaaggcaagactcaaaccagaggatagcacaaaccgaagcaagggatggcactggcactagcaatgaaggccccaatacgtcgccatcagcgatggatgcagtggaaacgatggacaaggatcatgagaatgccgctcacacgagaaaggacaccgaagccatggacagtcaagaatgccattcccttgagcccggcagtctaaagaggaaggagcacagtagccatgatcgcagcagcgagagggacgtcaagaggacgctgtcatgagaggaggtacttcctccgtcttaaaataagtgtctcaantttgtactagttctagtacaaagctgtac

SEQ ID NO: 2868 - DNA, 295 bp, Hordeum vulgare
tttttttttttttttttttttttttttggacatgtacgcaccatgccatattctccaatcacggttcaaatctccaacatggccaacaaggacagagatagctcctgcaacagaaaacggaaaaaagaataggcttgacactggttgctgcactgcatcgcgcaatgccaccactctgccgattgttccgcccagggtgttatggtgatgaatactccatccgtcccaaaataagtagtacagctttgtactagaactagtacaaaattgagacacttattttaagacggaggaa

SEQ ID NO: 2869 - DNA, 299 bp, Hordeum vulgare
ttttttttttttttttttttttttttttggggacagatattcaataactagcgaaaactccatacaggaatacgtgttgtcatatcaaacacattattcggataaggcggtgctcgaaattgaacatggcgcacaaccccagaaacagatagcgtgcagaggaactgtatgaacacgagcttcatggcggtaaacactaacaactacagcatagcaccagtcctttgctcatttggctttggggtgcgaagcgatgaagtccactgcagctttgatggagtcaattttgtcagcttcat

SEQ ID NO: 2870 - DNA, 367 bp, Hordeum vulgare
ccgccacaacgcgtcacaattcctccgatcttctctgccccctcccccggagctaagcacccatccacccaaatggcggcgtcggcggcgaggaaccttgtgctacggcaccttcgcttggccgcggtccccgcgtcgtcggtgtccgtcaggctggcagcggcgctgcagggtgtcctgtcggggcggcggtggatgtcgtcggaggacgccaaggggtcgttcctagacaaggaagaggtcgccgagcgcaccatcaaggtcgtcaagaacttccagaagatcgacaacctatccaaggtgaaagcagatgctcacttcaaggatgatcttggcctggacagtttggatgcagtggaggttgtga

SEQ ID NO: 2871 - DNA, 545 bp, Hordeum vulgare
gtcccccgggctgcaggtctggatgccgttgatcctaacaggatatcattatgtatgtgaactctccaggaggatcagtgacagctgggatggccatatttgatacaatgaagcatattaggcctgatgtttccacagtttgtattggacttgctgcaagtatgggtgcttttctacttagtggcggcacgaaagggaagaggtacagcttacctaactcaagaataatgattcatcagcctcttggaggagcccaaggacaagagaccgaccttgagatccaggccaatgagatgctgcaccacaaggccaacttgaacggatacctagcataccacaccgggcagcccctggataagatcaatgtagatactgaccgtgacttcttcatgagcgcgaaggaggcgaaggagtatggccttatcgatggagtaatcgtgaatcctctcaaagcacttcaaccacttccagcttccagttagccatgtcatgcacaatctctgctgctccaagcatttttgtcgtgatcttctggagctgtgttt

SEQ ID NO: 2872 - DNA, 544 bp, Hordeum vulgare
agtcaggtgcccctgtttgatccgcagaaaacctgaagtctcaccccatatcaaacaaaagtttgtgtccaaagctgagaaagccctaagaaggtgaaattaacaaaaacaacatcgactcacgtgcaaatatgttaccacaaatgatgaatattctagtagtgcatctgttccgcacaacctgtgagcttcataacacgaaattacaaaagcatctagccagactaatgaaaacagcgtgggtacaaacacagctccagaagatcacgacaaaaatgcttggagcagcagagattgtgcatgacatggctaactggaagctggaagtggttgaagtgctttgagaggattcacgattactccatcgataaggccatactccttcgcctccttcgcgctcatgaagaagtcacggtcagtatctacattgatcttatccaggggctgcccggtgtggtatgctaggtatccgttcaagttggccttgtggtgcagcatctcattggcctggatctcaaggtcggtctcttgtccttgggctcct

SEQ ID NO: 2873 - DNA, 318 bp, Hordeum vulgare
ccggctccccttccctgttccccttctcaatcgcgttgcttcgctcacaaggagaaggatggtttttgttgatctactctccacaggacggggccgatctggtccttcccagatggtggcgagccggagctgactctgcccgtcctcaacctcgtctacgaagctggtcgctgccagctcgtccacctcgccgcccagcagccaccactggcgccaccctcgaagacagagcaaagggtgtgagttcacggaaggaggtgaccaactagatttctgcaggagtacatgttcaactttgttatgtgattggacattctc

SEQ ID NO: 2874 - DNA, 384 bp, Hordeum vulgare
aactgaattgcacaacaggttcttgtaccccggcctggatgaagaggtagaacattcgtgtgaaggacgaaaacatgacaaagataaacaacaaggcaatggtgacgttcaacgacgccttgtccgcctcgaaagtaaatgttatctttttcttcgagtgactacacaaggtagttttgctagcattagttccatactttcatgatagttgttccagaagtacacaatgatgctttattatcctttctcgcgcacggggccgccatattcacccccgacttcattcgcttcggctgctggcaccgcggtcaattctggccactccagcctctcctgcctatgatgctggtactgctaatgggcgacgccgacatggacctttga

SEQ ID NO: 2875 - DNA, 518 bp, Hordeum vulgare
ggagataatgcgcaagttctcggagcagtacgcccggcgctccagcaccttcttctgctccgacaagtccgtcaccgccgtcgtgatcaagaaaaaacctcttttgtgcacgggcttgctgaccacaaggatcaactcggagctcctctatgcccctgcaggcattatgacgacaaggccgccgatgcggcccaaggcttctggaactgcccgtgcgtacctaatttcaaaatcagatttttctattcgctgttgcaaaggagtcctcgaaattcctgcccatcttgaaggaaacaacaaaatcattaaagggaaaggtcctttgttctcttgatcggaccagtatttcatgaactttttcctctgtcatgttccacgttttatactcaaatccaagccatcccttatttcctttgtggctcgagcgtttttgctgaggtggagtctcactaagaagtgatgtggcctatgtctcaaatgcatcttttatttgtttttgtggagcgtgacaatgagga

SEQ ID NO: 2876 - DNA, 550 bp, Hordeum vulgare
cccaatgaaaaatgtttattaaacatgcacatacattgaacgcaagttgacaaacaaattaacctagaggaagcatagttttgaccatcttaacaatcatctagaacacacaagtcacaaaaagataaggactattggttactatgagagacttcagatggtccagaaaacataagtttgtatctacatgcacaaagtgcaagctccaaaacactcgaaacaccaaatggtctacaagacaatatggtctatgattacacgttgattggtccataaacgctagagagtcatcatgtccatgtgcatcaataggttgagtacctgtcaagatggcggccgaagcagaaacggccttcttgagatatcgctttacagctgaatgccaaccaaaggggaaaaagccaccccatccaaatgatctagcgaggtcatttcctgtcccaagtggaatgattcttgtgggaggaactggtttccttttcgacttattaagttcttggagacatccaaatactcaaccaacagtgccatcacctccagcaaccataat

SEQ ID NO: 2877 - DNA, 400 bp, Hordeum vulgare
gccgccacctactgccacgtcgaggtctagccgtacgtccgtccgtgctctgcttcttcttcttctttttcctctgctccgtcgtcggcggcgaggtaggtttcttgcgggtggcgcgcgcgcgtgtgcgtagcgaagagcatcatcaaggctcaaggccaaggggtggggggtggtacatggacatggtggtaataagtgttagcgtcgaggggtataggtgtaaaaaaaagagaaggaaaaatttagggtgggttaagttaaattgatgctgcgatttacacgtaaattgtgttttgtttgtgtttacttattaattgttggcggactgtttgttccacgtttaattgtcaaatatatatataaatataaacttgttgtgattgatggaaaaaaaaaa

SEQ ID NO: 2878 - DNA, 379 bp, Hordeum vulgare
acaaggtttatatttatatatatatttgacaattaaacgtggaaccaaacagtccgccaacaattaataagtaaacacaaacaaaacacaatttacgtgtaaatcgcagcatcaatttaacttaacccaccctaaatttttccttctcttttttttacacctatacccctcgacgctaacacttattaccaccatgtccatgtaccaccccccaccccttggccttgagccttgatgatgctcttcgctacgcacacgcgcgcgcgccacccgcaagaaacctacctcgccgccgacgacggagcagaggaaaaagaagaagaagaagcagagcacggacggacgtacggctagacctcgacgtggcagtaggtggcgg

SEQ ID NO: 2879 - DNA, 518 bp, Hordeum vulgare
gcgacctgtccccacgaggcaacgccgccgcctgcgacgaagacggcggatcctctgcaaactctccgctcaccttctcgcctctaccttccactgctaaccccaccaccccttctgcataccatttaccatcgctcacgaagcctcagcccgccggcgccaccttctgccttctcacggatcctgcgacggccgagccgtcggactacaatgcggcggacaattagttggttctcctctcccgtcgttggggggcatccttccgagacgcagtggagcaatcgacggaagcccttgcggtaattgctcggattcaaattccagatcttttccagagtttcttcggcaacaagtcccggccgtttcctccttggatccggacttccttcttctaatcggatcacatgtgaggcctcggctcggctcggctcgactggatataagtgcagccagcccccggtgtgctttcttctcagattagatacaagacaagtccagttggtttgccgctgaagcaa

SEQ ID NO: 2880 - DNA, 556 bp, Hordeum vulgare
  UNSURE (22): n stands for any base
gtaggggcaccatttttcattncctaatatttatttttcagcctagtttcatcagatacagcaaacagtatatggaaaaaagagataaacggaacatgcttccagtgtcatagcatctgctcgcaaaagagtggcaaatttggttgacagaccccataatcaaagtacataattaaaaaatgctacctatttgtacaatgacaggttcatcactgtaagactgggtgttatccatatgggactcggccagctgcaccaaagcggggacacaatttcctccctgctgtcatcttcaaggttgagaacacctatatcccggggattcgtcttatacatccaattatattgctcatcatccgcgaaatagacacaatttgccttcagttgcggatattcttcagcactaaggcatataggctggttacgaccaagaaacagcacgttatgatgcaggctatttatttccacgaggtcttctgcttccatatcaactttgtgtaacaagattttattagtttcaactatgagctcctcatagcccgcatctatgacttca

SEQ ID NO: 2881 - DNA, 518 bp, Hordeum vulgare
  UNSURE (23),(33): n stands for any base
atactctaccctgatagtgttgntcggcacagnattcccacacaactatgatagatggtcttggtgttgctggatggggagttggtggtatagaggcagaagctacaatgcttgggcagccaatgagcatggtcttgccagcagttgttggtttcaagttatcagggaagctgaggaatggagttacagccacagacttggttctaacagtaactcaaatgcttaggaaacatggtgtcgttgggaagtttgttgaattttatgggggaggtatgggtgaactatcacttgctgatagggctactatcgcaaacatggcaccagaatatggtgcaactatgggtttcttcccagttgatgcaaagacattggactacctgaagctaactggcagaagcgatgaaactgtggccatgatagagacttacctgcgcgccaataatatgttcgtcgactacaagcaggttcaagctgaaagagtgtattcatcttatcttgaacttgacttggatgaggtg

SEQ ID NO: 2882 - DNA, 551 bp, Hordeum vulgare
  UNSURE (20): n stands for any base
gtccccccgggcctgcaggnaattcggcacgaggcaacaaccgacgacgagacgactccacacacgcagccgtggacgcgcgcttctcccaagcaagcaggtccaacccctccctccctccgtccctccatccatccgcagcactagagccttcgcctcgctagatctcgccgcccgccccgatttgttttctcggcctctctccgtagctcgctcggcagatctgcgcctcccctgggaacctccgtcgcttccgtccaaagacccgaatcttttcttgctcttgcgctcaggcttcgtccggatcgtgcggcgggggtccaggatgatgggtcctgctccttcgtggtgggctgtgctgctgctggtgctgctggccatggcggacgccgtggcggggaggttcgtggtggagaagaacagcgtgcaggtcacctcgccggagaatctcaagggcaagtacgagtgcgccatcggcaacttcggcctgccgcagtacgggggcaccttgcaaggctgggtcgtctaccccaaggacaacaggcaggcct

SEQ ID NO: 2883 - DNA, 964 bp, Hordeum vulgare
  UNSURE (30),(48)..(64),(67),(70)..(79),(93)..(101),(103)..(108),(110)..(112),(114),(116)..(118),(134),(152),(179),(222),(228),(233),(237),(239),(240),(251),(252),(263)..(270),(334),(339),(347),(348),(391),(548),(604),(644),(648),(860),(861),(934): n stands for any base
aataattggcggggaaaggagggcttagtntttttttttttttttttnnnnnnnnnnnnnnnnnggnggnnnnnnnnnnggggggagaggggnnnnnnnnngnnnnnntnnnantnnnttcttttttttttttntttttttttttttataanataataaaaaaaatattatttataatnaagtctcctctcctcttcctgtatttaataaaaagatataggnagaggnagggnagtntnntagtaggagtnnagatttaaatnnnnnnnnaatggttagggggggtagagcccggggctgggaagaattaagagtttggggcccaaggagttgnggatntcttttgnnaaaaacgggggattggggaattttattgttttggggggggggncgggggctgaagatctttaaaaacttggctggaagaggttgggttggcggttttatttaaggggggaaaaagaggatttttgggttagaggggcggaagatttggggtttttggtttttgccggggggaaaaaagagaaaattggggccggaaaagntgcgttttaaaatgcttaaagggtgcgatataaaaagagggggggatttagtgggnaggggtttaaaaattttttttaaaaaatttataaaagatntggngggggcttttggagagaaattagacagggggttttgaataatattttggggggtgtttaaaaagagagaagaaaaaggaggagattttcatatatataacaaggatgggggccccgggggtttatcacccaaagagggggagagagaatatatttgttttgggaggggagggaaacacacaacaagaaaggagagtgggtgtttgtttttgnnaggggggcgcgacttctctttatagaggagagatcatattttttgttggggcgataatatatattaattaagnagagggggcgggttatttttatttatatgg

SEQ ID NO: 2884 - DNA, 548 bp, Hordeum vulgare
ttagtaaggtgagtagtttgttggttttcaggagagctgttatcaccaagaactgatttgtaacccctcaattggctaaccggtttctccttcttttctactccctccgtaaactaatataagagcatttagaacactattttaataatctaaacgctttaatattagttgacagagggagaatttccggatgcaccgctgctgctgctttcttcttgtgatgttggtggaaggctgagacgaagctgtccaggcaaggaatccgcaaggctcgaagaagtagctgggttgcttctatatccggaacattctcggtccgaggatgctgttgtccccgggaagagctggagctcctgaggccgtgatgcaacctgaccagaaacaacagagtgatgctgctgattctgcactggaggtagtgtgtttgttgggggcaccatgcgcatggtgcttacattagaagtattgctccatatatcatgccgcgttgggtgagttgctaaattagcagtgcagctgctccctattggatgtgacaccccaaggct

SEQ ID NO: 2885 - DNA, 329 bp, Hordeum vulgare
gaaagaaaaaaataaaataaaataagaggagacagccccctctcctcgcagatcttcctcgtctccggtcaccatgaactcctactccggcgaccggtcctcctctcgtcccaccacaacctccttcgactcctaccagtttgacttcggtgccaacgcctcccgctcctccacctcccgccccctccgcgaccagaggccaggcggcgccaccaacccttcaccgaggccaaccaccacaaacacatggtcacaccagccggtgaagacgtcctggacccatcagccacccccctccgccgccgcggcgctcggatccgggcctatgc

SEQ ID NO: 2886 - DNA, 558 bp, Hordeum vulgare
ttctaagggtactatacaaattaacaatatatgatgttacaacatggaagacgatggaacacagtgaaggtttcgaaccacaaagtgaactattaaagttcaataaaatatatgatatacaattcatatcaaagaatatactgtgtgtgaagatgcaatgatgtgcttcataacaccaaagttgtaaattattacccccaaagccagaagttagtaaaacaatttgaaataactcacagtttccgtgtcaaggatgattacgatggtggtacataagggaacgtgacaagcatccctagtcagccattttgttcaatcgatgaatcatactcctggcaagacgattcccagggtcaatcttcagaacaaaacgcaggtcctcagccccaagcctatatttctcactactctcatataagagagcacgttgcactagcaccgacacattatccttatcttgctcgagcaccttcgaacagtcggcaatagccttcttgtactcgccgacctccttataggaggaggcccttgatgacaacacctctgcaataccagcat

SEQ ID NO: 2887 - DNA, 540 bp, Hordeum vulgare
  UNSURE (4): n stands for any base
gggnctgcaggcaattcggcacgaggcaaacaagagaccccccacccccctctctcctccacctccgtgctcgccgcgagaagccgagaaggaagagcctgagaaggttgcatcatggcggaccaactcaccgacgaccagatcgccgagttcaaggaagccttcagcctattcgacaaggacggcgacggttgcatcacaactaaggagctgggaacagtcatgcgttcgctggggcagaacccaacggaggcagagctccaggacatgatcaacgaggtggatgcagacggcaacggcactatcgacttcccggaattcctcaacctgatggctcgcaagatgaaggacaccgactcggaggaagagctcaaggaggctttccgggtgttcgataaggaccagaacggcttcatctcggccgcggagctccgccacgtcatgaccaacctcggcgagaagctaacggacgaggaggtggacgagatgatccgcgaggccgatgtcgacggcgacgggcagatcaactacgaggagttc

SEQ ID NO: 2888 - DNA, 556 bp, Hordeum vulgare
  UNSURE (36),(37),(53): n stands for any base
ctgcaatcagggttcatacgaaggggggccaagtgnnttgcagattcacacangaaagaaagatgtttcaatgacacacgggagagagacagggtagcaggaggggaggaggattccatgaatgttcttcagcaactacgtctactagtacgcttcttctggttcggggcaaagacaaggaaacgagagccgcattccttactactaatatgcatagcacaatttcctcctccccggtaaataataataccaccgtccaccggcacatcggcgggattacttggccatcatcaccttaacgaactcctcgtagttgatctgcccgtcgccgtcgacatcggcctcgcggatcatctcgtccacctcctcgtccgttagcttctcgccgaggttggtcatgacgtggcggagctccgcggccgagatgaagccgttctggtccttatcgaacacccggaaagcctccttgagctcttcctccgagtcggtgtccttcatcttgcgagccatcaggttgaggaattccgggaagtcgatagtgccgttgccgtctgca

SEQ ID NO: 2889 - DNA, 926 bp, Hordeum vulgare
  UNSURE (1),(11),(866),(923): n stands for any base
ngtcccccggngctgcaggaattcggcacgaggcactactgcacataataagcactgaaacatcatccacgcaacaaacacgatacaaatttgaaggaagcctaacaattccaggtcacatatgcatagccctgctgcatatgcattcacccctccaaggtcctcactgaataaagttgaggcagcccaggagactcaattaaaagcttctcgcgacgtaaggttgctaacgcgatggctactaaagcaaaactcggacttcgcgaactgaaaactgttaaagcggacctagcctttgcgaagcagtgctggactcagctagaagaagagaacaaaatgttgcgcgaaactaagcataaaggggtcaaaattgaacaggatgatgacctgatcccgcatgcaactggaaacgttactggcccataaatcaaggctggcacaggagaactccatgtatgcccgtgaaaatcgctttctgcgtgaaataggacattttcaccagttcgccgcccacaatgtggactcctttggcgatggcaatatgaaagacagcaagctcgaagaagataccaatcgtgcatacactgaaaacatgtttacggtgggtgaagcttatttagctcaggaagaagtatctcccgtcccctccatgccgaactctgctatccttagcccaggcgagtcatcatccgcagcattcatcgtttctgtagacaatgatgctgattcgccgaggaacgtctcgaagccaaatgagttgctgtctgacatagattgctgcgtgccggcttctactctgctcgttgggcttgcaatggtctaggtgtgagctgcgcgcatacattgtgaccatctgatgccacatnctttgcaggtgcaatgctattagcaggttctgctttgcgtgagaaaacagatacggnctt

SEQ ID NO: 2890 - DNA, 336 bp, Hordeum vulgare
gcccgtatactctttatctcacacaaaagcagaaacctgctaataaccattacaactgcaaaaggatgtggacaacagaatggacaaaaatttatgcacgcttctcacaaccaaacccattgcaagccccaacaagcagagtagaagccggcacgcatcaatctttgacagacaccaactcatttggcttagagacgttcctcggcgaatcaacaacattgtctacagaaacgatggatgctggggatgatgactcgcctgggctaaggataggagagttcggcctggaggggacgggagatacttcttcctgagctaaataagcttcaaccaccg

SEQ ID NO: 2891 - DNA, 554 bp, Hordeum vulgare
gtccccccgggcctgcagggaattcggcacgagggtacctgctaaccactgcacccctctcttttatccatatagctccatccatcactgacgatcgatctcagtccacctgcatctgtaggtgtactagtagtacgccggcctaatccagctgagagctgatcgagctagcttgcatataccactgcacgtacgcacatcaaattaattagaaactactgtaattaagttatcagcagcgagaagagaacgatcgatcaacaccatggcttctgctttctcgtccaccgttggagctccggcgtcgaccccgaccatcttcctgggcaagaaggtgaagaactactaccatggtggcaacaagatgaagagcagggtggtgagggtcatggcggccaaaaaggaacttgaccagggcaagcagaccgatgcggaccggtggaagggtctggcctacgacatctcggacgaccagcaggacatcactcgggggaaaggcatcgtggactccctgttccaggcccccatgggcgacggcacccacgaggccatcc

SEQ ID NO: 2892 - DNA, 553 bp, Hordeum vulgare
  UNSURE (29): n stands for any base
ggttgttgggacttgggaccctagcttgncatccattggagaaatggattaagcggaaaatgacgatttaagaacatatacaattcctttctctttcaagaagagacttacaattgggttacctgtgcggcgatgaatcaaaaagtttgagtggatttcgggtccaaaatagtccaacatatatatagtgcatgcatgcatcttaagtagagtaggaccttctacttgccgtagaaggcaccggtcttcatggcgtcgtcgttggcttggccgagcgccgcctcgctgaggtacttgtcggcgagctgcacacgcttgacgttctcctgctcctggaccagcatgtggccgtactccatgagcttctctatggtcatcttgggctggtcgaacgtgggcggcccctccctcgagttgacgaggcgcttggagatgttctccacgccgatctcgccgacccacttgcgcacctcgtcgtcgtacacccgtgcccgcagcgcgccgaagaagtcgatggactgccccgggaaggtgtccaccagcctcaccacgg

SEQ ID NO: 2893 - DNA, 515 bp, Hordeum vulgare
caaaacactcgactcaaatggcagccctggactatcttgtttctgtcgctagtgatgtttttattcccagtaatgatggaaacatggctaaagttgtcgaaggacaccgcaggtttatgggcttccacagaaccatacagcttgataggaagaagctggttgagcttatagatctttttgaagaccaggagctgtcatggaatgaattctgtactgctgtcaaggagctacatgagggccgaatgagccagcccacgagaagaaaagtcatcgctgggcagcctaaggaagaagactacttctatgcaaatccttatgagtgccttgggcctgctagaaagagaagggaaaagctaaaacataccgaggcatgaacactacactcgggtgcccgattgatcggtatagagggctggagttaacagtggtaacacgggttgacagctacatctagatgctcatcctaataacctgattagctgactgcagtaatggcataccaagcttcagcagcc

SEQ ID NO: 2894 - DNA, 552 bp, Hordeum vulgare
aaagcagcagtgcatttttcattcgaggggtttgaagcaaggtttatgtacatcaaaagcaaatgctgcaatctaacactacaacatagcatctggtgccgacccaagagaagttagatctacatctacagttcactcacatgtagcacttgcagctgagtaagtccgcatcatcagaaaacctgaacaagtgggaagcctttatcaagcctctgggtggcataagctcctctccacctcccatgttgatcatccaatacagaagaatactctgctgagctacatgttgcacatgcacagcagtgttacaacttcatgagtggagactcgacgaaaaaatatgagcacgtcttaggtggtacatgaggaggctgctgaagcttggtatgccattactgcagtcagctaatcaggttattaggatgagcatctagatgtagctgtcaacccgtgttaccactgttaactccagccctctataccgatcaatcgggcacccgagtgtagtgttcatgcctcggtatgttttagcttttcccttctctttctagc

SEQ ID NO: 2895 - DNA, 549 bp, Hordeum vulgare
gtttcccgggctgaggaattcggtacgaggggagcctagcagctttaacacgttggcccgctacgctactctcgtcctgtccaccaaccgaaactcacagctccgagctccgcctccgactccacctccggccacggcgagcagtcacgcaccatggcgccaacagtagagatcaggaatctcaccttcacctatccgggaatcgacggcaagccgccgcccggagcaccgcccctcatcgaggacgtctgcttctccctcgaagccggtcagcgctgccttctcgtcggctccaacggcgcaggtaagacaacgatactgaagatactaggcgggaagcacatggtggatccgagcatggttcgggtcctgggaaggtcggccttccacgacacggcgcttacttcctccggtgacctctgctaccttggcggcgagtggaggcgggatgttgcctttgctggctaccaggtgaatatacagatggacatttctgcagagaagatgctatttggtgtcactggcgttgatcctcagagaagagatgag

SEQ ID NO: 2896 - DNA, 543 bp, Hordeum vulgare
ttgctgttaccgccaaaatccctcgagcgtggtgtttaggactgtttgaactgagagaaaagtgcagtgcggggatactaccgaagaacgctgtttgaactgagagaaaagttctcttcaccggctatcgtcgaagtgagccttcctgctgcccacccgttgttcactactctgctcccctcaatgaccttgtcgaatgccgggaggcctttctccttccgctcctttctcttcctcctgtcttcgtccctctcttttctcagccagcgctctactgttctcatgagcgataactggctcatttctttcaccttttctaatggcagcgctagttgcaacttcccatgagcaacatagacaatgtgagttggccaatcatccaggccatcgaagatatgtgtggcatagataattgttgcaccttgttccgcacattccttctttagatatgtcaacagatttgctcttgccaacacatcaagatcaactgttatctcatcaagaagaagaaccttgaatggcttgagaagtcccatgcaaatc

SEQ ID NO: 2897 - DNA, 520 bp, Hordeum vulgare
  UNSURE (513): n stands for any base
gtcgaatccatcgaggcgaggaaacaaaagagaggttagggttccgaatggacgatcctagaaggttctagaacgtacgctcgttgtgaggcctcggggcagtgcgctgcggtggctgatggaggaggagaaggctagggggttgtcctcggcgtcctcgccgctgatcccgccgacatcctcggagatcgacctcgaggccggtgccggggaccagctccagtgccggatctgcctcgagaccgacgggagggacttcatagcgccctgcaagtgcaaggggacgtccaagtacgtgcaccgcgactgcctcgaccattggagagcagtcaaggaggggtttgcattttctcattgcaccacctgcaaggctccttattacttgagggttcatgtccacactgacaggaaatggcgaacgctaaagtttcgtttctttgttactagagatatattattcatctttgctctagtccagtttgtgatctctgcattggcttatttggtacattntattgat

SEQ ID NO: 2898 - DNA, 512 bp, Hordeum vulgare
aggtgttttacgtttccgttttacatgtacagaggacccatgatatcgcaccatgttgggctgcgcaaattgcgatacaatagatgccctgcaatcgtagtatgtgcttcctgtacagctggggaagtgcatagtgctggtcctcaacttaaggtcaatggcatgggctataggagtcccagggacttgagctgctggacgtgctcagcagggagtggtggcggagaccaatctgcacgttcaccgtcaacatcttccacaacatactcctttgttagcattcgtttggcaaggatgtggtagtgtctttgccagatcctctgccctaccatagttgccaccagaacgctatagaagatgccgacaaccgtgaacagcccaagcacgattactcccatgatgaggaacaatggtaaccctgcttctcctgcacctcccaagcaaccaccgcactccccagctgtagttgcacaaccttcaaagcatgtggtgcagtcagtccacatgcaaag

SEQ ID NO: 2899 - DNA, 1612 bp, Hordeum vulgare
  UNSURE (9),(10),(12)..(18),(20),(21),(533),(706),(1181),(1394),(1430),(1434),(1520): n stands for any base
tgtttgttnngnnnnnnntnnggttattgattttctcagtcacccagaagtccctcccgggttctctgaatagtatatagtcgggcagggagagggcttatggtctctcgtatcacggctacgaagggcctacatgttccggttacgctatcgcgcagtcattgagcaggactagcccatagtacacattggattatactccactcagtcatagtataggctggcgtagcaggcactggaggtgctggctaatggatcctattatgcctgtagcagctcagccacgtgcgctagatatacctagataggcgaccttctcggacacggaataacagagcgatcagcatagcctacgcgagccgcttggtctcatggtatacgagccggaccctagcgtagcgtagccaagcaggagagagcccgtcccggatagcctctcataagtacacatacaccccacatccagcaggtctcatagacctctatacgagagggtatcggccctgggcgcgcgccaactctcccactctatnttgtcgtagcctatggattctagcacatttcgtatcccgcgcagggctcctgcttgctttcttgcgagagatgagcatccctcgcccggctctaatcgcccgtacacggtcaactttgccctaccttgctgccgatcagtactttattattcgtggccattccctatgttccncgcgcatgagtatcattcatttacaaatgagagattagttagttgccgtaatcattgcacttcattcggtcattccataggttctctcgatcataatgctggcctctcgaaatacctcctttgatacactgcagtacctcaatgagcaggctaattgcatcggggtgctcactgctctctttgtagttcacaactttatgtaaccttgtgtctgtgttggagcgagcagtgcctccagttttgcgtgaaagagagagtgagcccgttagaggttcaggtcactcgtcagcctcattgtattaacacctatacgcgcggaaggcaagaaggcaacagacagcttgtatatatctaccatgttcaccaaccctcaccacaccccccagagtctcgaagggcaatgaagttcggcgctccgagaggcgtcattgcctatagttatatatacaacgatcatagcgcaataaagtaaggnattagtattcattatatatgcacacggtacagacctaggataaatacctagatacatgattcatgtacttaaggcgtagcattgctcgtaataatgttttgacacagatagaaccttaattatatacgtacattatcgagacgacatatttcatatacactcatgttatgcacataggataataaatatattcgtatctcgacgttcgttctngcagataactatatattatgaacgaggtcgtgagantaancacagacggcgacgatgtgacgagtacctcactgagtacgacgcgtcactctcgacatcacgacgtgtaatagtgtattgtgtgtngaacagtagccaatggattcgagagatcgtgtctatcctacctgttagttataggagctgatatagcgtgttctagataagctgcgtcgttg

SEQ ID NO: 2900 - DNA, 549 bp, Hordeum vulgare
gctcttgagtcatggttgtactgcattgcataggagacaaaaatattgtgtacacactacaaaccaaatcaactagaagtatgatcgatggacctagctagtcgttcgacacacctgaagtacaatccctttccctatatatttttgaccaataatttgtctaatttggacctatcttgtgcaataggccccaataattgtttttcaagtcaccacttggccgtatataattcagactgatggagtagaagtagtatcgtgtgtatccaccgtcagttcatccgatccccatgttagaaatggagcagcggctggcccagtgacccctgcaaggtgttgttgccgacttggaacgttgttgcaccgaagcaagaactgttgggcttcttgttcgtcacggccgccgctggctggctcgtcgacccattatgttcaccgtcctcctccgacagcctcttgcgcttcccggccgcaccatcgcgtgccaccgacgttgaggctggtgaatccatctgcccaagctgcgacatgttgttgccgctgctgttc

SEQ ID NO: 2901 - DNA, 552 bp, Hordeum vulgare
ggatccccgggcctgcagggttctgatgtcacctcactcccttctttgcgttcatatttcttcagcataatgaactgtcaggagatttgccttcctttttttctccaggcctcattacccttgacctttcctataactcctttacagggcaaatgcatacaagcttgcaaaatcttactcagttatctatcctgaatttggcagaaaattctttgtctggacctattcctgatctcaaacttccaagcttaagacaattaaacttgagcaataatgagctgaatggctcaattcctcccttcctccaagtattctcaaatagctcattcatggggaaccctggattgtgtgggcctcctctagctgaatgttctattcttccttcgccgacaccctcgttaccaccgtcacaaatattgccacgacgtggaaagaaagtggctactggatttatcattgcggctgctgttggaggctttgctgtatttctgctagctgctgtggttttcaccgtgtgcttttcaaagaggaaggataggaaagaagcgggac

SEQ ID NO: 2902 - DNA, 555 bp, Hordeum vulgare
  UNSURE (6),(7),(15): n stands for any base
aaccanngtgtcgtncaattgtacacaacaatgtctgatcactgagtgacaaagcccacgagcagaggcaacgtattaagattacatgttaaacagactaccaattaacttgcacgcatggagtatcggcacagttataaggatacaacaattgttcatggaatacaagccagtgcttgagctgcttctggacgaacaaaccccgatggagggtcgccagccacacccagcattacgccgatggaggattggaatccctcgggttttcattggaagaggcacggctctcggaagcggtgaactgccggaggtcctcgatcatcctgatcacctctgccatcgtggggcgccggtccgggaaccgggacgtgcaggccatggccagctgcagcatctgcaccagttcatcctcgatgttatggtacttcatcagcgctacgtcgaacacctcagcggtccactcctcccggaccacggaatgcacccacctgggcaggtcgatcacgtcttcttgcccctgcgactggaggggggcttttccagtcagcatctcca

SEQ ID NO: 2903 - DNA, 1251 bp, Hordeum vulgare
  UNSURE (779),(1102),(1207),(1219): n stands for any base
tgggggggggggggggggggggcggcgggggcggtttgaggtggggtttttatagtacatgaggcagatttttagaagggttagagggatttgcggaatgacagagacaattatctctggtagagagggaatattcgtgtggatggatctacagtttatctatttctgtttggttgtacccctcgggccggcgatgaagaccaccaagaattgttcttgctcgtctattcgcactaatataaaaaagaacaaaaggatagcgaaaaaagattgacaaaaaaagagaaaataggaaagatgtaaaataaagagagaaataatagataagacttcagggcagatgctattttccactctttcttccgtttttttagccgccattgaggtattagactatatgtaaccgcagttgtccgtgtacttagatacgtataagacccagccacaataataagggaacggggagcacataaaatcgatcagatgtctccgtaccccaacctgtgtgttcactcattgttgttgacgaactgactcgcccgtgattgtctataaaaacatgcaactatcaacaagataagctaggttttgtaccccgggagagggcgtgggtggaagccatggtaaggtaatatgtgtgaacgcgtaccgcggaattccgcgtccgggtgtgggtcatccgtgtcgttcgcgtatacggtcttatgccaccacccatcaagtttatctagtttactgtttgtttttcctctctacacgggtacggtttttaaccctcncatttaggacgtgaacaccatagggatactcgacggagagaagcgacaatgtttacacgacgaattgatattgcgcccaccaatccggatataacgaaacgtactaggcaagtattgtacctcgtgctttagcgacagttaccgaccggatagcggacctcttgtcgcacttccggctctactctctattataatacagcctatagtcttataattcgaatgattcctgtatttcgagcaaccatgtgaaggagatagaatgaaagcgcgtatatataatagagtggtatcaccagtgcgcagagttctatctagttatacanagtagacggaatgatgaatactacactaatacatgcagaatgagatgtcgtcacccaccgcatagtgaatacacgcgcaatacgaaggtcatttacactacattncatcatcgacgnctgatgagagacataagtgagaagtcgtcgag

SEQ ID NO: 2904 - DNA, 461 bp, Hordeum vulgare
  UNSURE (12): n stands for any base
tttttttttatnccagctgaatgggcagcgtccgtgtggtagtcaaacacccaagtggctcatcatcaaatgtatgcaagatccaaccatcacatatttcagatatacacaagaaattctgccacagaccacaacgtaattaacatgccacagcccttgttttctgattgattccaaagcatattagcagactggactcctttcccttatgttttccttgaaggaaacagtaggatattaccttcttaacacgtactgtagttgatatataacttgtctccttgccactctcaaagcatcgcacggctgtaaacgccacacagtatgagtggcagctgcgtttatcaacctttccaggtatccttgatgttcctgaccgtcctcagcgcttcaactgccgacttggcaccgaattttgcctgtatttcagggagatcaacacgcatgaaggtgtttatctc

SEQ ID NO: 2905 - DNA, 517 bp, Hordeum vulgare
ggggatccaaggagggcagggagggaggattctccccgcggacccaataaaagaaacccaatctcgcctcgcccgagaccagagagttgtttaccgcccctccatctcatcaaagggataaataaagaacaccattgccagaaagccgcaggcgttaggtggtggtggtggtggtgcgtgccagtcaaagaagaggtctgggagggaggaagaatcaacatccatccatccaccaacctactcttcctcctcctcctatcccctcccattctcgccacgccgcgccgcaccgcaccacgccgacgagagggtcgaaagggggagccttgctcgatttgattcccgtgtgatccttggttgattagagatgtgcccgctgagggtgatactcatcttcctctccgccaccatcgccggcttcttcctcctccggggcctcaacgccgagccggacctgttccaggacgacgcagccgccgccgtcgcggggaacgacgacgacgacgacgaggggtcg

SEQ ID NO: 2906 - DNA, 551 bp, Hordeum vulgare
accaaatggcttacttgcattgccgcatttggacatcaacaaagtggaaacaatgattcaaacacatgcaaatttagttcgatacccatacaccatactcccagggtcccaccatatatgaatatgacacacggttcatacgtaaacaatttggcacatttactccaaacatacatcaacccccatgttacaacttacaactgccgccgcattacacacaagatgtaaccaaaacagatacaatgcaaatcatccccattctggcactccagttaaacaggtaatgaatgttcgtcaccgggccttctcggattcagattttgccggtggtgcaacaagggtcctccaaaggtaccgcccgcttgccatgtccaccatcgtccagaatcctgtcttcgcggcagatgcgaccttggaatggagcggcgcgggttccctgggcgacccctcgtcgtcgtcgtcgtcgttccccgcgacggcggcggctgcgtcgtcctggaacaggtccggctcggcgttgaggccccggaggaggaagaagccggcgatgg

SEQ ID NO: 2907 - DNA, 404 bp, Hordeum vulgare
  UNSURE (4),(12),(32): n stands for any base
gggnctgcaggnaattcggcacgaggtggatntcattgttcttccaaacgggatcacaagcaagatgatcatttccctaggatgggttctaggccgacagcttgggatagcaaggatggacgtcgtttttctcgtttgatttcgccgttgccggaccctgctcttctacatggtgactgaatgtattgatgtattgtgatgttcatgattagcttgtggcgagtgtaatccaattccatatactcatatcttttgtacatgtagttgtaacaatatccattccttcaaaacaacgagatgcactttcatccctatcgaggccttcgtgcaaaaataaggttaggattccatcttcggtgttacacttcaatacaatgatcgtcacatcttcaaaaaaaaaaaaa

SEQ ID NO: 2908 - DNA, 359 bp, Hordeum vulgare
gtgtgacgatattgtattgaagtgtaacaccgaagatggaatcctaaccttatttttgcacgaaggcctcgatagggatgaaagtgcatctcgttgttttgaaggaatggatattgttacaactacatgtacaaaagatatgagtatatggaattggattacactcgccacaagctaatcatgaacatcacaatacatcaatacattcagtcaccatgtagaagagcagggtccggcaacggcgaaatcaaacgagaaaaacgacgtccatccttgctatcccaagctgtcggcctagaacccatcctagggaaatgatcatcttgcttgtgatcccgtttggaagaacaatgaatcca

SEQ ID NO: 2909 - DNA, 370 bp, Hordeum vulgare
gtggcgtgctcccgcacaccttcgccgccgcgtgcctcgtcggccgtgccgcctcgttccaggccggcgggcgcccagcagacgccatagcagattgcaaccgtgcgctggctctcgaccctgcgtacatcccggcgctccgcgcccgtgccgaccttcttcagtccgtgggggcgctcagcgattcccttcgtgaccttgaccacctcaaacttctgtacgacgcggcgctccgtgacggcaagctgccggggcctaggtggcgaccgcagggtggtgtgcgctaccgcgagatcgccggcgctcaccgcaagttgatcgcccggattcaggggctacgcagccgcgccgccgtcggcgaggggtgtaa

SEQ ID NO: 2910 - DNA, 330 bp, Hordeum vulgare
ttttttttttttttttggcaaccaaaaaaatttcattcacctccacacaagagatacgtactacaggtacaagacaagatgcgtcgctctctttttttctcctcccagaaccacaaaactgtacaatagcgagttccatcgaataaattcaaacgccccctgctttttcccgccagcttccagtccggcatcctgtgtcccgaccggtgatccgtccgcctccgcaccgcatcagatcgcacctgctgcccggaacccatccccatcagcagctcatcgcctcgcatttcaccgggagggagcggtcgaacccgctgcgggacagcaggg

SEQ ID NO: 2911 - DNA, 517 bp, Hordeum vulgare
  UNSURE (6): n stands for any base
caacgngctgtcaaggatgccattgtacctcttgtgatgccgtttatagagggcaatataacaaagcctgactggcacagcagggaggctgctacatttgcatttggttccattcttgaaggtccttcagttgaaaagcttgcacccctggttcaagctggctttgatttcttgctaaatgcaaccaaggatcaaaataaccatgtcagggagactactgcatgggcactttcgaggacctttgagtttctacatgcaccaaccagtggtgtttctgtagtgacaaatgcaaaccttcctcatgttctagaaattatgttaacaagtatcaaagactcccctaatgttgctgagaagatctgtggtgccctgtattttcttgctcatggctatgagaatgcagggtctatgtcatcagtgctgtcaccctattttggtcagttagtgtcagctctccttgccactgctgatcgttctgattccaacaactccaggctttgtgcatctgcatatgaaa

SEQ ID NO: 2912 - DNA, 554 bp, Hordeum vulgare
aaagcatcggtatatcccactaatcgctggagtatagggtgagtgtaacagttccacaccatcagcgacaactttactgacgagcaatggtgccaacaagacacagatgctgcaactacaatcgactcacatggacacctgaccaaaatgcaacagaaacccaacccactttagacaatggcaagccgctgccactattacgaacatgacaagcataaatgatctcctgcgacctttgtcttgcgacataataacatgagatatatgcagcacatttcacaataacgtttcatctggcaagagaagtagtttgcccagagaaccatcaacaacgctgaacgatccagataaagaaccagcagctttactggagaggctttcgctcatgaaaccagcacacgtgagatcacaccctggacccaggatgcagtctcccttagctgttcgtcatcagactgggagcagcgcccaaggagctccgagtggaagtttgaattcttgagcagcagtttgatggaaggtcctagcgcatctgcgaggtccccgaccaaggc

SEQ ID NO: 2913 - DNA, 329 bp, Hordeum vulgare
aactagcaagggatctccatccctccctctcgctcggtctgccagatgagatgagattggctggagagggactggtgcggaggagcgagcgaccgagggttccatttcgtctccggagggctgctgtgctgagtgggtgccccgtcgccgtcggctcacgctacgcgctctctttttaatgccccgccgccgcactcgcctgcacacaccctccccttcttctccagcctgctagctgctgcagcactgagtcttactggcctctcttccgtggacctggagtgatcaccaggttattgtctgcctatccactacaccgcaagatgtcg

SEQ ID NO: 2914 - DNA, 261 bp, Hordeum vulgare
ttttttttttttttttttttttttttgcccggcggtggtgacacccattaataaacagtagataaaaaagtcaggtttgaagacagcaacaagtcctaattaaaccacatccaaaccgggtgggtatccgtaccgtatcccactatgcagcagcactacgtatcccatctgcttgcttttccagatccaacgactaggcaaattatagtgaagacaagtcactttaatacagggcgccctaccatgcaaccgcaaataggt

SEQ ID NO: 2915 - DNA, 520 bp, Hordeum vulgare
ctcggtcatctttgtgcttaccatcggcaccggggtgtacgtgttcacgctggacccgatgtacggcgagttcgtgctgacgcaggagaaggtgcagatcccgaagtcgggcaagatctactccttcaacgagggcaactacgcgctctgggacgacaagctcaagaagtacatggacagcctcaaggaccccggcacctccggcaaaccctactccgcgcgctacatcggcagcctcgtcggcgacttccaccgcaccatgctctacggcggcatctacgggtaccccagcgaccagaagagcaagaacggcaagctgcggctgctctatgagtgcgcgcccatgagcttcatcgccgagcaggccggcggcaaagggtccgacggccaccagagggtactcgacatcatgcccacagaggtccatcagagagtgcctctgtacgtcgggagcgtggaggaagtggagaaggtggagaaattcttgtcttcagattagaacaagaatgagggatacaca

SEQ ID NO: 2916 - DNA, 549 bp, Hordeum vulgare
ctccaatccactggaattctttaaatagatttccggcattacaaggaaaaaggctatattataaattagatacagtacagtaatttcttcgaagaaacagcgtgtgtatccctcattcttgttctaatctgaagacaagaatttctccaccttctccacttcctccacgctcccgacgtacagaggcactctctgatggacctctgtgggcatgatgtcgagtaccctctggtggccgtcggaccctttgccgccggcctgctcggcgatgaagctcatgggcgcgcactcatagagcagccgcagcttgccgttcttgctcttctggtcgctggggtacccgtagatgccgccgtagagcatggtgcggtggaagtcgccgacgaggctgccgatgtagcgcgcggagtagggtttgccggaggtgccggggtccttgaggctgtccatgtacttcttgagcttgtcgtcccagagcgcgtagttgccctcgttgaaggagtagatcttgcccgacttcgggatctgcaccttctcctgcgtcagcac

SEQ ID NO: 2917 - DNA, 516 bp, Hordeum vulgare
ccctagctagcctcgcatcccgcgccatcccaccctcgccgccgccgccgccgccgccagatggaagtcgacaaagctccgatcgctgcgacggcaggcaagtcttcctctgccgccatggcggtggacgcggccggcggcgtggagaagccgcggttcgacgctctgatgccaagcgagatgagcggcgggcggccacagtaccgcaaggtccaggtgccgccgcaccgctttgcgccgctgaagaaggcgtggttggatatctacacccctgtctacgagcacatgaaggtcgacatccgcatgaacctcaaggcaaaaagggttgagttgaaaacaaggcatgatacaccagatgtgagcaaccttcagaagtgtgcggactttgtgcatgcttttatgcttggatttgacattgctgatggcgttgccttgcttcgtcttgatgacctgtatgtggattcctttgagatcaaggatgtgaagacacttcggggggagcatctgtcgcgtgcc

SEQ ID NO: 2918 - DNA, 553 bp, Hordeum vulgare
gcacttaaaagttgtttttatataagaacatttatagcacggggacacaaatctgcagatacaacaacttacgaggccaaaaccgcaactacataatgtgacccagactcaactaatacctttctgccaacctagcagatacagccctaagcttagaatagaccttgccggcaggagaacctaagataagactacagagtgaatccctggcaaccttgatgttaacaaaagagccaagtatgtggatcttcgtatcagcaataactatgcgagtcctggtagagttctcgatggcatatttggtcttgcctccttttcccgataggcggccaatggcacgcgacagatgctccccccgaagtgtcttcacatccttgatctcaaaggaatccacatacaggtcatcaagacgaagcaaggcaacgccatcagcaatgtcaaatccaagcataaaagcatgcacaaagtccgcacacttctgaaggttgctcacatctggtgtatcatgccttgttttcaactcaaccctttttgccttgaggttcatgcggat

SEQ ID NO: 2919 - DNA, 542 bp, Hordeum vulgare
  UNSURE (468): n stands for any base
gtcccccggctgcagcattcggcaccggcttttgcttgtccgggcacgccgtgagcgcctgacggtgaggcagctcctcggcgatccgactccaacagtatagaaatccggaatcgccgcgtcgccaggggcatccgcggcgagccggcgagcctttgacctcccccacccccatcttcagcatagaaccaaaaaacccgctgatccgaaccgccgagtcccgtcccccctcccgatccggcgacgatggagggcggcgccgacgccttcgggtcctcgaccgcgccgctggcctggcacgacttcctcgagcgcatgcgccagccttccgccgccgaatttgtcaagtccatcaagggctttatcatgaatttctcaaacagagcacctgatccagagagagatagtgcagctgttcaagagttccttgaaaatatggaaggtgctttcagagcccacactccttgngctggcagttctgaagaagaactagagagtgccggtgagggcctcgagaagtatgttatgacaaagctgtataa

SEQ ID NO: 2920 - DNA, 542 bp, Hordeum vulgare
tgcgctgattaagaaacccatgcaggtacataaattactctgaatattggcacgaataatacctgcccttatggaaattctagttacatagtagtaacagtttacaaaaatggcattcaccacaaaatcaagagccccaaggatcaaccaacaaatgtttggatatggatctagcttcagcagaataaaatgccatcttccttcggtgctgaatatctgtttcccggtttccagcatgtactctacaactgtggtttcaaggatcgcggcatatctgctcaggggaaatatccattctgttccgcggccgctcgcctcttggtataagaacaaactgcagaaggcaatgttctcactgtatttcaccagcttgacccgactgccagctcacgcatgctctggctgatctgatgattcatttttcagtgttttctggtcacgacttggatcgacagcagcttgttgtgtacctgcattgcctacttcttctgagtcgggaatttcatttctaatgtcctcctgagtcttgctgcttgcttcag

SEQ ID NO: 2921 - DNA, 526 bp, Hordeum vulgare
gcacgaggtaatgctcctgttgcccaaaccttcggtagtccacaacagccacagtcaaaccccctccttccagctattcaagcatgtatcgatgcaattacagagcaccagaggcttaacgctctgatgaagggagagcttataaaaggcttgctgccacagagtagcgtccgtgctgattatactgttcacagagttcaagaacttgctgaaggaacgtgcttgaagaattatgattacatgggttatagagatggctatggtaaatcagagaaaaaatggactagtgagctgccaactgactcacaccttcttctctacttgtttgctgctttccttgaacatccaaagtggatgcttcatgttgatccaacctcctactccggtgcccagtccagcaaaaatcctttatttctaggaatccttccaccgaaagagaggtttccggagaagtatgttgctttgatatctggcgttccagcaattattcacccaggagctcttgtgctagctgtgggcaagcaga

SEQ ID NO: 2922 - DNA, 532 bp, Hordeum vulgare
  UNSURE (7): n stands for any base
acacaancattgcatttgaggagtttggacagtcagtgattttaagatacaactcagtaataaatttcaggtgtccctcgactagggcatatcgcattctaacactaggctagttcaagacattgctggtgttgataacaatgtagcaccagcaactgggacagtcataattaatccccttaatggtggtagaaaccagtactacaacagttccctcctggcaagcaaacagcccttcttcagctctccatgtctgaatcaagaacagaaaggatgttcaaggcagaagacccgatgtgggttcccctgacaataccgccataaccaactttgatttggtggcatagaagcaaaatggcgtcccacagtgctgttcttccctgaagagaaaactgcagtttcttgtcccagtatagagcaaaaactggaggactctgcttgcccacagctagcacaagagctcctgggtgaataattgctggaacgccagatatcaaagcaacatacttctccggaaacctctctttcggtg

SEQ ID NO: 2923 - DNA, 241 bp, Hordeum vulgare
ttttttttttttttttttttttttttttttatacaaaatccaagtaaactttatttggtcaggccaacatcctcctttatcaatcaagaatcgagaaggatggcagactattttcacatggtgctccaaaattcttcagcacattattacactcacagaacactaacctcatgttcgacctattggtacaacaacactattgcttcagtatgatacagtttttagagtgcagttgcatcga

SEQ ID NO: 2924 - DNA, 368 bp, Hordeum vulgare
tctctgtcttcatctactgagggttcaaattcttcagctgtggccatcacaactacagaccttgttagcaagagcattgctgtccagactgagattggaggagtgcctatcaagataggaggaatggccaaaggttccgggatgattcatccaaacatggcaacaatgcttggtgttctcacgaccgatgctcaagtgagaagtgatgtttggagagaaatggtccggacatcagtgagtagaagtttcaaccaaattactgtggatggtgatacaagtaccaatgactgtgttattgctatggctagtggattatctggtttatccgacatcctcactcatgatagcgctgaagctcaacagctcca

SEQ ID NO: 2925 - DNA, 473 bp, Hordeum vulgare
ggggatcagcgacgagggagtcttttttgctgtcaaagaagtgtccttacatgatcaagggagcaacgcacagcagtgtattttccaacttgagcaggaaattgcactcttgagtcagtttgaacatgagaatatagtacactattttggaactgacaaagaggactcaaaactttacatcttccttgaactagtgacccaaggatctctcgtatctttgtatcagaagtatcgcctacgagatactcatgtttcggcatacacaagacaaatacttaatggattgacttacctccatgagagaaacattgttcatagagatatcaagtgtgccaacatactggtgcatgcgaatggatccgtgaagcttgcggactttggacttgctaagcagacctccaaactcaatgtgctaaaatcatgcaaaggaactgtatattggatggcacctgaggtcgtcaatcccaagaaga

SEQ ID NO: 2926 - DNA, 360 bp, Hordeum vulgare
caaagaaaacttttgccctacggtcatgcatcagctttgaagttaacaacaagaaggcatgcacttccaggccataccagtcgccgttatcgaaagttccagaccatgccctgttctttactctttgctcccctatgccttgcagttggaacaagcagtgaattctctctcattcagcaccatgcgtatttacatcgtgtcttttcctactttacactaagctcaggcgctcgaatgagcatttactctactccccgggcagaataatattagccggatcaccggaattcggtaaagaatcaactaacaaaacacaagagatgctgctggttgaaaatgctgtttacaaggaccgtccct

SEQ ID NO: 2927 - DNA, 546 bp, Hordeum vulgare
  UNSURE (16): n stands for any base
gtcccccggctgcagnaattcgcaccaggctcgactgcctcctctgcctccctccacttcatccacaccagcaaaagttgttaattttgcaaaggtcaaatactgtcatgaataccactcagaaagttgatccagcggaaccagctgctaagattgctcaacaagcctcacagttcaaacgatggggacgcaagcatccatttgttcgttatggccttccactcatttctttgacagtgtttggtgcggttggtctagctcatcttatacggggaagcaaagaagtaacaaaggaaaaggaggatatggaatgggaggtcgtagagaaaacaaaagctctgagccgaacaggacgggtggaaggggcctataagcctacgaagctctcactagaggatgaactgaaggctttgcagcaaaaggtggacataaacagctacgactacaagagaattcccaagcaaaatgagaacaagtgaaataaagcaccgtttatcatgctaatgagtgggggattttcttaaaagctttggagtaatttcttct

SEQ ID NO: 2928 - DNA, 525 bp, Hordeum vulgare
atataagatgttttgaatatttcaacatagactacataaggactgaaatgagtgaccaaacacactaaaacgcgtgtatacatatgattcagaaaaagagttagaacatcctatgattcgaaacggagggagtacaatttattggccccttgataaggaaggcagtattcgatctgactaaaaaaaaacgcttgggtggaccgtgaacatgctgtctcctgtcgctacacacaatgattcctacggttcaagccttccaaaggatcctcgacctaactctctactgctggtggccgaagaagcacagagttctgatgatgatgtctctgcaatctcattttgacacttggacagcatcccaaggaactcatgaagaaacaggaagaagaaattactccaaagcttttaagaaaatcccccactcattagcatgataaacggtgctttatttcacttgttctcattttgcttgggaattctcttgtagtcgtagctgtttatgtccaccttttgctgcaaagcctt

SEQ ID NO: 2929 - DNA, 518 bp, Hordeum vulgare
cctcgtgccgaattcggcacgaggctcttctcttctcttctcttctcctctcctctcaccacagagcccaggctcagttttatctcacgtctggtcctcgtaacgccccgccgggttctggaaacatccacggctactttcacgcgcgggtcaaagctcgcgcgcccacgcccatgccgccaccgcccgcccctcgacctcccacgattccagtagttggatgcagcatgcccatttctgaacccaccgtagggcatgctccgtcgtccgtgaaccgtcgctagttgcgaacgccacggatccagctgatggtgagcgccggtcaagctggcgcggacggaccttccagcagtgatattagggggatcggaaacggcgccgtagagaatcagaacggccatgccctcaagccaaacgaggacaaggaatggaggggcggcagcaaggaagaggactggcccagtacgcacagtgcgccgccaggcttggacgagcacaagcagcagcagcaagaccgg

SEQ ID NO: 2930 - DNA, 548 bp, Hordeum vulgare
ttgaattcctttatttgcgtcggcaacccctattgctgcctatctctgatctggggtgaattacttgtgcacaagtactatcaggtgaatctgatagatggtagaagacacaagttgtgggcttcaatctccacagcacgcttcgtccatgaactctgagtgccactgccattatcactgccatccctagcattgggcccaacactaaagtcatcatcagcatcatcatcgtcatcgtcatcatgactgccgccactgtttttcgcatattcatcaccagtctttggtttggaacacttttgtatatggatgccactttcacttccactggaactgtggcatctcctccatatgtgctgccaaagggtcttaagttcattcttccttatcggcttcactaagaagtcaactgctccctttgatagacacttaaagactgtactcattgagtcattcttagacatcatgatcacaggaatgcccttacaaatactgtgactcgtgatcttactgagcagaccaatgccagatagacaaggcatggcgac

SEQ ID NO: 2931 - DNA, 518 bp, Hordeum vulgare
gaccgccgccgcctcatcctatcggttccctctccttccttcgagtttggttttgtacccatcagccatgggtaaggagaagactcacatcaacatcgtggtcattggccacgtcgactctggcaagtcgacgaccactggccacctgatctacaagcttggaggcattgacaagcgtgtgatcgagaggttcgagaaggaagccgctgagatgaacaagaggtcattcaagtacgcgtgggtgcttgacaagctcaaggccgagcgtgagagaggtatcaccattgatattgccctttggaagtttgagaccaccaagtactactgcaccgtcattgatgcccctggtcaccgtgacttcatcaagaacatgatcaccggtacctcccaggctgactgtgctgttctcatcattgactccaccactggtggttttgaggctggtatctccaaggatggccagacacgtgagcacgctctccttgctttcactcttggagtgaggcagatgatctgct

SEQ ID NO: 2932 - DNA, 892 bp, Hordeum vulgare
  UNSURE (869): n stands for any base
gtattgcaaaacgaacccgtaataaaattgcatctacacgtataaaattcaacaagctatcaaaagacacaatcaagtctcataacatccaggtttcaccaaagcttacattagaacagtatgtaaaaggcacaagacagacaccaccaagggcacaatatgcagcgctaacagccgaacagctaaaatatacccagtacgaacaatgcccttgacaaaactctagccaacgctaaaaattgcttggtgtctgaaacagtaatttgggtatcaattgtcaaattacttcttcttgatggcagccttggtcaccttggcgccggtggggtccttcttctccacgcccttgatgacaccaacagccacagtttgcctcatgtcacggacagcaaaacgaccaagaggagggtaagtggcaaaggtctccacaaccatgggcttggtgggaatcatcttcactataccagcatcaccattcttgaggaacttgggcagggcctccagctccttacctgatcgcctgtcgatcttggtcaccagctcagcaaacttgacagcaatgtgtgaggtgtggcagtccagcactggagcgtagccattgccaatctgaccagggtggttcatgatgatgacctgggcggtgaagttggctgcctccttggcagggtcatccttggagttggatgcaacaaacccacgcttcagatccttcacagcaacgttcttgacgttgaagccgacgttgtcaccgggaagcgcctccaggagagactcatggtgcatctcaacggacttgacctcagttgtcagaccagtgggaccaaaggtcacaaccatacccagcttgatgacaccagtctcaacacggncaaacaggcacggtccaatgcca

SEQ ID NO: 2933 - DNA, 1159 bp, Hordeum vulgare
  UNSURE (1)..(5),(13),(22),(25),(32),(55),(763),(990),(1065): n stands for any base
nnnnnttgaaacnaaccagacnacngagtcgncagcactacaacacgatgcaggncgcctctttcagaagtgaaagcaaggagaaagaaagaggccagactcaagtgaagcaaaccatgggctctgcaacagtcttggaggtgatcctcgccatcattctgccaccggttggcgtcttcctgcgctacaaactcggtgtggagttctggatctgtctcttgctgaccattctggggtacataccggtgatcatctacgccgtgtttgtgctggaggttcaagcatttttttttgctgtttgttcctgcttttacccctctctttattacttttttactacattttctttctcactcagttccgctgtacatttatccttccccctcatttctttttatattctactttacatcccctctttttttccttcctttccgccttcgtcacccccttgttatcattcgttttcgccgctttacttatcattttttttattgctcgtgttttgcttccgtgcggcgtgctctttgctttgatttctctcccccctgtctgtcagcactcgtcttttcttttttgttcctgtgtgaactatactctatatagcgatgttgctttttacctccttttttttcttttcttttcacacctcggatctgcgtcttttctccttttggttacaccaatatagcgtatgttttgctgctcacttgtctacctgttcgcgtctgtcgccctcattcgctttacttcgtgagaggancgcgttaattctgaattgctgtgtcggcgtcgtgaatataagaaaactaaacattttcttctattgttgatataaaatcgttatgctttcggtttgttataccaaatactctgttcctctcactcctctcttctgcgcgcgcgatctcgttatgctgtcctcgtgtatataagtgtgttgtatgaatttgttatagtggtgttcccctcgtttccattctctttttngtctcagctgacctccacgtatcgctcccgtccgctatgcttctctgtcctttctcttttttttctcatcttacntatcgccggttcgtgcgattgtttttttatagcccgatccgcccggacgatcatattcttattttccgacccctccctcttacttactctctat

SEQ ID NO: 2934 - DNA, 514 bp, Hordeum vulgare
gcgtccatcttaaatttaagatacaaacatgtggccgacgaatgctctactacaaatgccctcgagctagctaggtacactcgtgacatcacaggatcaacaataccgagttccagaaaaaaaaatgaaatccacaatattcaatagatacatgcatacacatactctcttaacccatacatacacgcatacattctctcttaacccatagagcatgagcatcagttgatcttgcacagcgactcgctcgtccaaacgccggaccctgcagcagaggctgttgcttaaaccaccagcacatacaccgcgtagatgatccccggtatgtaccccagaatggtcagcaagagacagatccagaactccacaccgagtttgtagcgcaggaagacgccaaccggtggcagaatgatggcgaggatcacctccaagactgttgcagagcccatggtttgcttcacttgagtctggtttctttctttctccttgctttcacttctgaaagaggcgcctg

SEQ ID NO: 2935 - DNA, 917 bp, Hordeum vulgare
  UNSURE (19),(803): n stands for any base
agtcccccgggcctgcagnaattcggcacgaggaagaaagcgcaaggcgatatctgcagtgactactagcgagatgcgactcagctaaagcgtgaatggcggtggtgtgggatagcaattcaagcgttgtgctgctagactaacactgcactgatgcacagaccctaaagggatcatggccagaagccgaaagcatcactagctaatagctctcacccggatagcagtagcggcacgtggaataccgtgtgaatgacatatgaccacctgaccagggtaactcctactgatggaccggtaccaaacacggaccagaagggaaaggagaacacagccctgactgaggagtgcaaaccatcccatgcccgtgctgctcatcaactcaaggacaggggaaagtgagctctgaccgggggcctgtcgtagaatgaaccgaccactgatagacagggtgttggatctgggaacggaacccaccgaagcctcaaacgaaagcgagacatactaggccgatgtgtcacatggtgattgacccgaacctggctgatcactccatgaccaacaagactcttaccctaaactaaacagagagccgcatccgctgatgttctgaaaccaacggttcacttaagattattgagtgaaatgccactcgaccccatagctggctggctcttcgccgaaatgcgtacatgcctagccataactgtacatctaggctagagtcctctgtatgtgacaactgcacgatctgctgcaaatcgatgtactctctgtatctgcatctgagccataatacaggnagtcaaagtcgcacatactgaccatcgtggagagaccatatcgatgagagctatactgccgggtcagcaactgagaccactaatcaccgctctacgactaaagacggggcggtg

SEQ ID NO: 2936 - DNA, 553 bp, Hordeum vulgare
ggtggagaaatttctattgctacattgactagttgtccagaacaaactgttcatgccgcaaacttttattttcggtgatcaactgatctctcggtgtacactaatccaatgtatattctaggatacaggtttggtacaaaactgcaaactgcttggcaaaaccctgaaatgtgacagacagatgaaagagaggggggagggggatatataagagggccatgtcgttccaaggcaggcatcatgctagatctggtgccaacgcaggtgtactgttcgcggaaccgattggttcttgtagggcgaggttcagcgggaacatctcgcattgagcaacatgtgccatcagctggtccatgaggaccaatgcggccatcgtctccaccattggaacagcccgagggacaacacatgggtcatggcgaccccttgtcagaagctcgatatcctcatgatcccttgtcacagtattttgcttcttcccaatagttgctgttggcttgaaagctactttgaagtatatggtttcaccatttgatatcccgccctgtacacc

SEQ ID NO: 2937 - DNA, 374 bp, Hordeum vulgare
gtacccccgggactgctaggaattcggcacgaggggccactgatgcaatgatcctgggaaagaatgtgttatctgcctctcagaacctagggatactactgtccttccatgtaggcatatgtgtatgtgcagcgagtgcgccaaggtcctgaggtaccagaccacccggtgccccatctgccgtcagcctgtggagcggctgctggagatcaaagtcaacaacaaatccgaagagccgccccagcagacatcccagtcgcctccgctacctccaccccctgctctgcatcaggaagaggtgtagctgcagcctatctcggacagtcgtaaaaacactatatgcttctagattgcggccttcgggccttcctccc

SEQ ID NO: 2938 - DNA, 549 bp, Hordeum vulgare
gcaccctcaggtaaatttatgatacgatagaaatactgagactttgtacaaatctggaggcaccttccgtgcttctttcccccctcccccgacagaggaaaccgggcaggcacgaggcacacccccaaccctgctgcaaacttcttcagctagccaacagcacacgcatgaacgtatcagatgtcctcatctcggcatctgcagggctccccgccggagccagtgagccgcttcgtgatgccagaagctttacaacatgctttacatacactacaggtaactgagacaagttttaacagttacatcccatctgctcaaacgaagcgagcaccctgcaggggaggaaggcccgaaggccgcaatctagaagcatatagtgtttttacgactgtccgagataggctgcagctacacctcttcctgatgcagagcagggggtggaggtagcggaggcgactgggatgtctgctggggcggctcttcggatttgttgttgactttgatctccagcagccgctccacaggctgacggcagatggggcaccgggt

SEQ ID NO: 2939 - DNA, 517 bp, Hordeum vulgare
gaggtgacaacaccggcgcgcctcccatccggcgcattttctcctctccttcccccgtctacacctcctctggcgctgcacccaaccatacctccgctgcgtcataggcagagcaccggctgttcgcctcgcttcctcctttccctcctccggtcaccttctccctctacgcgctgcacggctgcacccacggcgcccgcgcacgcatccaccgtgcccaccatgcgcgtcaccgccaccgctgtacggctcctccgccatcagactgactctcggccccaccttcaagacgtcgccgctgctcaccgcgccattagcggatccccttgctcgcgtatcgccccgcgctgtgtcacagcaaactttcctcagctccgagcgtgtaggcgcagttgggacgcgggccgtctgccgttgtcaccggccagtgtcatccgccatggtcacccaccgtccacccagaatggaccctctgtataccattcttctgcttcgcggcgtccacggcgaggagccc

SEQ ID NO: 2940 - DNA, 373 bp, Hordeum vulgare
cggtgctgtgcagaccattgggatcaaacaaaaaagatagaagattaatcctccaaagcaccacccgaaatccaagactacaacaacagataagtgcaatgcaatgacgtcctgacgggccaatcacaaggagaagagatgctcatgctcttcttcagttggtcctgcgggtgttcattgcgccatagagagggcattgggagacagcagtgatctaaatgcgggtgtttgtaaaaaagcaaacgtaaaaattgaggacctccagcttcagaagcctagcgagcagcagtgagctaaatgttagatgtggcggtgctcacctcgcctttgaatcgggctcctcgccgtggacgccgcgaagcaaaagaatggt

SEQ ID NO: 2941 - DNA, 494 bp, Hordeum vulgare
tgggcagagcgcacaacatgggaagagggtttgaagaaaacaattgaatggtacacaagtaatcctgagtactggggcgatgttgccggtgcattgctccctcatccaaggatgttgatgacgcctggagttgaaaggcataactggactgaggaaatcaaatctcttgcttcttcgccagctgaagccaaggaatgtaacacagtagctgctgcagccacttccaatagcaccagcagtgcccctcagaaggccacctacaaatttttaatatatggtaagactggatggattggtggtctactcgggaagatatgtgagaagcaaagcataccttatgaatatggtaaagggcgcctacaagagcgctctcagctcctgcaggacattcgaaacgtgaagccgactcatgttttcaatgctgctggtgtcactggaaggccaaatgttgactggtgtgagacccacaaacaggacactatccgcaccaatgt

SEQ ID NO: 2942 - DNA, 543 bp, Hordeum vulgare
acctcataaatgggaaaagattttaagatctgttctcaatagataaccaggccaatgaacatatccaccactacatagaacatctggtaatactcaagtgaaacataatgcgtaacaaaaaatcgtaaatatgtatgcctgctgctataccacaatagaattggccacagctgccaccgtgaaatatattagctaattagaaatagcttctagcagacctgtgtcacatgaatcttcaattagtagaaaccttcctgtttggctcaaagacattcttgatcaaagattccttaatggacagtagctcagggaactctgacttcagctttgacgcgtccatttcgttgttgcttcttggtgcaactataaccttggcctgctcttcgagcgtgaagttggtccacttgaagtccgggttgatgtattccttgtacatctccagaatctcgttatgactgacaaccccagggttggtgaaattccatatgcccctacaatcccgctttgccatctctacagagataggcaagagttcatctaaaa

SEQ ID NO: 2943 - DNA, 310 bp, Hordeum vulgare
  UNSURE (21): n stands for any base
ctgctgcaggcaatgccacancctggacaagatcccggattgggcccaccatatccctacaaaaccaaatggggaatttaaaatataccttttttttcatgtacatactcactataacaatgaaatatccacaaaaattatatattaccatatcattttattttccatttttatttctttttcatccttaaaatttatcccttctattataaaatgttttttttacatcaactcttacatatcacaaacttaatattttttaatattaagaaaccatggcataccaaacatatacctaaaaccctaatca

SEQ ID NO: 2944 - DNA, 553 bp, Hordeum vulgare
  UNSURE (15),(35),(50),(56),(63): n stands for any base
gcacggggaatgganatgggttttgggttacaggnacctttgggctgggncccgtnggcgccnctaccccatgggcgcacagagttagagggaattgaacgaatgcaataggcggcaaggctggctagaccacccgacgacgtacgtggacgagcgcttcttcttcttcttcttcttgtgcggcttgttataatcagaaagacagatcgggcgagcacctccggcctccttttaactcctcgcactgtcaccgcgccttcagctgcacccggccacctgctccactttgggaggcagcatgactgtgggcttggagatgatggcgggcacggtgggcacggcggcggagaccggcgggaagtagtgcgcggccgggacgcccagcccctgcgaggcgtggtagtggtggtagtgatagtaggggtacacgggcatcatgccgttgggcgccagcatgcctccctgcgccgccgccgccgggtacgagaagtgaccctgcggctgcatgtagggcccgcccgcgccaggcgccgctgccgcttggcccagcttc

SEQ ID NO: 2945 - DNA, 552 bp, Hordeum vulgare
gtacccccgggtctgcagggaattcggcacgaggcgcaaccatttgtagaggaagctgtgctgcaagtatctgattggggtttcagcttgtcagacattcaaatgcagaagaaagaggatcagggggtgtttgaatttatcaagtctctgttcagtcaggctgagcgagagtgggtgggatttctaggcccaatccacatttggcagggaatggacgatcgggtggtgcccccgtcggcgaccgaatttgcccggaggatggttccaggagccaccgtccacaagcttctcgacgaaggccacttctcgtacttctgtttctgcgatgagtgccaccggcagatattctccaccctgtttggcaccccgcagggccctctaaaccctgtaccggaacccagtgaagtggcccgggaaccgacggaagaaacaagccctgcatacgaagaagaagaagaagaagtcgcagaacaggagcaggaaacatcaggcctggcctgatatcatgttcagcatcaggatcatgagtatagatacaagagtacaagacga

SEQ ID NO: 2946 - DNA, 542 bp, Hordeum vulgare
gactactttacttctgctagctgagagagtaatacaaccatcccattacaccacatactaagcaggtgatttcatgcgcagacctttcaagacttctgtacattatactgaacccgcacaatcggtgcagcagccccccatccagaccccagagacccagagcttccttttatactcgacgctctgctcagtccaccaactatcggtcagcatttgtccaccggcggcaaggaaggaaaagcctatcttttctgtgaggtcggtctgtgttgaggttcctagtaacgtcgtcttgtactcttgtatctatactcatgatcctgatgctgaacatgatatcaggccaggcctgatgtttcctgctcctgttctgcgacttcttcttcttcttcttcgtatgcagggcttgtttcttccgtcggttcccgggccacttcactgggttccggtacagggtttagagggccctgcggggtgccaaacagggtggagaatatctgccggtggcactcatcgcagaaacagaagtacgagaagtggcc

SEQ ID NO: 2947 - DNA, 521 bp, Hordeum vulgare
tcctacgcttccgagcgcgctcttgaagcagcaggctcccacacctctgccttcgcatccgcgagctctgttgcattgccgcagaggaggaccgtcagtagttctttccaccagagtccggatcatggagttcgacgagcgctgcctcaaggtccaggaccccaagttcgactgcctgctcttcgacctcgacgacactctgtacccgctgagctccgggatctcatcacacgtcaagaccaacattgaagcctacatggttgagaagctgggtattgaggagagcaagatcgaaaaccttggcaacctgctgtataagaactatggcaccacgatggccggcctcagggcaattggctacaacttcgattacgacgagtaccacagctttgtccatggaaggctgccctacgacaacatcaagcccgaccccgttctcaagcatattctcaagaacatgcgcatccgcaagctcattttcaccaacggtgacatgatccatgccgtgagagccctcaaga

SEQ ID NO: 2948 - DNA, 532 bp, Hordeum vulgare
cctagcagtaatttacaagcaagatctgactgatcgatacatacctccatatacatatacatatattaggaccggcccggcatggtgtgcatgccgcattaattcctgacttttctgagctcccccctcctcgtgctggatactgttttttcccggccaatgctgaattccacgtgatgatcaccagtagtccggcaggctcggggacgccgggtcggatcgggttgcgcttggggtatcagactgaaggtgcaccgggagccagcggcggcggcggcgtctacgcggtcaccgatgtctcgatcgcgacgcggtcggcgtagaggacgtcctccgtcttctcggcctcctcccacagctccggcagcgcctccctgatgttgtggatgctctccagcgcgtgatccgcgcccttcacccggtgtgacgtgccaaccagcaccgtgtggaggccaattcgcttgcctgcctgaatgttgcgcacgctgtcgtcgaagaaaatcgccttgtaagggttcacgttggcgatcct

SEQ ID NO: 2949 - DNA, 519 bp, Hordeum vulgare
gccctccttatttcttccccttgagccaaaatctggtcctaagtttcatcggagagggcggcaagggcgatccgtttagcgcgagcgcgaccatggcctacgtcgagagaggtgttgtgaaaggcaaacggacaatctggagactaagcataatccccgacttctttaaggctgttgtgaacttcatcagaatgttcttcctcacaatgttttctatcgagaaaacagacagctataagaaaggatatggtagtggtaagaagtgggatggtggacctggtgggggaggtcctggtgggggtccatatggcggtggaggcggcggtggaggtggccctcgcggtcctcgcacactatctgacctccgatcaaacgatcagagttccctccctgcttgtggatcctgctgcggatgacatcttaacgaaagaagacatttaatgacggaagaaccagatgaactcccctatttcagtttcagcagagcaaaaacgctgtcaagagtttagcatgtccagt

SEQ ID NO: 2950 - DNA, 558 bp, Hordeum vulgare
  UNSURE (15),(21),(22): n stands for any base
ggataaaactatttncctagnnttgaattcaacatatagccgaacaattccaatctccgcagaattacaaagtggacagaaggtatagtaaattcacattgcacaacagaaagccggtataaggagattttgactctatccaggacagttaagcatggcaaagcgatgatgaatacagtatgcaaatcacattagaaacaagctacagaatatatactggacatgctaaactcttgacagcgtttttgctctgctgaaactgaaataggggagttcatctggttcttccgtcattaaatgtcttctttcgttaagatgtcatccgcagcaggatccacaagcagggagggaactctgatcgtttgatcggaggtcagatagtgtgcgaggaccgcgagggccacctccaccgccgcctccaccgccatatggacccccaccaggacctcccccaccaggtccaccatcccacttcttaccactaccatatcctttcttatagctgtctgttttctcgatagaaaacattgtgaggaagaacattctgatgaagttcac

SEQ ID NO: 2951 - DNA, 551 bp, Hordeum vulgare
  UNSURE (21): n stands for any base
gtacccccgggtctgcagggnaaaaactccccggagtaagaattgcttttgttggagatggacctacagggctgagctggaaaaaatgttcacaggcatgcctgcagttttcaccggaatgctccaaggcgaggagctctcgcaagcgtatgccagtggggacgtgtttgcaatgccttcagagtctgagaccctcggacaagtagtgctggagtccatggcttctggagtaccggttgtggcagctcgtgctggaggcatacctgatatagtacccaaggacaaggagggcaagaccagcttcctcttcacacccggggatctcgacgagtgcgtgaggaagatcgaacagctcctctcgtcgaagaacctcagggagtccgtcggaagggctgccagggaggagatggagaactgcgactggagaacggcctcgaagacgatacgcaacgagcactaccgcaccgcgacgttgtactggcagaagaagacgggtagaacggggtaggcgtcgtttatcaggccaggcactccgtttgctgccctgccta

SEQ ID NO: 2952 - DNA, 547 bp, Hordeum vulgare
gtatgtcagtactgctacagcggccggtcaatcatccgtaacagtggacatatgagtgcagctagccatacaagctcgcaagctgctgctggggtacaatgtacaaatcctttggttgtataacagtaggcagggcagcaaacggagtgcctggcctgataaacgacgcctaccccgttctacccgtcttcttctgccagtacaacgtcgcggtgcggtagtgctcgttgcgtatcgtcttcgaggccgttctccagtcgcagttctccatctcctccctggcagcccttccgacggactccctgaggttcttcgacgagaggagctgttcgatcttcctcacgcactcgtcgagatccccgggtgtgaagaggaagctggtcttgccctccttgtccttgggtactatatcaggtatgcctccagcacgagctgccacaaccggtactccagaagccatggactccagcactacttgtccgagggtctcagactctgaaggcattgcaaacacgtccccactggcatacgcttgcgagagctcctc

SEQ ID NO: 2953 - DNA, 518 bp, Hordeum vulgare
cccaatcttgtgaagctcatcgggtattgcttggaggacgagcagcggcttcttgtttacgagttcatgccgaggggtagcttggagcaccatcttttcaggagagctccacatttccagcccctctcatggaatttgcggatgaaggttgctcttgaggctgccaggggacttgctttcctgcatagtgatgaggctaaagttatataccgtgatttcaagacctctaatgtccttcttgactcggaatataatgcaaaactctctgattttggcttggcaaaagatggcccgagtggcgataaaagtcatgtttctactagggtcatggggactcaaggatatgctgcgcctgaatatctcgcaacaggccacttgaccacgaagagtgatgtctacacctatggtgttgttcttctagagttgctgaccgggcaacgtgctctagacaagaaccgcccgcctggacagcataacctggtggagtgggcaagaccttacatcaacagcaagaggag

SEQ ID NO: 2954 - DNA, 553 bp, Hordeum vulgare
atgccgatggtgctgcaaatatataaaacaggcgtcaggctgacagcagagtaacaggctaatagctagctgtacacatggcagacatatattctacattctcttgacagattcaaaagctagcagtcttcccctcaagcccggcatctcttcactgtttctactccctgaagtgttgcttacaaggagtgggcgatgctccacagaggtaaatgagtacacatggaaccagcaaccttcccctacttgtatgttttcttcacctccggaagcttttgcagcacggtcacgacctggtccatgtccggcctgcaccgggcatccattgataggcactgcatcgcgagcgccgccgccttctgcgccgcgggaagcgaatattgtgaccccaaccgtgggtccaggacatggatgaccctcctcttgctgttgatgtaaggtcttgcccactccaccaggttatgctgtccaggcgggcggttcttgtctagagcacgttgcccggtcagcaactctagaagaacaacaccataggtgtagacatcactcttcg

SEQ ID NO: 2955 - DNA, 494 bp, Hordeum vulgare
  UNSURE (10): n stands for any base
aagcccccanaatcaatccctcgcccttccgcttccaacaccatccaaatcgtcgattcattccaccaacccgagtacccgatcgacaatgtcgctgatccgtcgcagcaacgtgttcgaccccttctccctcgacttcttcgaccccttcgacggcttccccttcggctccggcagcagcaacagcggcggcagcctcgtcccgcgcacctcctctgacacggcggccttcgcgggggcgcgcatcgactggaaggagacccccgaggcgcacgtgttcaaggcggacgtgccggggctgaagaaggaggaggtgaaggtggaggtggaggacggcaacatcctccagatcagcggcgagaggaacaaggagcaggaggagaagacggacacctggcacagggtggagcgcagcagcggcaagttcctgcgcaggttcaggctcccggagaacgccaaggcggagcaggtgaaggcgtccatggagaacggcg

SEQ ID NO: 2956 - DNA, 533 bp, Hordeum vulgare
ttgctgatggagtacatagtacagactgacgaacaaactggactggaaacacagacacgagagactcaaaacactggctgcaacatcgcaccattcgcacacaacactaccgcgcaaacacagacggccggactctgatttcattttatttcatcacgacgaccactgctctgcactctgcagtcgccagtccatctcatggcgcagcgagcacgccgacgcctagccggagatctggatggacttgacctcgggcttcttggcctcctctttgggcacggtgacggtgagcacgccgttctccatggacgccttcacctgctccgccttggcgttctccgggagcctgaacctgcgcaggaacttgccgctgctgcgctccaccctgtgccaggtgtccgtcttctcctcctgctccttgttcctctcgccgctgatctggaggatgttgccgtcctccacctccaccttcacctcctccttcttcagccccggcacgtccgccttgaacacgtgcgcctcgggggtctcct

SEQ ID NO: 2957 - DNA, 541 bp, Hordeum vulgare
  UNSURE (4): n stands for any base
gggnctgcagggaattcggtacgagggtacaagatgcagacgacttacggctggcagtgaaagaagttatatgtgacaaccaaaccgagcgtcaaaagtatgaagaggcaattatagccattacagtggatgaatctttgaaacgatactgccaaaggataaggcgacctgatttttggggcggagagtcagaactcttggttttgtctagactgtgccggcaaccaatcattatttacattccggagcgtgagtaccgcggacggggcaacgggtttatcccaattgccgagtacgggttggagtttaccaaagactcaaaagaggggaagaaacgggtgccggtgaggctattatacagcgggaagaaccactatgatctgctgatataaaatgggcacatgagacacgtccgggctaagcatcagacagaataccggcagccacaccgcccatccgtggcacatatataaattcccgttttctttccatggttacattcttcgatcctgctaattaagctcttgttcttcggttatga

SEQ ID NO: 2958 - DNA, 544 bp, Hordeum vulgare
  UNSURE (61): n stands for any base
gcggttacaggcatcataaccgaagaacaagagcttaattagcaggatcgaagaatgtaanccatggaaagaaaacgggaatttatatatgtgccacggatgggcggtgtggctgccggtattctgtctgatgcttagcccggacgtgtctcatgtgcccattttatatcagcagatcatagtggttcttcccgctgtataatagcctcaccggcacccgtttcttcccctcttttgagtctttggtaaactccaacccgtactcggcaattgggataaacccgttgccccgtccgcggtactcacgctccggaatgtaaataatgattggttgccggcacagtctagacaaaaccaagagttctgactctccgccccaaaaatcaggtcgccttatcctttggcagtatcgtttcaaagattcatccactgtaatggctataattgcctcttcatacttttgacgctcggtttggttgtcacatataacttctttcactgccagccgtaagtcgtctgcatcttgtaccctcgtgccgaattc

SEQ ID NO: 2959 - DNA, 468 bp, Hordeum vulgare
aacaaccaagtacctagatgaagtcgtgataatgcagtcgacgaggctcatattagatacagttaaaggagcctgggctgtgataaagccgtgcagtataggagaagttcaaagtactctgagaacatgcaaagaagaagtcaatatcttagatgtaaattcttctgggtcaactggtgccttcttgagttttgtgtgtgactatcttgatgcagtacagctcattgttgaaatatggcgtttcgttcagttggatgattctcatgcttttggccccacatcacttgatattttgctagagaagttggatacatctgtgagaaggatgaaatgttgttatgctggattgaatagagaactggaggttcaagtcttggattttggtttgttagctattttatgtagactgtccgagtttggaacatgttcaaaactaatgctagataagttgcattggataattaatca

SEQ ID NO: 2960 - DNA, 552 bp, Hordeum vulgare
gctgcgtagaagtgcagaacacaacattatatattaaattatatgtgcacaaggttaacattggcatctgcagcctctaattcagcagcctgataaaattcacagaatttccaattcttcaatcatatgccaaacccttacatatacatatggcgtgaagtaaacataccctagcaacagcagcacatcttagtggtcgagaaactgctttgttcttgcttactgctaccaaaatatcagtgcaaccgaactcttactcaagagttcttgcgagataacatttcttctggccacatgccacaggaaaattcttgattcataaagaaaacaactaaccagtttgatctgataatacaatgaaacaactaatcacatgaaactcctcatttgtcactactggtatcctaactgctttcccatattatacttgatcgcagttaatgttagaacacggtggtgcagtcgatcaaaggggtttaagagggcatgctgaagaacatggagcacatgacccctatcatttcgaccatggcctttgatcggtatcagcac

SEQ ID NO: 2961 - DNA, 519 bp, Hordeum vulgare
gggcgccctcaccgcttccggggcgcgctcttactcgaccccagtggcatttccccttgcatcctctcgtctcttttcaaccgacgcatccggcgccgtagcgggatcacaggacgactcatcgtccggcgaaggccatacctatggaaggttttacactaatatttctggtgtcggccgtcttggcaagaacatgctgaagactgacattatccattaccttgaccaatgtgaactgtcactggatgatgtgaagattgattacaacaagggattttatcccatgggcgcattattgaagtttccttcagtggaatcatttgaggcagcactcaggcaaacaattcagggtcgcatgtacaggcttgagagggtgagtcctgatgtgtgggaacacaagatatctttgaatggaaaagctgtactgttgcaaggagtccctcgaagcgctcaagctgatgacatagaacgtttcttgtgcggcactaactatgaacctcctccatttgaaaactttgt

SEQ ID NO: 2962 - DNA, 555 bp, Hordeum vulgare
tttcatttagttagattaacttcgtttaactacttctgtataacaggaaacctgcaagctaagcacaagcacaaggtccaggttgacaacaaaaatggtacaataaagtggcagagaaaacccataataaatcaggttgaatggagtctctatcacatgcgcctataggcttcacatcctaggtttgatgggaaggaggtgatcacatgataatatctgacaaattactgaataacccgcatggtaacaggactgttcagacagaaacccttgtttttagcaatgaaggcattggttgcatcagtcctcgagccgaactttaccagcaccattcttacaggctcaggaaccccagctctgacaaagttttcaaatggaggaggttcatagttagtgccgcacaagaaacgttctatgtcatcagcttgagcgcttcgagggactccttgcaacagtacagcttttccattcaaagatatcttgtgttcccacacatcaggactcaccctctcaagcctgtacatgcgaccctgaattgtttgcctgagtgctgcc

SEQ ID NO: 2963 - DNA, 944 bp, Hordeum vulgare
  UNSURE (879): n stands for any base
tgacccccgggtctgcagggaattcggcacgagggagagactagtcgagttttttttttttttttttttggaggcacagaattttaaacagtttttttggaaaggacataaactcctgggttaaacaccgggacccagttggcccacaggggaaaccaaaattgataaatccgggtttcccgggggtttgaacacagaatacagagggttaaaatggaaaaaaaagagaagggtttcaaaatttccagcctaaaagcccattttaaagaggggggcttaatcggggggtttaaccacccccttgtgttttttggcccggggcctggggggtttgccccttttttgcccctttgaccgaggcccatttgataaaagggtggaagccccctttttctttaaaaagttggaaaaaagggggtttgcaaaaaaggatcccttcaaaagccggttaattgggggggaagggggcccaccctccatgaaagcttttaaagcaggatttggggaaaaattttttttaaatgggaactttttaaaaagggtttgctgtttaaccaaaggggggccatttgtcctgggttcaaaaaaaaatgccaacatttttgtttggggatttatccagttaaggagtaaacttgcccgttgaaaatttcggggggaattggaacgggaaccttttattggagttccgggtttctttgaaagttgcccaaaagggggtttgaattagggccccctttcaaacgaggagtacttgttaaaggaaagggtggacttccaggggggacacttgaacaggcccggtgaaaaacggcccccccggtggaaagctgtcacaggggtaaaccgtttggggcaaactttgcacttttggtgggncccgtaaacaaggtcccccccgcccccggggttctctttttcccgattttgattttggctgcccc

SEQ ID NO: 2964 - DNA, 501 bp, Hordeum vulgare
tatgacatcaactccatggttcaacaacgtgatccagctagcacacaaggagatacgaaattgatagatcctggtatccccggagcttgaacacagcatacagcaggttacaatcgtaaataaagagcaaggcttccaaacttccagcctcaaagcccactttaaagatggcagcataatcaggaggattcagcagccgcctgtgctgtttgtgccgcggcctgtgcggtttgcgcctctgctgcgcgcttgaccgatgcgcacttgatcagatggttgtagctccccttctccttgaaaagctgtgagaaatggtgcttgcagtagaggatgccttccaaagccgcgtaattggagggcgagagggcgcagcctccatgagagcatttgaagcaggacttgtggtaagacttctcttcaactgtcaccttctcaagagggtatgctgttttaccacaagtggcgcacttgtcctgcgttccagaaaacatgccagcagct

SEQ ID NO: 2965 - DNA, 559 bp, Hordeum vulgare
  UNSURE (22),(27),(31),(32),(48): n stands for any base
ggtactccccccgggccttgcnagggnattnncggcacgaaggcaaanccacagccacactcgagttcgtatcctgccgccgtctccgcccgtccgccgtagcgtcccccccggtgagcccgcctccggatctctgcaaatgtcggagaggaagcgccgggcggggacagatgcggccgaggggggctccacctcgaagaaactgcgcggcgcctcggccgccgcatcctacgcccaatccctccgctcgaagctccgccctgacgcctccatcctcgcctccctccgcgccctcgcctccgccgcctccaaatccaagcccgcgaccgcctcctcagccggagcgaaagccctctccgaggacgacccggcctccgcctcctccaactacatcgtggtcgccgaccaggacaccacctccgtcacctcccgcatcaaccgcctcgtcctctccgtcgcgcgaagcatcctggctggccgcggcttctccttcgccgtcccctcccgcacctcctcaaaccaggtatacctcccggacctcgaccgcatcgtgctcctc

SEQ ID NO: 2966 - DNA, 539 bp, Hordeum vulgare
  UNSURE (57): n stands for any base
tcccagtatgccagataccttccaaataccaggtctcacaagtacacaacatacggntttttcaaatacataaaacatacaaagggattgccgcacagatgttacacggtacagatgaggtattgttaagctagctccccactagtgtcaaattgatgctcctcgatcaagctgctctttctctgtatcatctgcagctgctgtcatcagaagagatcttaaatccagtcctcctgctgcagcttgaggggtagatatacctcagtcaggtactggaacccaaacgagctgagagcctgaatctcagccttctgttttgttcgcaacatcgtctccaactccttcacccacccttcattttgcttcacgaagtcttcctctagcatctcttttcccaccttgatatcgtgatcactcatgggaagccggcactgctccggtaccctgtacttgtccagatcacttggccgcacgccgagccacttgatatccggcgttgtcagattggcactgtcatacgacatgttcttcgagccaca

SEQ ID NO: 2967 - DNA, 534 bp, Hordeum vulgare
agcaattcggcacgaggactgtgtacaaacttgcaatggatgatggcagcgtttttgcattgaaaaggatagtgaaaacaaatgaagggcgtgataaattctttgatagagaacttgagatattgggaagtgttaagcaccgtaatttggtcaatctccgtggctattgcaattccccttcatcaaaactgttgatatatgactaccttccaggtgggagcctggatgaagtgctacatgaaaaaactgaacagttggaatgggaggcacgaattaacataatacttggagctgcaaaaggcctggcttacttgcatcacgattgctcacctcgaataatacatcgtgatattaagtcgagcaatatcttactcgatggcaattttgaatcacgtgtatcagacttcggactcgcaaaactactagaggatgaagaatctcatatcactacaatagttgcaggaacatttggctatcttgcgccagagtacatgcaaagtggcagggctaccgaaaagacggacgtctacagtt

SEQ ID NO: 2968 - DNA, 551 bp, Hordeum vulgare
ggcaagttagtctccttatttaaataacatataacagtctgtagcgtggcatatagatacatacaaatcgcaaaaatgttgtccccgtagaaccagcctgttggagcccacccaacccctcggtaatgcatgcatttacaagaatctgcaaagaataaatggaatgtgcctccacagggtagaagagtggttggtgcgtctcaatctggatcgtagaactgaagccagcagccgtggttctgtagcctactctgaatcgtagaaatcgctaccgcacggcgtaattacatccgactccagcatctgtaccaccctgtgcatcgtcggccgctcctccggcaaagagctcacgcattgcttggcgagagagagcagggcgtccagggtctcgatctgcacgccgtcgcaatccggatccacgatctcccgctctctgctctccccggccaagaagtttagccatcccacaatgttcaaccccttctcgatgaatgacgcgtcggtaggccgctttccactcagtatctccagtaccaaaactccaaaactgt

SEQ ID NO: 2969 - DNA, 520 bp, Hordeum vulgare
cggcggcctgagtctgccagcgaacgcccactgggagcaggttccagcgacgctaccggtgatcatcttcacgctggtctaccacgacatcgcgccaggtagcgtacgtgcccaagagaaaccacgtgctgccaccacgccagatacacaaagcgttcatggtacagtaccaaccaaaccaaaccaaaccagtactgaacataatgcgttgcggttggcgcatgcagtgatctgcgcgtacctggagggggacctcgcgaggatccggctctcgatcctagtcgggagcctggtgccgctcgtctccctgctcgtgtgggacgacgtcgcgctcaccctctccgcctcctccacggaccccaacggattcggcatcctcgacatgctggagacagagtggagctacgtggtggtcgagaccttctcgctcctggctgtcgggacgtctctcatcgggaccctgcttgccgcgtcgcagttcttcatcgagcagatgaccaatctaaccacctccttagcc

SEQ ID NO: 2970 - DNA, 514 bp, Hordeum vulgare
  UNSURE (21): n stands for any base
acaataaggtggtaaaagganaagttatgtacactgatacatatggtttgcagggggtctccgtttacaactttacatcacgcgctgaatcccggatcagcaaaccatgactagagacattctcgattattcagcacttgctactctagctagcccatgacagcagataagcgttaaaactgacaaggtcttgcaagatttgctggaagaccatgagtacagagaacacccccatccccaccagcacaggctttgcaccggtgaagcccactctttctttgccagccctggatacttctacttgtccaaacccagcttttttatcagataatttggagccaatggaccaggccatcagtggagggagaacaccgtacaagatggtcatgcagtagcccccggcgatgtcagtggctatggagaatgaatctggaacagcagctgctatcagcatggttgggacaaccaccacccctgtggcaacgtagctgatcttgttgttttctaggaatgt

SEQ ID NO: 2971 - DNA, 1861 bp, Hordeum vulgare
  UNSURE (9)..(20),(22)..(25),(30)..(32),(35),(42),(43),(55),(218),(470),(594),(638),(714),(718),(739),(814),(823),(1036),(1085),(1129),(1134),(1164),(1237),(1245),(1249),(1255),(1315),(1316),(1322),(1329),(1331),(1371),(1474),(1509),(1538),(1579),(1581),(1664),(1710),(1779),(1787),(1794),(1802),(1806): n stands for any base
ttttttttnnnnnnnnnnnntnnnnttttnnnttnatttttnnttgttattattntttatttagtgtgttgtctccacgcgggcgctctagatataggaactatgtatcgttcacagcgtggggtgtacatgatgttctctaagtctttagccgcgaaccgatatatcagtacaggacatccagcgtatgtgtcagaacacagcagagcaaatagtcncaccatcaggcccagtcatagtacagacatgtgagagatagagtaatgtatgtatacagatagagattagtatgatctgatatgatgtagtcatgtcatgtcatgccccattgacgcgatatgtatgtcattcatatgtcgtacagtgtgacttgttatctaggagcacagatctatgtatgtagtgtagactagttatagtaagtatagtcatcatcttgtactctgcgcagttattatcgtgtatgtcanttgatataatgtgcagatcgagatcacagtcgcacttcgatctatatgtcatcatcagtgaaagtatatcactcgcttttgcatcgcgtgtagcctgtgcagttatacgcatagtgtcatagcntagtgaggtataccatatgatgtctgtatgcctgccagacgaangtcgttgatctgtgtattatctatcgtagatgtgtacgtgagtagagttagcaccgtgtcaagaatgtcactgatngaanacgtaacgcgtccgctcactntagcggaccataagcgtacgcaatctcatcgcagtgaggtacagctagacatcagacatcaacagcatagcgcancagcaccancaaggacaatgagcaccgtggacacaacgcacaccaatcggcaccgtcggtcgagtagtaatgcggcggtgttgcgtatacgtctcctggtacgtgttgttgtacatgcatgaaccgtgcaatacaatagcggtctgagcttctcgtacaagcgctatcgtatatgatgaggtcggtcacagtgatctagtgtacttgtgtggatataagctntggtgtatgtggtatcaacaccgtatatagtacttcgtcgtctggaacnttggaaacagattaacacgtctttgacggcggtcacacgtttgnatttncactcttgtattagcgcgtatttcagaacnagtgtatcaaatacctctcgatatattctctttcctttatattcaccagacacatagtgctacgcacggattngtagggangctnaccatnatatctctcgatatagctccctctggtgtagtgctagtatcgctgtgtgcgtcttgtgtnnttctcnctgcgtngntcgacacagcacgtctgaccggtcaacattctctttactnttaaccataacgcatgaagacgtctgactagtatatactagatctctcacatttcatgatattagttggtaacgacatatactatttatatttgagtatctcnctgtgcatctgatatcgtctaatatattagtcgtncgcgtcgtctatctagtgtgtgaggtttntcgtgttgtgtttgatagtgtgtctgcgtgtgtattgattntntgttgtttgtaggagatctgcgtgagtgtcacatagtctaacggcgatagcgcgaggtcatagtgggtctgctgtgtttgagnagacagattggcagcgtgattatctgcatacatcgtgtctgctcanttagtattcggatacaaatatgtcataacacatatcatgtatgtttcttatcatattatttacatagcngttgctgntacatantgtacagntgtnctaggctgctagtactactcgtcttattccatcttcactagatcaatgtcatact

SEQ ID NO: 2972 - DNA, 550 bp, Hordeum vulgare
gattgcaatgtgtcattctggcttggaagccttattcaaacttatatacaccaaccgtgtaacatactgctggagtacttgacgaactgcagcgttgcattccgtcagtttccaacaaaccatagcaaagcatgaatgctcgtgatcagataaaaaacacaaccacatgcaccgcttacggagaggccttatgcccactctcctacagtactatttaccttttatatgcgcgcgttgctactcgctcggcggagatgccaccgcgggcgacggcaacagggcggacgagccgggcatcgactcgtggacgacggtgctggtggagaagaagatcggttcgccgctcagccgcagcatcacggccccaaggacgtccgtcagcagcttcttgaactccgcttcctcgaccgccttcccgtcgccggcgtccgccaccttgagcgtctcgtccacgacggcgtccacccgatcaacagcgccatggggtggcaggcttgctgcgtcggccatcttatcgagcgcgacccgcaggtgctccttgtccttgggc

SEQ ID NO: 2973 - DNA, 516 bp, Hordeum vulgare
atcggcccttgaaagtggtgtggaggcacttgagtctggagaaaaacatgtgatctgatggaagccatcaagcataatccattggtaccctttacatttcctaaaatggtcactgttggatcgatggttatattggtaacatatggacttatcaacttcctcaagttctttgtacaactgaaaagtacactgaatgcacgtgacttctactataatagtcttaagattacagatctcgagatccagacgatatcatggcccagaataatcgagaaggttgtcctgctacaaaagtctaaaaaactctgtgttgttagggatctgtcggagcatgatattatcatgagaataatgaggaaagaaaattacttgatagggatggtgaataaaggcattatctcatttccaattcgtccttggcttcctggtgctggtccaactgtcaaatctcatgtacacgacagaagaaaccatgtggtacttccaaaggccctagaatggaccttaaattggtgc

SEQ ID NO: 2974 - DNA, 552 bp, Hordeum vulgare
  UNSURE (12): n stands for any base
ggcctcactggngtacctgcttcgaggtattattcttacgggaaggccggccggcgtgcggtcgtaggcatcagcagctactccgggtcgttcgtcgtcgccgtccttgcgaaggacatcggcgaaatgaagacccagcccttcctcgatgtaggagtcatccatatacctcgtcttggacaaggctcgtggaggatttctccagctgctggtgctgctgcttctgttatcgccctgctgcagatctccctcgcttccctctgatatatcaccactgtggtggctggaatggctattgcctgccatattgtgatatccaaatgctggaggctcaagaaaactgccttgcggatcaaggggagatgcagggccctggttccaccagttgcccgcggaactgtcttcgttaccatcgtgctttgtagaagcttgctgaaacaaagtgcttgatgtagatgctcccatatgactctgaacccttccgtacagatcagagtaataattttcatcctcttcaagctcagatgtttcccttgctagttgatttgagtt

SEQ ID NO: 2975 - DNA, 373 bp, Hordeum vulgare
agaaggaaaaatcaatttacccactctgaacatgttgagcgttgatgtgacgaagaaatgcttagttggtgagggctggagtccagttttcgcaactaatcaggttcaggatgcacttcagcgtgctactcttgagagcaagtcccaagttggctcgatttttcaggttcttaacacaaaagagtctcctccaacatatttccagacaaacaaatttacctcagcattccaggaaattgtcgacgcatatggggtagccaagtatcaagaagcgaatcctggtgtatacactattatcacttttcctttcttattcgctgtcatgtttggagattggcgtcatggaatctgcatattacttgcaacactctat

SEQ ID NO: 2976 - DNA, 558 bp, Hordeum vulgare
cttttattacatgccttatttatatcacgaatgcacatcatccaaagagcaaccacgagtacacaactcgttattagcattacgccaaaataagggtaatgccactagagttttgttgccaaacgtccacaaaaaaattcctacccttcgtgtaatccacatctaaagaaaaatgatgctgcaccaccctcattcgaacaaggggctggggttttatgattgatccgtgacaaataatgactgttctggcaacaaggccacccgcaagatattacagagactacaatagatacaagaatttggacgagctcactcttcgtcctcactgattagcgcaaacgagaatggtgcgaacttgtaaccatcaccctcatagaacttgttctggaactccacccagtggagcctcaaggcatgaaggaatgcacttagggtctccataacaagcaacacaccgacagtagcgcagatgaagacaacgacaccaatagcaaggattaaaatgttgttgtaccccagcgtcaaaatgagaactttatcatagaacacagtggacaa

SEQ ID NO: 2977 - DNA, 1123 bp, Hordeum vulgare
  UNSURE (18),(521),(522),(524),(639)..(642),(657)..(659),(674),(676),(677),(680)..(682),(689),(693),(695),(709),(710),(714),(734): n stands for any base
taccgaataataaatttnccagaaccccaaaaataataccgccatcaaaatgtggggtcgtgtgggtcatcaggcgctggatctgtgttaaaatatatcttggacaatacaataacgtgtgggaacgaggacgggttgcgcgctgttgttgctggggcgatggcagggaggtgtgttggagaaaattggttgtgccgttattaaaaaagaaaagaaggagtaagtgttatgggatagaacgtcggggagaaattgatggttgccattgactgccgcatgcttcttgtttttcaaccagcaaaaccgtttatttactttctgtgcaggccggcccctccgctcccttttggtggaatcgaacgccgccagtttatgcggccccgccctaccttttcacaattttcacccacccccttcaccaattccactataatcatacccagatccctaatataggtccaacaaccggcgcccccccatagccggcctataattccctatttttgaagttatttctcttnncnaaggtaggtgacgggctccttcttcgcgtggagtgataaattcaagaggggggggtggccacgatagaagcagtcgtaatggacccttggtttgccaaaaccacccaacaaaaannnnttggggccctaatgnnnccccccctagataantnnccnnnccaatgnattngnatttccccaacccnngagncgtgatccggaaaatccaanaccctctttccccctcgtcgtacgttacctttatattaggggtttctggcccggttgccgtgaacctgtcctggcattccaccagttccctttcttttattatcaaaaactttcgcgcttttttacaccagtagacgccactaaatgttatcctattttggtgaaacggcgtttgggtatcgacccaattttttatttcccggtcttatattttttcttctgctacattcattccagcaaagcgggcggcgtttccgcattctttccgcgtgtgcttgcgcggctcttttaccgccgttttccacctctttttgcggatgggaccgtggggttcgtttttgccaagccgtcaattgtgtgttcaatacttgacactggtgtgtatgttg

SEQ ID NO: 2978 - DNA, 551 bp, Hordeum vulgare
cttcataaatgtaatggaacttacgttttcgctggaaattcagagtgtacagaacaggttgacatttacaaagcacaacagtatatacaccaagtcaatctcatgatgttggctattctactgtaaggacaacagattatacggagagtaaggtagcgcaaaaaatccctgtcctatgcccgaaaaacaacaaaagaatcatgtattgtcaacgacagttaatgtctttcaaacattgctatacgacactatgacctaagcacagatgccgttttcgctgccaatggcgcccacctcacgcatcttgatcacctggaagcatattgagggttattgtggttatgctgtgcttccatctgacagtcctgctctgactgtggagattcatcataatcttgaatagttaaagtaagttccccgtcttcgccaaaccacagttgcatgtcatcaaagtctggtagagcaggcatgtcagcaaaaatgtccccggatgaaccttgtgtgttgaggttgtctgaggtcgtttcagtgtcgatgtccatgggcatgtt

SEQ ID NO: 2979 - DNA, 521 bp, Hordeum vulgare
  UNSURE (34): n stands for any base
gcaattttcctcccccaaaatcctccagatatangccctaccacacctcagcaaactctctctcgcgcgcgaagcgtcgactctgctggatccccccctttacctggacatttgactccccccgaatttcccatcattttgggtttatcgcccatctgtggcggcagctcgggatagggctcgcggggatgaggctgcatggggacgtgtcggatgacgaagaggagggtgcggtgatggatccggcactgctgtcgtcgtcgtcgctcgccggtgcggcggcggcggccgcgtcgaggctggtggtgggctacgccctcacgaagaagaaggtgaagagcttcctccagcccaagctgctcttgctggcgaggaagaaaggaattagtttcatatcaattgatgaaactcgtcctctctcagaacaaggcccatttgatattatcttgcacaagaaaactagcaaggagtggcagcggattctggaggattatcatgaagtgcatccagaagtcactgta

SEQ ID NO: 2980 - DNA, 550 bp, Hordeum vulgare
ttccgatgttgcttactgtgatgtaatgtttctaatttaactgcataggttaatggtgataattctgtttgatgaaaacatttgagatcaacgagaggaaggtgaccaaactgtcataacaaccctgatttatacaagatcgacacaaggccattcgagtttttcttgtttttgccccctcccccctactcctgatcctgtgtatctggcgccacttctgacaagacatgtaatgccagtttgggacttcttaaagccttgggctccagcttatgtatccgagatatgttcattggtgcagaagtatgtctaccgccgatgtatctcctctagccgtttactctttcacaaacttcccggcgcttcagcctccgctcaagcacctttggtatttgttttgcccaagactttgcaagaaatcggtgaatatgtgctcataaccaggcattttcccatatcctgggaaatagttgatatcaattatatagtaccggtcattagctccaagctctctaatcatatctatgttgaacaatcttagacccagccg

SEQ ID NO: 2981 - DNA, 551 bp, Hordeum vulgare
gtctccccgggtctgcaggcaattcggcacgagggggaagaagattagatgagaaattctttaaggcactattgcatgtccaagaaatccattcgaactgcaaggttctgctgcgaacacaccaccagcgtgctggtttggaacttatggatatgatgtccgtgtaccaagaaggagcttatgaaagattatgcaggtgggttcaagttgaatgtaaaaagctaggtgatactgataatcctgaagtaagtgaacttttgaagaaggctgttcggtgcctgaaggaaaggcctgttctgttcaagtactgcgcagaagaggttgccaatatgaggcatcatgccttattcaggcggtttataagtgctcttactagaggtggacccggagggctcccaagaccaatagaagtgcatgctcatgatcctcttcgttatgtaggcgatatgctgggatggctacatcaggcacttgcatctgaaagagagcttatagctgcgctgcttgatccggatgcaataagtgacagtggtccagctaatcatcgtcat

SEQ ID NO: 2982 - DNA, 549 bp, Hordeum vulgare
acagttcgccctttatatttcttaagaagaaactgcaacctcagtcagattttagtaggtaatatacatcacagtgattcagaacatgaatctcctctcgttacatgtatcaaaaggtatgctgtgtggacctcagatttcgagtatggttcttatctgctccggcgaatgcttgaccaacgatcttgggtcaggataacagttctttggatccatcaccgccttgtagatgagctcgtaagcttctgctagagctctcgccaaaccgtagcaagcgtctgatcgtaaccttggaacctggagctgctcgaattctggcaaggagccttctgtcccagtcacaagaccatagaatgccttcaaacactccagaagcatttgtgccgatgtctccacgacatctgccagaggtcttgcatcatccttgccatcagtagagctgtagttctttatgtatggcatcttacttgacaatccacatttactgagaatgctgtcagcttctttatctactaaggcacgtgtgtgcgtttcgatcatagagcgaag

SEQ ID NO: 2983 - DNA, 518 bp, Hordeum vulgare
gaaaccccgaaagcctccgcccgccatggcgaccgccgcccaggtcgccgccacattcctctccttcctctcatgcccccgtcaccacaccgctccctctccttccgcctccttcctggtgaccccggtattgcccgcctcgctccgggccgctgccgcggggggcccaaccctcacattcggctgccggggccgtcgcgtcgccgtcgccgtcgtcgctcagctccctactatgattccggagctagctagcggggagaagaaaatccggtggtcatcgagggcggtgcgatcatttgcaatggcagaactggaggcacggaagatgaggtacccaaccacaggcaccgaggggctgcttatgggcatactcgttgaaggaactagtgatgcggcaaaacttatgcgtgctaatggaatcacattgctcacggtgcgtgacgcggcagcaacaatacttgggaagtcagaaatgttttacttcagtcctatgcatccaccattgacagaatctgcac

SEQ ID NO: 2984 - DNA, 532 bp, Hordeum vulgare
  UNSURE (5),(472): n stands for any base
tgatntttgaagtgtctccgagggcagtccaacaaactagctgagagtggaacaaaaccgtgttcgtccgaaaatacatcgtgatgtttttacatgtactgcgtttggtaatggtgggagcacaattttggattcggccgagccgatctcttaaaacccctaaaacttatagaagcaatctcttcaagttaacttaatgtgggtccatggtactgcagccgccagccgccaactagtgtctagatgttgccatgtgaacacataacctcagggaagttcaatcataaaccggctgctcggtttgctatctaggactcattgctttctcttctcctgccgttttggccagcaaactggctttctgatcatcaaaaccaagggaagccagaaccttatgaccagccgactctttatctgaccatatcgccaggaacaaatggttggccgttacctccccatcctcacctgattntagtttctcgtttacagcccaatcaagggcacgctgtgcagattctgtcaatggtggatg

SEQ ID NO: 2985 - DNA, 518 bp, Hordeum vulgare
cctcgtgccgttccggcgacgcttcttgctccggagctgttccttggtgccgtgtcgcaggaacagaaggaggagggtgaagttggcaagaagcagcccgatttgaccgctgccacggaggcggctgtcgaagcgaagccgcgggattcgggcgccgaatcttctcacggcgaggttctttgcgtggagctggaggaagagacaagccatcagcatgatctgggtgctgaagttgccccgagtgaagtccctgttgcgggattgcagaagcaggaagttcaggctacggaagctgttggagtgaagcagcttcatctggatgtgggggctgctgctgcagaagttactgatgcaggactggaggaggaggaggagggagcacaagctgctgaagtgattccgcgtgaattggcttccgacactctgcctgcagatgttcttgacgctgtacctgggaagcaggaggagcaagtcattgaagcgaatcagcacgaatcggctcccgttgcggctccaag

SEQ ID NO: 2986 - DNA, 541 bp, Hordeum vulgare
agggtaggattgtttcttaacccttaatctctcgtcccaaacagcgagatgacatactaattaccgcttaccacggatactgttacaaactaaacctgatgataaggttgatactggccgatatacaggcagcaggcggtcgttgtgggatatatacagtcatatacattacacataccaacacccattacagcactaatattagcacaaccacaaacactgtacaaatctaatcttatgaggaaggcatcagcagcgatctcagcaatgcgctgatatcaccgatgcaagaaatacttgatgaccgttacgttcattcggcagggatgtcagaactctgccctttttctgggttaggaggatttgttagtggaccttcatctatgctagtactaccttcattcccttgattgatctgtgggtcgcttgtatgagcagtcattgttaaaagggccccttcagaatcaacgtcaacctcgcgcttctctgtgctcgaggttttgtcccccatccatccaggaacaaattctgacaaaagatt

SEQ ID NO: 2987 - DNA, 359 bp, Hordeum vulgare
ttgagcgagcatgtaactcgtgcaaaaaaagatacgtgcccaattgcgcaaggagcggcaagtccggatcgagagatacaagcagcgtcttgcacttcttttgcctccaccaccacccccacctagcgagccatgatggacctatatacaaaccaactgatgagattggaagtaccatggcttccatgttgcttttgtgttgtcacatgttaagttacagaatctgtagaagcggagacaattccagatgttgcactgttactctgttttagaatttgttccagctgccaaataatcaacattaaactttgcatctttgcttggaaggtttttcttcctgataatctaacatttctttt

SEQ ID NO: 2988 - DNA, 323 bp, Hordeum vulgare
ttttttttttttttttttctttttttttataccatgctagaaatagttcaattgttggtctagaaagattctcaacacatatttacatggagcaaatgttccaaaagaaatgttagattatcaggaagaaaaaccttccaagcaaagatgcaaagtttaatgttgattatttggcagctggaacaaattctaaaacagagtaacagtgcaacatctggaattgtctccgcttctacagattctgtaacttaacatgtgacaacacaaaagcaacatggaagccatggtacttccaatctcatcagttggtttgtatataggtc

SEQ ID NO: 2989 - DNA, 518 bp, Hordeum vulgare
gtcccccgaaagccctagcgccaagcgtcccccactccgcggcggccgcctcctcctcgcgcctgcaagcagacaaactcgtcaagggaagatgagtcaggagacggtcaaccccaaggcctacccgctggcggacgcgcagctgacgataacgatcctcgacatcgtccagcaggccgccaactacaagcagctcaagaagggagccaacgaagcgaccaagactctcaacaggggaatatcggagttcgtggtgatggcagctgacacggagccgctcgaaatcctcctccacctcccgttgctcgcggaggacaagaatgtgccgtatgtctttgtcccttcaaagcaagcccttgggcgtgcttgtggagtgactaggccggtcattgcttgttcagtgaccagcaatgagggtagccaactgaagcagccgatccagagtctcaaggatgccatcgagaagcttctcatatgatttatcaagacctttcagtgtgatgggcctcgtgtgacac

SEQ ID NO: 2990 - DNA, 555 bp, Hordeum vulgare
gaatgagagatcgcacacaagttgccagctcccaattctcaaactcataaaccattttagccattacaacatatcttgagtccagggagaaaattcaactgccataaaacatgtgtcttatggattacacaagtcacgaatataagatggcagacataatggcagcatgatttaacataacagtcttgcaaaatatagctgaaaaacataaaagacctagcagacaagacaccatcaccagtccaagcccctgaaaaactgtgtcacacgaggcccatcacactgaaaggtcttgataaatcatatgagaagcttctcgatggcatccttgagactctggatcggctgcttcagttggctaccctcattgctggtcactgaacaagcaatgaccggcctagtcactccacaagcacgcccaagggcttgctttgaagggacaaagacatacggcacattcttgtcctccgcgagcaacgggaggtggaggaggatttcgagcggctccgtgtcagctgccatcaccacgaactccgatattcccctgttgagagt

SEQ ID NO: 2991 - DNA, 543 bp, Hordeum vulgare
  UNSURE (26): n stands for any base
gtcccccggctgcaggaattcgccgnggcgctgacccaatgtacacgaacgacgaatgggtcatccggttggagttgcttttaagcatcacaagtgacacgaggacctcgtgatgcgctggttcaaaagaaggataaccctcggcctttgcatggagggcagaacggttgttggtgatagcgggaatcttcacttttgcgtgtttagatggtgcttctttttgttgcatcttattgcattgtcaatgcgcgtggattgcacttgtttctcagccgacttcccatgtcaattttttttaggaaatgatcgatcaaattgaccatcaatcgactttaccttggtctagtgtcttttctctgagtgtactctctcgagaggtacttctcttccagttccttctcccccatcgcgttgtcctcattctttttcaatccagaatatagatctctttgccctctcttcgagtctgtcgtcgttatctcctccgagtgcctctatcgccgacaatgcatctccttctagaatttccttcacttgagtgcc

SEQ ID NO: 2992 - DNA, 539 bp, Hordeum vulgare
  UNSURE (2)..(4),(14),(17),(76): n stands for any base
annntgcagcggtncgnaggcaatataggcaacatgataaagtctcgcattcactaacctctcaccattaacaatngaaaacaccgtcactcgtacatccaagattgccggagccgcgagagctaaatcacacaacctggtacccactccccatactcacagtgtcttcccgatgttggtggtgcaaactaaagttgcagcatggccatccatgaagtgttggaggcactcaagtgaaggaaattctagaaggagatgcattgtcggcgatagaggcactcggaggagataacgacgacagactcgaagagagggcaaagagatctatattctggattgaaaaagaatgaggacaacgcgatgggggagaaggaactggaagagaagtacctctcgagagagtacactcagagaaaagacactagaccaaggtaaagtcgattgatggtcaatttgatcgatcatttcctaaaaaaaattgacatgggaagtcggctgagaaacaagtgcaatccacgcgcattgacaatgcaataaga

SEQ ID NO: 2993 - DNA, 534 bp, Hordeum vulgare
agcaattcggcacgaggttgatgtcctcctgtacgttgatcgtttggatacatatagaatggatacattggatgaacaagttataagagccatcactagttcacttgggaaggccatttggagaagaaccttggttgtattgacccatgcccaactctccccacctgatggaatcgactataatgatttccttgcaagaagatcagagtcgcttgtgcgatatatccgttctggtgcaggaatcggcaaaagagaatatgcggattttcccttgccaatagctttggcagagaacagtggaaggtgcaagactaatgagaatggggcgaagattcttcctgatggaactccatggattccaaacttgatgaaagaaatcactatcgttgtctcaaatggaagcaggtccattcatgttgatcagaagttaatcgacggtccaaatccgaacaatcgctggaagaagtacatacctctcatccttgctgtgcagtacttttttgtggtaaaaggaatcaggagggcgattcattc

SEQ ID NO: 2994 - DNA, 554 bp, Hordeum vulgare
ataattaaataactggtatgtagttacaacaataacatttgcaaaattgcgagagcgtaatgaaatggggtacataatcttaacacctagaacactagcaactttattcaagttgtccctgagagctctatagattcccctaaacagaccactggaattaggagcaacaaaagaacagcacaggaagttgaatggaccacgatcaagagactcgcatgcactctcattggcccgctcaggccttagggttgcgggatgacgaaactttttggtctaccgggttaccgcttccaaccagatctctataacgctgctcccagtcatccagcttcccgttcgaaatgtcagaatgaatcgccctcctgattccttttaccacaaaaaagtactgcacagcaaggatgagaggtatgtacttcttccagcgattgttcggatttggaccgtcgattaacttctgatcaacatgaatggacctgcttccatttgagacaacgatagtgatttctttcatcaagtttggaatccatggagttccatcaggaagaatcttc

SEQ ID NO: 2995 - DNA, 517 bp, Hordeum vulgare
gtacgaggagctcgtcgccgcgctgcccaccgacgactgccgctacgccgtcttcgacttcgacttcgtctccgtcgacaactgccagaagagcaagatcttcttcatcgcatggtcgccggcggcgtcgaggatacgggccaagattctgtacgcgacgtcgaagcaaggcctgcggcgggtgctggacggggtccactacgaggtgcaggccaccgacccctccgagatgggcttcgacgtaatcagggagcgcgcgcaatgagcgagccgccgcagcgagcgggttttacttatgttggcgtgcctgtcgccgacggtcgccgctatactataatcggacggacgctgatccgggtgggctgctttggttggtggtggcctcgctcgatgcgatccgacgagggtttgggcttttggtttagaagatttatcggtccgtggtttgtgtgatgtatgtataggagctgagagagtggcagcggattagtgaagcgtcccacccgtctctgcgtgc

SEQ ID NO: 2996 - DNA, 546 bp, Hordeum vulgare
  UNSURE (1),(14),(15): n stands for any base
nccgtgttataatnncttgaacgggttgaagcacaataagcaaagcaagtcggggcatcctcagcatcagtggaatttccacgtcgcacgcagagacgggtgggacgcttcactaatccgctgccactctctcagctcctatacatacatcacacaaaccacggaccgataaatcttctaaaccaaaagcccaaaccctcgtcggatcgcatcgagcgaggccaccaccaaccaaagcagcccacccggatcagcgtccgtccgattatagtatagcggcgaccgtcggcgacaggcacgccaacataagtaaaacccgctcgctgcggcggctcgctcattgcgcgcgctccctgattacgtcgaagcccatctcggaggggtcggtggcctgcacctcgtagtggaccccgtccagcacccgccgcaggccttgcttcgacgtcgcgtacagaatcttggcccgtatcctcgacgccgccggcgaccatgcgatgaagaagatcttgctcttctggcagttgtcgacggagacgaagtcgaagt

SEQ ID NO: 2997 - DNA, 516 bp, Hordeum vulgare
tgcgttagaccttttctcttccatctccatacacgcgccacgcctccacccagaattcccaattccacggcctcctgccgccggcgcaagctcgccgcctcgacgaaattcctctgcccccttccaccggcccggcgcggagtggagatccgcccgcgccgattcattctgctggtctggttagatactccattgctccatctacaaaacgaaggacacataaaagaacaaaggaggtgaaaggaagaaaggactagaggcgaggaaataataatgggaaagggatatgtggccacgaggtccaaatcccagaaatcgtcgacagtacagaatgaacagagtacacctactaatcctcctacagcatatcctgactggtcccagtttcaggcatactataatgtccctggcacggctcaaatgaccccaccggcttattttcattcaacggtggctccaagtcctcaggggcatccatatatgtggggtccacagatgatgcctccttacgggacg

SEQ ID NO: 2998 - DNA, 545 bp, Hordeum vulgare
  UNSURE (4),(9): n stands for any base
catnccttnagaggcatgatgcaagcagaagatgcataattccttcaaacaccactcatcactcagtctcagtgcagtatacacattggtaagttactctgaatgtttataaatcacaactataacaagcatcagatcagctctacaacaagcatctcataagctaatcccgcaaagtctcaaacataacttggggatcttcacatactgctaaggtagcatctcacacaaaagcaggggaaaaaaagacaccatagcgcacggcggctgccacgtccggaagaagaagaatctgtaaaccatcatgttgaatcctatgatacaatcctatcatctcagccaaaaatctaattgcacacatgaacacctcctaattatctccccgacctatcatgtcactccaatttatatcagcagtcagaaagtgaggccgcggccttcactgcttcacaagtttccatttggtttctcactatcaaccgctttaagcttttcatgtaaagatgtattttctgaggtcaagctatcacacttctcctgaagct

SEQ ID NO: 2999 - DNA, 411 bp, Hordeum vulgare
aaggcttcaccccatgaactatatcgtgcaagcagccgcgccgccgggcaaggcaaaaatgctctcggtgcgggcgccgccccgcgctttctcgccctcgccgccgtggcggagacggggccgcctagacggtttcgccgcgccgcggtgtgtcagcgccgcgccacccgtgacaaccctagagacggctaccgcgcggccggcaggcgtctccttcccgattctggtgaatggctgcactggtaaaatgggggtatctgttgctgaggcagctacttcaaggggtcttcacctagttcctgtttcattcagtagtagagagaaccttgataaaacaatacaaattggtgatacagacattgagatatatggcccttctgcaagagaagatgttctttcatctgtcattga

SEQ ID NO: 3000 - DNA, 432 bp, Hordeum vulgare
ttttttttttttttttaaaacgtcttagaaaagtttacagtcttatagaagtttacagagggagtacctaccacacacatgtgacgatattcacgtcctgccggttccggactaaactatttcgggtgtatgcggttcagtacatatatcaccaactccactattccacgctcactaattactacccccgcgccccaaccctctgttttgatggatgaagatgctaaacagtaactttaccgcatatcgccttcttgcaagacatcaatcatgttgtaaattctcttaggatccattgattgtaccttcttatacagaaatatggcggcatcaactgacccttcggcgtatattgaacggccacaaacattgtgctggaactcaaatgaaacgctgtcatcgggagaagtcagatggtacaaatggaatgca

SEQ ID NO: 3001 - DNA, 419 bp, Hordeum vulgare
aacacacacacacacacacaaagcctcctcgctccaatcttgtctgcatcgagagcgcgagatccaaagttccaaacccaaccagcctagctagcagcagagttagatgaaccagagcggcatggcgcgcagcgacgagggctccctggtgccgcgggaggtgccgggcagctacggcctgccgttcgtctcggccatccgcgaccgcctcgacttctactacttccagggccaggacaagtacttcgagtcccgcgtcgagaagtacggctccaccgtcgtccgcatcaacgtgccgccgggccccttcatggcgcgcgacccccgcgtggtcgccgtgctcgacgccaagagcttccccgtgctcttcgacgtcaccaaggtcgagaagaagaacctcttcaccggcacctacatgc

SEQ ID NO: 3002 - DNA, 423 bp, Hordeum vulgare
tttttttttttttttttagaaaagtccggcttattacactgggcaagattgccaaaagtaaacacaacacacgcacacatacacgagggcacaatgctgcgaagcaaccgaacaagatgcatgcacatgcatgactgactcgtacgtacactactaaggtagatatagcgaggcacgtacgtacgtacgtgatgacggtgtaaggatcgttgctgccctgcgttgatccctttgtcaccgatggccgtccggtgaaggatttaaacagcgtctgccacaccggacgttgccttggtgacgccggtgaactcaaccttggtgccgagaaggtcgaggccgactttggccgtgaaggtgtcgtaccggaggaacagctccaccaccaggagccggccgacgagcacgaccaggttcttgcctggg

SEQ ID NO: 3003 - DNA, 330 bp, Hordeum vulgare
  UNSURE (84),(85),(99),(100),(111),(112),(122),(123),(135),(144),(153),(169),(189),(208),(213),(243),(248),(252),(256)..(258),(273),(305): n stands for any base
ctggtagtaagctacttagtatctatctttcaatctttattgtgagcgagggagaggatgtccgtctcccctatagaaaacagnnacacataggctaanntgattttgcgnnccaaaaagannttagttcaagtntatactgtnttccacttncagattagctagtgcntgcttgtagtgtatcgcgtngcacccatgtcgtatcgcnggatngctgagccatttatatttttccgtcacgtnctatngcgncagnnnactttacgactccgngacacacaaacagcagcacacatgaggtggancgggatagtgaggtgtattactcta

SEQ ID NO: 3004 - DNA, 516 bp, Hordeum vulgare
cttggtacaacaaccaaacacctgagatgtcttggctttacagtgttgagaggacaaaaaaaagatggctaataaggagataacaatttctcctctaggtcacggaaacctcggtacacattatctgtttggttctgtgggagattcaatcgcctcacctctgtcatatacctgttcgccaaactaattattttatctcgaacacccttctgcaaagaccctgtttgattcagcgagaatgttccatccaaaaagaatgaagccccggcagttgtggtgcctagcttatgtgcaatgactgacattccccattctcgaaggattgcaagaactgatctcagaagccgcagcttcagagtaagtgagggcacgattgcgccattcgataacagctgatcatacacagcaagcacaggctcagctagacctttacaagctccgagaagagcccttgcaacatcctcatcaccaactaattcctgtcctgaacttaatctatccagtgcagccttctca

SEQ ID NO: 3005 - DNA, 512 bp, Hordeum vulgare
cggcggtggggacgggttggttcgtggcgtacaactcgtatgcaatggggcggatggagtctgtgtggggcgaggacgcgcaggcgtaccggccggagcggtggctggacccggcggaggggacgttccggccggagagcccgttccggtacatggcgtttcacgcggggccaagaatttgcctcggaaaggagatggcgtatatccagatgaagtctatcgtggcgtgcgtgctggaggagtttgaattggcggtggacggcgcgtaccggccgcggcaggtggcatctctgacgttacggatggcggacgggctcccggtgcgggtgaatgccagagggaattgagtacgacgacaaaatgcagggaaaaatctgctacgtaattgtgtagaaagccgtcactatgtaaaagatggattcactaggcctgatttctgattgtttcaccaggcgtttctacttggtatgttggtccatcgtcaagctcgatcttctggtggatttccatgc

SEQ ID NO: 3006 - DNA, 505 bp, Hordeum vulgare
tggcatggaaatcaccagaagatcgagcttgcgatggaccactacaagtgaaacgcctggtgaaacaatagaaataggcctagtgaatcatcttttacatagtgacggctttctacacaattacgtagcagatttttccctgcattttgtcgtcgtactcaattccctctggcattcacccgcaccgggagcccgtccgccatccgtaacgtcagagatgccacctgccgcggccggtacgcgccgtccaccgccaattcaaactcctccagcacgcacgccacgatagacttcatctggatatacgccatctcctttccgaggcaaattcttggccccgcgtgaaacgccatgtaccggaacgggctctccggccggaacgtcccctccgccgggtccagccaccgctccggccggtacgcctgcgcgtcctcgccccacacagactccatccgccccattgcatacgagttgtacgccacgaaccaacccgtccccaccgccg

SEQ ID NO: 3007 - DNA, 263 bp, Hordeum vulgare
ggatgccttgttgctgctgagcccaggccttcaactgtctcgccaggaactgtgtgccaaaatatcggcgcctcccttcttcctcctggacttcgctcgctgattgaagccccaattctccccaaatccctcccctttctcgcgaaatcccgaatcttgctcacgggaggaggccatggtgtcgagctcctactccaacctgcttgacctggccacgggcgcggcggaccaggggccggcgccggcggcgctcggcgcgctgc

SEQ ID NO: 3008 - DNA, 377 bp, Hordeum vulgare
ttttttttttttttttttttttttttggtgtaagaaccagagtcggcgcaaaatatgttttaacatcacaaattagctttttcccatggcattcagagagacattattacggttgcggtaactagactagcaggtttcaaacggagcccacaacactctagagcaaccactgctgctgataacaaaccactagcaggtttcaatcggggcccacaacactctaaagcaagcactgctgctgataacaaaccaccggcagtgcagcagataccatgaaaaaagcatagctcatgtacacctaaactacgctgcagaagcctcctcagactgttgccaacacgacaatgcccttcctcttgtgcttccaacttcctact

SEQ ID NO: 3009 - DNA, 553 bp, Hordeum vulgare
gtctccccgggtctgcaggcaattcggcacgagggtgcacacctcatctcatcatcgtcttccccccattgccatcgacctccctccctgcgagcagcagcagcagcaatggccagcctcgccgacctcgttaatctcaacctcagcgactgcacggacaaggtcatcgtcgagtacctctgggttggaggatctggtatcgacatcaggagcaaagcaaggacggtgaacggacccatcaccgacgcgagccagctgcccaagtggaactacgacggctccagcaccggccaggctcccggagaggacagcgaagtcatcctctacccccaggccattttcaaggacccgttcaggaggggtgacaacatccttgttatgtgcgactgctacacaccacaaggtgtgccaattcccactaacaagaggcacaatgctgccaagatcttcaacagcgctaaggttgcagctgaggagacatggtatggtattgagcaggagtacacactcctccagaaggatgtgaactggcctcttggctggccaattggtg

SEQ ID NO: 3010 - DNA, 550 bp, Hordeum vulgare
aagaatacaaccggttttatgattccattttatcagaatgcggaaacaacattattttcagagtacactgaagactcttcttatcctgaagagcagtagacgtactactatgaaagataccaaaggcacgccccaaaaacagactagaccttgcaattgcaaaagaaacggaaacgggaaatgttttgcagaaatcaatcaccaccctcgatcgagagagtcgagacgagagcctgcccaaagtgtcatctggcggtggagtaggcattgccggccgtgtgctcagaggagaagcgtggtctcggcgatcatggaggtgacgacgtaggggtccatgttggaggccggcctgcggtcctcgaagtagcccttgccgtccttctccgtgtcgcgccccacgcggatggacgcgccgcggtccgccacgccccatttgaaggtgttgatgtcggcggtctcgtggtggccggtgaggcggcgctcgttgccctcgccgtaggcggcgatgtgctgcatgtggcgcttgccaagcttctcgatggccttcttg

SEQ ID NO: 3011 - DNA, 496 bp, Hordeum vulgare
cctcgtgccgtttttttttggatgcatcggtgcggtcttcttcagtccattgccatggactactggactcatggtacaaaaatgagaggacatgtcgaatcattatgaacaatcatgagctcacggtgatgttatcacatcggaaacatcgttcgttgccctttgttatgtagtgcaaatagtacaagatatatgcatcctcgcagtcgcagacaactggaaaaggaaaatatatttctttgttgcctcttgttccctatctgatgatggtgatctctgtgatacaacgtatggcttgacagtgaaaggcacctatgcaacgcaaaccacgacaatggtaaaacaaaaaagaggagatgttacacagtgtagcatgcttatactccgcctcgtgccgaaattcggcacgaggcaatcgatcagtagctcatggccgccatgatggcctccataaccagcgagctccttttcttcctccccttcatcctcctggccc

SEQ ID NO: 3012 - DNA, 548 bp, Hordeum vulgare
gcttggattgcttatcgccccccgagagatatcttcttcatgctcgaggcctccttgttcattttctcgagcctatcctccattttcctctctattaccccaagtatggtggctcgagacttgagggccttccagtaggccgtcccggggaagttgaggggcgcggacaccacccccttcatgaaggtgatgtactcgagcctcagccgctccgtctcctcctcgccggggtccatgctcatgatgttcttcgccatcaggttaaacgtgaacttcttggcttcgtgctgggcggagaagacggcggaggaggaggaaggcagccagtcgcggaggacgaggagggtgtggcgctccacctccgggaggagcacggcgcggaggcggagggagctgaggaagttgagggagatggagcgcatctcgcggtgggggtcgcccacgagcaccagcatggaccatttgcccaggatgccgccgatgctccgcgggtagctgcactcgaacagccgcccctcgttctgcaggatgtaccggttcagccccgc

SEQ ID NO: 3013 - DNA, 539 bp, Hordeum vulgare
  UNSURE (17): n stands for any base
gggctgcagcaattcgnacgaggcccaccgtgcggagattagcatttacttcgtcaaaggaggatgttctcgggcgtcatgatgctccagttcgttgtgtggagtactcttatgctgcaggacaagtcatcactggcagctgggataagacaattaaatgctgggatcccagaggagttagcggaccagagcggacacttgttgggacatatgctcaaccagagcgtgtatattctatgtcactggtgggaaataggttggttgtggcaacagcaggaagacatgtcagtatttatgatttgcgcaatatgtctcaacctgagcaaaaaagggaatcctctttgaaatatcaaacacgctgtgttcgatgtttccccaacggaacagggtatgctctaagttctgtggagggacgagtgtctatggagttctttgacctttctgagtcggcacaatctaaaaagtatgctttcaagtgtcaccggaaatctgagtctggcagggacactgtttatcctgtcaatgccattgcattccat

SEQ ID NO: 3014 - DNA, 541 bp, Hordeum vulgare
tactactcaagtttaacagtttctgcataaaatataaaacgagctggaatatgaccactcccaagcaactatttctagacattaatatatgccaaacaacacacagaaatggtcagatatggatactgccatttgactccaacatagagaagggattccgtcaactagtgcaattgacactacaaagttaaccagataaagaaacgcctcgcatttgctctccgcataatgtcttctcccagacaacacacctgatacgtttgactaccttcttgccaaatggttgcggtactactgcggcgcggccaatgccttgggcttcggcttaacctccacttcattcaccccacggataaatattgcatcaggctcgtggggtttctctccctcttcgtagccatagcttgatgccacagcaagcagatgcccatccttactgaacgacagagaggcaatgcttgacgcgtactttgagtactgatacaatctcttcttgttcgtgccatcccacacgttcacaaatccatcatggcctccagtg

SEQ ID NO: 3015 - DNA, 515 bp, Hordeum vulgare
gcaggatcacccaatgatgacacaaatatacgagctgagaatgaaatgggcaaagccatattttgcaggtgtattttgcgcaaggatgaccaacactcagaggtcagagagcgcaaactatatgttgaagaattttgttcctgctggagcatcaatgcacatgttcgtgaagcattaccagaaacttcagtttgaccgtgattccgaagaaaattttgctgaaaagaagagccgattggcgggcacagtgctaaaaacaggtttgcctatggagagacatgccgggaaggtatacacgccggcattgttcaagctcttccaagaagcatgctttaaatctgcatcctacttcgtcgagaacacttgcgtagtcaaagatacataccgcgtgacacacctttatgccaagggtagagaaagttggtccaagacttcttacaacgtcaaagtggctcaacctgaaaatttgtttcaatgcgagtgtggtaatggcacacctgaagttcacgaacata

SEQ ID NO: 3016 - DNA, 526 bp, Hordeum vulgare
aaaccttataatggattgtaacaaatggtctgagtcacacacatatctaatacaactatgatcttacaccaaaaggggtaaacactgcattgccttatattgtttgggacatcgagttgatgtcaggtatttgttttactccatcattgaaaccacgattcgaatccacgactgcattgtgtcctaatgtgaccaagcaagccacacttaccacacttgggttccttccgttgcttcttgtttggtccaccgtttgttgggcaattaccagagttgtgtccctttccccagcaggtcttgcagaactttgttcttggcttactaacttcatatcctggtctagatcttgcgttggttggtcggccacgatctctcttgcgaaattctacgctcattgatgatttgagcccagtgtcaccgttaaatttacgttggccatcactgttttctttgtgtagaacatcctcaagtcctttgccgtcctgctcttttgccttttctttgaggccaacccttgtatcagata

SEQ ID NO: 3017 - DNA, 515 bp, Hordeum vulgare
  UNSURE (513): n stands for any base
tgtgcacctacgtcgcctccttgcctggtatggggcccgctggggtggctgatcccgagcgagacgttcccgctggagacgaggtcggcggggcagagcgtgacggtgtgcgtcaacctgctcttcaccttcctcatcgcgcaggccttcctctccatgctctgccacctcaagttcgccatcttcatcttcttctcggcatgggtgctcgtcatgtccgtcttcgtgctcttcttcctcccggagaccaagaacgtgcccatcgaggagatgaccgacaaggtgtggaagcagcactggttctggaagcgctacatggacgacgacgaccaccaacaccacaacatcgccaacggcaagaacgccaccgtctaaacagtcttactccgtcctactcctatgtaacgctgccggcctgcctgcctgcagaacccgacttggaaagaacgaagatggatactgagctctttatcgatcggtcccgtctcatctcgtcctatcatgcagacactntc

SEQ ID NO: 3018 - DNA, 548 bp, Hordeum vulgare
tgacaccccgctcttgcttgagaattgacaacaatactgctgttcattaagaatacaatatcagttttacaaggtgctgtatatgcttgcattgtcagagaccaatttcaaacaaatatatatagacacataaaagcgaaagtgctcctgctaaacaagaaacaccgaaacactcttcactattactattacctaggagtataatagaacagcaaggtttactaccgcactgcctgctgttcctcttggcatgtcagcagtgtaaatagttgaggtcgcgactgagaaagtgtctgcatgataggacgagatgagacgggaccgatcgataaagagctcagtatccatcttcgttctttccaagtcgggttctgcaggcaggcaggccggcagcgttacataggagtaggacggagtaagactgtttagacggtggcgttcttgccgttggcgatgttgtggtgttggtggtcgtcgtcgtccatgtagcgcttccagaaccagtgctgcttccacaccttgtcggtcatctcctcgatgggcacgtt

SEQ ID NO: 3019 - DNA, 456 bp, Hordeum vulgare
ggcacgaggatttctctcgggcagcacgtaggctgagaaactgctagcagactctccgtagctagccttgctagctagctagtagtagctaggggtgtgcacgtacgtacctacctgcaggttgcaagagagagggcgggaggaggcgatcgacgagagagggagagaaagatacatgggtagcttgggatcggaggtcggccatggcggcagggagatgttccatggccaccccgaccccgtcgtcgacgagctcaacaggctggagaatcttctcagagaaaaggaacgagaacttggactcgcatacagtgaaataaaaggtatgaaggtgacagaagctctgaaggacaaggccattgccgagctgagcaaggaactgaagaaacaggacgagaagctgagcatcctggagaagcagcttgagcagaagaatctggatgtgaaaaggttatg

SEQ ID NO: 3020 - DNA, 538 bp, Hordeum vulgare
ccaactgcatttgtattttttttaggcaaaattgctttgctgtcaagagagaataagaacagaacaacatgcctgctggttttgttgttcaaacaatatcccaagttgaagaaaattgcagagaggcacacatgttcttataaataaattgccatgctgcatcagtacatgataactattattcacccttcttgtatttggcatcctcttgcaaaagaaattccttagtttcccctgttgccaccctgggtactctctgcattcgaagcatccactttttcatcatccaagttctccaaatccatggctttgtgatgttcactgcactgaactccacagtccccattcacatcaaatactacagcttgtggctttgtgctatcatgttcctccacatgtggagcacttgaatgtggcttgtaatttggattctgctccttgttctctttgccagcatcactggtcactttacttgtcgcccacaggtgatttttcacaggacgatcctttctagcagcagctgttcttgctcttgggc

SEQ ID NO: 3021 - DNA, 524 bp, Hordeum vulgare
ctgccgttgagaagtctcaaattattgaagcgcttggagctactgtggaacgagtgcgtcctgtttcaatcactcacagagaccattttgtcaatattgcaagaagaagggcattggaagccaatatagcatcagcacaaacggaacctaatgacatacaaactaacggttcagcctatcatgacactaaagcgctgaactctagacagactaacggttcagcacatgccagttctgaagtgcctgacactggcaaatgttaccctaattctgattcgaagggaggtttctttgctgaccagtttgaaaatatggcaaactatcgagcgcattacgaatggactggtcctgagatatggaagcaaactaaagggactgtccacgcctttgttgctgcagctggtactggcggtacgattgctggagtttcacgatatcttaaggaaatgaacagaaatgtccgatgctttttaatggatccacctggatctggtctgtttaataaggtaactagaggggttatg

SEQ ID NO: 3022 - DNA, 540 bp, Hordeum vulgare
attggtgacttgagcgtgtacaacaggctgaagaaaaacagcagattggcagtgtacaacatgtctgaagacaaacaataatactaacagggttggctatcccaacccctactaaaaggtaatgacaactactctaaagtacataactatatcttccagagaaacctacgatcagggtgacataaaatttgaggtccattatctggagccaacagttcccttgtttgatggaatgtttcagcgccgcggtgttcactcgtcaattgctttcagacagagaccgcagaatgacaaaattgctgaaatcgtgcattcccctgtgacgttttcactgatcgagaaactccagaccagtagcagttggtgtcaacccatgattggccagatattcatcattgaagaacttacttagatgcctcatcccactgtcgcagagaattgtcacaattgtatgtcctggacctaaatcccgggcaactcttacagccccaacacaattcatggctgaagaactcccaacaaatagtccatctcttctca

SEQ ID NO: 3023 - DNA, 511 bp, Hordeum vulgare
  UNSURE (477),(478): n stands for any base
ccaagaccgtgctcctgcgcgccggcgcggttctcttcgccctcggcttcgtcgacgccgggtacagcggcgactggtcccgcatcggcgccatctccaaggacaccgaggagctgctcaagctcggggcctacgccgtcgtgcctctctgcctggccctcgcactctcggtgcccggagacggcggcggtgaatcttaggaagagcgagagctgcatgccatgtcgtactttgcttattcatttacgtgtcagtattattctgtattgcatccgagtgagcggtacacgacccttttgagataagtaccagagtgtttaaccatggttctgtattctgctcactgcttagtatgttgagaggtcagctgtaaactgctgagtgctggcagagttttagaggagcggggaggattgggaacttcagcagtgtttcttgctgcctgtctagcgtctaattttggcaagttgaactgcnnaaaaaaaaaaaaaaaaaaaaaaaaaaaaaaaaa

SEQ ID NO: 3024 - DNA, 473 bp, Hordeum vulgare
gttcaacttggccaaattagacgctagacaggcagcaagaaacactgctgaagttcccaatcctccccgctcctctaaaactctgccagcactcagcagtttacagctgacctctcaacatactaagcagtgagcagaatacagaaccatggttaaacactctggtacttatctcaaaagggtcgtgtaccgctcactcggatgcaatacagaataatactgacacgtaaatgaataagcaaagtacgacatggcatgcagctctcgctcttcctaagattcaccgccgccgtctccgggcaccgagagtgcgagggccaggcagagaggcacgacggcgtaggccccgagcttgagcagctcctcggtgtccttggagatggcgccgatgcgggaccagtcgccgctgtacccggcgtcgacgaagccgagggcgaagagaaccgcgccggcgcgcaggagcacggtcttgg

SEQ ID NO: 3025 - DNA, 948 bp, Hordeum vulgare
  UNSURE (791),(821),(914): n stands for any base
ggatccccgggactgcaggaattcggcacgaggggttcccttctggctgcttcctcctgcaggtgctacttctgagcttccgaggcgacacagctgcagaagagcagagcaaacagagctggtcagagagagatgagggagatcatcagcatccacatagggcaggcgggcatccaggtggggaattcctgctgggagctctactgtctcgagcatggcatccagcccgacggcctcatgcccagtgatacctcggttggggttgcaaaggatgcattcaacaccttcttcagtgaaacgggttcagggaagcacgttccgagggccttgttcgtcgatctggagcccacggtcatcgacgaggtgaggacgggggcataccgccagctcttccaccccgagcagctcatctcccacaatgaagatgctgctaacaactttgcccgtggacattacacagttggaagagaggtagtggacctttgccttgaccggatcagaaaattggctgacaactgcactggcctccaaggtttcttggttttcaatgctgtcggtggcggaactggctcaggacttggctcattgcttctggagcgcctatcggtcgactatggcaggaaatccaagctcggtttcactatctatccttcaccacagatttcgacggccgtcgtcgagccttacaacagcgtgctctctacccactcgctgatcgagcacaccgacgtgggtgggttctcctggacaaccgaggcatctacgacatctgcaagaggtccctggacatngagcgcccgacctacaccaacctgaacagnctgatattcccagtgatatcggtccctgacaccttccttgcggttcgacggggccatcaacgtggacataaccgagttccagaccaacctggntgcggtacccgaggagcaacttatgcctctctct

SEQ ID NO: 3026 - DNA, 530 bp, Hordeum vulgare
tttcttacgtacaaaactcttcgttcattattatgtggcactgaaccgtcagagcatacgaatcaatctgacaagttttttactctgctaaccaccgaacatcacagatgcaacagcaaaacagggacagagaagaaggaacggcatagaagtgcacaacactgccacccaaattaagcacgaccgatcaactcagtactcatcaacttcgtcgtcgtcgtcttcaccctcagctccgacctcctcgtagtccttctccagcgcggccaggtcctccctggcctccgagaactccccctcctccatcccttccccgacgtaccagtgcacgaacgcgcgcttggcgtacatgaggtcgaacttgcggtcgatgcgcgagaagacctcggccaccgccgtgttgttgctgatcatgcacaccgcccgccgcaccttggccaggtcccctcccggaaccaccgtcggcggctggtagtttatcccgcacttgaacccagtcgggcaccagtcgacgaactgcacggtcctct

SEQ ID NO: 3027 - DNA, 541 bp, Hordeum vulgare
  UNSURE (4): n stands for any base
gggnctgcaggcaattgttcacgaggtggatacctgaggaaccttaaaatcctgacgcttgacagaaataggatcactgtcttgcctgaagaattgtgttctctatcaaatcttcagcagcttacactttctcagaattctttactgtgcctacctaaaagtgttggagatttgtccaatatgctgctacttaatgtatctgataacaaactaaatgcccttcctgaatcaattggaggctgcaagtccctggaagaattgcaggcaaatggaaatgcaatcgaagacgtgccctcgtcaatttgcaaccttgcttgcctcaaatctttatcattgaacggaaacaaaattcgtcagcttccccaaaacttattgaaggattgcaaggctcttcagaacttgtcactgcacaacaacccaatctctatggaccagttccagcaaatggatggattcgctgaatttgaagcacgcagaaggaagaaattcgacaagcaaatcgattcaaatgtgatgatgagctccacagccctggatgaag

SEQ ID NO: 3028 - DNA, 545 bp, Hordeum vulgare
gtactgtatttattttgatttctttaccaaatcagattgtcaagagactgatatatatacaactttacaattaattccgactaatgaggaaaaaaaaatgagttaacccaagtttcccccctgcaaaactaacgtaaatcaatgccttcatccagggctgtggagctcatcatcacatttgaatcgatttgcttgtcgaatttcttccttctgcgtgcttcaaattcagcgaatccatccatttgctggaactggtccatagagattgggttgttgtgcagtgacaagttctgaagagccttgcaatccttcaataagttttggggaagctgacgaattttgtttccgttcaatgataaagatttgaggcaagcaaggttgcaaattgacgagggcacgtcttcgattgcatttccatttgcctgcaattcttccagggacttgcagcctccaattgattcaggaagggcatttagtttgttatcagatacattaagtagcagcatattggacaaatctccaacacttttaggtaggcacagtaa

SEQ ID NO: 3029 - DNA, 518 bp, Hordeum vulgare
tggctgctggttattgcctgtcagcatctctgctctcgattatcaacaaatgggcaatcatgaagtttccctaccctggagcactgacagctttacagtacctcactagtgttgctggagttctcctttgtggacagctaaagcttattgagcctgatagactgaatttgagaaccatgtggaagttcttgcctgctgctgttatgttctacatctcaatcttcacaaacagcgagctcctgatgcatgccaatgtggacactttcatcgtgtttcggtctgctgtgccgatatttgtggccattggggagacactttaccttcaccaaccatgcccatctttcaagacatggctctcactttccactatacttggtggaagtgtgatatatgttttcacggataaccagttcaccctgactgcttacagctgggcgatagcctatctggcgagcatgtctattgatttcgtgtacatcaaacatgtcgtcatgaccatcgggttgaacacatggggc

SEQ ID NO: 3030 - DNA, 552 bp, Hordeum vulgare
gtcatccattgtatttctggaatttggtaaatactagcataccatggttcagtatacagaggatttgactctagtatgttgagttgtctggtaccctacaccaccaccacaatcctgcctaaccaatgaaaagcagtatacagtaacaaagatattgtagaatgaaatttagttcctcttgaaatatcaatgtcctacagcatgttcaggatttctcatctgagatatatcacgaatgggttgtcgagggaaggtaaagaaaagcttatgaggaggaatgcttttgacttgaattgctctcatgcccgggctgaatctgcagcaaattctgcccctcttcatcgtcctcttcctttggctcaatcttgggtaccttgggctttgtggtcgattgctggtagagaacgccaccagacatgcatatcaagagcccaattgtccccaccagggatgcatgcttgtcccagataagcagattgatcacgacggtcaggagcttgttcactataccgagcaccgtaaatccagtggcagagatggcccgtctgcagg

SEQ ID NO: 3031 - DNA, 524 bp, Hordeum vulgare
gcttgtgacgtctgtcaagtttcctgattacaatgctggaaaggtggaggtgcaatacttccatgacaatgcaacttttgctgccgccgttggcatgaagccctctcctatggttgatttttctgtggtagtaggccctaaaggacttgccttcggtggggaagctgggtttgacacttcttcaggaaagtttaccaagtacactgctggtttcagtgtaaccaagcctgacttccatgcttcagctattctggcagacaaaggtgacaccatcaaagtgtcaggtgtgtatcaccttgatgagaagcagaaggcttcggccgtggctgaatttacccggaagctctcaacaaacgagaacacactgacagttggtggcctgtacactgtcgaccctcagacagctgtgaaggcaaggctcaacaacactggaaagcttgctgcccttctccagcacgaggttaaaccaaagtcactcttgacgatatccggtgaattcgataccaaggccttggacagagcac

SEQ ID NO: 3032 - DNA, 545 bp, Hordeum vulgare
  UNSURE (40): n stands for any base
ggtaaaatacataacaccgcatgaaaaatcaaatgtagcnttcttcaagtaacagactactgtgatagctactcggaactcacagtagaaagaaacaagctgcatacatctatgaatgatcatcaaaagtaaacgactggataaaatcccaggtgaaggcctatcggatcctgcccacagagcacctaaacctccagagatttaacagaacatgtctgcggaacaaattattggccatagcttcacaaaaaataaccaaagaatccgatgttcaaccaccatcatccacgtatgatctcatcagggcttgagcgcaagtgacagcccaaacttgggtgctctgtccaaggccttggtatcgaattcaccggatatcgtcaagagtgactttggtttaacctcgtgctggagaagggcagcaagctttccagtgttgttgagccttgccttcacagctgtctgagggtcgacagtgtacaggccaccaactgtcagtgtgttctcgtttgttgagagcttccgggtaaattcagccacggccgaag

SEQ ID NO: 3033 - DNA, 552 bp, Hordeum vulgare
gtacccccgggcctgcaggaaattcggcacgagggctcgagttcaagatactacagaggaggttataatagtgacaagggtgacaatagtgataaagaaggaagttgggcaaactcaagacaacgaaatacaggccgcaactatggacgtagccaatcagagaggtatggcatgaggtctgataggcagacaacagatgaaggtcagtttgacaggcagcggagatcctatagaaatgactcacacaggcatgaggcaggtgctcaataccttggacagggtcaatctcatggatccacaaactctactcgcagaccagggaatatggcacatggggtttactcatcaccatatgcagtgccaaatggcgttggtgcttcagattcaccgtatcttatggtttacccatacgaaccagctgcaaatcatggttcttcctctgaaccgcttgaatttggttcactggggccaatctctatggcagatgatggtgatctaccacagcccactcgccaagtaatggccaatggcttttatgggcaaagacatact

SEQ ID NO: 3034 - DNA, 553 bp, Hordeum vulgare
aacgaagcgatcgattgatcttttacttagcctagagtaattcagataatcatattcctcgaagctagaaactcaacttcaagattcttaaaccctaatacatctaacgtgaaaagttttccatatgtgaaaacatgattacatgatcttgcttctgcccagtgacatgagttcactattagctttcggctctggataggtgcccaggcagtactagtagaatctgatgataatccccacttttgtctctgatatcgagatgacaatacgagggctggcattctggcttaacccttccttgatcatatcctttgggtcgacaagaggatatattctcgtcctcccggttccatggtttattcagaaggtgattctgctttagtctcagaaaagcccagtaaaggatgttggaaggactggtgcgtctttccatggaactaaatattcccgaggcatctcaaagtatcatcagctgcttgccagtaaaatgacctgctgctgactgatgtctctttggacaaactaaatattggtgaggtatccggccaccagc

SEQ ID NO: 3035 - DNA, 533 bp, Hordeum vulgare
gcaattcggcacgaggtaacgattgtacaccacatatgaagagggacagtggatactacctccacgaggaagctaccgccaaaggttactatgtgaaagatgcaagcgggaaggactacgatggatggtgctggcctgggtcatcatcatatcccgacatgttgaaccctgagatacgggactggtgggctgacaagttctcctatcaaaactacaagggatcaactccaacactgtacatttggaatgacatgaatgaaccatcagtcttcaacggccctgaggtcaccatgcctagggatgctatacacaacggtgatgttgaacaccgagaactgcacaatgcatatgggtactatttccatatggctacttcagatgggcttctcaagcgaggtgagggtaaagacaggccctttgttttgtcaagggctttttttgctggaagtcaacggtatggggcagtttggactggtgacaacactgcagattgggatcaccttaaatcttctatcccgatggttttaactctt

SEQ ID NO: 3036 - DNA, 554 bp, Hordeum vulgare
aaactctagattgcactggtgagattcatctacaatcttaagcaaagaactatccaagattacaaaaaaaatattctaaattgcagtgtcacaagaacttcatatcacatacatcatacctggcacacaaatttcagtataaaagctacaggtatacatcagcaattaatgtctctcacttatgtcaaaattggaagtacaagcagcatgcgtaccagatacatgcagaaattttgaggccaccgaaacaacgaaatttgggtgcccacagagaacatttacgaggctgaaactacacttctagcattacccaagtttatggcctgacgcgaacaatagagacatcaggctccaggtgtgaatgggctgcatatcatgcgatccttatcgtccaatcatctacgactcgaacattgggcctcctgactgttggtgcaacagactttgaaccactccttaaactaatcggtcctagatcaatttccacttcttggttcccaggttcaatgatggccttctttgctcccgatggtaacccaagcactataattctt

SEQ ID NO: 3037 - DNA, 407 bp, Hordeum vulgare
cagaggtgaagataattgggtgatgtctaagcgcttcaggacttatttcaacttctctcaccctgttatagatcgaagtcttgacccggatgaatgtgcatgggcatatgggatgaatgtctttgatctggaagcttggaggaagacaaacattagggatacataccatttctggttgaaggagaatctaaaggccggtcttactctttggaaatttggcactttaccacctgcgcttatagcattcaggggtcatgtccatggtatcgacccgtcttggcacatgcttggcttaggataccaagaaagcacggacatagaaagtgttaagaaggctgcagtggtccactacaatggtcagtgcaagccatggctagacattgcttttaaaaacttgcaaccgtttt

SEQ ID NO: 3038 - DNA, 549 bp, Hordeum vulgare
  UNSURE (2),(14): n stands for any base
tnctgcaccatttnctaaagttgtaaccaatatcctgtaggtaatcacagcaatgtcatcgtctctactacagtcttctccgacctctaccaaaacgatcacaaaactagcggaacaaaatttcaagaaggaaaaaagaatatgtgggagtaaaaataaacattataaactgtcacgaccttagctacctccattcttcaccgtgatgttccaattcgctaaactgcccgctgcattattctccgattatggatcagcccaatcccagaggaagagacctcaccaaagctacccttgatagttatactactatccaaaagaatgaccaaccaatatgatacagatgaaaagaatcgtgtacccatatgatacagatcaaagtatcgaggtatctgcaactcggttgatgcaggggcgtgtcagcgatatatatatgtcttcactgatgattgctttcctccttcaccaacagcaatccacctctccagtaagcaaatgaatggcggggctatgccccctcagttcagtgtgtctacaccatttgtccaa

SEQ ID NO: 3039 - DNA, 541 bp, Hordeum vulgare
  UNSURE (4): n stands for any base
gggnctgcaggcaattcggtacgaggtgcccgcagagatatctggaaggaaggatggcctagtactagtgcctttcaagtgatatgtaaagcatatccatccaaggtatggctggtagatttgcctgttcttccatgtgcaagagaaatttgaaagaggagttgtacagagtggataaacgtaagttgaattacaggaatttagtggtcatctgaaaaattatttccacattgtaccactagtccccgactacatgaatgaacgtaattatacataagaaaaggtgtgaccatctgtaactgttgctagataactagtgaagcagcctatttctaagcctcaacattgcaagctacgcaaaaagaagaggaagatcttcctgtcattattcttcttttgtacaaaaaattccacacattccaagttgtatacaccccgatctctcctaaccttgatcatcccaaggtcaaatatgtgcttaattatcactatcatacatttgccgcacctgctaaagctatcaaacttcatatgtgctatg

SEQ ID NO: 3040 - DNA, 405 bp, Hordeum vulgare
ataattctggttcttgatataaaacttaacagaattacaaggacttgaaataataagggaagaaaatggctcgaccaatccttttctagtaggaaggctgtgaacatctaggtagaacaaacatccaacaaccgttacactgatcttttctttttcctttcttccattataaacgatggtgtcgtctcacttgacttccaaagtccaacgcccaaaatttgctctctgaatcaaactccccctgatttctacacaaaatcgttttcatacttttcaatggagtgttttgctgttcatatcacttccctgtacagcagtgtccactgactacattacttctactccatatttgaacaggcaatgctgaatgtttaggcagtgagcttttggaaacgttagtcaaga

SEQ ID NO: 3041 - DNA, 908 bp, Hordeum vulgare
  UNSURE (11),(659)..(661),(750): n stands for any base
cgttccccggngctgcagcaattctgcacgaggtttttgttttttttttttttttttttttttttttttttttttttttttttttttttttttttttgtttggaggttgtggggcgttctatatgaccccccagggtggcgggggggggagcctgtggtggcaccaaaaggaagaaaaaaacctgtttttttttcagggtttgcaccgtagaaaacctgttggggggggaaaaagaacctccccgggggcgggaaagtttgggcggaacattaaaaatggatgtggttttaacaagaacgacgcaaactgctcacacttaatgaacaggggggctcctcatctaccagcctgactcccctctgggggataggaggccccccccccctcttggggggggagacggggagaacggttgcttatcttccatgcagagcctaacacaacaagccccccccatggtggtttttttagtttagcccgcggaaatgcaccagcccccctgcctatcgtagtgtgacatttggggatgccccccaaaaagagaaagcctcttgtggggggggggcccgccaccttcgctgttccactgcgactgtttataggatggccaactgttcactcccccttccagttagcactttcgttcagggggtggtgnnncccatctcacccccccgccgtggagacaaagaaacacccgcccgcgggggcgtgtgacaaacaaaagaacgaagcgcgccggccccagnttgcatacccactgacacagtattacataggggcgccgcgctctccaacccttgccaaggagtggttctggtatccaggtatattccgccgccccctccccccaccatgggacagatccgacagcctgaaatatttttcattatatacatcgcacctc

SEQ ID NO: 3042 - DNA, 443 bp, Hordeum vulgare
  UNSURE (13): n stands for any base
ccaaactttgttntactttaacaaagctacataaactgtacttacatttcagaacagcacggctcaagtgaatatctctctcacgagccagtccaaggtgggataagcaaagtagaggatcagaaacgacggcagcgcaaacaaaaacgtgacaaggacatacaggagcagaaccgcggcgctggcagggacggcatagagaactatgagaagaaacattatcacgagcgggaacttggccgtcagctgcacaaagcacaccatgagcttctggagagacacgctggcagtgttggaggtgttgccagcggcatttctatctctggcagaagaggtctctgcccgtgccgtaggggctcttcggtggtgttgacttgaactggtgccaccactggagggacatactgattggcgttcctcgtgaccagagaaatggaactttg

SEQ ID NO: 3043 - DNA, 966 bp, Hordeum vulgare
  UNSURE (1)..(3),(14),(21): n stands for any base
nnnggtcccgcgcnatgactncaggtactgaggccacattcacgtgtcctcgtgccgccatacggcacgagggggaaacccattagcctcaagggcgtcgcccttatcagcggcggtggcgccgacagcgctgtcgccggcgccctccacttcgtccaagacccctcctccgggtataccgaggtgagggggagggtctccggcctcgtactggtcctccatggctttcacatctttttctttgcgtaccccctcggcggggggtgtttcgtcgggtgtggtttttaggcgtcttagctctacgtctagaagggagagcgggcccgcctggcgccggcgtgtagccacggtgaacgtgtgcacatctccgtgcgacgtcgggtgcccccggacggcccgcacgcacgcgtgccggaacgcttgcggatgaaaaggtacgttatgtgccggtcggtcttgtgtgttgttcttttattagtacattcgacctgctctcgtcctatgactctctgtctcgtgagttttttgtcgctgttcagctcccagcggagtctcgatgattgtattctctagtctattttgtctcctctccagtgttcctgtggggacttacttctcatttcttctcttttgattatttatcttttgttgaattggttggcgctgcccacccctttctcgacccggtctcttcaccgccatcggacctgtcgttaatagattgtagaaatgttatcgctggcgtcaccttccacgacttctcaactgatgaagaccgaaacatgacttcccatgccggtccctctagacctccacaccttgtcacttccttcatcctcaccgtcccaatgataattcgctcatccgcttatccctataagagtccattccatcagcaacaacctctaaccctgtaccgacccgcactcgccacaactatcaagacattatcatcgcgttacaccc

SEQ ID NO: 3044 - DNA, 560 bp, Hordeum vulgare
gttcgtatacacctttttatcttcttttatttaaatatatacagagtacttacccacaaaaaaagaagatataaggtacttgtatacatttacataactgatcacattaatatcacaatgaaaatgttattatcttgaacgatatcagtgtttcctcgtctgcgcacaacgatgccaacatgaactccaatggctcttatatttgtttgttaaacagcaggttgaattccaatgataccacatccaatcctggctcctgcatttcctgttgatttactgagctcatggccaccctttcctaggtcatcagaatcagcatgaacaacaactgcccttcccagtatggaatgaggccctcttagtgaaatctgtaagtcctttatgaagatttctgcaacgccatccttgttggcttgtatgtttcccaggtcgcccacatgtcgttcatcatcaacaggtgctccatgggatttattaagaggattgaaatggggtccggtggagttgcagccgttggtggtgtcgccgaaggcgtggatgtggaagccgtggaggcccgg

SEQ ID NO: 3045 - DNA, 520 bp, Hordeum vulgare
cagctttgaagcttcttcagtccgcaatgaagtatgcgtgtatctcctattcattttcttgcatatttatttgggctatttgttagttaatttgcatttgattattttttaatcctggaaactgttggtactattttaaagaatatgatgtagtatccaccaagttaatgcatcaccaggaagttgaacgtgaacatcgagaggtctatcgagtttttaagctctatcttgtaatgcaaatgtcttggaacttctattttcaaacataaccataatactgttgatctttttagcaaatcaaggtctcattagatgtggattaattgtccagaaacaagaattcactttcatgatactgttatccttgtgatatgttcgcagtaatactttcataatgaagtgcttaacatgtcttccctgttctaagtcatttgctgtacctccaagatttccctcttatgtcaaatataggtaagttcagggcacatgggttgctacgacatgatatcatcacaataaa

SEQ ID NO: 3046 - DNA, 501 bp, Hordeum vulgare
tctgtttgtacaatttctacaccagtgaacttgatgccagaatgctaaacaaaattacaccaatatcacatcacatgccttgtacagactaatgaccccaatctaatggaagcatacatgaggggggtaaagaagaagaaaaagaaggaaaattacatatttggtatgaagaccttattcaggatttaataaagatatgtgttgtgcaatggatattataggatgatctcatcttgcacgctggcattgagagttttatttgggagcacgatgctgttagttacaactacctcatcttcaacatcaacggcttcaccaagaatggtgataccaagtttggcattgtggtcaccttcaccctgtacacgtgaccatttccctactgttgacttccaccctactattgaatgtataacaactgcattctccataatttcaacatcatccagaatgatgcaattgataagcctggctcctgctccaatgcgtgcatttgctgat

SEQ ID NO: 3047 - DNA, 957 bp, Hordeum vulgare
  UNSURE (1),(654): n stands for any base
nttgctacatgaacctgtacccccgaactgcaggcaattcgcacaaggcacgcgtagccgccgtcgcgcgagaagagctcgacatcaacctcttccgcaggggaagggcggcgaccctgagcttgtccgcgaatcgcagcgcagacgcttcgcggacgcccccaagccccaaacattagaaaacgccggtgcgcttgtcgacgagggcatatgcctcgacgaagcgtggcgccagaggcagattcagctccacaaggatcgcccggagctccacaagaccagccaggggatcggcaagctcaaaggccaaagcaagatgcgaccgagcttttacacagcaccggggggaattaatagaggggtggccctcccacgaaacgggagggggggggaaggccaaaaccaccctttttggccaagcttgttaaccatttgggaaccccttggcttgaattttgtggcccctcaaccgggggccaaggggaaaacaaagctttttttcccggccaccggggggggggaggaaaccttgggggaaaaaacttacaaaaaaaaatttggggggttttttcctaaaaagggttgggaaatgtgtactttttttgtgaaaaaagggggcccccccctattcacttcttgggaaaaaaaagagantttttttttttttttaaaggcgaccgagtgtgtcccccctctcggaccccccggcgttttgtttaaaaaattttgggggcccaatattaatctttccgaaaatataaagagggtgtttctctattttgtcacaccactccttttcttttcttcacaaaaagagaaaaattttgtggaaaaaatgtttgctttgttcgtccctttctttgggaggggggtgcttctcaaaaccagccgggggcgggggggaagtacgttttttttgtttttttttgtcggccgcatacttttcgcctttttcct

SEQ ID NO: 3048 - DNA, 553 bp, Hordeum vulgare
gtgaagtcacgacacttaaacgattaacgagtgtatgaactatgaagtcaattatggaagatactaatgtattttcttgtaaaatgtgagcaggcagcctggattgcaatgttttgtaaacaaaacaaccaaaatggaaaaccaattcgaactgctctgccgtgcagatcttcagtcgaatcgcggatgaggccagatgctggattgtgccaacttgaaagattatacaagccgccatgaatgtggttatagccggctgtatagaccgattgccggcgatggtttccctttttcatttggttataccctagctttgtaacttcggctccactgcttcttcttcattaatgaaatatagctccacggtgtcttttgttaaaaataatggggcaccaaatcataatcatgctacagacgacccataaattaacaaaaggatgtatcattatctgcctgatggaaataagtttccattcgcccctcttaaagctcaagctgcatttcccttgggtttagacttgttgggtttggagtcagcagcttgtttgctatc

SEQ ID NO: 3049 - DNA, 518 bp, Hordeum vulgare
ccgaccctcaagccgccactccacccgccgcagcgccgccactccacccgcagcggcaaccatggcggtcggcaagaacaagcgcatctccaaggggaggaagggtagcaagaagaaggccgtggatccgttcaccaagaagcagtggtatgacatcaaggcgccgctgctcttcaccagccgcaacgtcggcaagaccctcgtgtccaggacacagggtaccaagattgcctcagagggcctgaagcaccgggtgtttgaagtatctctagctgatcttcagaacgatgaggaccaggcctacaggaagatcagactccgtgctgaggatgtgcaagggatgaatgtcctcacaaacttctggggcatggatttcaccactgacaagctcaggtctcttgtgaggaagtggcagaccctcattgaggctcatgtcgatgtgaagaccactgacaattacatgctccgcatgtttgccattggcttcaccaagagacgcccaaaccaggtcaagcgca

SEQ ID NO: 3050 - DNA, 555 bp, Hordeum vulgare
taaatatttagtttacactcataacctccatccagaaagtaacacgaacaaaacaagatagttgaacgctggctaggaatgtcgacagaagtactcaagaaatcagccatcaaaactgactacaaagttcacgacacccaggtggcacatatatcatcttctagataagaagcagcaaaatagcgacttctatttttctactcagcagcagcaacctcctccgcaccaggaatgacctcatctccatcaggcctgtcaagcttcacaccaacatcctccttgtagtcaccgtgcacctccatgagctttcccaggtcaaacttcggggccttcaggatcttcaccttgcggacgtacacgttctggagcgggaagatgcttgaggtggccttctcaatctcctttccaatcacctcagggatgaacttgttcacaagctccttcaagtcacagcttgcagcttggttgaccatgatctcaaccatcttccggcggatctgtctgatctgacttgcttgagcatagcaagtgcgcttgacctggtttgggcgtctc

SEQ ID NO: 3051 - DNA, 521 bp, Hordeum vulgare
  UNSURE (6): n stands for any base
ttctgnatccagcaccaccggcgccaacaccacacgtcgtgagccctcgtcgccggagaagtagcacgcaagatggccggaaggaagggaggcgacaggaagaagtcggtgaccaggtccgtgaaggccgggctccagttccccgtcggccgcatagggcgctacctcaagaaaggccgctacgcgcagcgcgtcggctccggcgccccagtctaccttgccgccgtcctcgagtacctcgccgctgagctcctagagcttgccggcaacgcggcgaaggacaacaagaagacccgcatcatcccgcgccaccttcttctcgccgtccgcaacgaccaggaactcggcaagctgctcgccggcgtcaccattgctcacggcggcgtgatccccaacatcaactccgtgctgctccccaagaagtcccccgccgcggccgagaaggaggcgaagtcgcccaagaagaaggccgacaccaagtctcccaagaagaaggccacgaaggagtagactagctgaca

SEQ ID NO: 3052 - DNA, 554 bp, Hordeum vulgare
ggaaggattagcatctttacttcattcccggcagaattcagagataaattacagcccttactggcttgttcatcgaactaatgaaacagccactacagactatgcaattacacaaaggacccaaccaacagtgttctcatcctcgctccctgatatggaactaagcagtgtcagctagtctactccttcgtggccttcttcttgggagacttggtgtcggccttcttcttgggcgacttcgcctccttctcggccgcggcgggggacttcttggggagcagcacggagttgatgttggggatcacgccgccgtgagcaatggtgacgccggcgagcagcttgccgagttcctggtcgttgcggacggcgagaagaaggtggcgcgggatgatgcgggtcttcttgttgtccttcgccgcgttgccggcaagctctaggagctcagcggcgaggtactcgaggacggcggcaaggtagactggggcgccggagccgacgcgctgcgcgtagcggcctttcttgaggtagcgccctatgcggccgacggggaactg

SEQ ID NO: 3053 - DNA, 351 bp, Hordeum vulgare
cagcatggcgaattctggcccccataccaacgggtcgcagtttttcatcttatacaagtctgccacacatttaaatttcaaacatacagtatttggcatggtggttggtggtctgcacaatctttcagcaatggaaaaggttcctgttgatgatgatgaccgcccattggaggaaataaagttactgaaagttagtgtatttgtgaatccttacacggaacctgacgaagaagaagaaaaggcaaagcaggaggagaagaacaaggatgaagatcatgataaggtgggttcatggtacagcaacccagggactggtgtttctgcttcagcgagtgctggcggtggggtcgg

SEQ ID NO: 3054 - DNA, 89 bp, Hordeum vulgare
ttttttttttttttttttttttttttttttttgattttttttttttttttttttttttttttttttttttttttttttttttttttttt

SEQ ID NO: 3055 - DNA, 552 bp, Hordeum vulgare
gtacccccgggcctgcagggaattcggcacgaggctcgctcctcccctcccctccccgtcgccctccggccggccttcgtcccccccgcggaatatgaaactaaggacaaaacgtcctggatggaagtccctcgtgcctctgcagctgagcaggaaatccaccatgcgcttctttctgtttcccaaggttcaggcatccggtcaatccccaaatgatactccggtttatcttaatgtgtatgatttgacacccatgaatggctacatatattgggcaggccttggtatatttcactctgggatcgaagttcatggagttgagtatgcatttggagcacatgattatcccaccagcggggtatttgaggtagaacctcgtcaatgccctggtttcagattcaggaaatcaatatttcttggtacgacctgcttggatcctatccaagttaggcaattcatggagctacagtcagtaaactacaatggagattcttaccatcttatcatgaagaattgtaaccacttctgcaaagatatgtgttacaaattgac

SEQ ID NO: 3056 - DNA, 535 bp, Hordeum vulgare
ctgaagaatgaagagagactattacaatccatctggccggcagtctatcaggagtacagggagcgggtggaatcgaggcgaattccttcacccaaaatcacatctgtagccacactctttccacggggattacatcacatgatacaacaacagcatcaacaagcaagcattaggccgacgccgacagagaaagaaaaataaataaccggcagctgcgacggcagcaccgctgcccgaattagccaacttggttcttccaaaagttacacgggctacctactcttgagcgacgcagtgctggatttcctcgacgaagagctcggaaggggctctttcacgggcgatggagggaaaggggaagaagacgggggaagcgctctctggctcgagatggaggagaagcagctcaaggggttccgcagacgccgcttctctgaatcctcgggctggctgtttgggtcatggccgaccggggagatcttcagagactccgggaggaggcagttgcagatggcacctattctggcgagacgat

SEQ ID NO: 3057 - DNA, 517 bp, Hordeum vulgare
gctccacccgacgccgccggtgcgtcgcatcctgatcgcctgcctcggcctccagttcttccgcaagcctccggcatcgactccgtggtgctgtacagcccacgggtgttccagcaggccggcatcaagaccgacgccaacacactcggagccaccatctcggtgggcgcgaccaagacgctcttcatcctggtggccacgttcctcctcgaccgcgtcggccggaggccgctgctcctcaccagcgccggcgggatggtggtgtcgctcgtgacgcttgcgtcgacgctgcacgtgatcgcccagcggacgtcaccggcggacggggcgacggcgctgtcgggggtgagcatcgcgtccgtgctgacgttcgtggcgtccttctcgatcgggatggggcccatcgcgtgggtgtacagctcggagatcttcccgctgcggctgcgagcgcaggggtgcgcgctgggcaccgcgatgaaccggatcatgagcggggccatcaccatgtccttctact

SEQ ID NO: 3058 - DNA, 547 bp, Hordeum vulgare
catttttgtacaaaaataaactaaagtacaaatattatcatgcttgtccactaaagttccatctttacataactagtcatcttgccatgtgcttgtaactaacattgactttcgtcacttatcagggtccttctagaaatctgacattcaggatccgaatcacaagtagtagaagtattcaaaaagttacagaagatcaaatttagctggtatgtagttgttggcttgttgctttgatcgtacgtaggcgcatccatgtatgtctacaaatctgaccggcaaaatccaaactcacaagtaggaatattcagcgagttattgaatctttcacttttggacgaccgctaacagtataccacatacagtgttgactcactaccgagtagtcaactgcgtggacttggcatgcccatgctcatcttccttctccacggcatcgccagtaccaccgaagagcttctccgtgtcctccagaccttcgcccctcgtctccggcaggaagcagaacatgaacacccacccggcggcagctatgctggcgtagagg

SEQ ID NO: 3059 - DNA, 543 bp, Hordeum vulgare
gtcccccgggctgcaggattcggccggggagccaacaacgccgccgccgccgcagccgccggaagaggtgttcgccgctggcaagtcttcgaggatggggtaccaccgcaataggcgcgggcgtggatcctcgtcgtcctcctcctcctcttcgcgccgcaccaagcaagaagcctcgtgcgatgatgctcctgggacatcacttccaaggcaggaagacaacgccgaagaggaatctaatagcccaaaaattcagcttgcaatgtgggactttgggcaatgcgatgctaaaagatgcactggtcgtaagctttcaagatttgggctgttaaaggagttgcgagttactaatggttttggtggtgttgttctcagccctgttgggacacattgtgtgtcaaaggaagatcatcctatcgtgcaacgaaaaggattggctgtggttgattgttcttgggcacgtttagatgatgtcccttttgtgaaactccgttgtggtgctcctcgtctcttgccatggttggtagcagcaaaccctgtgaa

SEQ ID NO: 3060 - DNA, 550 bp, Hordeum vulgare
  UNSURE (22),(24): n stands for any base
gtctaaaagcgcactcatcttntnaaagagtgtgtgtgtttacagtttacgcttacatatactcatacacgaatccctcaaaagaaaaatacataaactggtacgcgaagcaagcaggcaatgcgagtatacagacatatagattgtcttcagacccacgaccaacacctcaaggcaccttatcttatttcgatcgggcacacaaacatcatttcgtgtcttcgttttcaatttcactttcctcttcgctttcttcatccccgctgaggtccaagtggttcatgttctcttccagagggggcaagccatcgtcagattcagaatctgatcctgcgtgtgatttatctgccacgtttacaggtgactttggaacactcgatgcacttgccagccacgagttctgcacattgattatctcagtgccattttcacacttggagtatgctttgagcagatccctgttaagtgataagaatgagtgaccccacttgaattttgcaagcagcagttctcctgtctcttcctccccacatattatgagggctgctga

SEQ ID NO: 3061 - DNA, 517 bp, Hordeum vulgare
cgggaccttggtggttcttcttcccccgtggaggccccccaagcagaagctgctgtggcctctagcgagctcggagtcgagtccagaggtgatttcgacggtcaaaacggccttatccaaggggaatcggagtcgcgtgccggcggcgttttgcgcggcgaaggggcagggacggagcctgaggccccagaggcctccacgccacaggccaaggaaggagtggacaggatggagacgagcttggatgactctgaggcctcggacgggtcgaccacgcaggaggactctgacaccgacgtggagacggagtccagcagctccagcgcaggggaacaggacacgggatatagagtccacgtcccactcatggaacaagtgatccgcgaggtatctggtgaaaacaacgcttcagaggcgaagagctctgataggatggattcagtagctgtatcaacacttgtactagcttcaggtgcagccatgttacctcatccttcaaaggtgcacacaggtggtg

SEQ ID NO: 3062 - DNA, 540 bp, Hordeum vulgare
tcttaactctctgttcttttcttagccagggattgggtcattcttcagcccaaatgcaagcattcggactcgatccgaatatggctcgcaacttgctgcggccatggccataagatccgagtagaaatacaacttatcaacagcttatagttcagatttcctaacaatggacacgacaactgttacatcatccaacttgcccccggagtagcccagatagccttctgcgagcgccgcgtccgagaacgggctcctcccggacccggacctgcccacctcctttgctctagcagccaggagctcagcaatctccgtaggcttgcggtcagcttccagagatttcgagacaatagatgccacctcatgatcgtagacgttgtcgaacagaccatccgacgctgtcacaatggcatcgccttcttgtaaatcgatagcgtaattctgtacaagtcttgaaggatcaacaccgttttctatttgcaacgggaaattgaaaccgtatgtcatcgcctttgtttgtgtgtatacttgcccatttct

SEQ ID NO: 3063 - DNA, 518 bp, Hordeum vulgare
atgaagttgggcgccttgaagttctcaggattcacaccaaaaacatgaagttggctgaagatgttgaactggaacacatttcacgagacacccatggttatgttggtgctgatcttgctgctctttgtaccgaggctgctctccagtgcattcgtgagaagatggacattatagatcttgaggatgagaccatagatgctgagatactgaattccatggctgttacaaacgaccatttcaagactgcactaacaacaagcaacccatctgctctccgtgaaactgttgttgaagttcccaatgtctcttgggaagatattggtggtctggaaaatgtcaaacgggagctgcaggagactgtccagtaccctgtggagcatccagagaaattcgagaagtttggcatgtccccttccaaaggtgttctgttctatggccctcctggatgtggtaaaaccttgttggccaaggcaattgcaaatgagtgccaggctaacttcatcagtatcaagggacct

SEQ ID NO: 3064 - DNA, 550 bp, Hordeum vulgare
ttacgcggcaggtaacgaatatacgtgcatcccaatataattttaagtacatagtttgaccgtgtcttgcataccacaaaacataacagtatacgaaggaaatcacgggtaagttaaggccacaacaacgaggaggatttagctatataagtcgtcatcttcagctgctgctgcagcggatgcaaaaggatcggcagcagcggcggaggcggtgcccgcggccggctgatcagggaaccggaactcgctgccgaatccacgggactgctgcagagtctgggcaaaggcctggtacttgcggatgtcggcgtcgctcacactccggcgggcatacttcatcgactcctcgaagtgggcagctctgatctcagccacctcgtccacctcatcctcctccattgcttcggggttgtccttcctccgcctctccctctcgatgtccttctcaatgttctccctgatggcgtacttgcaagcacgctggcaaatttcggtgatatcagcaccgctgaatccttgggtgtacttggccagagcactgagatcaata

SEQ ID NO: 3065 - DNA, 518 bp, Hordeum vulgare
attcgtatgtgtatgaacttaccaacacccttgctgaagttcgtggtaatctccttgggttacatagaatggcaactttacatcacgatgagcttggtcaggaaaccctgctcaatctgcttctccgcaattacctccactataacttgtatgaccaggcagagaaacttaggtcgaaggcaccacgttttgaagcccattccaaccagcaattctgccggtacctcttctacttggggaaaatcagaacaattcagttggagtacactgatgctaaagaaagcctcctgcaagctgctaggaaggcaccggctgcagctcgtggctttaggattcagtgcaataaatgggctatcatagtaaggctgcttcttggggagatcccagagaggactgttttcatgcagaaaggaatgaaggaagctctgacaccatattttgagcttacaaatgctgttaggattggcgatttggaactgtttagagctgttgcagacaaatttgcaagcacattcagt

SEQ ID NO: 3066 - DNA, 552 bp, Hordeum vulgare
  UNSURE (49): n stands for any base
gcgaggaagagaaagataactaaaacacattacggtccatgaagtgctngataacatagaattacagaagatgtaaaaagtttacaagattcaaacctcccttgaggggacaattcagtgatttcagggatctaaaatcaacaattcaaaaaacggaccaacttaaaaatcatcgtcatcctcctcagccatgtgctttgccagctcttcctcctgctggagcctttctcggcgcttctcagcgctctccttctccttgtgagaattcgggggaaacctcatggccttgaccgcttcattatgcatgttgaggcagaacgcaatcctggagttgaatgcagcctggggttcatttgtcgagtagacatcaccagtttctttcgacaccatccagccatttgcatggtctatggtggcatcaatagcaccatctcttatggccttggctacaatgcactccgcatcggcaacaggattcccagtgtctagccttagcttcttcgcaatatcagcaagggagatccgcgagtatgaaatgctgatgttgcgtag

SEQ ID NO: 3067 - DNA, 389 bp, Hordeum vulgare
  UNSURE (20),(38),(39): n stands for any base
gtcctcccgggtctgcaggnaattcggcacgagggggnngccgggaagctccgacgaaccgcgccgctcgtcaagttgatatcatcgccgcactgaacatttattgataaagaagtcaaaactaattgctgttattctcggggaggtgtatcgtctccttggattctggcaaatagatcacctccacaaggttggaaaatatgtcaacaaaggcctctaacatgtcataccgatatccagacaattctcaaataccatactacagcagttcaatgcatgtgggtggaaatggtgcttgctatgtgcaacaaaatcatgaggatcatcagtacatgtcctctgatgggggggtcacagaacagcgattcaaagtctcaggtgattcaccc

SEQ ID NO: 3068 - DNA, 520 bp, Hordeum vulgare
ccggcacacagaaaagcatgcactaattcacaactcatgtcagttttacttaattgtttcagatccatgaacatagactaagaacagaatcagtgtgtcgtgtgttgacatatattgaaccatgtgaattagtatatacgtctctataataccaccaacatcaagagacaaactgaagatttctaagccagagctagccttctaagatgacatctatttcaggttggagccatggaggtactaatactacctaagagcatctccaatttcaggttgaaccaagggaaggggatcgcacaaatctacaacaagcacagtcggttactgttccaggtgccatcttcaacacaaagaattaccgaacaccagaaggcaactccaagtatgaaactataattagggcaacattgattgattccctggccggagtacacaaatctgtcggccaaacctgaccaacgagaacacgacactctcgactcgctggcactggcataaaaagcttcaccagaatagggaa

SEQ ID NO: 3069 - DNA, 516 bp, Hordeum vulgare
ggctaatgtgcgtgagatctttgacaggctagggggtcagcaccatgtgtcctcttctttgatgagcttgactctattgctacccagagaggaagcagtgttggggatgctggaggtgccgctgatagagtgctgaaccagctgctgactgagatggatggcatgaacgccaagaagactgtcttcatcattggtgctaccaacaggccagacatcatcgaccctgcccttcttaggccagggcgtcttgatcagcttatctacatccctcttcctgatgtcgattcgaggcaccagatcttcaaagcttgcctcaggaagtctcctttggccaaggatattgatctcagtgctctggccaagtacacccaaggattcagcggtgctgatatcaccgaaatttgccagcgtgcttgcaagtacgccatcagggagaacattgagaaggacatcgagagggagaggcggaggaaggacaaccccgaagcaatggaggaggatgaggtggacgaggtg

SEQ ID NO: 3070 - DNA, 553 bp, Hordeum vulgare
aaaatatttaagtactagtttgaccgtgtcttgcataccagagcaaaacataacagtatacgaaggaaatcacgggtaagttaaggccacaacaacgaggaggatttagctatataagtcgtcatcttcagctgctgctgcagcggatgcaaaaggatcggcagcagcggcggaggcggtgcccgcggccggctgatcagggaaccggaactcgctgccgaatccacgggactgctgcagagtctgcgcaaaggcctggtacttgcggatgtcggcgtcgctcacactccggcgggcatacttcatcgactcctcgaagtgggcagccctgatctcagccacctcgtccacctcatcctcctccattgcttcggggttgtccttcctccgcctctccctctcgatgtccttctcaatgttctccctgatggcgtacttgcaagcacgctggcaaatttcggtgatatcagcaccgctgaatccttgggtgtacttggccagagcactgagatcaatatccttggccaaaggagacttcctgaggcaagctttg

SEQ ID NO: 3071 - DNA, 480 bp, Hordeum vulgare
cgttattctactggacatgcgttgtataaatctctgaagtgtaaggaacctcaacctacaaattcagagctcatgtcctacatgcatcttctctatgatatctgtccattcttcaaatttggttacatgtctgccaatggtgctatagccgaggctgttaagggtgagaactttattcacatcattgatttccaaattgctcaagggagccagtgggtaactatgatacaggcccttgctgcgagggctagcggaccaccatatctaagaattactggtatagatgattcagattcggcttatgcccgaggtggtggactggatatagttgggcgtaggttatgcaacattgcccagtcatgttgtctgccctttgagttcaatgctgtaaatgcagctagtcatgaggttacacttgaacatctcgatataagaaagggagaggctattgctgtcaactttgcatatcagctgcatcat

SEQ ID NO: 3072 - DNA, 551 bp, Hordeum vulgare
gtttagttgccacccgtttgtgtgacatatacatacaataaagcatccatcaaatggtacatacacaatctactcttttcttgcgaacatacacaatctaccaggcaactgtgtgccagctaccatggcctagcataagctccagttttcgcataaagatcagagagaaaaaatgaaactacaaggaacataaagacaccctttaagattcaggacgtggttcaccagctcgggatagtcactagacggtagcagcagcatggtttgtacctatattacaacccaagccacgactactatttcagttatacccatcaaatctgaatggtgtgcgcaggggagggttgacagctgggcgccaagaagcaagcagccacagttctttggattatggaattcacattcgctgattaggttccaccttggatttatgtgccgaacacaaagccatgaaagaacctaaacaagcttcttccatattcaagaatgtcaccgccatgcagaagatacaaccagctttctgttcttccatccaagataaatgacaccat

SEQ ID NO: 3073 - DNA, 353 bp, Hordeum vulgare
ttttttttttttttttttttttttttttttggttgtaggatgtgccattagttgaaagcttcggattatccttggattcatgaacctctgtatatgaatctgtatttagaatatattgcctagtaagataatctgaatgaattgaaagtagatttagaagatctgcaaacagattcatcagaggaaaattttcagttaaggggaaattttcatttgaaagcttgagtttggcaactacaacctgcaacaagcaagggagcttcctataaattttcagataggggaaaatgttacttataaatagctaatgtatggatcaaatgatggacgggaacaagtaagcctgttttgga

SEQ ID NO: 3074 - DNA, 376 bp, Hordeum vulgare
caaaattcaataatttactctccagaggttctgatttggattatcattggtggatctccagaaatttggatttggcttagcggcgggggtgacttgtcttcttcttcctgatctgctttggatgaatcattacttcctccatttcatttatttctctccacagctcaccttatgtctacgacaattctgatttacatttgttggtggttcttcagaaattgggattatacggcttagcggggagcacctatcgtcttggtgatctgcgttggatgatcattacctttctcagtttagtttcttcttctccagagttcagttagtctcccaacaattctgattgtgatctgttgatggttgttcagaaattggaatt

SEQ ID NO: 3075 - DNA, 493 bp, Hordeum vulgare
gggccgggaagctccgacgaaccgcgccgctcgtcaagttgatatcatcgccgcactgaacatttattgataaagaagtcaaaactaattgctgttattctcggggaggtgtatcgtctccttggattctggcaaatagatcacctccacaaggttggaaaatatgtcaacaaaggcctctaacatgtcatacagatatccagacaattctcaaataccatactacagcagttcaatgcatgtgggtggaaatggtgcttgctatgtgcaacaaaatcatgaggatcatcagtacatgtcctctgatggggggtcacagaacagcgattcaaagtctcaggtgattcacccacagtactgcactctagagtcttcatcagccaattgtgtttatgctgcccatagctctacatctcctcagtgcataagtgggagccacatttctctgcatgatagccactcagatcacacatatgattctcctgcaagtggc

SEQ ID NO: 3076 - DNA, 554 bp, Hordeum vulgare
ttagtagaagttgcaccccgtttgtgtgacatatacatacaataaagcatccatcaaatggtacatacacaatctactcttttcttgcgaacatacacaatctaccaggcaactgtgtgccagctaccatggcctagcataagctccagttttcgcataaagatcagagagaaaaaatgaaactacaaggaacataaagacaccctttaagattcaggacgtggttcaccagctcgggatagtcactagacggtagcagcagcatggtttgtacctatattacaacccaagccacgactactatttcagttatacccatcaaatctgaatggtgtgcgcaggggagggttgacagctgggcgccaagaagcaagcagccacagttctttggattatggaattcacattcgctgattaggttccaccttggatttatgtgccgaacacaaagccatgaaagaacctaaacaagcttcttccatattcaagaatgtcaccgccatgcagaagatacaaccagctttctgttcttccatccaagataaatgacacca

SEQ ID NO: 3077 - DNA, 516 bp, Hordeum vulgare
gtccagtaccctgtggagcatccagagaaattcgagaagtttggcatgtccccttccaaaggtgttctgttctatggccctcctggatgtggtaaaaccttgttggccaaggcaattgcaaatgagtgccaggctaacttcatcagtatcaagggacctgagctgcttaccatgtggtttggtgagagtgaggctaatgtgcgtgagatctttgacaaggctagggggtcagcaccatgtgtcctcttctttgatgagcttgactctattgctacccagagaggaagcagtgttggggatgctggaggtgccgctgatagagtgctgaaccagctgctgactgagatggatggcatgaacgccaagaagactgtcttcatcattggtgctaccaacaggccagacatcatcgaccctgcccttcttaggccagggcgtcttgatcagcttatctacatccctcttcctgatgtcgactcgaggcaccagatcttcaaagcttgcctcaggaagtct

SEQ ID NO: 3078 - DNA, 551 bp, Hordeum vulgare
ggtaagactgatattaggggatttaaacacagcatacaaatgcaaagcaacacgggatgacagatgaaaagatacagctgcaaataaccggcaggtaacgaatatcagtgcatcccaataataattttaagtacatagtttgaccgtgtcttgcataccagagcaaaacataacagtatacgaaggaaatcacgggtaagttaaggccacaacaacgaggaggatttagctatataagtcgtcatcttcagctgccgctgcagcggatgcaaaaggatcggcagcagcggcggaggcggtgcccgcggccggctgatcagggaaccggaactcactgccgaatccacgggactgctgcagagtctgggcaaaggcctggtacttgcggatgtcggcgtcgctcacactccggcgggcatacttcatcgactcctcgaagtgggcagccctgatctcagccacctcgtccacctcatcctcctccattgcttcggggttgtccttcctccgcctctccctctcgatgtccttctcaatgttctccctgatgg

SEQ ID NO: 3079 - DNA, 556 bp, Hordeum vulgare
  UNSURE (25),(26),(34),(38),(44),(47): n stands for any base
gtacccccgggcctggcaggaattnncggcacgnaggnccgagnagngagctaacaaaagggaaaaggcaaattacgccggtttcaggagagctcctacatggatccaaatcaaagtctgtgccttggagcactgtttaacattgcagcgacaaatgggctagacatgggtagaagattatgcatctttggcttctgtcggtctattgaaatgctgagcgatgtggtggaagatacagtattggagcacggcggcgagattgtcattgcagagaaggcgagcagcgacggcctccaggagaagctgaccatgtcggtggcggttccgttgctgtggggagtccctccggcatcggagaccctccatgtggccgtgcggagcggcggaggcatcgttgacaagatctactggcagtgggacctgttctaagagcccaggccccccagacattggttgacaaataatccaccccacccacactgtatatatgatccttaactggcctggctgcacacattgtgtcagcatgcaacaacctgtgttggtgtccttgtgc

SEQ ID NO: 3080 - DNA, 543 bp, Hordeum vulgare
  UNSURE (26),(29),(80): n stands for any base
cctttttttttatttatatgcaccanagnatcaggtcggtctgtacaagtatacaccaagtttgctggttgcgcacaagnacaccaacacaggttgttgcatgctgacacaatgtgtgcagccaggccagttaaggatcatatatacagtgtgggtggggtggattatttgtcaaccaatgtctggggggcctgggctcttagaacaggtcccactgccagtagatcttgtcaacgatgcctccgccgctccgcacggccacatggagggtctccgatgccggagggactccccacagcaacggaaccgccaccgacatggtcagcttctcctggaggccgtcgctgctcgccttctctgcaatgacaatctcgccgccgtgctccaatactgtatcttccaccacatcgctcagcatttcaatagaccgacagaagccaaagatgcataatcttctacccatgtctagcccatttgtcgctgcaatgttaaacagtgctccaaggcacagactttgatttggatccatgtaggagctctcct

SEQ ID NO: 3081 - DNA, 481 bp, Hordeum vulgare
gacatggtcacagtttacctaatctgtcactcaggcggggtgaggagcactcattcattttgaagccagcaattatgtcctccagggaccggaggatcaacactgatgtacctctgactttgtcactcccaaagatgagtggagctgccacaaatacttccacgcctagggtcagcgagcttagcggtggtcttactgatcagtatgctgtacttatatcatatcgctgcaattatacagaatcaaaacttttcttcaagcaagccacaagctggcaaccctgtgcagctagtgatcttatgatctctgtgtcttctgaactctcattacgaaatcctagcccgagtgctcgagttcctcaactccccgtgcaggtcttaacccttgaagctactaatatgacttcagaaaacctcacattaactgttcttgctccagaagcatctggctcttcttcagttgtatcattgaactcagctcc

SEQ ID NO: 3082 - DNA, 412 bp, Hordeum vulgare
aaccaaaaatggaaaaccacaaaatgatttcaaaactatgcaacacaacattacaggtttttcgacaagcctacccaatcgctcagcgctccgcgtataaatgcatatatgagaatctggataacacaaagcattggtctcagtttatccagttgatgcttttttttttgcggcagaaacagcattacaggtatctggctgccgggggtcctggatcctgcccctgagctgccatgtccaacatccaattcaaattagcagttgcacacttggactaaaactaaacgcagaggttcaaccacagaagacataagagtaattaatactctgctaattcctactatgaccttcctgctgagatggcagacgatgcgtgtatctccaaggagtgctctggtatgtacgtaagacc

SEQ ID NO: 3083 - DNA, 519 bp, Hordeum vulgare
atcttgttgcattggcaccactatcaattgggagatcaagactggagagtggactagttggtgccctttggggctgtggtcatgatgctggacaaataatttttggcctgctcttcttgttactcaaggatcgtttgcacattgaggttctccgtatatggggaacaagagttgtaggtctgacccttcttatgataggcgcgacgggcatccgggaagcttcagaggtccaagaatcagggctaattctggagggtgtagacatgagtggcggtgagcccttgcaacagtcccctgctgttgctcccaggaagaagaaagttggcttcacaacatttgccaccggagtcgtccatggcctccagccagatgctctgctgatggtcttgcccgcgctagctctgccgtcacgctttgccggcgcggcgtacctcggtatgttcttggtcggcactgtattttcgatgggtagctacaccgcttttgtaggttcttgtagcgaggctctaaaggacagga

SEQ ID NO: 3084 - DNA, 482 bp, Hordeum vulgare
ccaaacatttaacatagtataagttgcagtctaaaaatataactgtgtcgtattctgagctcaacgtgccgtcaacataacaaataacaatcaaaactaatgttgccaagtagtaacaggaacgcaggacatcaatcaatatagggtgaacccaaagaactgcccaactagaagagctagccccatgcatacagctacaagggaggcagcccaggtcagcttctccgttatcttaggtatcctgtcctttagagcctcgctacaagaacctacaaaagcggtgtagctacccatcgaaaatacagtgccgaccaagaacataccgaggtacgccgcgccggcaaagcgtgacggcagagctagcgcgggcaagaccatcagcagagcatctggctggaggccatggacgactccggtggcaaatgttgtgaagccaactttcttcttcctgggagcaacagcaggggactgttgcaagggct

SEQ ID NO: 3085 - DNA, 515 bp, Hordeum vulgare
tgcaaagaaccaaggatatctcctcactggctcttctgtattttttggaatgaagaggccagtgtaggttcaagaagcccccccttcgacgccctttctccctcatgtgtctactaactttgatctgtgcacctctccccccaccatagtttgttgcatatgtagtcaaatcccctcccctgccatccaatcttcattccatgcatatataatccaaagttccatccagtagcagggatgcatttgttccagcaccctgtgtagttcctggtccttgttcatgttcatggaacatgtggaggatacgagttccgttggtatgcgagactccatttcagagacctgcgagcagacaaaccataatacggttggcttctccagtgcacttcatgacgcacatacctttggtgttcagagccgagtttccaataaatctagttgcttgtttcctttgtagttaatgagcagcgcagcttaagctagactgtttccttatatgtaatgtctgcttggct

SEQ ID NO: 3086 - DNA, 546 bp, Hordeum vulgare
  UNSURE (23): n stands for any base
gtaaatacaaatagaacttaacnttcaggtcacagctgagacaacacataacaaaagacaagctagattgtaagacataaccgacaatcaccacacagaatttagcaccgatataagagtcttgcatataggtgaagatccattgaagagggctcatcaaagatgactcgcccaaaacccacgtcgtcagcacccaacagcaggtactcttcagctccagtttccaggtcccaaagctaaagtcccagtttcaaggtgccaaagctaaagaccacccagcagcaggatctctgggaagccttcagctttgaaaccttgaaactggaacagtacctgctgctggaggccttcatctttgggaccttgaaactgaagcaacaccaatccgtgcatgcaccaatggtgttctgtcaacacacattatcctccacaaatggatcactgaccatggatggaaatgaagatctaacacctaaagaacaaatacctaagtcaggactcaagaccacataggtgaccaccacaagctacaaggtggctctgaag

SEQ ID NO: 3087 - DNA, 327 bp, Hordeum vulgare
tgatgaaatgatcaagtatgcgagagaagatacacactatctgttgtatatatatgacttgatgagacttagactgcaaagggagtccacaagtgaaaacgatcttcttctagaggttcaaaagcgcagtaatgatatttgcttgcagttgtatgaaaaggagctgctgacagataaatcttacctccacatatacgggttgcaggaacatgaattgaccgcagctcagcttgctgttgtttctgctctacatcaatggagagattatatagctcgtgaccaagatgagagcactggttatgtattgccaaacaaggctttgattga

SEQ ID NO: 3088 - DNA, 299 bp, Hordeum vulgare
ttttttttttttttttttttttttttttttgtacaacaacacgccatgtttgtttttcgacactttgttacatacacagatccaattcaccacacgacagcatacacatgtcttccatcatctactgtcaatgaaacaaacaaatgctatggcctatggctatatggggctattctcacatctcatttcatctcatctctgttagtccagcgcctagccactcacgcgagagggcacaacagatcagtttcctactctctttctctataactatttctctgcacaacaggacaggatgg

SEQ ID NO: 3089 - DNA, 502 bp, Hordeum vulgare
  UNSURE (10): n stands for any base
ctgacctaanattggaagtgtcgaacaattccagggccaagagagggaagtaataatcatctcgacagtcaggtcaaccgttaagcacaatgagtttgacagattcttcaacctggggttcctgagcaactatagaaggttcaatgtcgcaataactcgtgccagatcgttgctcgttatcgtaggaaaccctcatatcatcactaaggatcggcactgggataagctcctgaggtactgcgcagacaatggttcttatcaaggatgtccgcttcccccaccagaagaagaggttagatactcaggatacggcgacactagagacacaggatacggcgacacccgaaaccagcctgctggtgatggttgggggtacaaccaagaagagccagcaaaccacgtccacaatcaagacccttctgaccgcggcttcaaacacgacgatggcgggtcctcaaccgcacacgaagcggaatggcccgaggagaagccagacggggac

SEQ ID NO: 3090 - DNA, 551 bp, Hordeum vulgare
  UNSURE (44): n stands for any base
ggcagcagatgagaaggacgacgactacattcacatttcttttnaacacacagggatggcatttagcacgcctgcccatccacgcacagtcaagaatcaagatccagttcacgacggcctaacaaaacaatgtgacgcaccaaacaaacactagagacgttccgaattagcatccgacgagggtgagttcaacatgcccccggaagttagctccgcaaggccgatccccgtcttattccaccaacagcaatggccccgacggaagatctggtcggtcactcccagcctgtcgcggggatgctcgagacatcaccccaaccgggaggaaacgtgtacttctgcacatacgcgtcttggaccgcgctgtcgtcgacatcgttggctgaccactggccggcctgcgcgtcaccctgcccggtagtagccccttcctcgacgtgctgctgctcctgccgtgcctcctcctgaggttctgctgctgtgttggggtatggatggtagtccccgtctggcttctcctcgggccattccgcttcgtgtgcggttgagga

SEQ ID NO: 3091 - DNA, 552 bp, Hordeum vulgare
gtccccccgggactgcagggaattcggcacgaggccagagggcgcaggcggagctcgtcgactaccgcggctccggcatgagcatcatggagatgagccaccggggcaaggagttcgacgcggccatcaagaaggccgagtccgacctgcgcgcgctcctcgccgtccccgacactcacgaggtcctcttcctccagggcggcgccaccacccagttcgccgccgcgccgctcaacctctgcgcctccccctcggaccccgccgacttcgtcgtctcgggctcctggagcgacaaggccttcaaggaggccaagaagtactcggccgcctccgtcgcctggtccggcaaggccggcaagtacacctccctcccggaggacctcggggccctcccgcagaacccggaggcccgcttcctccacatctgctccaacgagaccatccacggcgtcgagttcaaggactaccccgtgccgacgaacaagtccggcgtcctcgtcgccgacatgtcctccaacttctgctccaagcccgtcgacgtctcccggttcg

SEQ ID NO: 3092 - DNA, 485 bp, Hordeum vulgare
  UNSURE (13): n stands for any base
aagtgagcaatgngaaaagagtcccacaatcgtgggaaaatgcagcagcattgcaaaatatagttaccatactaatactacgcatggataggaaacctcaaatgggagacgacgatgcagctcttgcacagagcctacttatgttactgaccaacaacaagccatcctactagagcgagcaataccagaggatcatggccgatcaagggttccttgcttggaagtccttcatgaaagcgacgagcttctccacgccggagagcggcatggcgttgtagatggaggcgcgcacgccgccgaccgacctgtgccccttgagctgcagcatgccctccttggccgcctcggcgatgaactgcttctcaaagtcggcgcccttggccagcgtgaatggcacgttcatgagcgaccgcaccggcttgtccacggggcagatgaagtagccaccgctggcgtcgatggtgtcgtagaggatgccggccttg

SEQ ID NO: 3093 - DNA, 506 bp, Hordeum vulgare
agctcatcatcgatggctatcgctgccgctcgtcggcgcctgtggcgcgggatgcgaactgcagccaccgccaccgcgtcaggcgaggagctgtacgggtccctgctctcgcgcctggtggcggagccggagtgccgcgtgaaggccaccatggaggaggcgacctcctcgttcccgcaccgcgacggcgccttctgggagccccttgccgcggccctcctccgcgcctcctacccagccaaggcgcacctcgtcttggaatggaagctagagaagctactaaaggaaggggttaatagtcataattgtgaaccctactcgacaatgatccatttctgtggagagacaaggaatgcagctcttgcaatgagagtctttgagtgcgcagaggcacggggaattcaactgaacactggcattttcaatgctcttattaacactttcttggctgtcggagatctccttgctgcagtgaccttatacgagaccatggaagaaatggagga

SEQ ID NO: 3094 - DNA, 487 bp, Hordeum vulgare
cgaaagctagctttaagaacttcgatcctagtaaggtgaaatatgataacacctcacagcaaaaacatgaactacatacctaaatggcatgttaggcagcaaaaaacctctcactggcctgtagaagtttaaaacctatccccactacacaaaccgccacatattctatgcactacagttttgtgacatcttggctaaatagataaacaatcaacatgatactgtgactgtgagagatcgttcctaaacctaattagagctaggaaaagtggcaccaagatctgatgttgatgcactttatttataacttctgcaaataccaaacaaaggaagccagtgtacatacttctttggaacctcatgcaaatccagcttccctcatatcttttatggttgcctcaagtctttgatgcaagtcaaacctccgaaatccagcaactaatatatcgtagctagagcgggtgagcatgtacaagctttgaatgcg

SEQ ID NO: 3095 - DNA, 540 bp, Hordeum vulgare
  UNSURE (3): n stands for any base
ggnctgcagggaattcggcacgaggattttgagaaaactctggagtactggcaacaagacaagtggaatggttcattctctgtcaagtggcacattgtcaaggatgttcccaacaacattctcaagcacatcgtcctagagaacaacgaaggcaagccagtcacaaacagccgtgacacacaggatatcaaccttgagcaaggtattcagatgctcaagatattcaaagagcatgtgagcaagacctctatcctggaagacttcaccttctacgagaaccgtcagaaattgatgcaggagaagagaataaaacaacagcagatccaaaagcaggtgtgggacagtagggctccgaatcttgttgccggggagaaacaacaggaaccgaaggtaactgtaccgaatggtgtcaatggagagaaacaacaggatgccatcaatgggaagccgaagtctcctgtagcgaacggtgtcaacgggggcgtgaaggttccggcagagaaagccgcccctgctgctggtcctccagccgttacctac

SEQ ID NO: 3096 - DNA, 555 bp, Hordeum vulgare
  UNSURE (24): n stands for any base
gaaacacaagtcaggattccgatngtaatataatcttaataagacgcaaaaaaaacagctccaatctagaacccactttcagatccacacacccaacacatagtacttactcaaacaccaccgaataccgaaaacagacgcacaacgcgacgcaaacacaaccgcaaccaggccaccgggtacggcggcccggcgacactacctttgtcttgccacaggtttccttttctctttttctgccgattccgatgataccactatagggaggagtctttagagctaagcaaactgaaacagggatgatgatagtacgacgacaacaagagaaaaaggaggagctaggggaacctaactatctgacccgctttccagcacccgcctttggtgatcgctccttcatgaacccgcatgtctcgcctgattcgccaggaccattacgtttgttcctcatggctagctgggaggatcgggtatgcgatcaagcagctacgccggtcttgacagcaccgttggcaacggcaggcttcttctcggtcaccgcaggcttcttctcgg

SEQ ID NO: 3097 - DNA, 516 bp, Hordeum vulgare
gggatgcaccagtcgacgacacccacggcgacggccccaagaaggtcctccgccggctgccgcacgtgtacagcaaggtgctcgagctgccgctccccgcggacgccgacgtcagggcgttcgagggcaccactgcgctccacttcttcgcggcctgcggcgccatgggcgaggtgagggcgcggctcgtgaggatttaccccggggtcgtcaaggtggtggtggtgcacgctgggaccggagacggcggcgaggacggcgacgacatggagcttgacaggtggaggtaccggctgcctgaagattgttgcccggagctggctatggccgggtacgtcgacgggcagcttatcgtgacggtgcccaagggacgcggcgaaggcggcgacggggcttggaggtgcggcaatggagcagcgggggagattggtgggaagctcgtggtcgtgcaatagaaccggtggggtactagtgagcgagcgtgagctccataattgctcatctagtcttgagtat

SEQ ID NO: 3098 - DNA, 549 bp, Hordeum vulgare
cccttgaccagagctaggaagggttgcttattgggaacagcttctcttccccaaatcaggaaggagcagaacacaaagcgcccatctttatggaaaaagaagaaacaaatggcaagaagtaaccagaatactcaagactagatgagcaattatggagctcacgctcgctcactagtaccccaccggttctattgcacgaccacgagcttcccaccaatctcccccgctgctccattgccgcacctccaagccccgtcgccgccttcgccgcgtcccttgggcaccgtcacgataagctgcccgtcgacgtacccggccatagccagctccgggcaacaatcttcaggcagccggtacctccacctgtcaagctccatgtcgtcgccgtcctcgccgccgtctccggtcccagcgtgcaccaccaccaccttgacgaccccggggtaaatcctcacgagccgcgccctcacctcgcccatggcgccgcaggccgcgaagaagtggagcgcagtggtgccctcgaacgccctgacgtcggcgtccgcgggg

SEQ ID NO: 3099 - DNA, 518 bp, Hordeum vulgare
cttccgtctcccgtgcgcacaactctccaccgcagcccccaatccccacccgtcttcccggagcagcgatggcccccaaggcagagaagaagccggcggcgaagaagcccgcggaggaggagccggcgacggagaaggccgagaaggccccggccgggaagaagcccaaggccgagaagcggctaccggcgggcaagaagaccgcctccaaggagggcggcggcgagaagaggggccggaagaagggcaagaagagcgtggagacgtacaagatctacatcttcaaggtgctgaagcaggtccaccctgacatcggcatctcctccaaggccatgtccatcatgaactccttcatcaacgacatcttcgagaagctcgccggcgaggccgccaagctcgcccgctacaacaagaagcccaccatcacctcccgggagatccagacatccgttcgcctcgtcctccccggggagctcgccaagcacgccgtctccgagggcaccaaggccgtcaccaag

SEQ ID NO: 3100 - DNA, 555 bp, Hordeum vulgare
tcttaagcttgcaaaagccggcaccattcataattagttcttacagcgaacgaagcattgggcaagcattcagcaactcccatccagcaccagcactacttctacttggcgatgaccagactgaacaaccacgtttaccacatgatacatgcaatggaatctaagaggaggtgaacttggtgacggccttggtgccctcggagacggcgtgcttggcgagctccccggggaggacgaggcgaacggatgtctggatctcccgggaggtgatggtgggcttcttgttgtagcgggcgagcttggcggcctcgccggcgagcttctcgaagatgtcgttgatgaaggagttcatgatggacatggccttggaggagatgccgatgtcagggtggacctgcttcagcaccttgaagatgtagatcttgtacgtctccacgctcttcttgcccttcttccggcccctcttctcgccgccgccctccttggaggcggtcttcttgcccgccggtagccgcttctcggccttgggcttcttcccggccggggccttctcgg

SEQ ID NO: 3101 - DNA, 552 bp, Hordeum vulgare
gtacccccgggtctgcagggaattcggcacgaggtaagctggaacctaaatgctgataactgggagaaagatgagaatctcaagaaaatccgtgaggccaggggatactcttatgtggacatttgcgatgtatgtccggagaagttgccaaactacgaggccaagctgaagaatttctttgaagaacacttgcatactgatgaagagatacgctattgtcttgagggcagtggatactttgatgtgagggaccaaaacgaacagtggatccgtatagcagttaagaaaggcggcatgattgttttgcctgcaggaatgtatcaccgctttacattggatagtgacaactacatcaaggcaatgcggctctttgtgggagagcccatctggacgccgtacaatcgcccccatgaccatctcccagctagaaaggagtatgtcgacaagattatcaacagaggtgggagccaaaccgtcgaggctcgttgatggcttctacagtgttccgcaacgagtgactcttctgtatgtatctacatatcacaccaaaag

SEQ ID NO: 3102 - DNA, 552 bp, Hordeum vulgare
ggagagcatgcatctgttttcgttcaccgttgctgacactggatcattattattcaatacaggcatcattgccgggcgaagaagtttcaggaaagatttcgagcgggtaacggtgcagactaccacacaagtgatacatgatcgatgctggtacgagtacaccgcgaaagccaatcacacacatcttattcagtaacttttggtgtgatatgtagatacatacagaagagtcactcgttgcggaacactgtagaagccatcaacgagcctcgacggtttggctcccacctctgttgataatcttgtcgacatactcctttctagctgggagatggtcatgggggcgattgtacggcgtccagatgggctctcccacaaagagccgcattgccttgatgtagttgtcactatccaatgtaaagcggtgatacattcctgcaggcaaaacaatcatgccgcctttcttaactgctatacggatccactgttcgttttggtccctcacatcaaagtatccactgccctcaagacaatagcgtatctcttcatcag

SEQ ID NO: 3103 - DNA, 519 bp, Hordeum vulgare
gggcttaaataaagccgcggaggtgacgctgaagctggatttgagtacacttccgaaacccggcgtcctagtcgagttgctaaggtgccgcacgaagaagcaaggcgctaggtttctctcattcaatcctgtgaatggtaactggaagttccaggtcgaccacttcagtaggtttgggcttgtggacgaggaggaagatgatgttgccatggatgagccggttgttcgacaaccggttgctgaagcaagagacccacctccaaatgggcatgagctggagctttcgcattcgttgcctgctcatcttgggcttgaccctgcaaagatgcaggaaatgcggatggcattgtttcccaatgatgaagaagacgaagatatggaggatggctttccatctgatcacagacacctcagcagagaaaggatgaatgtggattcacccaacacaagtggtaaaggtcagaggatgaggtctctgtctcctttgcatggttcttctcagaaatttggaaggagatc

SEQ ID NO: 3104 - DNA, 495 bp, Hordeum vulgare
ccgaagcctcgtcgctctcctttgaaaaacacagctttacatggttcgcgaaaagcagtatccgcacgccacaaaacaacaagatcagcctacgtattgcctgcgataaatctacaaccgactctttggcatttcaacacacacaaacactctactacaaccctacatgagttgttgttcgtaacaataataacaaaaaagacgatgcccgaatgggtgcggcacacgggttacaacaaaagtggcacgcgtgcagaaaaatatcgtcaggtttcttcatgcttttgcaggggtgggcaattgtctgcaccgaccatggcaatgttctacatttccctcagcttcagacatgggaatctctgtaacttgttccaaatgcgtggtgtgccaattcacagctcttgcgcaacccggattccgtgacggacttgagcaccataggaactatgtcatggatcatccgtaggaactatgccatgagtcccataggactag

SEQ ID NO: 3105 - DNA, 405 bp, Hordeum vulgare
attcggtacggcccacgggtctgacggatggaatggacgcgccctaactcgcagatcgcacttcgcaagccgcgccgccgccgctccccacgctcgtcgggcacacgccgtcaaaccactccactccacccacccgtccgccgtctcccacgcggcgaatccatcgccgcgcggtggccacgccctgcagctcctgcccccccagggctgcgcgccggcggcgagcccagcgatagggcaaagcgcgactgaatcggcgtgcaatcggaggcgccgggcgggggcggcaccgcggcaggctgccagcgaatcggtcggttgccgctccgttcgtcttcgtccgatggctgtcgacgccatgttccctgtcctgcgcttctccgactacttcacccggccgtccat

SEQ ID NO: 3106 - DNA, 413 bp, Hordeum vulgare
ttttttttttttttttttttaaatccacaaccgactctttggcatttcaacacacacaaacactctactacaaccctacatgagttattgttctacgtaacaataataacaaaaaagacgatgcccgaatgggtgcggcacacgggttacaagaaaagtggcacgcgtgcagaaaaatatcgtcaggtttcttcatgcgtttgcaggggtgggcaattgtctgcaccgaccatggcaatgttctacatttccctcagcttcagacatgggaatctctgtaacttgttccaaatgcgtggtgtgccaattcagagctcttgcgcaacccggattccgtgactgacttgagcaccataggaactatgtcatggatcatccgtaggaactatgccatgagtcccataggactagga

SEQ ID NO: 3107 - DNA, 517 bp, Hordeum vulgare
gaaccgcatcgggatagacagatccacagaacagaagaagaagaagggcagaggcagaggaaaccaagaagcgcggcgagggtcgtcggcgatggaggggtgggacaagggcacgaagagcgtggtgggcgagatcccgctgctgtcgacgcgggcgggtccccgcgacggcgacgcgtggcggcagcgcctcaaggaggagtaccgcgccctcatcgcctacacctccgtcaacaaggccaaggacaacgactggttccgcatctccgccgccaacccggagggcacccgctgggagggcacctgctggtacgtccacaacctccgccgctacgagttcccgctccagttcgacatccccgtcgcctacccccaggtcgcccccgagatcgagctccccacgctcgacggcaagacccacaagatgtaccgcggggggaagatctgcctcaccgtgcacttcaagccgctctgggccaagaacttgcccgcggttcgggctcgcgcacgcgctgtg

SEQ ID NO: 3108 - DNA, 550 bp, Hordeum vulgare
cctggagttatgtattgctggctcttattagtccaaaccgagtggattttcaatccttcaatccccctgacaatcatcacactgtaactgtcactgtcagcaacaacaaaaaagacatactgtaaccgtcttgcggctaagaggcagcagcagagccagacgcagcagccgcatctgcaggagcggcctcgtcgtccttgtgcttcaccatgcccgaatcgaccaggatgggcacctccgcggcgagccacggcgcgaggccgaggcacagcgcgtgcgcgagcccgaaccgcgggcagttcttggcccagagcggcttgaagtgcacggtgaggcagatcttccccccgcggtacatcttgtgggtcttgccgtcgagcgtggggagctcgatctcgggggcgacctgggggtaggcgacggggatgtcgaactggagcgggaactcgtagcggcggaggttgtggacgtaccagcaggtgccctcccagcgggtgccctccgggttggcggcggagatgcggaaccagtcgttgtccttggccttgtt

SEQ ID NO: 3109 - DNA, 368 bp, Hordeum vulgare
atcgccccctccctcccctctcccgagcagatctcgcctcgcctcgaccagcagccgcagccagatccgtccgcccggccgtctcacgaggttcgatccgtcggttccccgcggacgcgcttccctcgccgccgaccggtggctcgtctgatcggagcgcgcggcagccgttagggacggcggagagaagcgcggagtcgatctgagagagagggaggggcgaaccccttcgtgctcccgtcggtttcgatctgttcgtcgggtgcagatccggaagggcttggttcgatctgccgcttacgaccgggcgccatggagactctggtcatctcgcagcagcgcagccaccaccaccaccactctggtcg

SEQ ID NO: 3110 - DNA, 487 bp, Hordeum vulgare
gcccatatgaaagtcttgcatttatgcgctcaaaccatgaagctaacaaagaaagcagcaacatctgctaataaggtggaacaccactagttccaaggtttaaacaacaagccaagcagacattacatataaggaaacagtctagcttaagctgcgctgctcattaactacaaaggaaacaagcaactagatttattggaaactcggctctgaacaccaaaggtatgtgcgtcatgaagtgcactggagaagccaaccgtattatggtttgtctgctcgcaggtctctgaaatggagtctcgcataccaacggaactcgtatcctccacatgttccatgaacatgaacaaggaccaggaactacacagggtgctggaacaaatgcatccctgctactggatggaactttggattatatatgcatggaatgaagattggatggcaggggaggggatttgactacatatgcaacaaactatggtggggg

SEQ ID NO: 3111 - DNA, 518 bp, Hordeum vulgare
gcattcctctcccccgccgccaccccgtccctgcatcctctcccacgccaagaccggcgccgccgccgctcgtcaagatggtgctccagaacgacatcgacctcctcaacccgccggcggagctcgagaagctcaagcacaagaagaagcgcctcgtgcagtcccccaactccttcttcatggatgtcaagtgccagggctgcttcaacataacgactgtgttcagccactctcagaccgtggtggtgtgcccgggctgccagacggtgctctgccaacccaccggcggaaaggcgaggctcaccgagggatgctccttccgccggaagggcgactaagttgcacgcctgtttatgggaaaatgaagccccactgaacgttacttttcaagtactcctagttatccccgatgtgtactggtcaaattttgttaattatgcttgcccgtttgccagcctgaacgttgtagcaacttgttctatgtcatgcacttccttgaatcgcctgttgttggttct

SEQ ID NO: 3112 - DNA, 551 bp, Hordeum vulgare
  UNSURE (20): n stands for any base
gataaatacatgatatttgnatcagacccaggacatgacagaatacagaccgtattttgaacactgaagagaatgcagcaacaaacgaaacggacttgccaggtagccagacaaacagaagaaccaacaacaggcgattcaaggaagtgcatgacatagaacaagttgctacaacgttcaggctggcaaacgggcaagcataattaacaaaatttgaccagtacacatcggggataactaggagtacttgaaaagtaacgttcagtggggcttcattttcccataaacaggcgtgcaacttagtcgcccttccggcggaaggagcatccctcggtgagcctcgcctttccgccggtgggttggcagagcaccgtctggcagcccgggcacaccaccacggtctgagagtggctgaacacagtcgttatgttgaagcagccctggcacttgacatccatgaagaaggagttgggggactgcacgaggcgcttcttcttgtgcttgagcttctcgagctccgccggcgggttgaggaggtcgatgtcgttctg

SEQ ID NO: 3113 - DNA, 518 bp, Hordeum vulgare
gtgcgtcttccccgcgtggccgcgtggcctacaacaagccgccgccgccgtgccgtgccgtgcccataccccacggccgccggctgacgctgacgccccccctcaaacctctccaccttcgccgttcccgttcatgttcatagcgtccctgtccctgcttgtccctcccccgcccgcaagccgcaacctttggccactggatttaaaggtagtgtactgatgaagacagagatcgaggaggaagtcaccaaagggtcctggactgaggaggacaaatccctttgtgcttctgtgctgggcttagatgccttcacatatctgacaaaaggtggaggcgccatatctgaaaatcttgtagcagcgtctgtgttggtgggcttgcaaaataaactccaggacctggttgaagctgatggtcaaagcctttgctggaactacgccatcttctggcaactctcccgcaccagatccggtgaacttgtccttggctggggtgacgggtcttgccgtgaacccca

SEQ ID NO: 3114 - DNA, 551 bp, Hordeum vulgare
ggctgagttcgtttattttggttataataaatagctagaatcattgtaactataaccaataaacatcaaaactgaactgaccacaggatagacggttaaagatttacggcagtaatttgcacatacagattattctgcaaagtcagaatctgagctttctgtggtcatgtagcaattacatggacactgaggagtcctaccattgctacctgttcacagccagaaaagcaatctgacatctaatgcattaagttatcaatcaattctacatggagctcatagcacgagacatcgcggcaatcaatttctcccttgtttgctgttcagagccaggggacttgataacgaaggaatgcacaactgtcccattgttggatgtgatctttgattcgcccactttgacttctgcctcttcaaaagcttggaacacattctttactggatagttgtccataggtgacattacacgaacaagaacctcatcttgcaccacctggatatctacttctggcctaggtgttcggaccatgcggtctggcataccagactcc

SEQ ID NO: 3115 - DNA, 765 bp, Hordeum vulgare
gagtgaaaacctcggtttgtttagttcccggatgcacgaaatcctcgattttttgtactggggggggggaacccaattattagaagatagtgataagcgcaagtgccgtgtcgtcgggcgacagagtaactggagcgataagtcacacacagactccaacctgaaccgttgaaacatcactcaatggagagccgccagagtggctgcactactttcgcaagcagaatagcatagaaaatgacacatattaactaactatgtaatgcaggagggagggggaaaatatattattatatgttaatacagcaactacattctgcacgccaccagcaattttatacttgacaaacccccccacaagcataagtaaatgcaataacgtcgtacctcattatgaaatgacgcgcctatgcaaccataccaatgccacgagaaccgccggtcgattaaagatacgaaaaagctcacttgcacgggtcaagttcagcggtgaataatgaggaaaaataatcgactgcatcccccataactttgcctagcaggtgaaacatgtccatcccctatataatagtctttcagttaagtcattactatgccgaatccctaactacatgctgacctcgttcactctacactgttcactgcatggcagatactatccttgagtctactcaatggtctactgtcacatataacaatatccatatcaacttcatctatgtgcactccattacaatcatattatggctcgttgtggcggatgcg

SEQ ID NO: 3116 - DNA, 465 bp, Hordeum vulgare
tttttttttttttttaaaaacaagtactttcaaaaggaaggatacaacatcttctcttcttcaagaaagatgacacacagcccatgcatacccgcaacaccagcaaaataatcttctgcaccttactcccccctacactccattccaggaccagcctcgactaccagctggtcgcttttgaacaattcatggagatacagagcagagcaccaatcctaatctgaaatcacaatgctagaaatggcaaatggccttctaaatcctccagccacgtctacgccgactcggtagtactttacagttgaacttcacctccggatcacttcccgtgtgctcaatcggtcacgcacaaggccgtgtcgtctttaaattagtatagtcggaggagttgcctatgtaccaggagagcataccgcctcgaccgccaccctcttcatcacattcgggcaggggtctccgccgaag

SEQ ID NO: 3117 - DNA, 510 bp, Hordeum vulgare
ggttccaccagaattatgcaccttcacaactttaattcatgggtattgtagggagggtaacatagagaaggcattgcaactatttgaaacaatgctgcatgagcgtttgacgccagacattgtgacatacaacactttgattgatggaatgtgcagacaaggtgatctgggaaaagctaatgagctatgggatgatatgcattctcaagaaatcttccccaatcacattacctacagcatcctgatagacagccactgtgagaagggacaagtggatgatgcatttgggtttttggatgaaatgataaacaaggggattgtgccaaacatcatgacctataattccatcattaagggttactgccggtctggaaatgtattgaagggacaacaatttttgcagaagatgagggatgccaaggtgttgcctgatttaattacttacaacaccctaatccatggttatgttaaagaagagaagatgcatgaagcttttaatttgcttaacat

SEQ ID NO: 3118 - DNA, 544 bp, Hordeum vulgare
tagctagccaatttgggtagtgttggttttggtacaaaccaaacactcttattccatttcttacattttaagtctatatagtcttctgctacagtacatatgccaaaaaggaagaaaaacacatccatggacatgaggatgaagtgcaatttctgctgcctatcgccagcaacattgggctaaccaaaatcatgaagcatcagctcgcaaaaatcaccagcaacatagaggcagttatttatgacacaagaaccaaagaaatgccgcttccgtagcatatctggggcccggtgccacttgtttgtccgagtactgtaaaatacaacacgcctcatggaccctcgtactgagtctttgccaccaaataagtacaaatagcagccactgagaacagcgcaaccaaatcccacggcttcggaatactctggtcgaactggaggaagtgacttccagagctggtgcactttcttccgcagtgagtaataataattcccagataaaagtcggctccaccttttacagactaaacgaagattagggtgct

SEQ ID NO: 3119 - DNA, 71 bp, Hordeum vulgare
gaactagtctcgagttttttttttttttttttttttttttttttttttttttttttttttttttttttttt

SEQ ID NO: 3120 - DNA, 551 bp, Hordeum vulgare
  UNSURE (25): n stands for any base
acattgtacgtgtctcgtacatggnccatgtcgaaaaccaggcttcaacaacattctgagataatacaactttgtcactacagatgataagaaaccccctcccaggaatttgcaacaaaaagaaaaatgacagcatccattttctttgataccccccgcccttcgtcacacacagtacaacattcctccacatcgtaagcacaaaaaaaccgtatatattgataagcttctagcaaattcagcagcactcatgaataatttctctggggcagcacatgatcgagtagagttatccccgctacagtcctccacggcaaaatcgcattcgacaggatatggggtcaggctatatccaaagtccaaaaggaaaatatatatatcaccacttctctccttttagtaaaggctcggacgaccatttatttaaggcagggctcgacaaaaccgacaggcaagtgcaactgctgaaattaccaccattatcccccatagctcaaaacgaattttgtattctatcgctaaccttctcagtcaccgggaaaacctatatc

SEQ ID NO: 3121 - DNA, 488 bp, Hordeum vulgare
ggcctcgtgccgaattcggcacgaggagtcaatcctgggtttggtgggcagagctttatcgagagtcaagtaaagaaaattgctgatttgagaaaattatgcgaagagaagggagtgaacccctggattgaggttgatggtggagtcagtcccaaaaatgcctacaaggtcattgaagctggcgcgaatgctcttgttgctggttctgcggttttcggggctaaagactacgctgaagctatcaaaggaattaagaccagcaaaagacctgtagccgtagcagcatgaagaaccggagtataagcatgctacactgtgtaacatctcctcttttttgttttaccattgtcgtggtttgcgttgcataggtgcctttcactgtcaagccatacgttgtatcacagagatcaccatcatcagatagggaacaagaggcaacaaagaaatatattttccttttccaaaaaaaaaaaaaaaaactcgggggg

SEQ ID NO: 3122 - DNA, 449 bp, Hordeum vulgare
aattatttctttgttgcctcttgttccctatctgatgatggtgatctctgtgatacaacgtatggcttgacagtgaaaggcacctatgcaacgcaaaccacgacaatggtaaaacaaaaaagaggagatgttacacagtgtagcatgcttatactccggttcttcatgctgctacggctacaggtcttttgctggtcttaattcctttgatagcttcagcgtagtctttagccccgaaaaccgcagaaccagcaacaagagcattcgcgccagcttcaatgaccttgtaggcatttttgggactgactccaccatcaacctcaatccaggggttcactcccttctcttcgcataattttctcaaatcagcaattttctttacttgactctcgataaagctctgcccaccaaacccaggattgactcctcgtgccgaattcggcacgagg

SEQ ID NO: 3123 - DNA, 423 bp, Hordeum vulgare
ccagctcagttgtctccggcggctgctcctcctcatccctcgcgttgcccgccatctctctttctctagcttgctgcagcctgcaaggagaagttcagtttccccgcccgccacgccagctgacctgacccggaacggaggaaagaggagcggagttcgcctgtggatcgtcaggaaaaggtagcccattcatcctgtcaactgagaggtagagaaagggatggggaactgcatgaagtccacggcccgggtggatcacagcatgaacactagtgccgcctatccatcgaaagtgaccagcaaaacaagcttatcatctgctacttctgcgagcaagaccaactcaactcgttcaacgtttactctgccatctataagagatcgcagtgagcctcctcggacagaaggcgaaatcttgtcatc

SEQ ID NO: 3124 - DNA, 552 bp, Hordeum vulgare
ggcttggtgaaaaacaatttatacagagtgccgcgtagtcattattccgtgccacactctacaaatgagcaagcatcacttagaaaaacaactagtattacacagctcaccaccaaatgtacagccgtacaaatacatctgtctccctcttctaagctgcacatttagtgaacctgtgcagtcctatatgccggtgacgctccaagagagcgccgcggcgagggctggcccctcattggcgactttgggacggtgttggaggtcctccggatgtcaacctgcggcgacgttaaattgcttttggagtcctggagctgctccagctcttctaagacctctgaaatctgcggccgcatcttggcatcgttgcagatgcattgcaaggcgaggttcgcgacggcgtgtgcgcctttcttaggatactggcctcccagcttcgtgtccatgacacggtacagcctgcgcttgtcacggaggtgcggcttggcccagtctactaggttctgctctatgcctggcttcgacttgtccagggctcgtctcccggtcagc

SEQ ID NO: 3125 - DNA, 518 bp, Hordeum vulgare
tacaaaagcaatggttatctgaagatatcctgcaatggaggtctaaatcagatgcgttcagagatatgtgacatggtggcagtggcacgtctgctaaacctcacgatggttgtgccagaacttgacaagagatcattctgggcagatcagagcaattttggagacatatttgatgtgaggcatttcattaccacattaagagatgaagtgcgcattgtcaaacggctaccaaagaggtttggtccaacagattcaagcatcacacttgacatgtcacctgtgagttggtcagatgagaagtattacctgcaccagattttgccactcttcagcaaatataaagtcatccactttaacaagacagatgctcggttagcaaacaatggcatcagtactgaacttcaactggttagatgccgtgttaatttccgtgcactgaagtttacccctcaaattgaggcattgggtaataaactggtatggaaacttcgagacaagggatcatttgtggcattgca

SEQ ID NO: 3126 - DNA, 528 bp, Hordeum vulgare
ataaatcaacagtgaacaagaagccgaacaaaaatttacacaaagcctcgctacctatttcggcaagcttgaacataaatgaatggattgcagaattgaaagaagaaaaacctgacctatacaacagaacactgggaacactggttagacgatcgtggggactctgcccgaatgccggcttcagtccgaggatcatcaccaacagtaacttgcacaggcgaggcggcaaatgtgctcaccttacagtgactgtattcttggttccactgcacaggcttgaattggccaagcactcatgggggttagaatagaagtaatcctcctctttcggcttgttttcgagttttcgccgacaggatggttgaaccacacggcctctatgaacttcttggacagaagatgtaaaattctcccaagaaattgtcttgttggtgtacaagtctataagttcaactagtttccgtcggtctggcaacacactttttcggaaacccaggaaccttctgtggccttcaacaagttttgcca

SEQ ID NO: 3127 - DNA, 287 bp, Hordeum vulgare
cccttctacccctccgtggcgcgccccgccggcgtcgacatcgaccatctcctgcacgcctccgtccccaagatggagcaccaccacggcgcccctgacacggccagcttcggcaacctgctctgcggcgtcgacgagccgccgcccttctggccgtgggcggatcaccagcaattcaactgatggttcgatcggcacgacgatatatatcttgttgcagtcagtcacgtctgctttgctcgcacgatcagcaatgagcgtgcataaatattcgatgcgtttggatt

SEQ ID NO: 3128 - DNA, 548 bp, Hordeum vulgare
tgggggaacaagcccaaatgcaccattaacctatacaacgacggatcaacaccgcctcacaattcacaaatttatgtatgggaacaaaaaagggagaggaaaaaaagggacaagaaaaataataatagcaaagatactattcaaactccaaaatctacctacacacgcttcacacacaccggacttattcccctacacacgtgcccccactattcatcatcaactctccatcgatccatgactcaaatcgcatcgccatcttgggcttctcatggatgaactgaacttgcctcccatcaaacatgcatgtacaaccgtctccaccgtacgtacgtacgtcctcatcaagaatccaaacgcatcgaatatttatgcacgctcattgctgatcgtgcgagcaaagcagacgtgactgactgcaacaagatatatatcgtcgtgccgatcgaaccatcagttgaattgctggtgatccgcccacggccagaagggcggcggctcgtcgacgccgcagagcaggttgccgaagctggccgtgtcaggggcgc

SEQ ID NO: 3129 - DNA, 552 bp, Hordeum vulgare
gtacccccgggtctgcagggaattcggcacgaggctgcaatcagagatatacaacgcaatgacagctcaagctccaaccatggcagtccccaccgatgcccaactgattcaggcgcaggcggacctatggcgccatagcttgtgccacctcagggccatagcactcaggtgtgctgtccagctcggcatccctactgcgattcaccgactcggtggcacaacctcagtgtccgatcttgtcaccgcattgtccctaccacaatctaagatgccatatcttggccgtgtcttgcggttgttggccgcgtcaggcgccttagcgtcccctaaggaggggacctactccctcgtcccgctatcatacctcctggtggatggtgtattcattgatggtgaggctagccagaaggccattgtgcttaccacgacctcaagacattacatagaggcggccttagggctagctgactggttcaagaaggacatcgcaccaccaccatcaccatttgaggatgttcatggtgccacactcttcgaggagagtatggcgct

SEQ ID NO: 3130 - DNA, 553 bp, Hordeum vulgare
  UNSURE (60): n stands for any base
tcttaattagtatttattatattagccaacgaagttactctcaaataatgagaaagtgangactagtcctaaagttagttccccaagagtgaaaaaatggttcgaaatagtttacaaagacaacacttcataccttaagcatgagaacttgagcaggtggaatggcatggaataggtcaccagcaacatagttaacgataccatcacttggaactttctcgatcaccttcggaaggtccaacacattgcacttgatatgcgggaaggccttgacaatggccctagctgtcgttccatcaccaccacaacagtcggtgagtgactggacccccttaaataagtcatggcattcccgcaatatagtgcctatccccaaatggtcatgggcagccaaagcttcatggaacatcttgtctgactctgggtcaaggagcgccatactctcctcgaagagtgtggcaccatgaacatcctcaaatggtgatggtggtggtgcgatgtccttcttgaaccagtcagctagccctaaggccgcctctatgtaatgtcttga

SEQ ID NO: 3131 - DNA, 540 bp, Hordeum vulgare
gtcccccggctgcagcatatcgcacgggtccaagtggttttggccgtactgggagtaactactggggattccagacgcaggacgtcatccctgacatcgtaacgatggcaaagggaatcggtaatggtctaccactcggtgcagttgtaacaactcctgagattgctagcgtgatggctcagaagatccagttcaacacattcggtgggaacccagtctgttctgctggtggattggctgtgcttaaggttcttgacaaggagaaacgccaggcgcattgcgcagatgtcggcactcacttggtggaacgtctgaagtcgcttcagcagaagcatgaaatcattggagatgtcagaggaagagggctgatgcttggggtggagctcgtcactgacaggacggagaagacaccggccaaggctgagaccgctgttctgtttgagaaactcaaagatctcggcgttctactcggcaaaggcggtctgcacggcaacgtcttcaggataaaaccaccgatgtgcttctccaaggacgacgcag

SEQ ID NO: 3132 - DNA, 546 bp, Hordeum vulgare
ttactgatcgctttccccccttgatttattcatccctgtgtaggggttgtgttccaccatcacgaccatatagccacacgggcaagcagtgcaaacacgcattacatacacatgcgttgcgtgtaaacacgcagtgacgcatcccagcgatgagcacgtaccatgctaccagcattcatgcattccgcgccgccgcccggcgactgttcaggagcaggcgcgagaacgttcatggtcctcagaaccctgacatggcgtagtccatggcgtccaccaagaaatctgcgtcgtccttggagaagcacatcggtggttttatcctgaagacgttgccgtgcagaccgcctttgccgagtagaacgccgagatctttgagtttctcaaacagaacagcggtctcagccttggccggtgtcttctccgtcctgtcagtgacgagctccaccccaagcatcagccctcttcctctgacatctccaatgatttcatgcttctgctgaagcgacttcagacgttccaccaagtgagtgccgacatctgcgcaat

SEQ ID NO: 3133 - DNA, 417 bp, Hordeum vulgare
agagccgcagccacatccacagccatctccctcctctcgccctcccacctccggacctccgctgccgccagcctcccctaccgccgccgcccccgcatcgccgcgatggccgccgccgcctcctccttccgcccggaggccgcgcgctcgcccgccgccgtcgagcccccggccccgccgctctccaagttcaaggtggcgctgtgccagctctcggtaacggcggacaaggctcgcaacatcgcgcgcgcccgcgccgccatcgagtccgccgcggccgacggcgccaagctcgtgctcctcccggagatatggaatggtccatattcaaatgacagctttccagagtatgctgaggacattgaggctggtggcgatgcagctccgtcattttcaatgatgtctgatgttgctcgc

SEQ ID NO: 3134 - DNA, 329 bp, Hordeum vulgare
ttttttttttttttttttaaccccaacaggttgagtgacatttatcgatttttgttcctgccaatgcggttcaattatttcgcaactcaggcagttatacatgttacatacagtatctccttatttggttctgtccccttctcgcacattatctcatcatctcgcgatccgaaagcttgagcttgccttcccaatcggcggctgttgctttcacggatcacgccggcgcgagcaatgaggacagtctacttggaacccgatccctggacgtctaccagctgataaagatctccacgtcgttggtgtcgcagaggaaggaattgccgcct

SEQ ID NO: 3135 - DNA, 491 bp, Hordeum vulgare
ggcgtatcgctgcatacatcctcgtcagggcttgatctacctatgaaggtggttgatatgtttggatgtggattaccagtttgtgccgcttcattctcctgcatcgaggagcttgtgaaagtaaacagcaatggacttcttttctcaacatcttctgagctcgcagatgaactcatgatgctcttcaagggatttccggaggaatgcgatacactgaaatccctgaaggatggtgcgttgagtacaggatcatcttccaaatggtcaactgaatgggaaactaacgcacttcctttggtgaaccaggtcatagggtaaaataatcagatgtgcagaaaggatggttgggttgccttcctgaatatctgccaattacatagtttataggtgtaattctacacttgagtgaccagatgtacattcgatggtcgaggagaaagcatgttcatatatcagtttgcttgcaccagatgctacaagcgcattggtgt

SEQ ID NO: 3136 - DNA, 493 bp, Hordeum vulgare
gtgataggttatcctaaagacaaacaccaatgcgcttgtagcatctggtgcaagcaaactgatatatgaacatgctttctcctcgaccatcgaatgtacatctggtcactcaagtgtagaattacacctataaactatgtaattggcagatattcaggaaggcaacccaaccatcctttctgcacatctgattattttaccctatgacctggttcaccaaaggaagtgcgttagtttcccattcagttgaccatttggaagatgatcctgtactcaacgcaccatccttcagggatttcagtgtatcgcattcctccggaaatcccttgaagagcatcatgagttcatctgcgagctcagaagatgttgagaaaagaagtccattgctgtttactttcacaagctcctcgatgcaggagaatgaagcggcacaaactggtaatccacatccaaacatatcaaccaccttcataggtagatcaagccctgacga

SEQ ID NO: 3137 - DNA, 525 bp, Hordeum vulgare
  UNSURE (14): n stands for any base
gcacaagcccgcangccgcgcacacagagcaagcgacgcaccacccaggcccagctccggcgagatctccggcgacccttcgagatgagccgcggatcgggcgccggctacgaccgccacatcaccatcttctccccggagggccgcctctaccaagtcgagtacgcgttcaaggcggtcaagtcggcgggggtcacctcgatcggcgtccgaggcaaggactccgtctgcgtcgtcacccagaagaaagtcccggacaagttgttggatgacaccagcatcacgcacctcttctccattaccaagtacaccggcttgcttgccaccggcctcacagctgatgcgaggtccttggtctcccaagcaagaaatgaagcagctgagttccgtaaaaaatggggatatgagatgcctgtggatgtattagcaaaatggattgcagacaaagcacaaatatacacgcagcatgcatacatgagaccccttggtgtagtcgctatggtcctgggttatgatgaggagaaa

SEQ ID NO: 3138 - DNA, 556 bp, Hordeum vulgare
  UNSURE (52): n stands for any base
gcccgcaacatttcaaatttaatcgtagcaaaattaaccacacaaaggatgnatccgactaatacatggcagagtggaggcccgtctttcttgctacacatgaaatgattcactgaatgtttcttggctggccatgaaacaaaataacagtttatgggtgcattgacagctacagtcagatagctcagtcgcgctcgctaatggctgttaggtgctgatcaatctcctctgtcgtgagtgatcggaagacacggtcttctttcctcacaacaccgacctcgatctcggtagccttgaaatcttcctgcagaacagattgcaatgcagaaatcgcaatctgaacagtttcgtcatatgtgaactgcgggctatccttcattttcttctccagaaaatttattgcttcctgctccttaagtccggcactagttgccttgtgtccaaagaagtgacctgcggggtcacacttgaagagctgagcatttttctcctcatcataacccaggaccatagcgactacaccaaggggtctcatgtatgcatgctgcgtgtatat

SEQ ID NO: 3139 - DNA, 540 bp, Hordeum vulgare
ggctgcaggaattcggtacgaggctgcacgccaagggctgcacgctcgactccggcaactgcaacctcgtcgtcagcgccatctgcgagcaagggtgcgtggacgagggagtggagctgctgaggaagctgccatcctttggttgtgagccggatattgttagctacaacgcagtgctcaagggcctgtgtatggccaagagatgggacgacgtggaggagctcatggtcgagatggttagggtgggttgcccgcccaatgtcgccactttcaataccctcattgcttacttgtgcaggaacgggttgtttgagcaggtgcatgaggccctttcgcagatgccggagcatgggtgcacaccggacttaaggatgtacgcgaccatcatcgacgggatttgcaaggacgggcatcacgaggttgcaaacgatattttgagcaggatgccttcttatggtctcaagcccaatgttgtctgctacaacactgtgttgaagggcctatgcagtgctgagcggtgggaggaagctgaggacttgc

SEQ ID NO: 3140 - DNA, 556 bp, Hordeum vulgare
cgacaataagtaatttaactttgaaaatagtgccgtatgtataactttactacgcacctttgacctatcagaaactacaattagaagccactacatcatacagtgcaaaacaagagcgagctacaagatttcacggattcgcgcctaccgaccttcatgagctgctgaagcttcaagtaggcaaatccatcctggcaatgccaccacaataatctcctcccatcagcatctagcggtactgttggttcatacaataccaaaatgtctcaccaagtgctttcttacagctcttcttgagcacagttcactcagcaaatcttgtgcctcccttaccaatccctcgctagctaaacctctaataagtatagtgtaggttgattcattgggcatgcacccattcgacaccatgtaggcaaaaaaatcaatggctcgatcagtctcccatcttttgcaaagcgaagaaatgacagcattgtaaagcgctgcatcagacctcactgtggcatcttggatactgtcaaacatctgaataatcttgtcggttctaccttctcta

SEQ ID NO: 3141 - DNA, 517 bp, Hordeum vulgare
cgacatcctcacgacctcgagctctttgtcaacgagcaggtttcttctaaaacatataacctggatgcaaatctcagccttctacgcctttaccagtttgagccagaaaggttgagcgtgcaaattgtagcccgcatattgatcaaggctctcatggcgatgccagctccggacttcagcctatgcttgttcttaattcctgaacatgtgcaaatggaggagcagttcaagactatgatagtcctttctcactacctggagactggtaggttccgccagttttgggacgaggcatcaaagagccgtaacacactggatgctgtaccaggtttcgagcaggcaatccaaagctatgcgattcatgtgctctccttgacataccagaaagttcctaggccagttcttgcagaggccatcaacattgagggtcttgcattggacaagtttatggagtatcatgctgcaaactcaggatgggtcattgagaatggtacacgctcccaactgattgtccttc

SEQ ID NO: 3142 - DNA, 555 bp, Hordeum vulgare
  UNSURE (17): n stands for any base
tcattgaaaatttcgtnacattgcaacaattcgacaaaaggtgcactcatgaaatgtcaggcaattgcaacatttggcagaaatgcacaagaaaacattccagtactcatttagctaaaacaggcgcatccgatactcggtgtcaaaatgcggtacaccatacgagagagaatacaattgccaagactagcttcttcactggctcaagttctattaagccccctcagtgggtctgggtgcgcagccgagacagacaaaagtgcttgatgtcaatctgatcatggttgctgaatcagctcaagatggggaatatgcgggtcacgtgctcgaacggaacggtgtcggctgtgttcttcttgagttcagggtgattgaactcgttgcgcggaaggacaatcagttgggagcgtgtaccattctcaatgacccatcctgagtttgcagcatgatactccataaacttgtccaatgcaagaccctcaatgttgatggcctctgcaagaactggcctaggaactttctggtatgtcaaggagagcacatgaatcgcatagc

SEQ ID NO: 3143 - DNA, 551 bp, Hordeum vulgare
gtacccccgggcctgcagggaattcggcacgaggcgacgccactgaccttactgccctcaacacgctcttcactagcttgaattctccggggcagctcaaaggctggcaagtgaatggtggtgacccttgcggcgaatcatggcagggcatcacttgctcaggatcgtcggttacagcaatcaaattaccaagcttgggcctgtccgggaatttgggctacaatatgaataccatgagttcattggtcgagcttgatatgagccagaacagccttggtggtggacaagcgatacaatataatctccccacagctaagcttgagaggctcaatcttgcaggaaaccagtttggtggagagttgccctactcgattttctcgatgaataatcttaagtatttaaatattaaccataaccagttacaaggaaaaatgaccgacgtattttccaaccttggcagcttgacaacagtggatctctcctttaattctcttactggtgacctaccagaaggtttaagttcactgtcaagtgttaaaactctatatttg

SEQ ID NO: 3144 - DNA, 550 bp, Hordeum vulgare
gtatcatgtttatttggagcatttgtagatataggtaagtgttaaatctaacatgatggcaccaatatgagaccgggcgctgatttgtggacatgacacagccaaacaacaccactaatacttgggtataataaatcaagcgaaacctgtgtgatatgtactgacggaacaggacaatatttctgttctcttctcttcttccactcttctctcggccaggctaggcgctagaagaaataaacgaatacaatctcagatgctgcgatatcaggggatatattagagtggttgtgcttccatcatatgaaatcctggtcctggtcatcgcctcgccgggaagcgtcgccatcgagcattttcttcgtcatgttagccctctgcacgagacggaccagcgcctgcaccacctccgacatcggtggcctgaattccggctcagcctggacacacaaggcaagcacgtcggcgaatcgtgaaagagacttggcagggtacagacccttgagcgcaggatcgaccatcctgtccaacgcatcgatgtcgtggagct

SEQ ID NO: 3145 - DNA, 525 bp, Hordeum vulgare
ggtacgaggaccgccaggagatctccacctggctggccgtggtcaagcaggaagaggagctattcatgaggctgcacccgggcgctcgccctccagcgactgctgctggcggcatcgccagtgcgatatcattcaacgccagctcaagtgagtacgacgttgacgtcgccgacgactgcaagggcgatgaggccggcacccacaagatggccatggctgatccaaccgcgttcaacctcggcgcggccatcctgaatgacaagttcctcatgcaagcgcccatgaaagaagagaccgctgacatggagtatgtccagaagaggagcgccgtggccgccgagccggagctgatgctgaacaaccgcgtctacatctgcaacaacgtccaatgcccgcacagcgactacgggtacggcttccttgaccggaatgcgcgcaacagccaccagtacacctgcaagtacaatgatgccctcccgccaagcgcggagaacaaggcggcgccacctgcgccgccgcaagtct

SEQ ID NO: 3146 - DNA, 550 bp, Hordeum vulgare
ataatatctaagattcctttctgcgccttttggccttctgcataggtcttctttgttttacaaatcccctttttgttccaatacatggttaccagctcaattcactggtggactctacaacaatgtgacgatggcataggaaaatgctacaaaaaatcgaatagcgctaactatctacaactgggaggcgaccggggtttcggattgcaggctttcttggctcctgcgagacagcatcttagaatcctgcactatggactgagcgcaaagcttcccggacaaaaccgcgccctccatcgaagccaggtatttctgcttcgtgtaatcgccagccagatagaacccttcgatcggcgaccgctgcataggtcggcaaggttcgcagttcgggacggtcttgtaaacagaccttggtgtcttcacaacatggtatttaagaatcttcgctttactctggtcagcagcgatttcatctggaaacaacttggctagctctagcatagttgcttcgatgatttcggtgtcactccgtccaatccattcctctgct

SEQ ID NO: 3147 - DNA, 388 bp, Hordeum vulgare
gcagtcaccgacactctcctagctcaggccaagctcctcagccatggcggccatcacggcggctttcctcctcctcctcgccgccacagtcgccgcggccgccgacctctccgtctaccacaacgtccaccctccgtccgcctccccgctcgagtccatcatctcgctcgcccgcgacgacgacgcgcgcctcctcttcctctcctccaaggccgcctccaccggcgtcacctccgcgccagtggcctccgggcagaccccgccctcctacgtggtgcgcgccgggctcggctcgccggcccagcccgtcctcctggccctcgacaccagcgccgacgccacctgggcgcactgctccccgtgcggcacctgccccaccaacagcctc

SEQ ID NO: 3148 - DNA, 415 bp, Hordeum vulgare
tttttttttttttttttttggacaaactttgatgccacattccttattgcacacactgaaaattaagccggagattaacaatcatacgtacgtacgtacgtacacccaaatgcatggctaatgtctcgactaactgcgcgaacgcgtgaaggaaagtcgtccggtgggaaaggaaactagttgcaggactcccgggcgaagccgacgcgcgagttggcgacgtcaaagacgatccggaggttctgctgctgcaggttggcgacgacgttgacgacggagttgacgttctgcggcgcctcggccatggccaggcacgccagcggcgtcgcgctgctgtggatcagcgtgttctccatgggcagcgccaggtcgacgccgccgtccatgtggatcgtcacggccggcgcgcccccgg

SEQ ID NO: 3149 - DNA, 447 bp, Hordeum vulgare
gcagtcaccgacactctcctagctcaggccaagctcctcagccatggcggccatcacggcggctttcctcctcctcctcgccgccacagtcgccgcggccgccgacctccccgtctaccacaacgtccaccctccgtccgcctccccgctcgagtccatcatctcgctcgcccgcgacgacgacgcgcgcctcctcttcctctcctccaaggccgcctccaccggcgtcacctccgcgccagtggcctccgggcagaccccgccctcctacgtggtgcgcgccgggctcggctcgccggcccagcccgtcctcctggccctcgacaccagcgccgacgccacctgggcgcactgctccccgtgcggcacctgccccaccaacagcctcttcgtcccggccaactcctcctcctacgcgcccctcccctgctcctcctccatgtgctc

SEQ ID NO: 3150 - DNA, 433 bp, Hordeum vulgare
ttttttttttttttttttaacgaaacaaacaagttaattaaatgaaccagacatcactccagtaaatagtactgtaaatagttacggctagtgcagtacgtggtaattctctagttctaatgacactcgcgcacgcacccgtgacaaactttgatgccacattccttattgcacacactgaaaattaggccggagattaacaatcatacgtacgtacgtacgtacacctaaatgcatggctaatgtctcgactaactgcgcgaacgcgtgaaggaaagtcgtccggtgggaaaggaaactagttgcaggactcccgggcgaagccgacgcgcgagttggcgacgtcgaagacgatccggaggttctgctgctgcaggttggcgacgacgttgacgacggagttgacgttctgcggcgcctcggccatggccag

SEQ ID NO: 3151 - DNA, 519 bp, Hordeum vulgare
tcaatctgagcaatgacgtttacgattcagataccggtgctgataagaacaagaaagaatctgtcgtcaacattgttggcagtcgagcagtgacacagtatgcagcgaacctttctcttctgctcgggtttggagggctattttgggcctttgctgaagcaggggacgtcaggttcatcgtgttggtgctatgtgcaatcctctgcggctatgtttatcagtgcccgccgttccgattgagttatcgtggcctaggcgaaccattgtgttttgctgcatttggcccattggctacatcagctttctacttctcaaacagcagcagaagcatttcaagcgggactgcgcttctccctatcaccaaaacagtcatagcttcatcgattcttgtcgggttgacaaccacactgatactcttctgcagccactttcaccagatcgacggagacagggctgtcggaaagatgtctcccctggtaagaatcggcaccaaaacaggctcgacagtagtaacgcttg

SEQ ID NO: 3152 - DNA, 552 bp, Hordeum vulgare
ttcgtagcagtaatactagatactactgcaaggcctgcgatttgaagatccgggagccaatgatacagtacaaacataggagtagatggcaaggtgggaaaggcagcacacaagttggcctgcgcgccgtaccaggagcagctgggctaccaccactctctgccaccgccggttggtaaagaggggaagtaataataatgtagtaatggcagtccgtccgtcggtagaggagaggagagggccggagcatgttgtgactgacttgtcccgtcctgcctcatcagaattcaattcaattcatatgctgctggaggccaagcaaacggcgatctaccctagcagtagctgcgaggacggacgcgcacgccaagctacctctccctttgcatggagaaaagagtctacctagatgatcacgggatactgtactggtggtatgtacgtacaagctagagcctgctgctgtgagcctgcctctgaacctctgcttgcccaatccggacgcctccggctagacaactgccattgaatttctactggagtagagtagct

SEQ ID NO: 3153 - DNA, 517 bp, Hordeum vulgare
gcccagtcaatggttgcagccggagaaggtaatatgcggagggggaaatggaaccaaaagaaggacaatttcaataagaagcaagctactgtcattccaaccaaatcaatttctaaagtaaagctgcctaacagtattcccaaaggaaatatctcgacttcacctgcaccttctcctgagcaacctggaccaagccttccttcatttctttttgagtcagatgcaaataatgaagtcatagtaccttttgatttgaacaaagaggagaacagtaaatttgagaaagcaacgccaaataggatctctcgaggactaaatcacagggcaatttctgtttctgcaagtgttgatgataatacaactgatgtgcgaagcctgctgatatctatactctcagaaaatccaaagggaatgaacttaaaggccttggagaaagctgttgcagatgcaattccaaaggcttcaaagaaaatagagcatatcgttaagaatgttgcagattaccaatcatcaggga

SEQ ID NO: 3154 - DNA, 544 bp, Hordeum vulgare
  UNSURE (26): n stands for any base
taacataccttcaacagcttactgantcgcacgttacgtgaggagtacaccgtgattacccccacctccatcaaatactactctagtttggtctacagattatgtacaaggtgaaacagaattgagtttatcacattgatacaaaagccaggactgggagggatctcactgaaagaaagaaagaaggaaaaaatctacaaaggggaaaccccgtcccggcacagttcctatctacctgcctgcaaaattgatgttgtaaacccgccttcaacagtacctctgttccgtaagtttcgccttcaacatgtcacgtgtggaggcgttggttttactgcttgcaccgcatcaccctcgatcgccgctgctgtgatcactaagaaattcagcagaacaattgatgagactgctttctgtcacctgatgaatgtcttgagctgaatgttcaagccagggactgctttgtaagaaaggcaagcatgaagccgaggttcccggcatttttcagagtagatgctgggtaacagcctctgaaaagcagttgcaa

SEQ ID NO: 3155 - DNA, 523 bp, Hordeum vulgare
cgggaaacagcagttgagcaaagttacccttctgttctttctgccctgatactgaagctgggagctcttcacggtcttgctgaattaggccgcaatgagcttctacgatcgttattaattgcattccagtcattctgcgaatgtgttggcgatgtcgagatgggaaagatattagctcgagatggcgaacaaactgagaaggagaagtggattgatcttgtgcaagaggttgcatgcagttcctcagtaaagaggcccaatgagtccatattgaaatatccaaatcatcttatatttgtgaacggagggagtaacttctaaccctgcaaagaaaaaataatactgttctgccaacatgcgttatcttgagcaaatctctcgacaggaatcagagggctgaaagggaggctgctgctgctgcactatcagaatttgttcgccacagtgaaaaagaacctgcattgcttgaacaaatggttgaggaattgtgtcaacatgtaaccgatgactcaccgactgtcag

SEQ ID NO: 3156 - DNA, 482 bp, Hordeum vulgare
aaccggcatgaccgaggcgtgtctttgttatattacatgcttacggaacacagcgagttcgacaagcaattaacgagacagtctgctgtacaatcaacactaaaggcctatggacatggctacagaattatctctctctgctctattgttgaaggaggcacaaaatgtacaggcaggcagcatgaacattaaactctgtacatgtacaacagatttacatccaagagagagcctcttcgattacttctattgttcttgcgcaccatttggctttgctgcagcctcttcttgaagctcaggtgatgctttagcgtgaggctctccatgttgagaactctgtgatgggtctgttcgatcaaaccgtgaactcaatgacttgagcatgttagacctctttatcaggaggcccaatgcagaagatgctgctgctcgaacaacggcttctggtgattggctcattctaccaaccaacatagcgaaaa

SEQ ID NO: 3157 - DNA, 542 bp, Hordeum vulgare
  UNSURE (4),(12): n stands for any base
gggnctgcaggnaattcggcacgagggcttgaacaaatggttgaggaattgtgtcaacatgtaaccgatgactcaccgactgtcaggagtctctgcttgcgaggacttgtacagatacccgagagccacatacttaattacatccagcaagtcctaggtgtaatattagcattacttgaagatgccaccgaatctgttcaacttactgctgtccagtgcctgttaaccgttcttaatgcgtcagaacaagatgctgtggatcccattttaataagtctcttagtaaggctaaggaatctccagatctccatgaatacaaaaatgaggtccaatgcctttgcagcttatggagctctaagtgcctatggtgctggttcacagcatcatgcttttcttgagcagacacatgccacccttccacgtttgatcctccatcttcatgataatgaccttagcgttcgccttgcctgtcggaacacattccagctcctagcgcctttgatggaagtagatggcttgtcttcgctcctcaacaagcaata

SEQ ID NO: 3158 - DNA, 552 bp, Hordeum vulgare
ttggtttctgcttagctgccgctggtgttgactagcaagttaaatcctcttcaaagttcaaacacggcatgaccgaaggcgtgtcttcgttatattacatgcttactgaacacagcgagttctacaagcaatcaacgaactgcgacagtctgctgtacaatcaacactaaagacctatggacatgactacagaattatctctctatgctctattgttgaaggaggcccaaaatgtacaggcaggcagcatgaacattaaactctgtacatgtacaagagatttacatccaagagagagccgcttcgattacttctattgttctccttgcgcaccatttggctttgctgcagcctcttcttgaagctcaggtgatgctttagcgtgaggctctccatgctgagaactctgtgatgggtctgttcgatcaaaccgtgaactcaatgacttgagcatgttagacctctttatcaggaggcccaatgcagaagatgctgctgctcgaacaacggcctctggtgattggctcattctaccaaccaacatagcgaaaa

SEQ ID NO: 3159 - DNA, 400 bp, Hordeum vulgare
caacagcaattcagatgactcaacgaatcaacagcttacatcggatgctacaatcgaggttgcaattgacattccctttccgtttcaagcactaccagttgaagctattgaatcaagtggcaggcaagtgcttgagcagttactccgagtcatgcttccacgatttctgaagcagcttgataaggactaccaagctcgggcttcgggcgattcttcacggaaaccgcttggcaccggcgaaatatgaagctgacccgtatattcataggcgtaacgatagtgttttcttgtttgatctagttaatgtgctcgcacatgatccacttcctcatgatagtctgtccttggaaactctcgtggttgtatattgtcatcccacagtcatttggtcgatccatgc

SEQ ID NO: 3160 - DNA, 369 bp, Hordeum vulgare
ttttttttttttttttttttttttttttggacaaaaaaaaaacgcatggatcgaccaaatgactgtgggatgacaatatacaaccacgagagtttccaaggacagactatcatgaggaagtggatcatgtgcgagcacattaactagatcaaacaagaaaacactatcgttacgcctatgaatatacgggtcagcttcatatttcgccggtgccaagcggtttccgtgaagaatcgcccgaagcccaagcttggtagtccttatcaagctgcttcagaaatcgtggaagcatgactcggagtaactgctcaagcacttgcctgccacttgattcaatagcttcaactggtagtgcttgaaacggaaagg

SEQ ID NO: 3161 - DNA, 470 bp, Hordeum vulgare
ctggatgctggtggaccatgtcattgaatctcaagatgctggtcttcttgaaagcattttgataccacttgacctctataacgactctgctcaacatgcgctaacttatctcaaacagagatttctctatgacgaaattgaagctgaggtcgatctttcctttgatcttctggttcagaagcttaacgaggtcatctttacatattataagagttgtgcagcaagtactcttcttgatagttcatttacctatgcatgtgatgatggtgagaagtactttgtcaaacccttgagatttgatgcaattttcaagctaagaagagtcatgatcttagggaggacaattgacttaagaagcctaattactcagagaatgaacaaactgttccgagaaaatatcgatttcctactggaacgcttcgaatatggagatctatgcggtgttgtagaactacaacaacttatggata

SEQ ID NO: 3162 - DNA, 554 bp, Hordeum vulgare
ggatattggagttacacgtttattactacagttatataatatagtacttatataccattaggtccataaccacacaaatacatcagctcactgctcacatgcatacgagataagaccagaaaagaaaaacatacatccgcctggtaactacgagttcgccctctgtggcaatgtctcgaatgcagaaactatgttgctaaacttcatacggtgaaggggcgccccgcttggcttgatagcgcacgcaaccttgtcctcgagggggcagcgcgccctcagcatggagaacacgtggttgttcagcctcctagccttcctcatcgcttcaaggatgacctcgtagccttggaagatatttgggcttttgctcctatctgtaggttggtaaagtgagactgttgcggtttctatttctgccacgttgaggaattggtaggagaaatcgaatagctcgaaatgtagctgctgccccagcaagtacatgattgtacagccagcccatgctacagagtcgcccaccatttctcgtttctttgaaggattggtcatgctat

SEQ ID NO: 3163 - DNA, 898 bp, Hordeum vulgare
  UNSURE (634): n stands for any base
gcaggaattcggcacgaggaaaaacaattgagctattattatatctaacacgttatgtagacactgaatcactcatgcatctgtggtgctgacttgcacattttattgagaacaattcactggaatgttcagtttcagttagtgctcatgtgtaatacattacctgaaaaaaggtcagtagtaatattaatgctagctggacacgttgttatgcatgaatctcttgttagctcaaactgcactgctatatcgctttaccggcacgtatgttgtgcctgcattgcattttcctgtattcaagtgtctaaggagggatgaatctatagctgacagtggaatgatgtttcaagatttgattgttgtttgtggagattatttgtgcatgtgcgcccaagcttctctttagaatccattattaataccaacgacagtttatttctgaactattggggctttggttacctcattttctcatgaggttggttctcttaatccaggaacacctcaagcattgcttcaaagctgcgccactttcgcagcgttctcttgcataatggaggggctgaacaagcagcaggctgcaatggctcacaccctcggcgggaatgctctgacctttgcgcacgggaaaggntggcgttctcccccctttcacgcttccgccaattcttgacgcatcagatgctctagcttcatgctgcaagaccttagtcaagcccaagcactagacaacatcacagggagggaaagagagagatgatcagcaaaaaccttagcaccagactttcttcgcgaatgtagaatttgtttctcgacttgtaaagagcgtagatttgtttccttgccagtttttttgtttctgccttctgcagcatgtgctcttttgagatggcagaag

SEQ ID NO: 3164 - DNA, 532 bp, Hordeum vulgare
  UNSURE (2),(6),(67): n stands for any base
tncttnacttgccacaaaccatatctcagatgttaacaggagtacaaaatgcgaaggccacgccagnaaatttcaggttttttatcttctgccatctcaaaagagcacatgctgcagaaggcagaaacaaaaaactggcaaggaaacaaatctacgctcttgacaagtcgagaaacaaatctacattcgcgaaggaagtctggtgctaaggtttttgctgatcatctctctctttccctccctgtgatgttgtctagtgcttgggcttgactaaggtcttgcagcatgaagctagagcatctgatgcgtcaagaattggcggaagcgtgaaaggggggagaacgccacctttcccgtgcgcaaaggtcagagcattcccgccgagggtgtgagccattgcagcctgctgcttgttcagcccctccattatgcaagagaacgctgcgaaagtggcgcagctttgaagcaatgcttgaggtgttcctggattaagagaaccaacctcatgagaaaatgaggtaaccaaagcccc

SEQ ID NO: 3165 - DNA, 523 bp, Hordeum vulgare
cactgaagcggccgacaacgaaaataataatgctccaatatgcatctagcgtatgaaaatacatagatctaataaaaaaaatactctgatgtactatgcacatctatggaacaaaatagtatgtcgtactattaaccaggtactgaatttccttactttgtttctttttgcctgagatttcgcttgcagcctggtggcgagttctctcgcagtggcggattgagcgacggattggctgctggtgtgttctctggaagcgacggattggttgctgacgggttgagcgacggattgcatggcgacggattccctgatggcggcggattgcgcgacggattggttgctggtgtgttctctggaagcgatggattggctgctggcgggttgagcgacggattgcgtggcgacggattgcctgatggcgcattccctggtggcggcggattgcctgatggcgttttccttggtggcggatgataagaacgatgctccatggttgtttgtggaggacaacgtgaaaatg

SEQ ID NO: 3166 - DNA, 542 bp, Hordeum vulgare
tgatactatgtatggaactgatcgtgcagcacgggagttacgtacaactctcagaaaaaaaaagagttaggtatagctgccattattcttaggataaaataataacagaaaccacattggcgtccttatctaacccaccctactattaattagggacggtcatcaatctaatctgcctccaattgccgccgccagcattttcacgttgtcctccacaaacaaccatggagcatcgttcttatcatccgccaccaaggaaaacgccatcaggcaatccgccgccaccagggaatgcgccatcaggcaatccgtcgccacgcaatccgtcgctcaacccgccagcagccaatccatcgcttccagagaacacaccagcaaccaatccgtcgcgcaatccgccgccatcagggaatccgtcgccatgcaatccgtcgctcaacccgtcagcaaccaatccgtcgcttccagagaacacaccagcagccaatccgtcgctcaatccgccactgcgagagaactcgccaccaggctgcaagcgaaat

SEQ ID NO: 3167 - DNA, 401 bp, Hordeum vulgare
ggttcatatcctctgcagcaacaagcagtgtcgtgtcgcctcgacaaaagccattgccgtgccgtctcgtctccaaaagcacgggggaatggcttcctcagcaccggcgccgggcgagaaagcgcacgccgtgtgcctgccggcggccgcgcaggggcacatcatccccatgctcgacgtcgccaagatgctccacgcccgcggcttccacgtcaccttcgtcaacaccgactacaaccacgcccgcctcgtccgctcccgcggccccgccgcggtggccggcgtcccgggcttccgcttcgccaccatcccggacggcctgccgccgtccggcgacgacgtcacgcaggacatcgcggcgctgtgcagatccaccacggagacctgcctggggcccttcc

SEQ ID NO: 3168 - DNA, 450 bp, Hordeum vulgare
tttttttttttttttggggtataaaaagagatctacatcatggattcatggagcagctacattattatttgttttcccaaccatggtataccactagctagtactccctccgttactaaatataagtcttttaagcgatttcactaaggatctacatacggagcaaaatgatcgaatctatattctaaagtatgtctatatacatccgtatgtagtccactagtgaaatctttacaaagacgtatatttaggaacagagtagctaggattgccgtggaaagacggagctaacacgtcgcggatcaactcgtcgaagttgcggcgagaagagccgccgggttcagtcgccttgaccgctttctccctccactcccgcgccttcttcttcatcaccttcccgctctccccttccatgacctccgtgatatggtccgcgatggcgtcgcgccg

SEQ ID NO: 3169 - DNA, 965 bp, Hordeum vulgare
  UNSURE (1): n stands for any base
nggtgcagtctgacactgtactcccgagtctgcaggcaattcggcacgggggcgaggaccaggtagtgcaacttatagtactgaatactcctacctgatactctctatatgatgtccgcggattcctactagtaccacagatgattgcttggtagatgggcgaagcaaaaaaaaaaaaacttgaggggggacccagtaaacaataatgtttatccagccaactatttcaatttaggacaacttttttctttattcccatgtacattttctcccatgctgcaacctacaacagttaaccaactgctccctcggttccttcttaaatataaatccttttgaagatttcactacggactacatataaagcaaaatgaatgaatttacactttaaaatatgtttatatacatccgtatgtagcccgtaatgcaatcttttaaaagacttatatttaggaacggaggaagtagcattattaatctacccaagttttgcactgacacatttttatttactttaaaaatatcagggggggaaccccatcatgaacagtttaaagcttggcgttgaggttgtcagtgctcatggcctcctccctaaagagcagggcactgccaatgcttttgtaaagtttgaatttgatggccaaaagtttcttacgggctttaatatagctattttacctttgttggaacgagtagatatttttcacaattcagaattatttggcccttttaaaaaagatttttggcctttgggaaccatttataaccctgtaacacatcccaattttgccttgtaagagcttacattttagactcattcttcttaaatagtcttttgtttggcccctttttaatttgtgtgcaatggctccgtttattcttggtgtttaagggacctttgacgttatgtattctccctaattggtcctttttttcatggtttcttctttcttaatacataa

SEQ ID NO: 3170 - DNA, 541 bp, Hordeum vulgare
tattttatctcacttacatggtacaacaatacatagtattacttaatgaaatgctattatacaacagtattctgacagtagtaaacagatacaaagaagtgtaacatgacattggtagctcatgtccaaggacctttacaacaatgagtccgtctttgcaggtagcctcctgaagaagtttactggcgctgcgggcaccttgtggcgaaaccgcgggtgtctcatccagaagaagccaaggcagagcgcaatcacttgaaatggtgtaatatacagtatgattgcagtgaacaggcaaaataataggaacatagctgttgctcttgggtccctccagctcagcagtgactgcaatctctcaccctgagttgcaatgtccccaacaactgtctgtatcctcccagcaacgtgccgtagcctgtcatacctcatcctaatcaggtcagggctcttggaggttgggaacgtgtcaaattcctcatcaagctcgtctggatgagcaacatccgcataagatatccttgtgttcatatgtggtggg

SEQ ID NO: 3171 - DNA, 383 bp, Hordeum vulgare
ggcacgaggccgggctgggtcgccatgaggaggcattggagcagaatgagcttgttaggatggagtatgagaggttggggatggatgcagagctttcgctggttgaaatcgacggggccagcctgcgtattatgttggggagaacagaggctgcgatgaatgaccttaagaaggtgatgaagcgggctagcaaggatagcgaggagcgtgcgctagcgtttgtcgcgatggcgaagattttgtgctccgaggagaggtccagtgactcgagacgttgcttggagattgctcgtgagactcttgatgcaaagcgttctgtaaacactgaacgggtcgctggggcatacaccgagatatcgatgttgtatgagtcaatgaatgaa

SEQ ID NO: 3172 - DNA, 525 bp, Hordeum vulgare
gatattgatgaaaactgtgtacaatcatacttgctacctataatctgaaggtggataatctgcatgctctgtcttcccaaatgctatacgtgacacatataattccattggtaagtaaattaaccacataatgacattgggcgccaaaatagtagttaaaagacctgagagggtcgccgatgaaatcttagtttaccactgagtcgtcttcatcaaacagatgccaggagaggcattatcggttttcaggaagcacgggcaatgtatttgcaggaaatactgcagaacgtgacccttccgccttcttccttatctgctctagaagcctatgagcttctcgtatctcatagttcgaactatggccacagctttcataagcatctataactcgttgttgaaaatccatggcattcttgtaactgcaataagaagcagtatcaaatgtaaaatagcgacacgggtattcacgacatatataagaagtgctttactataaatcgttagaacatggtcggaaaattgcat

SEQ ID NO: 3173 - DNA, 518 bp, Hordeum vulgare
atctgcttctaaagctgcaagtgaggcagcagatgtagccatcgtgtcggaagttacaactggagctccccttgacaacaaaggtgtcacagagccagatattaaaatgggtgcttctcctgtcgatgaatctgcttctgaagctgcaactgaggcagcatacgtagtcacctcaccagaagttacaactggagctcccctcgacaaccaacgtgttgcagagccagatattaaaatgggagcttctcctgtcaatgaatgtgctgctaaaactgcaactgaggcagcagatgtagtcaccaatctgagagttacaactgtagcttccttcgtcaacagaggtgttgtagagccagatattaaaatggaagcttctcctgccaaagaatctgccgctgaaatggattttgtacacccaggtttccttgctactgaagctgcaactcatccaggactaccagaaagagtttctcttgctaatgaagctgttgctgagcgagaagtttcagaggcaggtt

SEQ ID NO: 3174 - DNA, 543 bp, Hordeum vulgare
  UNSURE (11): n stands for any base
aaaataacttncttatttacaactctaggatttgatatatcacccctgtgaagaacagacatcaccattgtaagaaacaaacacaagggatcttatcaaacagctttcaagaaaagcatagctaaagcttctaaactaaagattgtgacattttttcttcaataaagaaacaacaatcccgctataagttgtcagaactcagaacaattggaccaaggaacttccaacaaataataaagccatctacagtagcaagcacgggctttactcctaactctgcaatgttgagcaagattttacctctgcggtttgcacctcctcctatgccgggtaaagtccgaaacatacttatatatcttgctacacccaggcgtcctgcatttatagggcttttcccctgtatgaacttcgaaatgatcagccagagcccatgtccacttgaaagccataccgcaaccttcccacgggcacttgtacggtctctcctcgttgtgaatgctctggtggcgtctcagatacttgtgggatctgaaatgtttgcca

SEQ ID NO: 3175 - DNA, 516 bp, Hordeum vulgare
tatttatctcttcctgcatacaaaaggatcccgccgaacggaagtcggcttcagaactcttgaaccatgccttcatcaagaagttcgaggacaaggacctagacctgcggatcctcgtcgagagcctcgagcagcccatgaacgttcccgagtgagggttgccgctcggagaggcgaggctttgcggcgactctcttccagggccaccctcccgacggcaatcgtgtaattgctgcgaacccggtgggttcacagatgatgccccacccctgtatgtgatgatgtttacgttgggaaaaattcgcggaggagccgaacggattgttaatgtatggtggtgacttgaggcccttttgttgtgtcttgctatgaatgaatgagtgagtgaatgaatctggtgttgctcgtggtgatgttggctttgccatctggtctgtgtgattcctgctgagagtgcagcctttgattgcgcgcttggaccttgtggttctgctagtgatgtacccctggaccctg

SEQ ID NO: 3176 - DNA, 546 bp, Hordeum vulgare
actggcctgattcttaacttctcaaccagcttgattctgtttgccgcctaataaccatggcagcaaccagggtccaggggtacatcactagcagaaccacaaggtccaagcgcgcaatcaaaggctgcactctcagcaggaatcacacagaccagatggcaaagccaacatcaccacgagcaacaccagattcattcactcactcattcattcatagcaagacacaacaaaagggcctcaagtcaccaccatacattaacaatccgttcggctcctccgcgaatttttcccaacgtaaacatcatcacatacaggggtggggcatcatctgtgaacccaccgggttcgcagcaattacacgattgccgtcgggagggtggccctggaagagagtcgccgcaaagcctcgcctctccgagcggcaaccctcactcgggaacgttcatgggctgctcgaggctctcgacgaggatccgcaggtctaggtccttgtcctcgaacttcttgatgaaggcatggttcaagagttctgaagccgacttccgt

SEQ ID NO: 3177 - DNA, 488 bp, Hordeum vulgare
aacacctgcttccaccgccgcgccgaggagccacccggccgcgcaccgcaccgcttccttcctcctccttgccccgccgcccgttcggatcaccggtacgtacgctgctcatggatctactgaggaaccccttcaagggagtggtcgcagatgtcaaagggagagcgccttggtacaaggacgactggcttgcagggctccgagctggcttcgggatattggcacctaccatgtacatattctttgcctccgcgctccctgtcatcgccttcggagagcagctcagcaacgaaacaaatggtattctcagcacagttgaaaccttggcatctactgcaatatgcgggataatacatgcgattcttggagggcagccgatgatgatcgttggagtcgcggaacctactattataatgtatacgtatctctacaacttcgccaagaagcaaccaggtctgggagaacggctatacttggcttgggctgga

SEQ ID NO: 3178 - DNA, 551 bp, Hordeum vulgare
tggaaggtgttattgcattatcgacttatttcgtacggcggctaaggctagtctcatctatcaagcttcaccggcgaacccgtggatgcttcggtgcatgccactccggtagttggtggcggggagagaaatcccggtgccgttgcttatcaagcaatacttttaacatggtacactcaaacagaacaaagccaggcacacaagcaacaacagatcacagagggacagttttcctccaataccaactcagctaatctttctactcctcaccgttgctattccggcaatacttccttcagtctgctgctctcactgctacctgtcttatggaaagtgctatactaccagtaccgtgcatattatcacggaaagataatagtgcagtcggcaaagaacgactgcctgaggatttccctcctcatttccgatagaatcattgatgaaatcctcggtcggtcctgggccattgttctatcttcacacgcttggctgaacggcatttgaatggacctgaaggtgtctttcttcacgatggctcacaaccctgtgtt

SEQ ID NO: 3179 - DNA, 523 bp, Hordeum vulgare
gcaaggttgttgatacagcgtccgctacgccgatgtgaaacctgtcaagactgcaggaacagccccacaatggatgcagtcagccatgaagaatgtgcccctgacattggaggccccagcttcgagcagcctgggcatccagtcatccatttatggtgcactgatggttttcacttatgctagtggaacctctacatctttaccatcagcgtacactagccctgatgtgcctggatttatcctagcaacaggattcggtgcttcattgtattttctgtccaagaaaaacatgaacttaggtaaggccgcattgatcaccgtcggggggctggcagtcggtgcgacggtcgggtccggcgtggagagctggctgcaggttgacattgtgcccttcctgggcatccactcccccgctgtcgtcgtcaccgagttcattctattctcgcaattgttggtatcgctgttcgttaggtagggcctgcctgtggagcaagctaagctgtcagctggcctgtaactaact

SEQ ID NO: 3180 - DNA, 549 bp, Hordeum vulgare
ggtcaagtgatgattgaagaagccgagggacgtagatcccgctgtagtactgttttttgctatacacagctgctttttgcatcttctgaagaaaaagatgcccattttttcagttagttacaggccagctgacagcttagcttgctccacaggcaggccctacctaacgaacagcgataccaacaattgcgagaatagaatgaactcggtgacgacgacagcgggggagtggatgcccaggaagggcacaatgtcaacctgcagccagctctccacgccggacccgaccgtcgcaccgactgccagccccccgacggtgatcaatgcggccttacctaagttcatgtttttcttggacagaaaatacaatgaagcaccgaatcctgttgctaggataaatccaggcacatcagggctagtgtacgctgatggtaaagatgtagaggttccactagcataagtgaaaaccatcagtgcaccataaatggatgactggatgcccaggctgctcgaagctggggcctccaatgtcaggggcacattcttcat

SEQ ID NO: 3181 - DNA, 997 bp, Hordeum vulgare
  UNSURE (1)..(5),(16),(19),(20),(25),(31),(34),(45),(997): n stands for any base
nnnnnttggccaaatntgnnttacnagtgtnggngcccttccacnctaggaccgcgcacctacgtgatcccacgctctaccatcaaacttggggaatgtcgggttggtaagggggcaagacgacggacgccaaggccgacgaggccgccaagacggggccgtccgtccaggaccgcgccatcgaggcgaaagaccagaccatcagcttcatcggcgagaaaagcgaggccgtcacgaaggcggtcttcgacaccgtcgatgcgggggtgggggtggaccgagtttccttttgtgaaggtcttcgtgacgaggcagacccacacgggccgcgccttctaaagctccccccttatttcttgcttcatcctctttttttgctcatgctttttatattattttttctttttcttctattttttttctttgtattccattgctttcttccattttttgcttagccttttttgtctttttttttttttttttctcgcgttttttcgtttcccttttcctcgtctttttgttcttgctactcttcttctcttttttcctttttcttgtttctgcttccgtccgcttttcgtcttgttttctttcttcccttgctttagccttcacatttgttttttcattcctttctctatttttcccctttactcctttctattctttttcgtcatttccctattctcgttcttccctttttgctgccctcactgccttctattttattatttctcattcctctttatttttattctccctcctttatttcgcatttaataaacacaaattattggtggcccgtccgccctttttcctaattttcccgttttgttccctttcgcctttcttttcccaatttcgtttttatctcctcccccgtaataccgtcccattacttatcttctccctccgcctatttttttcttcttcaccgttttttcgcgcgtaccgtatttaacttttgaaatttgtatatattaccgtccgcctn

SEQ ID NO: 3182 - DNA, 553 bp, Hordeum vulgare
gattgaaatccgtatattaaagcatctttgctacaacggaggaagtacaccgacgcatgcgtagaaatcagtttcttggaacggataatagagcaacacgaataacgaaacggaaagagggctacggtcttcatttggcgctgccggcgtcggctttgtctcctcccatcccgagcgtgttcatgacggcgtccctggcgcccgtagcggcgcccatcacctgcccgccagcctgctggaacatgttgccggcgggctccttgggggcggcgggttccccggtgaactgcgccgcggtctcctcgacacacttcgcggcctcggcggacttctgcttggcggcgtcgccggtgtcgacggccatcttcttggcagcctcggccttctcgccgatgaagccgaacgtctggtctttgctctcgatggcgcggtccgtgatggcctgccccgtctcggagaccttccccatggcgtctccccccatcttcatggccgcatcggcggtgtcggaggccgccttcgtgacggcctcgcttttctcgccgatgaagct

SEQ ID NO: 3183 - DNA, 517 bp, Hordeum vulgare
gaagaaaagaagaacacaaattattaggcaccaacacttcatcgacttagaaaatgtctagctggttacaagagaagtcgggggaggtggtggagacgacccaagttaaggccggcgaggccacgaagatggcgtccgagacggggcagtccatccaggaccgtgccgtcgaggcaaaagaccagaccggcagcttccttggcgagaaaagcgaggctgtcacgaagtctgcctccgagactaccgaggcggccaaaaagatgggcagcgaggccatggggaaggtgtccgagacggtgcaagccggtcaggatcgcgccgtcgagggcaaagaccagacggccagctttctcggcgagaagacggaggccgtgaagaagacggccaccgagactgccgacgccgccaaggagaagtccaccgaggccgcgcagcatgttcaggacaccgctgcagagtacaccaaggataccccggtcgcccccaaggaaaacgtcttccagaaggccggcgggaa

SEQ ID NO: 3184 - DNA, 540 bp, Hordeum vulgare
gttgatataattggtggaaaattattatacctcggtcgcatacataaacaaagttacaccaaggagcgtgtgtataaattaattagttccttggaactgaaatttaaattatatcgagagaacaacgaaacggaaggagggaaagagcaggcaggcgcagacgcgtctaattatcctttgtgatcttcttggtggcaccatcaacatctcacttgtctcctcccatcccgagcgtgttcatgacagcgtccttggcgtccgtagcggcacccacaatattcccgccggccttctggaagacgttttccttgggggcgaccggggtatccttggtgtactctgcagcggtgtcctgaacatgctgcgcggcctcggtggacttctccttggcggcgtcggcagtctcggtggccgtcttcttcacggcctccgtcttctcgccgagaaagctggccgtctggtctttgccctcgacggcgcgatcctgaccggcttgcaccgtctcggacaccttccccatggcctcgctgcccatctttt

SEQ ID NO: 3185 - DNA, 277 bp, Hordeum vulgare
cgccaacatgctgctttctttccaggggatcaaatgatattgctgattttgaatatagtcgaagtaattgggcttgtgctaaccttcaagccattcctagcagttccaaaacattatgatttcaagtagctctcggaacccccaaagcagtggaacaatggatgatgtgaaaagttaaaacgatgttttagcttgcaaaaatgtgtacaagtcccatacaatcctcagtccatgtaaaataataaaaataaggaatatacatatacccgctatccat

SEQ ID NO: 3186 - DNA, 57 bp, Hordeum vulgare
tttgttttttttttgtttttttttttctttttttttttttttttttttttttttttt

SEQ ID NO: 3187 - DNA, 551 bp, Hordeum vulgare
cccgggctgaggccggcgtcgacggacgtggcccgggtgctcacctgcctcttcgagaagaacctcgagttcgagctcgtccgcatcgacaccttcaagagggagcacaagctgcccgagttcatcaagctaagggatccaactgggcaggtgaccttcaagcatggtgacaagacccttgttgattcaagggcgatatgccggtacctgtgcacccaattcccggaggacggcaaccgcgggatctacggcacggggtcgctggagcgcgcgtccatagagcagtggctccaggcggagtcccagagcttcgacgccccgagctcggagctggtcttccacctggccttcgcgccgcagctcaacatgatccccgacgaggcccgcatcgcggagaacgagaggaagctgcagcagatgctcggcgtctacgacgagatcctggccaagaaccagtacctcgccggcgacgagttcacgctcgccgacctgtcccacctgccggcctcccactacatcgccggctcccagaggggcaggaagctcttcac

SEQ ID NO: 3188 - DNA, 543 bp, Hordeum vulgare
ggaaaatttatttgttgaactgaaagcactgagcgttacaaccccgtgaaggacaatggcgttgcaaaaatggaagacataacgagagacacggcgcgctttaattagggcttcacattattctagccaacacgacaacgaacgaacggacgtagacgagagggaccttgacggcgtacggagacatcacggtgtgaagcccgatggaagattcatgcatgcatgcatgcatgctgccgatcgacgacgtacgtacggacggcgatcgatcgagctcgccgatcactcgaaggtgccggggtgctcgtgctgcatcttgaccacctgcttccaggaggggcggctggagatggcgtcgtaccacctggccacgtgcttcttggaggtgaagagcttcctgcccctctgggagccggcgatgtagtgggaggccggcaggtgggacaggtcggcgagcgtgaactcgtcgccggcgaggtactggttcttggccaggatctcgtcgtagacgccgagcatctgctgcagcttcctctcgttctc

SEQ ID NO: 3189 - DNA, 499 bp, Hordeum vulgare
gctaaggggccggcatggcggactgggcgccggtgttcatcgggctggtgctcttcatcctcctctcgccggggctgctgctccagatccccggcaagggcaggatggtggagttcggcaacttccagaccagcggcatctccatactcgtccacgccgtcatctacttcgccctcatcgccatcctcatcctcgccgtcaacgtccacgtctacatcggctgacaaggagacgcgcgccgccagctgcttcctgatcgatcgatcaacagctaggtatcgtggagcatcgagagaaatacacatgctgtcgcgttcatgttcaggcgtcctggtttagcttaagctcgtagaagggcatagaagcgcagtactatgtatgatgttcattgggcaatttagttgatgatttcatattttatcaggaacgtatagcttcaacttttatgtacaccgcgtcttatgatggtccacggcgcctgatctaaggctgtgtgcat

SEQ ID NO: 3190 - DNA, 474 bp, Hordeum vulgare
gtggtacctcataagacgcggtgtacataaaagttgaagctatacgttcctgataaaatatgaaatcatcaactaaattgcccaatgaacatcatacatagtactgcgcttctatgcccttctacgagcttaagctaaaccaggacgcctgaacatgaacgcgacagcatgtgtatttctctcgatgctccacgatacctagctgttgatcgatcgatcaggaagcagctggcggcgcgcgtctccttgtcagccgatgtagacgtggacgttgacggcgaggatgaggatggcgatgagggcgaagtagatgacggcgtggacgagtatggagatgccgctggtctggaagttgccgaactccaccatcctgcccttgccggggatctggagcagcagccccggcgagaggaggatgaagagcaccagcccgatgaacaccggcgcccagtccgccatgccggcccccttagc

SEQ ID NO: 3191 - DNA, 464 bp, Hordeum vulgare
aggtggtggacgggcgcggcgagggcaagtggcgggagtacctggtggagtggcgcgacggcggcgaccgggagtgggtgaaggcgccgtgggtggcggaggacctggtgaaggacttcgaggccgggctggagtacggcgtcgcggaggccgtcgtggacaggaggcaggcggcggacggcgacggggatggcaagtgggagtacctcgtcaagtgggtggacatcgaggaggcgacgtgggagcccgcggagaacgtggacgccgagctcgtgcaggagttcgagcggcagcagctcgggaacggtggcgacgcaccgccggcggagacatttgcagtttgacggcggccgtcgatcgtgctcggttcgctctccggttttgtcgtgtcggtggaacgtcgcactatgtattactactagcgtccgaagagatttttgtgtgattattaattaagaaacgtt

SEQ ID NO: 3192 - DNA, 445 bp, Hordeum vulgare
tacacaaaaatctcttcggcacgctagtagtaatacatagtgcgacgttccaccgacacgacaaaaccggagagcgaaccgagcacgatcgacggccgccgtcaaactgcaaatgtctccgccggcggtgcgtcgccaccgttcccgagctgctgccgctcgaactcctgcacgagctcggcgtccacgttctccgcgggctcccacgtcgcctcctcgatgtccacccacttgacgaggtactcccacttgccatccccgtcgccgtccgccgcctgcctcctgtccacgacggcctccgcgacgccgtactccagcccggcctcgaagtccttcaccaggtcctccgccacccacggcgccttcacccactcccggtcgccgccgtcgcgccactccaccaggtactcccgccacttgccctcgccgcgcccgtccaccacct

SEQ ID NO: 3193 - DNA, 507 bp, Hordeum vulgare
gaggtcacgctcggcggcgagaacggcatcttctcgccctgcacatggtcgtcctccgcaagcccgccgacgccgacgccgaagccgaggagagcagcaaatagagtgcgatcaaggatcaaacaaacaagaggaaggaacaagaaataatttcgatttctaatgagaggtaagaatctatgaggaggacaggcgtattcatagctaatggagcactattgatttggcctcggtgccgagaggaaagaagaataggaacggcggatgaagcttactgttttggttggtagctttcgttttcgatttttggttggagtttggaccgcatgcgtgcgtgagtgcaggctggattcagatttgtttctgctttgatccgtggatagatcttttccttcttccttcttctatgtatcgtcgtcagctatattttgccctgaaaaatcagatggaggttgtgcatgaaaaaaaaaaaaaaaaaaaaaaaaaaaaaaaaaaaaaaaaaaaaaa

SEQ ID NO: 3194 - DNA, 451 bp, Hordeum vulgare
  UNSURE (7),(22),(23): n stands for any base
ccttcanctgatttttaagggnncaaaatatagctgacgacgatacatagaagaaggaagaaggaaaagatctatccacggatcaaagcagaaacaaatctgaatccagcctgcactcacgcacgcatgcggtccaaactccaaccaaaaatcgaaaacgaaagctaccaaccaaaacagtaagcttcatccgccgttcctattcttctttcctctcggcaccgaggccaaatcaatagtgctccattagctatgaatacgcctgtcctcctcatagattcttacctctcattagaaatcgaaattatttcttgttccttcctcttgtttgtttgatccttgatcgcactctatttgctgctctcctcggcttcggcgtcggcgtcggcgggcttgcggaggacgaccatgtgcatgggcgagaagatgccggtctcgccgccgagcgtga

SEQ ID NO: 3195 - DNA, 538 bp, Hordeum vulgare
gtccccggctgagattcgacggggcgccggcaggcgcactacgtaagttcactggaagcccacctgcggcgtcaagtccctcctcgaggacgaggccgtcaccgtcggcggcaccaaccacagccacgccaccaaggacctcaccgactccatcgccgccggaaactacccggagtggaccttctacatccagaccatcgacccggaccacgaggaccgcttcgacttcgacccgcttgacgtgaccaagacgtggcccgaggacgtggtgccgctgcagcccgtgggcaggctcgtcctcaaccgcaacatcgacaacttcttcgccgagaacgagcagctggccttctgccccgggatcatcgtccccggggtctactactccgacgacaagctgctgcagaccaggatcttctcctactccgacacgcagcgccaccgcctcgggccaaactacctgctgctgccggccaacgcgcccaagtgctcccaccacaacaaccactacgacgggctcatgaacttcatgcaccgcgac

SEQ ID NO: 3196 - DNA, 548 bp, Hordeum vulgare
gaggatgacgggctcttgtacaattattacatgaatgacagacgacaatgcgcataatgtggtgtagaatcgtacgtatgtccttgttttgcaaaataggctcggtaaaatgaagtagctgatgtagcatgtggtacttaaattaatcctttgccgataagagggaagaatgcatgcatgcatgcatgcatgcttccacgaccgaagcagatatctgatttgctcacgtagtacgtgcgccattgaggactggtgattacatgctcggcttcgcgctgagacggctcgcaagcttctggccaagagacttgtcagcctgagaccagtaggagagccagatggccttgatctcgtgggtgaggcgggggtcggacagcgcatcgatccatctgttgatgaatcgctcttgccttgccgggtccatggagcggtacctctcccctggctgcttgaagttgttctccttgtcaatgcatgccttctcgcggcggccgttgagcgcgcgcgccgggatggggtagcgcggcgcgtgcttggcggggtcgaac

SEQ ID NO: 3197 - DNA, 448 bp, Hordeum vulgare
gcaatgcatgtaaacgtcaacagcggccgcatgcagccgatttgttttttctacctccaaatccaaatccaaatcccgagagaggagcctgccactttcggaccggccgcccatgcccacaccacgcatgcacgacacgacgagacgagaggagaggagaggagaggagagccacggccggccgcagcgatggaggaccgagatcgatcacgttagttcgatgctccgtggcaagcggccaagagggacgctccggcgcagcggtccgaaacccagccgcccggatccttcttttcttccgcaccgctgccgcgccgcgcacgggtggcatcatccccgaccccccaccgcatcacgcgatcccttccaccctcatggcaggcatcggcatcggccttgtggccggggcgctgtcgatcgtcgcgtcgacatatacggccggtcgccg

SEQ ID NO: 3198 - DNA, 371 bp, Hordeum vulgare
tttttttttttttttttgacttacttatcttctcttcattcacgtcagcagctcatgtaagtatgtgagtatatacacaaggctcacaaaacaaggagaaaagaaaataagaaaaggcggcagccaaagttgccgatggatcagcaggacgctaccgctacgagtcatcatctcgtgtgaaactaaactaatcacctcccctgtctggtgtggtgctgtgctgcgatccttcgtgcgtgcgtgcgtagcccggccaaaacgaggagccagaagcagcatcttcttcggctccatgttggcgatcgtttgtttgtttactatccccgatttgctttcacctccactcgtgggtgtcgcacgggaagcagccc

SEQ ID NO: 3199 - DNA, 509 bp, Hordeum vulgare
gtaaggatctctgtgaatcctacagttcaaccggtactccgtggttcctttggttaatcctgacgtttcttcttcaatattaaaaacaaccatcccttcttccaagttttcagtcacagcgataggtaaaggccacatttgtaaatatttggagtctgtggtccatccagtagtcagatgcttggtgagttattatcagcctggtctgtgttaactgaatatgacactttgtacttgtagactaggtcatattcagacataggaaaaatggtttactgcagttaccaaactagtgtacagaataggaaagaataggaatttgtcgaaatgaagctttgcattaggtctagagttacctggcaaatgtaagttctttctgggcttgtttgatccgtctcacaattctgaagcgccttcaaggtttcaacattccaaagctttcttgaaggcattcatgcgctttgtaattgaggaaattatgtttcgtgccttcacgcatcagtttgagc

SEQ ID NO: 3200 - DNA, 547 bp, Hordeum vulgare
  UNSURE (4): n stands for any base
cagnagcggttgcataccagtacatgcttagtggatttctagaagcaaggtgtacaggtgtatttctgagtgtaattatacaaaaagattaccacaaaaaagttctagtattccactgttcccaaacaagaaaaagtaggaaaataaatcatctcctatgtatgcaccatcgtcggccagagtctgtctaggagtctagacagcttcctgcctcacacatgagcagcactgattgaaaacatgatcttgatccatgcatgcattttcgacaccagagatgagcttgatccatgcatgcattcttattaatgtgagcaaagcaatccgagtgcccgtatcatgtactcatacaagcaagaaggcgttccagcaccgtaaaggatgcatcttcgtgccgctcaaactgatgcgtgaaggcacgaaacataatttcctcaattacaaagcgcatgaatgccttcaagaaagctttggaatgttgaaaccttgaaggcgcttcagaattgtgagacggatcaaacaagcccagaaagaacttacatttgcc

SEQ ID NO: 3201 - DNA, 95 bp, Hordeum vulgare
tttttttttttttttttttttttttttattttttttttttttttttttttttttttttttttttttttttttttttttttttttttttttttttt

SEQ ID NO: 3202 - DNA, 299 bp, Hordeum vulgare
ccgccgctgcttctgcaccacccactgccaccattaaccaacaggcctctgcttcgcgtcatgcatgcctagcttcgtccgcccgtgcacgtacgacgtacggtggctgaactgcgcctctctcttcctgcgtgcgtccatgcgtgtccatgaataagtctcagcttgtctcggcaagcttcccttcttccttttttttgtatgcttgttacgagtgtgcacgagtcgttgtgtctcgctcggttcgttctcagagtttgctgtaaggtttgccaattatcacagcggaatccttcttt

SEQ ID NO: 3203 - DNA, 466 bp, Hordeum vulgare
ggactgcagggaattcggcacgaggggcctaatcaaggattaccgcataggggccctggcgcacctgggttgcctactggtggtgtacggccacccttgccacaaatgcattcacagactgatggagctacaagaccagggcaaccaagacctcacatgcctggtatggataatcatgcagcagctcaaggaattaaagatgacagaagtggggtaaactcagctgcacaggaggctcctaagaaggttgaggtggagaagcaggtcctagactccagagagaaactagagtactaccgcacgaaaatgcaagatcttgttctgtataaaagtcggtgtgacaatagacttaatgagatcacagaaagggcgtcttctgataaacgtgaggtggaattgttgtctaagaaatatgaagaaaaatacaagcaagtggcagagttagcttccaaactggcagttgagg

SEQ ID NO: 3204 - DNA, 543 bp, Hordeum vulgare
  UNSURE (4): n stands for any base
cgtnctgtatatattgtacaaaaagaaagaaacgggaaccgcgcacacgcacgatgagtaagctgttgtttcaaagatacaagccactataaacagagaaaaatctcaggatactttacaggtcacaatcaaaaaatgtccactttgtacgtggggatggaggacaggaaaaatgcacacagggcgaacagaagtgagttgccaaccaaaaaaatgaatccgttgtattgtacttccgtcgagcaacccaaaccctgtatcgacaaatgaaccagtcgtctagtagagtttccacctcctctcaagagacaaatcctcataattccacaaatgaatatcagaatttggggggcgaccgtgctcctgatgctttaaaaggcccagtggaaccgaaaggatcagcttcatcaaaagaatcgaaccggccaaaatttctcgagctgtttgatgagtcaaatcctgctgcgctctcgcctttggagctggttacagagtcgaacctggaaaagcgactttcctgtgggacggcgctgtcctgggatc

SEQ ID NO: 3205 - DNA, 495 bp, Hordeum vulgare
ccgcccttcgcccccctgcccgcctgctcccgcccgcggcctccggcgcccgcatcgtcctccgtcggtccagcaggtatccttaccctttggcaagaaattcggggtggtttcagaatgcgacaaggttgaggacagagaacaacccgaagaaggctctgtttgcatcagagacagactctcctaacaccgagatttcaaaacagagcagcaccagcgacgccaactcttctccagatggcccgccagtcctcaccattttggccggtatagttgtgttcttcctgctcttgtgggtaatcggatcgatcttcacctggatcgtcggtctggtcttcggggctgcgaaatcttagatgttcatcagtgttaggatagttctgcaccttttcagttgtatatacacttgtccccgactgatgtttgatagcccctggatcgttgcatcctctgctgtcatttccagacgaaatttcttgaataattgtattacat

SEQ ID NO: 3206 - DNA, 496 bp, Hordeum vulgare
tatgtaatacaattatttaagaaatttcgtctggaaatgacagcagaggatgcaacgatccaggggctatcaaacatcagtcggggacaagtgtatatacaactgaaaaggtgcagaactatcctaacactgatgaacatctaagatttcgcagccccgaagaccagaccgacgatccaggtgaagatcgatccgattacccacaagagcaggaagaacacaactataccggccaaaatggtgaggactggcgggccatctggagaagagttggcgtcgctggtgctgctctgttttgaaatctcggtgttaggagagtctgtctctgatgcaaacagagccttcttcgggttgttctctgtcctcaaccttgtcgcattctgaaaccaccccgaatttcttgccaaagggtaaggatacctgctggaccgacggaggacgatgcgggcgccggaggccgcgggcgggagcaggcgggcaggggggcgaagggcgg

SEQ ID NO: 3207 - DNA, 520 bp, Hordeum vulgare
gttggttccaatagcgctgatgatgctccacgaaacaccacttccacgcaatcaacagctggatcatcagctgcttctgtccccagtcgtccagttggacgtgttgttggtatcatcaagaggaattggaactcgtattgtggatcattggagccaatgcccatgcctgctggtagcgggggtgttgctcatgctctttttgtgtcgaaagatcgaagaattcctaagattcggatccaaactaggcaacttggtaatcttttaaataaaaggattatcgttgcagttgattcatgggatgtcatgtctcgatacccatcaggacactatgtgcggactataggagatattggcgataaagaaacagaaacagaggttgtcctaatagagaatgatattaacacaagacctttctctacacaagtccttgcttgtttgccacctttgccttggacattgtcacctgaggatgtggctaatcctaataggcaagatttgcggcatgtgagagtctttagtg

SEQ ID NO: 3208 - DNA, 533 bp, Hordeum vulgare
  UNSURE (21): n stands for any base
gatttttagcatcaataaagncgaggatttttacacattctctgtaaagaggaattccaggctgacttgacaatatcataaaaatcaccaaaaattgttgaattgaagaatggaccctggtacaatgtcgtagcggaaaaaagggtgaatgcactaatgttacaattcaattgtacatttgttgttcatatgagggtgagctgtagcttggggcggtggggctgaggctcgaccacttccatatggatcataacactctgcaacacagcatagcttatgtttgttccgggcttggttactttctggtgcacctcgtctactacccagtcagcccctttgtctcccttggccgtaagatagatgggaccttctatgccaaacttcggtacgaagactatgaaaccatttgccttgatctttactattctagcttcagtatccacaggccttgtcctgaaatatatgagagtgtggagctcaaccgatgctctgcttgccatttgggcatttcggtgcctataattcaagttgtc

SEQ ID NO: 3209 - DNA, 517 bp, Hordeum vulgare
ctgctttgtcctgtttctcgcccgcctacttgtaatccgtccgctgccagccaaatcgctagctcagtccctcctaccttccctccggcagagctccgtcctcctcctcctgccgatacctcgagatctccgcccccgaacacagtcgcccgttttccatttcctctccaccaagcgccgccggtcgccgccgccgccatgtccaagtcgggagccctggatctcgcgtcgggccttggcgggaagatcgacaaggaacaagtcaaatcggcggtcgacgagtatgagaaatatcatggatattatggagggaaggaggaatcgaggaaatccaactacaccgatatggttaataaatactatgatcttgctactagcttctacgagtatggctggggtgaatccttccactttgctcacaggtggagtggagaatctttaagggaaagtatcaaacggcacgagcactttctggccctacagcttgagttgaaaccagggatgaaggttttggatg

SEQ ID NO: 3210 - DNA, 406 bp, Hordeum vulgare
attatgcaaattccgttactaggttacaaacgtcggcaccaccacatcgtacacacacttgtttggacaagaagtcggaatagccttacgctaaccttgacggggaggaaaactgcaactagcttatttatgccactaatagcttaccgcaatggtctcaaactgatcgttaatcaacccgaaccaaaagttcacacaacaaaacaacaaaacaacaaaacaaaacaaagaacaaacataaacacaatacatttcactacgtcccttctacagataagaagaaccacggattctaggcatgatcaaactccccaagcccgcttcttcaaaatgcatctttgcctgaaagttgcttgctcattccgaaagaggcttccgaaccacaaagaagtacatcggggtgaag

SEQ ID NO: 3211 - DNA, 404 bp, Hordeum vulgare
aacaacctccaacaacaaccagcgtcagcggcagaccctcgtgctgtagcctggtcctggacacagctgctcggcagccagaacgtgaagcgatgctggtgaggagcgcgtccacgccggtgctcggcgcgctgcacgccacctccggggccggcgccggcgccggcggccactccccggccgtccacttcgccgagtcctcgcccacggtcgcgtaccacccgtcgcccatctcctgcagcctgtcctccgaccacgagcgctctcgcgggggcggcctgcgccgcgcgtgctcggacggcaacctggccgcgctgggcggccgcgcggacgacctccaccaccaccacctgccgccgcggtccaggccggcgctcgagacgatccggtccttcacggcgcgc

SEQ ID NO: 3212 - DNA, 393 bp, Hordeum vulgare
ttttttttttttttttccttaactgaatctggattactaaagtaaaaaagatctgactgaagaaatgccacaccggaggggatcggaatctacttgttcactatagcaagcagtacaggcaggctggagtctggacgactaaaaattattgggagagaatctactggtgctgaagcagctacactagctccgatcagcgtcggcttcagcttcaaagagaccgcggcgaggttcagctcagctcgtggcggaagccatggacgggtgagcggccgggaacccggcgtagctcatggcatcgtcgccgtcttcggggccggcgccggcgccgtcgtcggtgtcccacaggaaggcggcctgcgcggcgaggacgtgggtgttgtgcgggtcggc

SEQ ID NO: 3213 - DNA, 1341 bp, Hordeum vulgare
  UNSURE (1)..(14),(270),(1046),(1341): n stands for any base
nnnnnnnnnnnnnncccccccccccccatttctcatttccatctggattccccccaattcaagcgccacaacccgcggggaactgctaatctcttacttaagcgtaatagttcaatattcgcacatttatctttatcctcttgtaatgctcatggtgtcttacaactacttcgtattgtatcggtcttattattttatgatcaattataacaatattacatcctaacaagatacacgctcttcacgatcctgaatcagccccgcccgatnttgaaatcgatagtaaagagcgaaagaatggcgatttaatttaacatttaaagatactgggcggggggtgtgtggactgtttagcttttttttttatgaaggatcgttgtcccattttcaataataattgaagaagatttatgctagtctttttatcattctgcctataagccgtattgacacggttggcacatattcatcgccttccatctacgcgaaccccggtttcgtcctttcgttgtctttgcctttcgtaacccccctcttttcggttccgctcttcgtgtacccacactcccttccttccttagacattatgatttttcctcgccacttggtgtattgtggcgatgatatctgttgtgacatgatggcgacattccgttccataccggtcgacggccgattctccgtccattgtcccgcgtaaaacacctatatattcgcccgttttatcccgcggtcgcctctccatccgttttttccgtggctccttaccgttttttacatgttattggctcgatgcttcggtaaccgatagcgcgtcttctcgtagtcgcaatcacgcgatcccgctatgtaccgttcctaaaacacacccgcgtcccccctgtttacactacctgttttaatattaaaccgcgaaccaaagcttacgcgacgtttttcattatgcaacgttccctctaatcctctgtacgtcgcacccagatccacattaatgcgcccatttttcctatcctgcttgcgatcatactgcaagttttgctgtcatnctgtaatacagacattacgttcgatgcgcgatgttagcggtttttatggcagccctcatgacatttcccggcatattcattttatcttcgagtccagtttcattatttcggtcgcattctccgccattatttgatttcaattccgtatattatacgtccactactcaccgcagcaaatttattaacactcgacctctccatatataaccctcacagttccgctatgttgcacccttttattctgttatccccatataggtttctgcgcgcatttatctcaggcaggtagcctggn

SEQ ID NO: 3214 - DNA, 555 bp, Hordeum vulgare
ttcactctgaagtctgaactaccattatgtatattcttaaatgcttccaatacaaaatacagaaaggcacacaaccctggtgcaaactaaagcacattcaggatgcctgttaggcaccccgttgcaatattacaaggagcttgtctgggagggcctcgttgtacatgtaagtgtacaatcgcgctcggtaaaaaaaaaaaggcgctgtcttcgacaagagacggcggactggaccatcgatgcggtgccggagaaatatacagtacccagcacccagcggtatcaactgaaggggtggtccaccggtacagcaccgctagatagttccattccgtgaagtatcaatcatcacgactatttcgcaattgtgttggattcagttttccacacaatgtcttttagttctgatgagaaattctggtagaaactgtgaaactccaaggtgtctcctccagttttacgaagttcaaccatatggagtgatggagcaacctcaaaaacctccgttgctacagataaatgaccttttcttcctgtcttgtcacctttcagttt

SEQ ID NO: 3215 - DNA, 387 bp, Hordeum vulgare
actcgccctcactaaaccctaacccccacaactactcccccctcccacgccgccagcggccgggagccatggtgaaggcctacctccgctacgagccggcgctctccttcggcgtggtcgcctccccggagtccaacgtcgtctacgacccctccggccgccgcctcctcgccgccgcgctcgaccgcttcgccgcctgggacctcaagcgcggcctcccctccgccaccttcaccccctcctcctcctccgcctccctcgccgtctcctgcgtcgcctcctcccccgccgctgcttccgcctccgcttcctcgattgcgagtggccatgcggatgggagcatcaggctgtgggatgctgagacgggcgcctgcgaggcgacgctcc

SEQ ID NO: 3216 - DNA, 458 bp, Hordeum vulgare
ctttttttttcttttttttttctaaaattttgaattcctttccagaagttcgatacttcaaatgctttgaatctttgattttttttctaaatgaggtgaattctgaaagctagggatgctgcaatttctgaaagcataaaaaagggaaggtttgaccaaatcttgactatctaaaaagagggaggtacgccatgtttctctagtaggaaaccgccgattaacactggcccacacacacatctctcaaaattgtgctgtgctcatgacagcatgaaatgaacgcgataacccagtgtggtgcgtatacgctacaacagttgagtaaaaacagacagatccttgctcagctctgtacagacggcttgggcttcttctttttccttctctcgcccccacccgacctatccgaccgcttcgactgctcctgcctgatctccatgagcttcgccttggcgtcc

SEQ ID NO: 3217 - DNA, 548 bp, Hordeum vulgare
gtcccccggctgcaggaattcgcacgaggcagccgccgcccatgtcgaagcgagggaggggaggctccgcggggaacaagttccggatgtcgctgggtctgccggtggcggcgacggtgaactgcgccgacaacacgggcgctaagaacctctacatcatctccgtcaagggtatcaagggccgcctcaaccgtctcccgtcggcctgcgtcggcgacatggtcatggccaccgtcaagaaggggaagcccgatctgcgaaagaaggtcatgcccgcagtcatcatccgccagcgcaagccgtggcgacgcaaggacggtgtcttcatgtacttcgaagacaatgctggagtgatcgtgaaccctaagggtgagatgaaaggatctgccatcaccggacctgtgggcaaggagtgtgctgacctttggcccaggatcgccagcaacgccaatgccatcgtttgagagcttgtttcaagttgtgagtctgcctatataatgccagtgtgggttgcaactgtgttgcctgggaaatagtggaacctttgc

SEQ ID NO: 3218 - DNA, 550 bp, Hordeum vulgare
ggagacatttgaacacacagcaattgagtaattgcagataatgttaacacaggttcagcaacacagatgtcaaactaagtagtagacaggcaggcttctgttcactaacaaactgagatgccagacaaaatggagcaacgcaaaggttccactatttcccaggcaacacagttgcaacccacactggcattatataggcagactcacaacttgaaacaagctctcaaacgatggcattggcgttgctggcgatcctgggccaaaggtcagcacactccttgcccacaggtccggtgatggcagatcctttcatctcacccttagggttcacgatcactccagcattgtcttcgaagtacatgaagacaccgtccttgcgtcgccacggcttgcgctggcggatgatgactgcgggcatgaccttctttcgcagatcgggcttccccttcttgacggtggccatgaccatgtcgccgacgcaggccgacgggagacggttgaggcggcccttgatacccttgacggagatgatgtagaggttcttagcgcc

SEQ ID NO: 3219 - DNA, 479 bp, Hordeum vulgare
gacaccgtcaacatttgggcgcggctccaccatactaaccgccgcggccggcgccaaggtcgccaagcaagggagcagggcgagctcgtcggcctgcggcagcgccgatgtgcttgaggcgttgggtgtcaacatcgagttgggacccgagggtattaagcggtgtgtcaatgaggtgggtgttggattcatgatgtctgcaaattaccatccggcaatgaaaattgtcaaacctgtgaggaagaagctgaagataaagacagttttcaatatccttggtcctctgttgaatccagcaagggtaccatatgctgttattggtgtttaccatgaaaacatagttagcaagatggccaaagcagctcagaaatttggtatgcagagagcattggttgttcattcaaagggtttggacgaaataagcccacttgggcctggatatatacttgatgtcactccaggaaagatcgaaaaaatgc

SEQ ID NO: 3220 - DNA, 550 bp, Hordeum vulgare
aggaagctgcgcctattctgttccggcctaaccttacatctcgtccaatgggattttctttacactgggtgaacaaaatcaaaccagaccagacggcatctatgtacgcttgcgacagacacgaacagaaggaacaagaagaacagacatggacatgatgaagaacagacaggctacaacaatccttatttcgcgccattcctcgcgtcttattgccgacctctgctgctcgagctcgccaatcaacctcggtctcagcagctattggaaacctttacccacaactcgagcgtgttgatggccactccggagcgctgcgtctcctgtgctagcgcaactccctcttgcagagttttgactttgccgctaacaagtagggacgccgcggcgttcagaacaagagcatctgcaattgagcctctttgtccagcgagaacatcctggagaacttttgcgttaaacgcaggatcgcctcctttaagatctagtaatgtgcagcgaggaatgccaaaatccaatggatcaaagagcattttttcgatctttcctg

SEQ ID NO: 3221 - DNA, 486 bp, Hordeum vulgare
atttgagaataaaggtaaatggaggtgaatggagaacggttgataaagtcactgctctatgcgtaggaaatgccaagtactttggtggtggcatgaagattactccaacagttgatccttttagcggtgaccttcaggttgttattatacaagatttcaagtggtgcagttttcttcttaagctacataggctgtatggaggcacacacttaacggtgaatggtgtgtcatcaataagagttcaatcaattgaagtggcagaggtggtgcctaacggcgacgtctttgtgcaatctgatggggagcacttcggttttctcccgaccagattctcggttctgcctgccgcagtagatttcttcagctagaccgctgtgccgtttcttcctgttggatttcgacgatggacagaagacgcatgatccttcgccgacccgcttctgttcacctggtcgatttcttctgccatagatcacgacgcctccc

SEQ ID NO: 3222 - DNA, 548 bp, Hordeum vulgare
  UNSURE (10),(11),(30),(31): n stands for any base
gacacttggnnatgtgcagtgccatttcanngttgttcgaacaagaagcagccacattattgcacgcggtactttgcatggctgatgaagaaactactgcgaaatttacgctcgtgccggctcgtccgctgtgctgtgattctactacagcttgtctttgaacatcgacgactcagctgctgcagccgcatactggtgtacatgcagagaaattacatggtgggtggctgccgcacagcagtaatttgtttcatctacttactacctgccagaagacgagtgagtggagcaacccgatcgccgtgccttcttaagctagtgtatgaaacgggaggcgtcgtgatctatggcagaagaaatcgaccaggtgaacagaagcgggtcggcgaaggatcatgcgtcttctgtccatcgtcgaaatccaacaggaagaaacggcacagcggtctagctgaagaaatctactgcggcaggcagaaccgagaatctggtcgggagaaaaccgaagtgctccccatcagattgcacaaagacgtcgccgttaggca

SEQ ID NO: 3223 - DNA, 542 bp, Hordeum vulgare
  UNSURE (3): n stands for any base
ggnctgcaggcaattcggcacgaggatttagagaagacccggaattaggtggttcactttcggtgcgtataggcgatgcgctttccccatcggctacagttgaaggaggatttgctggcattgttgttgatttatttgctgatggaaaagtcttacctcagctacaagaagctgaaacttggttagagattgcaaaaagctcatgccagatggtcgaatcatggtcaactgcggtggagcagatacccccgtatctcttgctgctgacacgggtgtttcgtcttgggtccagaatcctacaatcaaggctatgtgctctgcgttccctgggcagctaaactggaagagactttcggagaaggagagtgtaaactacgtcgcgttgacgggtccccttccagacctggaggagtggtcaacctcggttccgagcgagctaagcccaagagtgaaacaatgggtgccttgcaagctcgcgtgaggatgtgtgttttcttctggtggtgcctttgcttgcttctacttcctctgtacctaaataa

SEQ ID NO: 3224 - DNA, 541 bp, Hordeum vulgare
ctggaatgatgaatggcaataacagcaggtcaaaaggacatgccaaaaattgtagcgctatgcgttcttccctcggctcggtttcaggattacacgcatcaatcttccctcggatcggtttcaggattacacacatcaactccattaaacagacatgtcttcgcttcactgttcttcaagcttcgggagccagatagacaaccttccccaccgcaattccttccttggacatgtcacatgtgagtgctgataagatatggtacttcttcagatgcagacagatggccttatgtacaccttaaaaggaccgtggagggaggagacagacaaagttgtactccctccgttcctaaataattgtagttggagagaactagtctagttcttctcaactacaattatttaggtacagaggaagtagaagcaagcaaaggcaccaccagaagaaaacacacatcctcacgcgagcttgcaaggcacccattgtttcactcttgggcttagctcgctcggaaccgaggttgaccactcctccaggtct

SEQ ID NO: 3225 - DNA, 519 bp, Hordeum vulgare
  UNSURE (9),(21): n stands for any base
agaaggtgnaaggcctcgggnaaagacaagcagggtataaaggggcatgtcagagtgaagcaaaagcaggacacactaggtgttggtgtggacaatcctcagaacaaatgggcatatgataccacccagtttgatgacatactaaagaaactgaaagtgcaatctactactcctgctaaagaaattgaggatgtaaccagttcacctgacagtacacccaagaaagataaacctgcaaaagatgaagtcgctaaagttacgcggcctcaaggaagatacaagaaaagggagagggggaaaagtgtgaggggttattcagcagttgatcttgaaggcatacttgttcggaaaaaggaaagtgattgcgaggcagatcaggaagttcagccatcatgcatggaagagcctgatatcaccatcggtcagggtgcagtgtcccaagctgaagatgtgaactggtgggggcacaagtttggatatgtatcaggaggctttttaggagcaaaatctcgcaagaat

SEQ ID NO: 3226 - DNA, 551 bp, Hordeum vulgare
ggtaaatagttgatggatatatgcatgtggaaacttatggagcaaactgagtttgcagacttataagagagttctaaaaccctagacggccaatgcacaggaggcataaccacatcatccaaatacaagtctgcacccaaccaaaagaattacaaacacctataaatgcatcagctacatggatattacgatacagataactcagcacacacttccaatttttcagcagctagcaagatttgcaaaattttgggccccgttctgagggcctatgactcctgacatctataccgtgccatttgagtgcgcagcctatatgtatactcgtctgaagcaacaatcagcaaatatatgaatgcaggagccagacacaaaatcgcatggcgtcccataggcttcgtatttgcttcatgatacaagatgcactcttttgccctccagattgaatttcttgcttccctggagcttcctcttcaagaatgaaagagcttcacgtctacaggagaagtcggagaatatagttgattgtgactcaacagcttccttaagct

SEQ ID NO: 3227 - DNA, 516 bp, Hordeum vulgare
cgcaggagcactgtagggtcggcaagaagtctctcaagaactgggtggtgaatgcatttagagagcgcaaagctcttgccctaacacttaatgatacaaaaacagcagttaacaagctcaaccagatggctaatgttgttgttggcctcatagtgtccgctctctggcttcttattctcggcgtagcgacgacgcatttctttgtcttcctcagttcacagcttcttgtggcggtatttgtatttgggaatacacttaagacgatttttgaggcaattatcttcttattcgtgatgcatcctttcgatgtcggtgaccgctgtgaaattgaagaggttcaggtcgttgtagaggaaatgaatatcatgacaacagtctttcttcgttatgataacctaaagatctattatccaaacagtgtactggccacaaaaccaattttcaatttctataggagtcctgatatgggagaaggggttgacttctctattcatgtcgccactcctatggaaaaac

SEQ ID NO: 3228 - DNA, 550 bp, Hordeum vulgare
tgtattgcacctatccgtgcattttctgcttcattcataattcattttaaaaatctgtatgtccacttattgataacaaaaggagtatttgctactggcaatagttgctaccagttgtcaccactagacatggatggtaattgttgtatccgcgatctcataacgggaagatgcaccaccacttcatgaataattccacgtcgtcggcatccttgtggattgtagagggggcgtgtttcgcacgttcacgtcgagcggcaacattcggtactcgatgtcgaggtccctcaagactctaatcatctcttggagcacaagttccctcctcacgaacctcatacccatgtcctggaagttaagcgtgtgtcgtagccatatggatactttcagcttgttggtctcatctacatcccggaggacaaccatcgcaccagggtaccaatgttccttcttactgtcaatgtaacgtagtattctttccttcatgagcgtgagtttttccataggagtggcgacatgaatagagaagtcaaccccttctcccatatca

SEQ ID NO: 3229 - DNA, 553 bp, Hordeum vulgare
  UNSURE (20): n stands for any base
gtccctccgggcctgcaggnaattcggcacgaggtgcagctggccgcggccgttcgtctataccaaatgctgatgtgccatcagagataagaaatccccaacagatgcggaagggcaggcaggaaaaggcgatgcaagatctgcgcaggaatgacaaatctgcaagagacggtaaatttcccggaaagttccagaaaaacaggaggcctaatggatctggaagggatgataaattccaagacagcagatcccagaagaaccgaagaccagaggggaaagggaaagggaaaggaaaagggggcggaaaagggaacgccaaagggtttggtaaaggtaaaggaaaaggcaaccccaaagggaggggtgccaggtgattaatttgtccacaacgaagaaatattgttgtagaaccaacaggaaagaagcatgtgcctctgatatgacaggtgcttgttacttgccctagtccgggtccctggtttaatgcagttttgtttcagttctattgtgatagccggggaaataaccatgatttttgccagaaatgtaaccg

SEQ ID NO: 3230 - DNA, 544 bp, Hordeum vulgare
  UNSURE (541): n stands for any base
taacggtattgtttatttgttagtgctgtatgttatgtgaacaaagtacttgccatgaaaaataatacacaagttcgttttgactccaaggtgtcatcagtagtttctctattgtgcttaccaaaatctcacaggcagtaccaaatattggatgcgaatcagattaaacccatgaacaacaaaggcggttacatttctggcaaaaatcatggttatttccccggctatcacaatagaactgaaacaaaactgcattaaaccagggacccggactagggcaagtaacaagcacctgtcatatcagaggcacatgcttctttcctgttggttctacaacaatatttcttcgttgtggacaaattaatcacctggcacccctccctttggggttgccttttcctttacctttaccaaaccctttggcgttcccttttccgcccccttttcctttccctttccctttcccctctggtcttcggttcttctgggatctgctgtcttggaatttatcatcccttccagatccattaggcctcctgtnttt

SEQ ID NO: 3231 - DNA, 298 bp, Hordeum vulgare
  UNSURE (284): n stands for any base
cgcccggcgtcgtgcgccgacctgtacgcggtggtctacaagggctgcgccaaccagaccttcccggggggaagcccgccgcccaccgtcgcggcgctctcctcggcgctcgccgcgcagtcggcctccgccaagttctacaagacctcctcggcctccgcctcctcggcctccgcctccgtcttcggcctcttccagtgccgcggcgacctgtccggcccggactgctcctcctgcgtcgcccgggccatgtcctcctggcgcgacctctgcggcgccgccgncgccgcgcgggtcc

SEQ ID NO: 3232 - DNA, 314 bp, Hordeum vulgare
ttttttttttttttttttggaattccaaccgattcacatgagccccagccagccagccagccccaaaggaaagaacagtttctttttctgaacttgcctcctctcctttacccctctctctcatctctcatctctcatcgtgcatgcgatgtgggtatggcacccatcacaccacatggccagagagaggaacaagagccaaaaaacagtcccctctgtatcccactcaccaccgtccaacgcccctatcgaaaatgcacaccatgccccaatgctttcccttgtccagttgctacctcctcctccctccatgc

SEQ ID NO: 3233 - DNA, 538 bp, Hordeum vulgare
ggcaattcggcacgagggcgtctggagctacgcttcatatgagccggaagaggttcctgatggtttccactgccttggccactatgcccaacaaaatggccggcttttacagggttctcttcttgttgcaagcgaagcggctagctgccagttaatcaatagcaggcccgctcttgagaaaccattagattacaccctcgtttggactaatgcaggcgtgtatgaagatgacaatagtgaatgcgggtgcttctggttgccatcacccccaaagggttatgaagcccttggctatgtggttactagaggaccaaagaagccctcgctggaggcggtccggtgtgtgcgacacgacctcacggatccatgtgaaaactttaggtcagtcattaatttggaccgtacatgccaagtttggaagacaaggccttgccaccgagggacggcaggacgaggtatacctgttggtacattcttctgcaaaacaaattcagttaacagtcagaaatcaggcattccctgcttgaagaactgtgac

SEQ ID NO: 3234 - DNA, 556 bp, Hordeum vulgare
gctaaatacccagcattaaaagtcctcttgcattagctttatcattatcatacataccatgataccaatcaacccttctcatcacatacaatgtacataaagaagcaacagagatagacaatcaaggtgacacaacctagcatcgctcatcaccatcccagttatctttctcctttggtccggtcgggccttcctcctcgtacagctccgccggaagactgtcgaatatggcctccgctgtgaaccgtaggaagaacggcaggaagctaagtaccgcgtccacctctgaccgcgagttgtatgtcaccgtcgggccccaatccctcatgtactgcagccagcacggttccaccacggcgtcccccaggtactccgcagagataatcttatacctcgtgctagaatcaattgataggtcactccgtgcgacatcgtttcttagcccaacgccgaggttttcagaaccctgcaggtagcagccagggtgtgcatagcttgcgtgcccatttcttgacgaatacacgatcgccttgtttcctgagatgaactccagatc

SEQ ID NO: 3235 - DNA, 553 bp, Hordeum vulgare
  UNSURE (50): n stands for any base
gtacccccgggcctgcaggcaattcggcacgagggtgcgtactacttttnaaacgagtacctggtggatttgttctcaaaatgtggatttactcttgaggaaatttgtgtacacaacaaaaaggtcgagaaccgttcactagacttggtgatgaacaggaattggatccaagctacgtttaccctcaacccatctggtcctctaagtccaaataatcaacatgaccacaatacttgtgaaggaaaggatgataagctagctgttgacacgtctcagaagaagagcgaaagtgaagaaattgacctttctgtggattttagtaacatgtttggaacattgcactatcttaatgaggcacaaattattaggattaaagcaaagggtcacgacttcaaaataaaaatgctcgcgaaagaataccagcacacctgcaaatcaactggactaatgctctgggaatcagctcagttcatgtgcagtcttctagcagagaatccttccatagtcgctggcaaaagggtgctggaaatgggttgtggttcagctggcatct

SEQ ID NO: 3236 - DNA, 533 bp, Hordeum vulgare
aaatctgcagttacctgagattcaagtaacaccaatgtatcacacttcgaagtacaatatggaaagcgttacattccggaaagcaccgcaaacatcattgccacggaaccaagagctaatgataccattgctctcgtgaactccatttatccatttgtccacgagcatgaaaccctgggcctctgcggccgagaggattgaatcctcgtcaacacggcgctggatgtagcaaagaataagggccgcctttgaaccagcatcgccaccgtcagaaatcagtgcccttgcagtcttgaagagcggaagtgtagcgtcagggttgtaggtcacgtcggtgcctattatgcaatcgaagcctgcaccatcgccagaaagctctcggaccgccttcacatcatcttcgtcgccccagaatagcttcctaatcgaaattctgctgagaagttcagcctccaaattggaggaagtgttctgtctgagaagatccagcgattctgcgtccccgtcagtggctacaacaaattgagcagaac

SEQ ID NO: 3237 - DNA, 516 bp, Hordeum vulgare
cacgacaagcaggagctcgactccttcctcgtacgcgccacctagctacctaccaattcttcctccatggatcgcgtcgtgctcatcttcatgtgcgtgcatgcacgtcgtcgttgacgctgggtgttgtgtctgtgtacgtgtgtgcaggcgcagtacctgatgctgctgtgctcgttcagggagcagctgcagcagcacgtccgggtgcacgccgtggaggccgtcatggcgtgccgggagatcgagcagtccctgcaggacctaactggtgcgtccttggaggaagggacgggggcgacaatgtccgaggacgaggatgaggggccgctgatgatcatggaggcagcgccactggatatgagctcgaatggacacgacatgatgggctttggccctctggtgcccacggacacggagcgttcccttatggagagggtcaggcaggagctcaaaattgaactcaaacagggtttcaagtcaaggattggagacgtgagggaagagatactccgg

SEQ ID NO: 3238 - DNA, 550 bp, Hordeum vulgare
  UNSURE (51): n stands for any base
gtttaccaacacaaaaaacccaagattttttttccttttgagtatatatantcagctcaacaattgcaacgcatatgcaaagtggtcagactagtagcgtgtacgtatgtcattaaggtgtcacctctgactaataactagatatacaattgaatcgagatcttcttatttctccctgtgtggcgtgtcaccgagatcttccgtgtgattaggcgtcaggtatatgcatgtatatatatactttgcacttttgcagctcccacctagctaccttttacgctttgatttgagggtggatgtctgtgagttgttgtgccagttgcgcttcctctggttgatgaaccagttgttgatttgcttcagctgcagtccagtctcttcaacgagcttggccttatcatcttccgtggggtagggccacttggcgtgttcctgccaccattgcttcagtatggtggtggtgtccccaggcaacttcccggccctcctcttccggagtatctcttccctcacgtctccaatccttgacttgaaaccctgtttgagttca

SEQ ID NO: 3239 - DNA, 522 bp, Hordeum vulgare
gccactgacctccggcatcatcctcgtcgaccccgccgaggcccagaaggtgcaccgcctcaagaccgtctacgacaccaaggtcgtacccattatcaccgaggagttcggctacaccaatgtccaccaggtgcccaagcttgagaagattgtggtgaactgcgggctgggggtggatgccgggaacaacaagggtctggaggccgccatgaaggacctcgcctcgatcaccggacagtatcccgtcaagaccaaggccaagaactccgtcgccagcttcaagatccgcgagggcaacacaatcggtatcgccgtcactctccgcggcagggtgatgttcaacttcttggataggctcatcaaccttgggctccctaggaccatggacttcctaggcgtcaaccccaacagcttcgacgggcacggcaactacaccatcggcctccgcgaccagggcgtgttcccagagatcccctacgaggtgggcggcaagaagaacggtatggacgtcaccatcgtcac

SEQ ID NO: 3240 - DNA, 548 bp, Hordeum vulgare
cagcaactttcatttgttctgtggcagtaagtatacaacatgaacagcaagtaataagagacagcatgatgatcaaatatctaaaccaaactatgcaaaaggatctcaattgacaaagtgggaagcaacaaaggtcaaacgccgccgcttgatcttcacttccttcccctgcccttgctcatgaagtggtggcgcttcaacctcttcttcttgaactggtcagacttgatgttctcggcgaatggcatgccgaggagcgcaagcagcctttgcgcctcgttgtcggtcttggcggtggtgacgatggtgacgtccataccgttcttcttgccgcccacctcgtaggggatctctgggaacacgccctggtcgcggaggccgatggtgtagttgccgtgcccgtcgaagctgttggggttgacgcctaggaagtccatggtcctagggagcccaaggttgatgagcctatccaagaagttgaacatcaccctgccgcggagagtgacggcgataccgattgtgttgccctcgcggatcttgaagctggc

SEQ ID NO: 3241 - DNA, 189 bp, Hordeum vulgare
tttttttttttttttttttttttttttttagaaaaggatgtttttattaacccataataatatgacatgaaggagttacaaagcatatataacgagcatacacccacctcttgcatgatctttttactagcacatataaattgtgcagctgaccaattttattactcaacacatgcccacaattttatt

SEQ ID NO: 3242 - DNA, 340 bp, Hordeum vulgare
cctgaaaggaggcaagggcagcatccggctccagctcatcaaccagcgcgccgacttctccttcgccctcttcaccggcggcctcgaaaacccgaagttggtgtcggtgtcgaagaaggtgatgttcaagaaccccaaggcgccggtgttcccgcggctggcgcagggcaagacccacgacgagatgaccgtgacctggaccagcggctacgacgttaacgaggcctacccgttcgtggagtggggcatggtcggcgccgccggaacgcgcacccccgccgggacactgaccttcaaccgcggcagcatgtgcggcgagccggcacgaactgttggatgg

SEQ ID NO: 3243 - DNA, 261 bp, Hordeum vulgare
ggaccagcggctacgacgttaacgaggcctacccgttcgtggagtggggcatggtcggcgccgccggaacgcgcacccccgccgggacactgaccttcaaccgcggcagcatgtgcggcgagccggcacgaactgttggatggagagatcccgggttcatccacacggcgttcatgaggaacctgtggcccaacaaagagtacttttacaagatcgggcacgagctctccgacggaagcgtggtgtgggccaagccctaca

SEQ ID NO: 3244 - DNA, 417 bp, Hordeum vulgare
tttttttttttttttttttactagcacatataaattgtgcagctgaccaattttattactcaacacatgcccacaattttattggatggatgaccctccattacattaacatgacggccggacgatatgagctagctagcgagcgtggtggggaagcagctgtcgtgcacgcagctgagcacgtcgcggtaatccctgtggatggtgaaggagtcgtagaccttgccgtcgctgctcttcatgtactcgaagagaagcgaggagtggttgaatgcggtgagcttggtgaacccgtagtcatggtccctgaatatgctccacttggggatggcggtggtgtaggacgacaggtggctgccgccgccgccggcgacgacgaagatggtgccgttcatggtgcccgagtagtgggtcttg

SEQ ID NO: 3245 - DNA, 519 bp, Hordeum vulgare
cggagcacgactggagggagggcaccccgcagtacaagttcatcgaggagtgcctgtcgacggtggaccggaagcaccagccgtggctcatcttcacggcgcaccgggtgctgggctactcctccaactcgtggtacgccgaccagggctccttcgaggagcccgagggacgggagagcctgcagaagctgtggcagcgctaccgcgtcgacatcgcctacttcggccacgtccacaactacgagcgcacatgcccgctctaccagagccagtgcgtcaacgccgacaagacccactactcgggcaccatgaacggcaccatcttcgtcgtcgccggcggcggcggcagccacctgtcgtcctacaccaccgccatccccaagtggagcatattcagggaccatgactacgggttcaccaagctcaccgcattcaaccactcctcgcttctcttcgagtacatgaagagcagcgacggcaaggtctacgactccttcaccatccacagggattaccgcg

SEQ ID NO: 3246 - DNA, 552 bp, Hordeum vulgare
ggatgtttttatttaaccataataatatgacatgaaggagttacaaagcatatataacgagcatacacccacctcttgcatgatctttttactagcacatataaattgtgcagctgaccaattttattactcaacacatgcccacaattttattggatggatgaccctccattacattgacatgacggccggacgatatgagctagctagcgagcgtggtggggaagcagctgtcgtgcacgcagctgagcacgtcgcggtaatccctgtggatggtgaaggagtcgtagaccttgccgtcgctgctcttcatgtactcgaagagaagcgaggagtggttgaatgcggtgagcttggtgaacccgtagtcatggtccctgaatatgctccacttggggatggcggtggtgtaggacgacaggtggctgccgccgccgccggcgacgacgaagatggtgccgttcatggtgcccgagtagtgggtcttgtcggcgttgacgcactggctctggtagagcgggcatgtgcgctcgtagttgtggacgtggccga

SEQ ID NO: 3247 - DNA, 552 bp, Hordeum vulgare
  UNSURE (20): n stands for any base
gtccccccgggtctgcaggnaattcggcacgaggggtatgtgagaagtcgaagtgacaaacaactgcggtataagagcgctgtacatttgatatcggattgtgtgcctgaaggtaagaccgctgatggtgctccaattgttccatgtggccttgttgcttggagtttgttcaacgacacatatacagttcgggtcaatggggtggttgctcaagtgaacaaaaaggacatagcttggaagagtgacaagaacaataaattcagcaataatatctatcccagtaacttccagaagggaagtcttataggtggtgctaagcttaatgagagcataccgttaagtgagcaagaagatctcattgtttggatgagaaccgctgcgctcccaactttcaggaagctgtatggaagaattgagaaagatatcaatgcaaatgataatgtaacagtggttatacagaacaactataacacatatagttttggaggatcaaaagcgttggtcctttctactgcatcttggattggaggaaaaaacaatttcattggtatt

SEQ ID NO: 3248 - DNA, 558 bp, Hordeum vulgare
tagttctgctcactagcacattagttggtttataattataataggaattcagaaacgactctcagtatggtcagctaaggccaggtaaggtttagtcaaccgattacaatacattctgttcatgtatgtatgatgctattacggctccaaagttaacaagatggtcatgcctatgagccatgccaagcgcattgaatggcaataagaacaaacacccatagatccaattggaagaatttacccattgaatgcccttttattctcagaaaggatactccagtctaatagttaactctattcatctattccatgacaggttcgtgggatctccaaaggtcctttgtttaatcatgtagagaactaagaagcccatagcaagagaaaggcacagaccaccaatagtcagatatgcaataccaatgaaattgttttttcctccaatccaagatgcagtagaaaggaccaacgcttttgatcctccaaaactatatgtgttatagttgttctgtataaccactgttacattatcatttgcattgatatctttctcaattcttc

SEQ ID NO: 3249 - DNA, 944 bp, Hordeum vulgare
gtcccccgggctgcaggcaattcggcacgagggagagacatgtctcgagttttttttttttttttttaacaccaaaaaaacacaataccattaaccctgggggggctttcccagtccacttttaagggacggcctgcaggctcgccttcgacacaactgattttggggaaatatcggaacatccatcgatacgaaattaacctgggcaaaaacacaaatggggcccaatgatcctaaaggcggagctggagttcgagctcctaaccggcccttgcaacggaggccctcgtgctgagcatgtccaccgggaccccatgtccggggggggaatccacaaggggctgcgcggggtctccaaaggggggagcgccgttaccccacctttggggcctggaataagcgccagttgacaccctgccaccgccgggcgataaaatggaggggctcatggatcggccgttgccggaataaacgggggtgccacggttgtggccttcgtcgaaggggccgcacattgtaggggtcgttaaaactgccgagggggtccttgcggtgcgcgttctgggggcccccgagcgcctgtgacttgaggaaggtcttgttgcaaaagaggcacgggaacaagccgaacgttctttgccgttaccgcccgctgtgggggtgggtttccccccaaaaaacagggggctgacaaaacttcccaaatttttactgggacaggaacaactggtggcctggtgggctttaccgttctgtgacgttccaaaaaacaaggctatcacattgggcctgttgttggggaaaacacacaaggggattgggttgtacctttacccttaaacacatttggggggggggcccgcctaaacaggttaacctccattggggtaacagttttgggtaaaaaccccccgggcttaccttgggggatacccaaatcccca

SEQ ID NO: 3250 - DNA, 446 bp, Hordeum vulgare
gcatggtagaggctctcccagtacactttataaggacggactgcaggcttcgccttcgacacaactgatatttgggaaatatcggaacatccatcgattgaaattaacctgtgcaagaacacgaatggtgcgcaatgatcctagaggcggagctcgagttcgagctcctcaccggcccttgcaacggaggccctcgtgctgagcatgtccaccgcgacgccatgtccggcgggggaatccacaaggagctgcgcgtggtctccaaagcgtggagcgccgctaccccacctctcgggcctggcatcagcgccagttgacacgctgccaccgtcgtgcgataagatggaggtgctcatggatcggccgctgccggaatcaacggcggtgccacggatgtggccttcgtcgtaggggccgtacatgtaggggtcgctgaagctgccgag

SEQ ID NO: 3251 - DNA, 966 bp, Hordeum vulgare
  UNSURE (905),(931): n stands for any base
gtcccccgggcctgcaggaattcggcacgaggcaataggatttcgccgggcgtccgtccgagctcggagaagaaggcgagcgcgatggcagcgaacgtggcgctgctctccgccccctcgccctccacctccaccgcctcctccatcctccgtcgccgcccccctcctcgccgctccgcccgcccccgtcgagcagcctccagtccatccgtcgtggccgcgatgagcgatgacccgatcaaagagtggatcctcaccgaggggaaggccacacagattacagggaccagctccatcgggggtggctgcatcaacgccgcccagcgctacgacaccgatgccggctccttttttgtgaagaccaacaggcgcatcggtccagctatgtttgaaggggaggctctgggcttgaaggcaatgtatgataccaagtcaattcgtgttcctttgccgtacaaggttggttcgttaccaactggcggttcttttatcatcatggagtttattcagtttggtcgttctaggggtgaccagtcagctctagggaggaaactcgctgaaatgcataaagctgcaaaatctgataagggctatggtttctacgttgaaaataccattggaagcactccacaaatcaacacttggactgctgactggattgagttttactcgaagcatagactgggataccagtttgaaggtgatatcacagcggttccggagattcagctatatatgaaaaaggtcagcgattgattgacaatatccattcactggttggggggtgctgtaattgaaccatgcctgcttcatggaggattattgggtgggaatattagctccgatactaatggagaacctggtatattggatccagcatgctactatggacacaatgaagacanagtttgggatggtcatggtgcgcctnatatcgagagggatttcttcaggttctatttttga

SEQ ID NO: 3252 - DNA, 525 bp, Hordeum vulgare
  UNSURE (36),(50): n stands for any base
aataggaggtttcagttgatagtgcttttacaacanaatagaagggtttncactgtgaatccacaacatatcaagtggtacacatagaccatgtcattcatacatgcatgccattgtggggagaagcacaggtgggtgggaaattccctctcctcaaagagaagatgtggctatgccttgagcatccgcaggtagtcttcgattatggacatggctgacgagcggtacccagagccgaaaaggttgtagtgattcaggtagtggtagagtaaatacaggtccctccttttctcaaagcctggctgtttcggcatcacctcgaaataggaactgtagaaatcccctccgaatccagcgcaccatgacatcccaaactctgcttcattgtgtccatagtagcatgctggatccaatattacaggatctccattagtatcggagcttatatttccactccataaatctccatgaagcaggcatggttcaattacagcaccctcaaacagtggatggatattgtcaatc

SEQ ID NO: 3253 - DNA, 552 bp, Hordeum vulgare
gtctccccgggcctgcaggaaattcggcacgagggtggtgaagtccctcctgaaaaattataacatcgatccaaagtgcattggacgtttggaagttggcagtgaaactgtaatagacaagagcaagtctataaagacatggttgatgcaaatatttgaggaatgtggtaatactgatattgaaggagttgattcctcaaatgcatgctatggtggaacagctgctttgtttaattgtgttaattgggtcgagagcaactcttgggatggacgttatggacttgttgtttgcacagacagtgcggtttatgccgaaggaccggctcgtcctactggcggtgcagctgctatcgcaatgctgattggaccaaatgctcctatttcatttgaaagcaagtttagagggtctcatatggcgcatgtttatgacttctacaagcctgatcttgcgagcgaatatccggtggtcgatggtaagctatcacagacatgctatctcatggcactggattcctgctacaagaccttttgcaaaaggtacgaaaagattga

SEQ ID NO: 3254 - DNA, 543 bp, Hordeum vulgare
gttcaagtttacaaccagcagagcacgaatgttccactacagagccaagaattctcactgacaaggcattacgacaatggcagctctatctaactttacaaacttaatctgggcaagctccacccttccctttcccttccctaccagataaataatctaagagcgcttgcggcgcttattgcagcttcaggctggccagagtcaatcaatcaatgtccattggttataggagtggcggccgcatcgcctttcacggcatagaaccggcggtacatggagtcgacatgggtgaggtagtaggtacccggaacgagcaagcgcgtgtcctggctggtgatgaagtccttggcgccgtagcggtgctccatcagcttcagagcctcgacaaatttcttcggtggaaccacatgcctagactccaatttgttggagatatccagtatgcttgcaatattcgataggctgaacggatgctcgacttcattgatttttaaggagaacattgtcgatgtcatgccactgccgtaagaaaacatgacgatt

SEQ ID NO: 3255 - DNA, 548 bp, Hordeum vulgare
  UNSURE (17): n stands for any base
gtctcccgggctgcagnaattcggtacgaggcctcgtgccgaattcggcacgaggtcacagttgtgatactgcttggacagaaaagctgtacctgtcatcagctgctgcttttcttggctactccctcatcttggccatactgcgaacttcgaatctaagggacgaagcttcaagggtgatggttgcagctccaattctggcttttgtgacgacccacattttgtacctcaacttctacgaacttgacaaaggcctcaacatgaaggtttgcactgttattagcgtggctcagctcctcctgtggacagtgtgggctgccatcacaaggcatccttcacgcctgaaggtcatctttgttgctatcggtggtgtcctctcactatacctggaagcccatgatgtccctccgcgatggggatatgttgatggtcacgcaatctgcctcgccatggctatccccctgtcgtacctctggtggggcttcgccaaggaagatgctgagatgcgcacggcggcaatcatgaagaagaaacgataacgggcttcg

SEQ ID NO: 3256 - DNA, 537 bp, Hordeum vulgare
  UNSURE (4),(37): n stands for any base
cttncaattggcttttaaatggagagaaatacatagnggctatcacaagtttcaaaccatgtaaaacctcctgggctgaggcaaaaaggtagcatggaaaaaacagtaattcacaggcgaaatctcctaaatttacatggaaaaactcatctttacattggatgagtggagacaagttttcacagattcaccatgaaagatggaactatttggtctgacgaagcccgttatcgtttcttcttcatgattgccgccgtgcgcatctcagcatcttccttggcgaagccccaccagaggtacgacagggggatagccatggcgaggcagattgcgtgaccatcaacatatccccatcgcggagggacatcatgggcttccaggtatagtgagaggacaccaccgatagcaacaaagatgaccttcaggcgtgaaggatgccttgtgatggcagcccacactgtccacaggaggagctgagccacgctaataacagtgcaaaccttcatgttgaggcctttgtcaagttcgtagaagttg

SEQ ID NO: 3257 - DNA, 360 bp, Hordeum vulgare
ccagttcccctccccagcagctaagtcttgcagagagcaccagccagccgcggcttctccgtcattagcaagagggcaggaaggaagatgggctcgttggaggcgacgagggcggagctgggcctggcggtgctgtacctgaacaaggcggaggctcgggacaagatctgcagggccatccagtacggctccaagttcatcagcggcggccagccaggcaccgtgcataacgtcgacaagtccaccaccttggctcgcaaggtcttcaggctcctaaagtgggtgaacgatcttcatgctctcatcagcccagccgccaaaggcacccctctcacactggtcctgcttgggaagtccaag

SEQ ID NO: 3258 - DNA, 553 bp, Hordeum vulgare
taacatacccgtgtacatatatgtataaaaaccgtacgtacagaggatccacatcatcatcattctatactgctacgtgctttacgcataataacatctgagattccatgcacgtgaagtgaagggcagagtggtgcagcgtccgttcctcacgccttgactttggccaaaggggcacgggccgggagttgctggtagcaggagatgagggaggtgacgaatccgaaggccccggtgacccttggggtgaccttcttgggcgccagctgcagcagccccacggccaccaccacgtccatgcccgccttcaccagcgccagcagccggtcgtccgactgcttcatcttccccaggtactgctcgtcctcgtatttgtcggcgcccctgagctccttggcgcgcttcctcatcgccttggatagcctcttgagctcaccaagctcaactaggcttgcacagacggaggaggccatccagcagtagagggatatcctggcgatgcggtccgtgcgctccttgttctggtaaatccccgatctccctagccacacga

SEQ ID NO: 3259 - DNA, 383 bp, Hordeum vulgare
gctcccgcgaggacagcatccgcgccacccaggaagtggctgaagagctaggtgtgtacatggtgggtttcgaccgtgctggttacggcgagagcgacccgaaccctaaccggtccgtgaaaagcgctgcgctcgacgtcgaggagctcgctgacgcgctaggattgggccctaaattctacttgatcggcatatccctcggctgccatgctgtctggggcgccctcaaatacatccctgaaaggattgctggagctgcaatgatggcgccggtggtgaaccattggtggccgggcttccctgccgatctcgccgcggaagtttacaacaagcaggaggtgggcgaccagtgggcgctgcgtgtgtcgcactatgcccctggc

SEQ ID NO: 3260 - DNA, 392 bp, Hordeum vulgare
tcttttttctttaatgaacctagacgaggaggctcgtcgttcaaacaaacagaaaaaagtaagatcatcatcatggtataaatcgtataatagttgcactactttcttgcttccaaggatcaacagtaacacattttgcaccacaaaaaacactatgatgttacaccaccatttcacctatagtaacatcatcgctaattagcggcgatcacctgacctgaccacctccttagaatgaaacaatctgcaccggaagaacgctatactttcagcaccgcactatgttcagtgtcgtcgctgctgctgctactgatcactgcttggcgttgccgaagagggtccgaagaacggtgtctccaagcccggggaccggcgacaggaagtgcccggtc

SEQ ID NO: 3261 - DNA, 455 bp, Hordeum vulgare
gtgcttgtgctctactacttttttaggtccaaggtcccgacgagcaaggaggttcagcactcgagcggcggcggcggcggcggcggagatgagggcggtgagcggcgcggtggtctcgtcaaagccggtggccttaaacaaggccgcacgcgtgttcagccgcttcgccgcccgcgacgcgtcggtgatgcccgccggcgcgtgcgcgctggtcctctgcgcggccgaggccgccgccgagctccacgccgcccgcgcggctcccgacggcgatgcggaggacgcacggagaggagagaagcgtggcaagaagaggaggaggagggcagagcgcgaaggtgtgtctcttgagcaccagtagtagaactttctgaagaaaatcgcatgtgttactggagtgttggttggtctggtgactggtgttcttcattatatcctttggaacgggctgcgtt

SEQ ID NO: 3262 - DNA, 372 bp, Hordeum vulgare
ttttttttttttttttttaaaaagactagttttaatcagactagttttacattcttggatccaagcaacctctaaacaagagctgcgaaatgcatacggggttcgaaacccaaaagcagccaaggtttcagtcgattccactcaactgaactgaactgaaattccagtcaactgaactgaaactgcaagtcgtctcaactgaactgaaactgcaagtcgtctcagcaggatacaacaacacaacgcagcccgttccaaaggatataatgaagaacaccagtcaccagaccaaccaacactccagtaacacatgcgatttttcttcagaaagttctactactggtgctcaagagacacaccttcgcgctctgc

SEQ ID NO: 3263 - DNA, 517 bp, Hordeum vulgare
tggtggtgtagtaaagattgagctgctgggaagagtgcagaaacaagcaactgatgataggtattacatatgtgtctgccatgctcaagtggtcgggcgttcgctctcaccagtgttcatggtcgacatcaacgactcaggtggcaatgccatcctcaagcacctgccggaggccaagaacctcacggtgacggaagtggtgcaggacagtgcgacggactcgcaggagtggaaggacgctctcgccagctacagggagatgaggcatctggtcaccctcatgaacgtgctccaggaggggcctgcgcaccccgcgcaagacctgcacggagacggagacggagacgcgcttctgcaagaaatacaagaaatgcaaggagacgcaaacctcctgcaacagctgcaagtggatgcgcagctcctgtatttacttcaagatggtgtgctgcaactgcaagatgaagatggtttacaggccatggaggaagatgatgacggcggcgtgtcggacaacgac

SEQ ID NO: 3264 - DNA, 551 bp, Hordeum vulgare
caagtcgcaaaccatgactttaaactctttataaaccctgtctgtatgtactcacggccacaacaaattacaacagctgtctgtatgcactcagctatataacccccggctagttcatataaagggttccttcacaagtccactagttcacaacaacaaacgaacggtctctctctcggcatcggctccggcaacctcacccagcccagcaatggccctaggcgaaggggtcgttgtccgacacgccgccgtcatcatcttcctccatggcctgtaaaccatcttcatcttgcagttgcagcacaccatcttgaagtaaatacaggagctgcgcatccacttgcagctgttgcaggaggtttgcgtctccttgcatttcttgtatttcttgcagaagcgcgtctccgtctccgtctccgtgcaggtcttgcgcggggtgcgcaggcccctcctggagcacgttcatgagggtgaccagatgcctcatctccctgtagctggcgagagcgtccttccactcctgcgagtccgtcgcactgtcctgcaccact

SEQ ID NO: 3265 - DNA, 521 bp, Hordeum vulgare
gcggaggtcatcgcggccgtgtgcccgaggccggcgcgggccgcgtcggcgtgcgcctctccccgttcgccgactacgtcgactgcgtcgactccgacccggaggcgctcgcgctgcacgtgatcggcgccatgaacgggctcggcgtcctctactgccacatgatcgagccgcggatgtgcgtcaacgagcggatgatcccgcgccgcctgctgccgttcaggaaggcattcaggggcaccttcatggtgaacggcgggtacgaccgggaggaaggggacagggccgtcgacgaaggctacgcccatcttgtggcgtacgggcggatcttcttggccaaccccgacctgccggagaggttcaggaggaacgccgctctgaataagtacgacaggagcaccttctacacatccgatcctgttgttggctacaccgattacccttttcttcatcaggattagctgactgtttcactgctgttgtgcttgggacctgggagattctaaggtcttgtatgatga

SEQ ID NO: 3266 - DNA, 352 bp, Hordeum vulgare
cacgcgcatccctaccctgtcatcatacaagaccttagaatctcccaggtcccaagcacaacagcagtgaaacagtcagctaatcctgatgaagaaaagggtaatcggtgtagccaacaacaggatcggatgtgtagaaggtgctcctgtcgtacttattcagagcggcgttcctcctgaacctctccggcaggtcggggttggccaagaagatccgcccgtacgccacaagatgggcgtagccttcgtcgacggccctgtccccttccttccggtcgtacccgccgttcaccatgaaggtgcccctgaatgccttcctgaacggcagcaggcggcgcgggatcatccgctc

SEQ ID NO: 3267 - DNA, 516 bp, Hordeum vulgare
ccggcgcgaggttctgcatctgctacaaggaggtggtgccctgggtgatgttcccgctgcagatcgcctacgtcaccgacgacgactgcaatggcggcaagcgcgggaaaggcggtgacggcggcgtgttcgcgttcggcagcggcaccctacagggccatctgctggccggggaggagcggttctcggtggaggtggacgcagaggagcgggtgtggtacgaggtggtgtccttctccaagccggcgcacccgctgtcggcgctgtgttacccctacgtgcggctccggcagaggcacttcgcgcgggagtccggcaaggcggtgctcaggcacgtcgctgccgcggcctgctcgtcaacaacgccgccgccgatgcagtgatcatcgacgtcctttctgctccattctgcttccgttggacgatgtatacatacatgtgggggcatgtggagaaagatggcaggttgctctcgtctcgtggtacctgtagcagcgtaggcgctcctgaactgac

SEQ ID NO: 3268 - DNA, 549 bp, Hordeum vulgare
  UNSURE (2),(30),(31): n stands for any base
gnaaccttttttgaacattttttacaatanncttttcgaatttactgttcacctgagctcattttaacgagctcgggtgcaaaaacatcgagtcagttcaggagcgcctacgctgctacaggtaccacgagacgagagcaacctgccatctttctccacatgcccccacatgtatgtatacatcgtccaacggaagcagaatggagcagaaaggacgtcgatgatcactgcatcggcggcggcgttgttgacgagcaggccgcggcagcgacgtgcctgagcaccgccttgccggactcccgcgcgaagtgcctctgccggagccgcacgtaggggtaacacagcgccgacagcgggtgcgccggcttggagaaggacaccacctcgtaccacacccgctcctctgcgtccacctccaccgagaaccgctcctccccggccagcagatggccctgtagggtgccgctgccgaacgcgaacacgccgccgtcaccgcctttcccgcgcttgccgccattgcagtcgtcgtcggtgacgtaggcgatctgc

SEQ ID NO: 3269 - DNA, 531 bp, Hordeum vulgare
  UNSURE (3): n stands for any base
ggnacttcggcacgaggatgcacaatgtatcccaacagagcaagacagatataactcacccctagaaacgatggaaggagcagaaccaggtaaagggcaagatgagagttttacaggcccccctaagaattctcttgagatgctagatgagcgagagccagaaactcccagaccaaccgcgtcggttgagctgatagaacaagtgaactatataaagcaggagcaacccagtcctgtgtctgttcttgatccattattccatgaagatgtcggcagccctgaaaataagggcacgataaaatgtgagctgcgccaagatgtctcgagtccccaccagtactaccaagacgatggatcatcagacctggaagagatcttctgggaggacagggatgtcaggttaggatatatagaaaaggtgctggagctatcagaattatgcacataccaggacttagatgtatggtatctggaagatgaattgatcaacccttgcctgtttgaagaactacatcagggaaatcatcaaac

SEQ ID NO: 3270 - DNA, 551 bp, Hordeum vulgare
gggtatctatcactttgattgtcttgcatttgcataactactccgtaactgacactacaagttacacaaaccacacatgcacacaccacacaaggcacaagagcaacatcgtaaccatcagctgcacactatcaagaaaaccaaacctcacgggctcttccctcccaaacatgttaaaagctacttcctccgtcctcttatattatgggacggagggagtatctaatactcacattagcaagcgcacaatgctctgagttgaacgccctgatagactacatccacaagtcataagcgacatcttctaacagttcatccagtatgaattcccatatatccacaacagtctcctcgctttccgaccggagactcatccaagtcccctcttccagatccacactaactagctggttcaatgtgcttggaaattcataacagagatggccctcaatgtgcttgtttatttctgagatgaggctctgtcccactggaggcgcctgtatgttttgtctgacaaaagataagcaatgggggtttccaaagtgtttctc

SEQ ID NO: 3271 - DNA, 539 bp, Hordeum vulgare
gggctgcaggaattcttacgaggccgctcccacggtgcctcaagggaggacccatacgtcaccaaagagtacctcaaaggaaaagattacaacgtctacgttcacagctacttgcactacggcgcacaggcttcaagggtagagatcttcaaggccaaaaacggaccagtcagctactgcgtgctgcgcggatacgatggcaaatacacctacaacggggagcaatacgacgccatagcagcaccgcaaggagcggcgtacgaaaagtgcagagaggacgtgaccagggcgctgagaatcagcgcgccatgcgcggccaagaactgcaccttcaacggcgcgtggaacggcggcggcggccccggccaggccgagctctacgtcacctccagcttctactacatggcagcagacgtcggcctgatcgacagcgaggcgagcagcgggaagaccacgccggcggcgttcagggccgccgccgaggagatctgcccgatgagcttcctggaggccaaggccgcgtaccccaaggtgcggtc

SEQ ID NO: 3272 - DNA, 553 bp, Hordeum vulgare
  UNSURE (19),(533): n stands for any base
gttttcattctcttttctnctcttattatgcgccatgtcatcaaaatcatctatgtgccaatattaccaacgatgatcatacaaccattggagatgcccttactgcgcgagctagggccggattagcaatcatatcaaccaatactgtacgtacaagatcatgcatcgttgagccgcttggtgggcgagacggcctcgatggcctccccgagcggccacgcggcctcgatgaagtactccccgtgcttcaccttctgcgccacggtgatctccttggtcggctccaagccgaacccgtccacgagcagggagtactggtagacaaggtccatgcagatgtagggcgcgtccacggaccgcaccttggggtacgcggccttggcctccaggaagctcatcgggcagatctcctcggcggcggccctgaacgccgccggcgtggtcttcccgctgctcgcctcgctgtcgatcaggccgacgtctgctgccatgtagtagaagctggaggtgacgtagagctcggcctggccggngccgccgccgccgttccacg

SEQ ID NO: 3273 - DNA, 553 bp, Hordeum vulgare
gtacccccgggcctgcaggcaattcggcacgaggcctacctgccgaaaggaaattccccaagttctattttgtctgggcaagagcgacatggcggccgccaccggctacggtgacgccccgaccgacgagcagctgctcgcgtacgctgagctacccagacaaggccgctacatggcggaggtgttcgccgtgcgcatccccgccaccgccggagcagacccgcccagcggcaccatctctttccacggcggccactgcagcagcgacttcatttacagcccggaagaagaacacgcctcgcagcaaaccagctgcgacagccagggtaacatcgtgctcactgggccatcggtggccacctcggcatacagtccaattgtcttcagcctcgacctccatgacggagaagccgacgaggaggaggaagagaacaccgcgaggatagtctgcgacaccattggcggcgacttctctaactacaacagggccatatcggagactgtacgcacaggctatggccccgcggaggtgatctacgccgtcctaagcaat

SEQ ID NO: 3274 - DNA, 520 bp, Hordeum vulgare
caatcatattagaaaatccaaatcagtacgtgtcaagaagaaacgacacttatttttgaactcgtacggagttccatagtatttgtagttgatagtagtccgctggttcacatggatgtctaccaaggatagtccgaccatgagattgtcacctcgaattcagcaccattgacaccaacaagacgttccgtatgcaggccgtcgatggcagttttgaactcaagctcgcctctaacaatttcatctccggatccgccgcgacgaaggtcaagctcaatcgtcagcggcatgtgcagcggcaaggcgagtgcatgcctcgccaacggaaccggctccccgggtcgcacgtgcactccctgcttgttagcggcctccttgtagaagagcacgcaaccgacgtcgaacagcttgctgcgagcaacgatcctgccgacgagaacctcttcgtctcgggactgcaggcgagaaagcttcacgtcgacccggccttggatgccattgcttaggacggcgtagatca

SEQ ID NO: 3275 - DNA, 10 bp, Hordeum vulgare
  UNSURE (1)..(10): n stands for any base
nnnnnnnnnn

SEQ ID NO: 3276 - DNA, 557 bp, Hordeum vulgare
  UNSURE (35),(37): n stands for any base
tgttgggacatggagctgcagctcttgcacaaccnanctcctctgctctgcatttcattcagcaaataaactcatggccttgctgctgcttccctaaaacctaaagactagcaactactggtacacgcaacctcctcctccatctctagctatgaacaaggtaaatttacccaccttttctatcacaaaaaaaatatgaacaccaagccgaatcacgactgagaattttacacaatgataatcgctcagcctataccctccccaggggagagaagggcgggcgccgcgggtcgagcgtgatggacggaggcgccttctctcgcttcgtcgtcttcagtttcttcttctcctctgccgtgaccgcctcgatcaggtgcatcacctccccctcaaggagcatcttgagggagctggagtagagcttgtgcttgcccttctcgatgacgacggccgtcgaagcctccgagcagtgcagcagagagatgcagactgagaatgcctgtaacgctgatagccgcgcatggaaatccaccaatagctgccctttcccattggct

SEQ ID NO: 3277 - DNA, 552 bp, Hordeum vulgare
ccgggctgaggaattcggacgaggatctctgcacggcgtcgcattggggatttccatgtactatgagctagggtggagcacgccgccgccgtcccgagctaggttcaggcggcggcggaggagccgacctcatcagcgctctcccggaggatctgcttctccaggtcctcgtccgcctccgctgcgcaccggcgtcctctcccgccggtggcgcggcatctggacccacctccccgacatcatcttccgggatgtcacgcccggcccgctcctaccggtgctcgcctcgctccaagccgacgagctcagcgtgtccgtcgtggcacaacttgttgagaaggtctcctctcctgggagtgctcctattctagtctgactgctgggctgcttggtccttggggcctctgcaactggaaggtgagcctacatgctgcagagacccatggacaggcggtgctcaccgacaccggggaagacgcatgcttgcagttgtctacccttcatgctctgtccctgaaactatgggctagtctagtgtcctactcaattgac

SEQ ID NO: 3278 - DNA, 563 bp, Hordeum vulgare
tactacctcattttttgtatacaaggcaccaaactatattacaggtaccaatccgatgcatcccaagtagatgccaacacaggtgctccaacaacatgccccactgatttgataagaaaatcaaggcccattgtcgtgaaatgaagttgagctcaaaacagacaagttggtaaccagatgtttctctatctcctgctcaaagttgagctctgcatcaggataactatctgaaccctgcattccaagaagaaagggtggtatatcatgcatgcatacatttaatttaaattggaaaacccagtcaattgagtaggacactagactagcccatagtttcagggacagagcatgaagggtagacaactgcaagcatgcgtcttccccggtgtcggtgagcaccgcctgtccatgggtctctgcagcatgtaggctcaccttccagttgcagaggccccaaggaccaagcagcccagcagtcagactagaataggagcactcccaggagaggagaccttctcaacaagttgtgccacgacggacacgctgagctcgtcggcttggag

SEQ ID NO: 3279 - DNA, 517 bp, Hordeum vulgare
  UNSURE (14): n stands for any base
cggccgttatccgntactggtccttcgtcccctccatctcatcattttccttgcttgtgaagtctacatctcctactccatgaatgcctgcgctctgaactcgatggagccggtgaaggcgaagccagcgaggggcgggaagaggagcagggagagcggcggcacggcggtggtgctgctggagaagaaggagtcggagaaggagaggaggaagcggatgaaggcgctctgcgagaagctcgcatccctcatcccaagggaacactgctgctccaccactgatacaatgacccagctaggcagcctggatgtgggggcatcgtatatcaagaagctgaaggagagggtcgatgagctacaacgtaggatgacctctacgcagaccttggataccttcagaggagacactagcatcccaacacccactaccaccactaccacgaaaagcgttgtagggtcgctggaagaagagaaagctcgggaggcatcggcacccgtattgcaggtgcggcaacac

SEQ ID NO: 3280 - DNA, 544 bp, Hordeum vulgare
  UNSURE (11): n stands for any base
acaagcatttntaaaacgaatggttcggtttatacaacactaaatgtaggagggagggataacatataacacttataaactttatctcaactatggcaacccaaaacccgttaatataaatttataccgggtgactattgattgaagatcgatcaacatctttgtcatacatcgatcacgttgtaaaattaacatggagaagacaatagccagcaaattaacagtgagtgccgagattcgatgcccaggtacagacctgggtgtgatttttttttaaatagtaataacattcaaaacttctaatgaaatttggcatccaaaaggctcaattgcgtgatggcgtgcaaaaaaaaaatatggagtctggacatccgaggaggtgatggctaaaaaatggctttgaaggaaacttaaaaaaaacactatttggaccttattttgtttgaacgttcaaggaggttgtgctcctcgaatgtccatacacctaaagaacgtgctccttgcgcacatgagcatcttcaataccaacaactttcataattaa

SEQ ID NO: 3281 - DNA, 516 bp, Hordeum vulgare
gcttcgtgttgcaagaatctgtgctgcaagacggcattcaggccgtgccgtattcgcgctcctcgcccgcccacgaccctgtgttggctctcacagcttgggacacaactgtcatgatggtactaccaagcgcaatgttgacgaagatatcgccgggttctcgaaccagaaatcgcaacttgttagtcgcggcgcttgcttctccaccgccaccgaaacggttctcgtccaagcccgggacccgtctctgctagcatcggagatagaggccgcgatcgaccagcagaggttcgatgatgcttggagggcctatgagaagcaccttcacatggacgggctcccgagaaagtcggttctgagcaagctcatcaccggcttcgcggcgacctgcgatgctcacaggcttaaggagtcatacagtgtggttgatcacacttttcgggagaggcctgaactgctggagaaggaggccctgatttacctgtcccttgttcttgcacgttacgctcttcctga

SEQ ID NO: 3282 - DNA, 552 bp, Hordeum vulgare
tgcattagtttcttattatatatacttgcaggcccgcatcatccttccgcccaacgagctgtttcaacctgtacactggacggcattgcatacaaaaattccacaactgctgtatggttcatgtacatctaatctcaggttttacatgtatggctcaatttcagtagtacaaatggacattgtagaactttcaactaaaaaacaacataccagtagagaaattacatctgggagaatcgcgatctgtcgagcaatttgttcctgtaacatggtggctggcacagctagaaaccacactcatcatcctcgtgcaggtctgtcttcacgggaaaatctggcccgatcatgagatggggaggggacaagggaaggaccaaagacaagaggcatccatacattggtcttcaaccatgctggtctcaaaacaactatggctttcaaaatctcgctttcatgtcaacccaatccatttcttgaaacgaagtgctgcttctctccttatcagttgagcttctgtttgcaccttgggagccttacctttatacaatgttc

SEQ ID NO: 3283 - DNA, 518 bp, Hordeum vulgare
cctcgtgccgaattcggcacgaggggtcgatgagctacaacgtaggatgacctctgcgcagaccttggatactttcagaggagacactagcatcccaacgcccactaccaccactaccacgaaaagcgctgtagggtcgctggaagaagagaaagctcgggaggcatcggcacccgtattgcaggtgcggcaacacgacgattcaagcatggaggtgagattgatatgctgcatgaagaggccgatcaagctccatgaggtgatcaccatccatgaggaagaaggtgctgagatcatcaacgccaatcactctgttgctggccaaaaaatgttctacactatacactctcgggcctctagctcgagaattggcatagatgttccaagggtttctgaacgactgcgagcattgctccaactttattcgcatgaaaatcaggcaccgtcgtgcatgcacaacaatcaagtcctcaggtacaatgatggggccaacgcgactcctcccaaggagctcgtcg

SEQ ID NO: 3284 - DNA, 548 bp, Hordeum vulgare
gcgcaatggggatcggagctctggtagcagcaattgccccggtacaccagatacatcccttattaaatacataatgcttagatcaatttggagcttcaacattgtgaaagtgcatctcttaataccccatattggggtttgacgatttatgacatgttttgttgccaccacgcacaggtgccgtaaacttgccatggcaggagaggtattgcgatagacattcttcctcagatttgccaattacatgatgagaggagaacatgcaccacaaatgtagacaagtgctcaaccatggttgacacatctcacacctactcgagcaactctggtgatattgacgcaagcagggaactccacatcacttggtcttgctcaacccaagactcacactcgtggtttgccaccttgttggttccacctatatcattgttgccgacgagctccttgggaggagtcgcgttggccccatcattgtacctgaggacttgattgttgtgcatgcacgacggtgcctgattttcatgcgaataaagttggagcaatgctcg

SEQ ID NO: 3285 - DNA, 538 bp, Hordeum vulgare
  UNSURE (3),(31): n stands for any base
ggnctgcagcattcggcacgaggccacctgnacggggtcacctgctgcctgcgcttcccggggcagctcaactcggacctccgcaagctggccgtgaacctcatcccgttcccgcggctgcacttcttcatggtgggcttcgcgccgctgacctcgcgcggcagccagcagtaccgcgcgctcaccgtgcccgagctcacccagcagatgtgggacgccaagaacatgatgtgcgcggccgaccctcgccacggccgctacctcaccgcctcggccatgttccggggcaagatgagcaccaaggaggtggacgagcagatgctgaacgtgcagaacaagaactcgagctacttcgtggagtggatccccaacaacgtcaagtcgacggtgtgcgacatcccgccgacgggcctcaagatggcctccacattcatcggcaactcgacgtccatccaggagatgttccggcgcgtgagcgagcagttcacggccatgttccggcgcaaggccttcctgcactggtacacgggtgagggca

SEQ ID NO: 3286 - DNA, 542 bp, Hordeum vulgare
aactctgaatacatttagatttaacacgacaattagacgcgggcaccagataaacagacactacaattggagtagaacgcaacagggcgttgcacaccgccattgtgcaagatgtttacaccaatctatctcaatctcatcagcaaccacccttccatgagttttctgctcctcaacaacagcactcactaagaaagacacaacacttctacagaaccataatcaaattaacataagagaaccgttaattgataatcatatggatgatttcgcagagggcgggggctagtcctggaggtcggcgtcgtcctcctcgtcctcgtactcgccctcctcgtcggcggtggcgtcctggtactgctggtactcggacaccaggtcgttcatgttgctctcggcctcggtgaactccatctcgtccatgccctcacccgtgtaccagtgcaggaaggccttgcgccggaacatggccgtgaactgctcgctcacgcgccggaacatctcctggatggacgtcgagttgccgatgaatgtggaggcca

SEQ ID NO: 3287 - DNA, 523 bp, Hordeum vulgare
  UNSURE (20): n stands for any base
ggcgcctgccaggactgggngcttcttccagctaattaatcacactgtcccagacgatgtggtggagggaatgaaggccagcatccaagaattcttccggttacccgcggagacgaagaagcgattcacgcaggagttggggcagctggaaggctacggtcagctgttcgtcgtctcggaggatcagaagcttgactgggctgacatgctttacctctacacgcagccacctgagagcaggaacaaaaagttctggcctgaccagcctgccaacttcagatcgatgctggatagatactctggtgctgtgaaggatatagcggatacccttttggctacaatgtcggagaacttgggactgaaacaagaggtgattgctgacagatgcgtgggcggagtgcagtctgtcaggatgaactactacccgccatgcgcccaagcagacaaagtcatcggcttctccccgcactctgacgcggatctcctgactcttgtcctccaagtgaaccatgtccaaggcttg

SEQ ID NO: 3288 - DNA, 552 bp, Hordeum vulgare
  UNSURE (15): n stands for any base
ggtgatgacactgtncttgattattttggagctatatatgtacatatatgctcttgcttgaaaagaaaaaatgcaagttcggaagacacaagaaatgtctgtctttgcaacgtatgcgtgtcctctcctgctctctttatctcttaccttccaacggaggagaggacatacacaactttcagcttcagcttcgtcgccactcgtcttaccagtattttctgcttccttctttatttgtgccacgacctggcctggcctggccggcgacgagtcctcatcaagctgctgcagacgacatcactatcactctatcagcatcatcagtaatccagtatcatgtccaataattcggtatcaagtcttgtttggacgggcacggttcgctcgccttgcaatcctgatgattttctggggattgtttccttttctttgtctacatccacactttttcatccttgactttcagccgctagctacttgagcttcatccgctccatgaagctcttcccctcgagcttcgtcgcgaagaagagcttcctgaacctctcgtgc

SEQ ID NO: 3289 - DNA, 517 bp, Hordeum vulgare
tgtgtgcaaagctttgagaggagctgcgacgctgaagaagagggtccagcgcgaggcgagaagcaatgccagtgtcattccttatgagaaggcccctttgtcatggagtcctgatatctggtgcaaggaaggcaagctgctaaaacgcacaagaaaagggcatttacacaagagacgggtttcaatctacatcaacaagaggtcacaggtaggccaattcccctccagagcttcacttgtaaaataggacacaaaaaggtttgcgtttaaataactcgtctcattctggtgaatagattttccgactaggataacccccttctcattattttcttaacgggaatatcaaggttctgatgaataggtgtacattatacacagttgaatatcagttaacagcaagtctggataattacaggtcatattgaagctgaagagcaaacacattggaggtgtgctgtcaaaaaacaataaaagtgtagtttatggggtatacagtgagctcccagagtggact

SEQ ID NO: 3290 - DNA, 494 bp, Hordeum vulgare
cacgtgtcttcaactcttcatactccctcctgcaaaattttgatacatgtactaaccctaactgcaccagttgagttttaatgtttctagcctgtgccctacttgatcggctacatcaacctgctggagcagattttgcacaccatgaacccagctctgtttactggtgctgctctcacacttgaactcaatcaggccttgtgctgtactcaagccaaagcagcttgtctctggtaaacctttccctggctcagtccactctgggagctcactgtataccccataaactacacttttattgttttttgacagcacacctccaatgtgtttgctcttcagcttcaatatgacctgtaattatccagacttgctgttaactgatattcaactgtgtataatgtacacctattcatcagaaccttgatattcccgttaagaaaataatgagaagggggttatcctagtcggaaaatctattcaccagaatgagacga

SEQ ID NO: 3291 - DNA, 424 bp, Hordeum vulgare
gtgctctgatctccctccttccatataaccctgctactggctagcctaccgctggtgcacaacaaggacagtcacacactcacactctgctgctgcttggttgccctagcttcaccatggacatggacagagtttgcaagagacgagcgggcttgcctcctcctgctctccttctcgcccttcatggcatggatgagcagatgcctgcgtcatcgacggtgcctccgccgcagacacccatggagcccatggagtacctgtccaggtcctggagcgtgtccgccaacgagatatccaaggccctgctgctcaaagggggcaccaagcggagcttcttcttcgcccccgtcgacagccctcctccgccacgcacagagatggaggtcgacacctcctacgagctcgtcaccgtccctgcccccgc

SEQ ID NO: 3292 - DNA, 385 bp, Hordeum vulgare
tttttttttttttttttaatcaagcaatattacataccacatgccaagaacataatttgacgtttattgcgtacactgatggtgcaaagcacgcgccctaatgcaccctttgtcctgcaaaaattggatttatgtactaaccctaactgcaccagttgagttttagcgtttctagcctgtgccctacttgatcggctacatcaacctgctggagcagattctgcacaccatgaacccagctctgtttactggttctactctcacatttaaactcaatcaagccttgtactgtactcaagccaaagcagcatgtctctggtaaagatttccctggctcagtccactctgggagctcactgtataccccattaactacacttttatt

SEQ ID NO: 3293 - DNA, 322 bp, Hordeum vulgare
agccaagagcagacgaacggaaccagctcgccgccgccgttgccgacgatgcttccgttcgaggagcaggccgtggcggacctcctggaggatcccaacggagggctggtggtggtctccgccggcctcccgctcgcctccctcgccgctgcgctcctgctccacctgcaccaccaatccacatcctcctcaccctccccctcctcctccggcggcagcgggggcggcggatgcttcctcatcctctccgccccggacgcgctcaaggaccaaatccggcgccgcctggtcgaatcccagctcctgcaggtccacgacgtgg

SEQ ID NO: 3294 - DNA, 429 bp, Hordeum vulgare
tttttttttttttttttttacagcatcatttagccagctttcctaagagcaatcacatatttggcattggatttggatggaattcaactacccaattgacagtcctccttacacaatgtgatatcgattacactagcaaatagcctagccctacttacctgacaagtacagcgtatctgaacacccatagttcagaggaactcctcttccaagacctcacttcacttgaccagaacagtagaagttgatgctatgagatcatgctgggacacttggcatccagaaactccttgagcgtgcgggcacccttctggctgcccaccagctccgctagcctctctaccggtagcagcgcgagctccgccaggctattgcatccgtccattatcgctctgtagttggagtccgtcacgccagggagccttctca

SEQ ID NO: 3295 - DNA, 512 bp, Hordeum vulgare
gctctccgtcgttggtctgataaaatgggtgaaaaaatcttccagggccgcatcgaaggcatccaccaccagactacttcggcgcaagagttgcagcatcaacatccagggcgtggcgagatatttacacctaagcatccccattcagggaggagcaagtttggtgaagtcagatacagaggtgactggatgaagaggcccatctcggagaccgaagtggcgtggctcgcgaggatcctgatccacctctctgaccggctgaacgacgcccttcgacttggctgcgagggtactgccgatgatagcgccgctaacccgacgtacatcaagtttgatcggaatgagctgacgacgataggggggccgaaggacgcagctaggatggctctcgtggctgtttgttcgctgcttacagtggtgggacaggcagtgctgaggttcatgagggcgcacagggtgaagattaatctgagagtttttgcttcgaagaagctgctggctggtctcgtgtt

SEQ ID NO: 3296 - DNA, 549 bp, Hordeum vulgare
aactggcgagccaaagcaaaccggtttctctttctttttcaggactatgaaaccctgttacaacgtaagtttacatcattttttcctttcgttttacacaagtgtcgttgccagccacttctctaacgagagcacaacaagaacccagacagcgggtacggttcacttgctctcagtctccacggcacacacctaacaaattgatccctttgtgagtttcatctcttctttccttcatatgggttttgtacatcacatgcaccatcatctcccaactttgagagcttcagtgaagataactgaagcattagcagcggtgtcggtgctggaagcaacacatgtaaagctcaataaaaagctctctttgtccccaccaccaccgcgtacagcaacacgagaccagccagcagcttcttcgaagcaaaaactctcagattaatcttcaccctgtgcgccctcatgaacctcagcactgcctgtcccaccactgtaagcagcgaacaaacagccacgagagccatcctagctgcgtccttcggcccccctatc

SEQ ID NO: 3297 - DNA, 553 bp, Hordeum vulgare
gtacccccgggactgcaggcaattcggcacgaggaagaaaggggggccattgactttgctgactttgttcaagccctaaatgtatttcaccctagcattccaatggaagagaaaattgatttttcctttaagctatatgatatggacaacacgggctttattgaacgaaaagaggtcaagcagatgcttatcgctcttctgagtgaatcaggaatgaggttatcagatgaaaccatcgagtcaatccttgacaagacattttcagatgctgatgtgaatcaagatggaaaaatagatagagcagagtgggagaactttgtctcacgaaatccctccttgatgaagataatgactcttccatacctaaaggacataacgaccacattccccagctttgttttcaactcgaaggtcgacgacatcgtgacatgagcgccgtggattctgtgacgtatacaaggcccgcgcggaggaagagcggaaggcatgtacatctttgttagagtatatcaatgagggagagtgcaattttttttgtttttgttagagctaa

SEQ ID NO: 3298 - DNA, 523 bp, Hordeum vulgare
gatgatttgcagtcgatacaatttgatcctggcactaacattgcatttcacaacaaacaacacaagcagcatatggatgaagttcatatcacgacaacctgccaatttctcagactacaaccctcccctcacctcctaacctcattgcattattgctttagctctaacaaaaacaaaaaaaattgcactctccctcattgatatactctaacaaagatgtacatgccttccgctcttcctccgcgcgggccttgtatacgtcacagaatccacggcgctcatgtcacgatgtcgtcgaccttcgagttgaaaacaaagctggggaatgtggtcgttatgtcctttaggtatggaagagtcattatcttcatcaaggagggatttcgtgagacaaagttctcccactctgctctatctatttttccatcttgattcacatcagcatctgaaaatgtcttgtcaaggattgactcgatggtttcatctgataacctcattcctgattcactcagaagagcgataa

SEQ ID NO: 3299 - DNA, 365 bp, Hordeum vulgare
gcgcacatccatttccctctctttttttttcacgagttcccgccgctcctccctatggcggccaccgcctacgagcgccgcctgctcgccgccgccgacctcgtcctctccgcagacgggaagtcccagctcccccgcctctcctccgccgacctcggggtcactgccgacctcaagccgcaccagctcgacggcgtccactggctcatccgccgctaccacctcggcgtcaacgtcctgctcggcgacgagatggggctggggaagaccctgcaggcaatttctctgctgagctacctgaagatcaaatccatcgcccccaggccgttcctggtgttatgccctctgagcgtgacggatggctg

SEQ ID NO: 3300 - DNA, 373 bp, Hordeum vulgare
ttttttttttttttttaaaggttccaatatttctcacgtgacccatacaaggtaccctttgatcaacagccggataaaactgcgtagtaagtccattcggttcagctatccatagttgatcaagctacagaacaagcaaatagtaagtccattcggttcagctatccatagttgatcaagctacagaacaagcaaatagtaagtccattcggttcagctatccatagttgatcaagctacagaacaagcaaatagtaagtccattcggttcagctatccatagttgatcaagctacagaacaagcaaagattacacatatgctacatccatggtcgctgattgtttttgtggccaggttacacgaggaacatc

SEQ ID NO: 3301 - DNA, 518 bp, Hordeum vulgare
cgagggcgacgacgatgatgaggacctgttcggcctcattaccgtgctcaatttgggaagatatggggagagccgttgcatcaaggatctgaaggaatatctgcttgctgtttgcggcgacaaggacaccaagaagaagctcaagtcactgctggaagagaaggcatctaccgtcggcctgctggtgtgccggcgctttgtgaatttcccctatgaaatggtgcctaagatgtatgattcactctttgacgaggtttcctgggcgacagaagatgagccaacgcaagaactccaggactccttccggttcaagcagtacctgttccttgtcagaatcttggagagaaaaactccaccaaagcagaaatcaaagaacaataaagatgaggatgaacctgttatctatccgaagttggaggacgaaatattacatgagcttagcacgtggtcatttactttcccaattcgcgccgaacagtcggcacagcaagagctgaagaactacaaggagatgggcc

SEQ ID NO: 3302 - DNA, 555 bp, Hordeum vulgare
atgaaaacttatatttcggaacggacaaagtacaatacaaagtgccaaacagtagcattttctgggttccacgtatgccattccagagcattttcatggagcacagatttcagttgaatcagaaatgtcacacatgcatgttttcacgcaaccaaagaaaccctccatgaatataatctatcctgtggcaaaaactgaatacatgaaaagtatggagtacttcataaacgacccctccctacagaaccagcctctttgtgcaactgtggtgacagttgcacaatgacattgcgtcttgcggatggacagcagcagaatcccacttgggatttcttctcctacgagcaaaaatagacctgcctattccgacaccaaagcctccagcttcttgcggaacttcgggatcacgtcggctttgacgcacatcaccaggcccatctccttgtagttcttcagctcttgctgtgccgactgttcggcgcgaattgggaaagtaaatgaccacgtgctaagctcatgtaatatttcgtcctccaacttcggatagataacagg

SEQ ID NO: 3303 - DNA, 517 bp, Hordeum vulgare
cctcgtgccgaattcggcacgaggcaccggcggagccgatgtgccgctgaggtatctccggccagcggaggcggtcaccggtgacggcgaggcccagatcccgatcatcgaccaccggaggctgctgctggagctggaccgccgtggcgaggagtctgcacgcctccacagcgcctgccaggactggggcttcttccagctaattaatcacactgtcccagacgatgtggtggagggaatgaaggccagcatccaagaattcttccggttacccgcggagacgaagaagcgattcacgcaggagttggggcagctggaaggctacggtcagctgttcgtcgtctcggaggatcagaagcttgactgggctgacatgctttacctctacacgcagccacctgagagcaggaacaaaaagttctggcctgaccagcctgccaacttcagatcgatgctggatagatcctctggtgctgtgaaggagataacggatacccttttggctacaatgtcggag

SEQ ID NO: 3304 - DNA, 549 bp, Hordeum vulgare
gggccttagggaataatgggtctgagggagaggttgcagttgcagcacacgaagaacagatcttcacagatgcgaggatgctaactaactagtgatgcctggaacctcggagacaccacagatgcacccgcagttcgtaaccgacaacaaggtttacctgctatggtgggtagcattcagctgctagtttagcttcatccgatctaagaagctcttcccctccaacttcgttgcgaagaaaagcctcatgaagttctcgtggtccagcgtcttgtacgcctcttcttccccgccttcacgtgccgtaatttccttcagaggacctatcatggcgtggatgtttggggagtggaacgccgcgaccgacagccgttcttccttcgggttgacgacggctcggtgctcgatgctcctgtaccacccattcgtgaagatctcaaagatatccccaatgttgacgatgagagcgccctcgacaggcttgacgggaaaccagctgccattcctcttgatctgcaagccttggacatggttcacttggaggacaag

SEQ ID NO: 3305 - DNA, 526 bp, Hordeum vulgare
gcggagtgttccaagtagaaccgaaaagctgtcctggttttatcttcaggcgctccgtgtgtatgggtaccaccaatatgtcccgggctgaagttcgcactttccttgaggatcttgcagaggattatcatggggacacttatcacttgattgtcaagaactgtaaccatttcacagctgacgtctgcaagcgtttgaccggaaagccaactcctggatgggtgaatcgacttgccagattaggttccgtctgcaactgtgtgctgccagaaaacatcaaggtttcagcggtcagagatgaaactgcacaccttgaattttccgatgacgatttggagtcggacacgtcgatggtcgacgacagcgacatcggtgatttggatcacctcctaacaacaccaaacagcgacgtcatacccccaaaagacaagacgttaactcctggaagagagagcttgtaattgtttcaggttatttatgaacaacattacctgcttctgggttgtttgctggggatgggagatct

SEQ ID NO: 3306 - DNA, 544 bp, Hordeum vulgare
tgctgcattcaatttagtgaagggaacagcacaccaagtcaagccatttcgatcttgtacttacacaacaaaacaattgtcaatcgccatgaaataaacccaacagctagttacacaaatactatacagctgcactctactctcaaaaacaatcaacagttacaatcaactatgcacgcaaccatctcacacgtcccctgttggttaacttggccttcgccacaattagacaaaccacacccactatggtacctccctctctacatcaacatcaacatatatgtagcagcgactttaaccggatcagtatcagtatctgccaccgtcattcgcaaagaggacaccggcaccacggctaagatctcccatccccagcaaacaacccagaagcaggtaatgttgttcataaataacctgaaacaattacaagctctctcttccaggagttaacgtcttgtcttttgggggtatgacgtcgctgtttggtgttgttaggaggtgatccaaatcaccgatgtcgctgtcgtcgaccatcgacgtgtcc

SEQ ID NO: 3307 - DNA, 534 bp, Hordeum vulgare
gtaccctcgggtctgcaggaaattcggcacgaggcagcactggacgatgaggacatggaggaggagattgaggaggaggttgataaggtcctgtctgcaattgccggggagactgcatctcagcttcctgatgctgtccgaaaacaaaaggagaaggtgacacaaccttcgacaagcgaacctgaaaggagaactgccgtagcggaatccgttgatgacgacgaggatgacctagaaaagataagggagaggctggccaaagtgaggtcgtagaagagatgtggtgcgctcatgtgtacaatatataagtccatttggttggtaatctgacagggggacgcgcttgtcgctgacaaactggttcacaaacgtaaagttgttggatctctgttgtaacctgtaaggatcaccgtgcgagatgtattttgtttgtttctctatatctacttggtgtgaatacaatacgtacatacagatactgtgtcagcaataacatccagaatgcacccaagtgttttatgcaaaaaaaaaaaa

SEQ ID NO: 3308 - DNA, 455 bp, Hordeum vulgare
cttgggtgcattctggatgttattgctgaccagtatctgtatgtacgtattgtattcacaccaagtagatatagagaaacaaacaaaatacatctcgcacggtgatccttacaggttacaacagagatccaacaactttacgtttgtgaacctgtttgtcagcgacaagcgcgtccccctgtcagattaccaaccaaatggacttatatattgtacacatgagcgcaccacatctcttctacgacctcactttggccagcctctcccttatcttttctaggtcatcctcgtcgtcatcaacggattccgctacggcagttctcctttcaggttcgcttgtcgaaggttgtgtcaccttctccttttgttttcggacagcatcaggaagctgagatgcagtctccccggcaattgcagacaggaccttatcaacctcctcctcaatctcctcctcc

SEQ ID NO: 3309 - DNA, 542 bp, Hordeum vulgare
gggctgcaggcgttggtaacgcggcggagcacgccggagccgtgatcttcgccctgaagaacaagctcgacatcaccctcggtgttgccttggggtcggctacccagatctccatgttcgtggtgccattgagtgtccttgtcgcttggatcatggggattcagatggatctcgacttcaagctgctagagacaggctctctcttcatctcggtgctagtgacggccttcaccctccaggatggaacgtcacattacctcaagggagtcctcctcctcctatgctacattgttatcggcgcttgcttctttgttacgagacaaacagaacatcacgcgaacggcaacggcacgctgctggatgtcccaatgggtcccatgattgtccaggtcgcataactgattactaagagggctgcctcaaccaactagaatgtgtgcaagattgagaacgaagtgttcgagcctgaagcaaccaaattgtgtctatcatatatgtgcataactgtgccaaggaagagaattccatgcgttcagagtccc

SEQ ID NO: 3310 - DNA, 553 bp, Hordeum vulgare
  UNSURE (78),(87),(88): n stands for any base
ggtgctctacacatatggacaccccccacaaagaaacaacgtttgtatctttacatatatcatactgattcacataanctgtaacannacctcattgatgccgatgtatacacatggctacgcgcatatgagctaaccttattgcatgccgaacagcctagacaatacaagaagcaataaaaatagctagcagtacggttcaagaaaataaagaaaaaatctggtacaattgcatgcttttctcgcaacagtaatcaactgattcctttggatggggactctgaacgcatggaattctcttccttggcacagttatgcacatatatgatagacacaatttggttgcttcaggctcgaacacttcgttctcaatcttgcacacattctagttggttgaggcagccctcttagtaatcagttatgcgacctggacaatcatgggacccattgggacatccagcagcgtgccgttgccgttcgcgtgatgttctgtttgtctcgtaacaaagaagcaagcgccgataacaatgtagcataggaggaggaggactcc

SEQ ID NO: 3311 - DNA, 385 bp, Hordeum vulgare
gagcgagccatgggcgtccacgcggcgccctccccctttccacccttcccctttccccgccgggaagaggaccaccaccaccaccacgacgtcctcgccggcgaccgctggggcgcccaccgctggggcgccatgcccatgtcgcccacgccgccgcccatgtcctcctgcggccgatacatcctgcaccgcgtctgccgcttcgacacgctcgccggcgtcgccatcaagtacggcgtcgaggtggccgacgtgaagcgggtgaacggcctcaccgccgacctgcagatgttcgcccacaagacgctgcggatcccgctccccggccgccacccgcccgcccaacattcgcctccctcctccgccgccgccagggaatggacta

SEQ ID NO: 3312 - DNA, 328 bp, Hordeum vulgare
tttttttttttttttttttttttttgctcaagaacagagttgagatgacaaatccacgactaagagtaacacacaagcactaacaaagttcattccttcattagtgtacgtacaacatactgcctctcgtttccctttgctcctatatatgttgtctatctgcagttctgcgtcgcgtacaaaagacaaagaatatatcctctcaaacaactcataaaaaggaaacaaactgctcccgccgccagcaggttcagtgcactatgtatatgtagaactaatgtactcactgtattcaactctgtctttgggcatcatctctgcagtttat

SEQ ID NO: 3313 - DNA, 556 bp, Hordeum vulgare
gggctgaggaattcggacgagggtcagtctgctatttatgttgcagctgctcatgcattgaagccaaatattcggtttatcgcagtgctctacggttagtccgctcaatgctgcctttgccatatttgaaagtgggatatttgactgctcctccggcagacgaccccattgcaccacataaacattgggagaggtcacagttcatcttaaaccatgcggaactccagcaggtcaatgcttccgaaagcgctcctgtcaaaccaaacgcgctcgtggagaaagccaaaaggtttatcaaggtagacgttgcggacatagtttcagtgtccacgtgctccgatctaacgcttccgcctggtgctggcctctgtataaacacaactcatgggcccgtgttcttggttgctgatacctgggagtctcttgatggttggctagacgcgatacgtcttgtgtacaccattttcgcaagggggaagagcgatgtcctggcgggcatcatcaccggctgatcgatgatgccatgttgtgtgtgttgtgactagctgggtctgga

SEQ ID NO: 3314 - DNA, 538 bp, Hordeum vulgare
actcatcttctcatccgtcgtctattacaagtcatacatttgaacttgaaggtatatatgtgttacaggtacaaaacaatgccgcctatggtttggatggttgaacacattactctacacaagctgtgaaagatcacatcggagcagtaagggcatacataaaaaacaactgtggtgggtttttttgaattgacacagaatgcatactgatatacatgttgctttgtccagacccagctagtcacaacacacacaacatggcatcatcgatcagccggtgatgatgcccgccaggacatcgctcttcccccttgcgaaaatggtgtacacaagacgtatcgcgtctagccaaccatcaagagactcccaggtatcagcaaccaagaacacgggcccatgagttgtgtttatacagaggccagcaccaggcggaagcgttagatcggagcacgtggacactgaaactatgtccgcaacgtctaccttgataaaccttttggctttctccacgagcgcgtttggtttgacaggagcgctt

SEQ ID NO: 3315 - DNA, 434 bp, Hordeum vulgare
gaaaacccaaacccaaatccaaatccaaatcgcctctcctcctcatccctcgcaccacgcggccggacccccatggaagccggcgacgaccccatggacttcacctggaccgccggctgggaggcgggcgcacccggcctgcgactccagccccgaccccaagccgccgccgccggcctgcgactctagcctcgaccccgcgcccgaccccgcgcaggcctgcgactccagcaccgaccccgcgccggcgccgcaggaggcggaggcggagcccatgatcctcgtctccggcccgcgcgtcgccgtctccgggctgaggcgggccgactgccacgcaggtgaatgcgtcctgttcctcaatgccggcgggtgcgccatcgaggacgacgatccctctgcaaagttctccagcgattctttctttcaggagggga

SEQ ID NO: 3316 - DNA, 401 bp, Hordeum vulgare
tttttttttcttttttgactgattcactgcaactgcaagcaaacacatgattatgatgatgatgatgatgccttaattgagctcaactcagctcaaggttgagcgtccaattccgatccatcgtcttctaccagggagagggaggggtacagtaaaaaaaagtagactagagcatcttctacaaacaaagttacagacaagtcgtcggtcactacgacaatggcgtcccgtctcgtctcatctcatctcatctcatctactacaacgcctaaacgcaacgcagcccaggtagggggtctgcctacctcacccagcccttggtcttgttgctgctcaccacggtagcctgctgctgcctggtgaccctagaaccagaaaccgccgccgccttgttcgcggcc

SEQ ID NO: 3317 - DNA, 535 bp, Hordeum vulgare
cgagggcggcgtgagcgagcccatcaagagctcatcagccaggctggctgcacacacacaccctagctagggttttaccatcctctctcgccgtcgccgccgccgccgccgccgggatctgctcgtcggcgctcgatccttcaccgactggccggggattccgagcgccggagggacctcatctgacctggttggttggttggttggttgggaatcggaagggaagggactgacgatgaggccggtcttctgcggcaactttgactacgagacgcggcagtccgacctggagcgcctcttctcaaagtacggccccatccgccgcatcgacatcaaatccggctacgcctttgtctacttccaagacgagcgcgacgctgaggacgcaataaggcggctcagcaacgccgagttcggccacagcaggcgaaggctctccgtcgaatggtcaaggcaagaggagcccgtgcccaagaaccgcgacaggcctacaggggcagatgcaaagcccaccaggacgctctttgttatcaac

SEQ ID NO: 3318 - DNA, 526 bp, Hordeum vulgare
tggttagaggccaggcctcaagaggcctatatcatccgtgtcgttaaagaggccaggccatcaagaagctttggtccatggatgaactattcatctcaaatacacaaggtgttgatatgaaaaaactagcatcgccttgtgcttttccctcgctcttctagttctagcacacggccataaaaggtcgagcgtcttcatcctccctggaattccttcctttgagatccttcgaaatccatccaccctagtaacgaccatagccggggctcctacctctttcataacgatcatacacagggcttcggctcctaccatatggtgctccatactggcgatcataacgtggacggcggtcgtaatctggactgtaatcccttcggtacctagggctaggggagcgctcgtagggacgtctgccctggttggctctctttggactgccatatctgtcaccgcctcgtctggggctgccatatctgtcaccccctcgtctcgggctgccgtatctgtcacggccttgcctggg

SEQ ID NO: 3319 - DNA, 331 bp, Hordeum vulgare
tgaaggaagagatgacagtgcccgagtaactgaaattgataagggcacatcttttgagagtcattttggacaatcagcgcttctgaatggaaataaccacagtgaacgaacttgtaccactgcagtaaatccaggtggaaatggccctgaaacaagtgatgaatttgcttctgaccttggcaatgctgatagtccaaggatggttgatggacgcatatctcaaggaacagaaaatgattcgttgtcctctacatcgaagcaaggttctgtggctggaaaccccaggagtgaagttagacaaagacaaaggacattctctggtccggttatg

SEQ ID NO: 3320 - DNA, 542 bp, Hordeum vulgare
gcaatgaatcgtttattcaaatcctttgctaattgatatgttaaatcattcaatcttccagttattctctgcaaccaaattggctctactgctgcatcacctggcatcaacggccataccagtgatgagcgcggcaccgccaaaatgaaccgatgccgcaagtcaagtcggtaaaacgaaacaaaaccaaaccatactagctacagatgctgctaactagtgtagatagaggctatgtacagacacacacacagatagcaacaaccagcatattctcctgctacacctccaacagcttctctctctctctctgctgcctgagtagagtcgtcatctagaggttttcaagtcctttctcttataccagcgatccacctcaaacgcatgccttcttcacaagccaacggaggcggcctggtcaatgcatgagccggggcacgcagattatattatagtcacttgagaatactccttgtgccactcaaaggtaggtgcatcgcctggtcatgcttctccgttgccatcctctcttgtgtcggcta

SEQ ID NO: 3321 - DNA, 274 bp, Hordeum vulgare
aacccagtcagtgagagagagagagaggggccctaccccggcggcgaggagcgcacttcctcttcctcttcctcttgggcgtggcggcgcgtgctgctgcgctggtagccttgcagccggaccagcaacaccgatccgatgctctccgccagcgaggggggccagtgagccgagctgtctccgggcggcgccggcccgctcgcgcgcgctccgggacccaagagatctctgtgagctggaagcataaggagatcagcacattgtgcacatacca

SEQ ID NO: 3322 - DNA, 394 bp, Hordeum vulgare
ttttttttttttttttttaggctcgaaacctttttttgtcaaaatcttgtgacattttgaaatatgtttaaacacattttagaaaccaggagaacataacaaccctctcagatgcatgcatgcatctatctgaatacccaagcaggcaggcagaggccgtggatgtagcatcgtaattcgaccgtgggaatcccaacacggaatgcaagttgatgggcaccaagcaaacacatttgggtttccgttggtgtccaaaagaaaccatactaggagtaactccccacgtctagagctaacgctgcaaaaactactatcagttgcacattctcccttgtccggaacaaccaccaagaactgtatccatctgctcgtcacgcaccaccggccggccccg

SEQ ID NO: 3323 - DNA, 515 bp, Hordeum vulgare
gttgccgctaaggcaattgcttcagatgagaaaatcgcattgctgggagccattcagtcgctgttcgagggctcaatgtacacctttgtcttcctctggactccagcattgagcccaaacgacgaagacattccccatggctttatattcgctaccttcatgctgtcatctatgttgggtagctccattgcctcacgcctactggcccggaaaatgaaggttgaaggttatatgcagatcgtgtttgcagtatcagccttcacccttttcctcccagttgccaccagccttctggtgccggcgtcttcagtgaaaggaagcggcatatcgttcggtggctccctgcagctgcttggtttctgtacctttgagtcatgtgttggcattttctggccatctatcatgaagatgagatctcagtatatccctgaggaggcaaggagcaccatcatgaacttcttccgcataccactgaacctgtttgtgtgtgtggtgctctacaatgtgaatgcttt

SEQ ID NO: 3324 - DNA, 541 bp, Hordeum vulgare
aataataatatatgtatagcttggacaagatattcgtagcacattaaacacaaataatgccatgccgatgaacaaatcagcagcctctcaattcttcctcccaactatgtattcatcgatgtcctcgtgtgcctagccaataatattgatctacgctacagaataaatattacaagcaaaaagcatcttgctttccccacttccatcttattcggcacccaggcaggtggagtattcaatcaatggcgtatctgattcgctcccgattctgttggccttttaaggatttagcggctcgtcttccccggtcatctcttgtgattttgtcgagagcttgtgtaggtcagccacaaccatcagccgtctctgcaagattgccgccatgaagaggaagattgaacacatgccaaacatgacggtgatagggaaagcattcacattgtagagcaccacacacacaaacaggttcagtggtatgcggaagaagttcatgatggtgctccttgcctcctcagggatatactgagatctcatcttcatg

SEQ ID NO: 3325 - DNA, 842 bp, Hordeum vulgare
  UNSURE (11),(16),(18),(20),(29),(33),(34),(84),(825),(834),(841): n stands for any base
gtcccccgggnctgcngnantcggcacgngggnnagcggcggggtcagcgccaacaacgccgccgccggcaacgacgacgaggnagggcaacaccgcccctttccccgacacggtccagataggagggtctcccgagtacagggtcgagaggaagctcggcaaaggcgggtttggccacgtcttcgtcggccgccgcctaaccggtgggaacggacgcggcgccggtgctcaggaggttgcaataaaattcgagcacaacaccagcaaggggtgcaactacggccctccgtacgagtggcatgtgtattctgctcttggaggtactcacggcgtgcccaaggtgcattataaaggccggcagggtgactactatgtcatgattatggatatgctggggcctagcttgtgggattcctggaatttagcagggcagactatgtcatcagaaatggtagcttgtattgctgcagaggccatctctatcctggaaagcatgcattctaaaggatatgtacatggagatgtcaaacctgagaatttccttctcggtcagcctggaactcctcaagaaaagaaactttttcttgtagatcttggattagcaacaaagtggaaagatcctgctactcaacagcatgttgattatgatcaacgtccggatgccttcagaggaacagtcagatatgctagtgcccatgcgcatttaggaagaactgcaagcaggagagatgacttggaatcactggcttatacactagtatttctccatcgaggcaggttgccgtggcaagggtaccagggtgataaataaatcattttctggngtgcaaganaaagatnt

SEQ ID NO: 3326 - DNA, 524 bp, Hordeum vulgare
  UNSURE (8),(41): n stands for any base
cagtcagntagtgcattacatgatcaatcaatcaatcaggnaaattcattcattcaccatccagccaaacaaacaaacagacgcgctacgatgatctagtaattaaaagtaagtaagcagatactcctgctgctgctgaccaccaatgcttgctcggcgaaaatatacacatgaatgtgatggctttttttggttgggttgggttgggttgggtgtcagcaacaggaatcaggtctgcataaatacaactcagaagagtcgcctaataccgaggatggatggatggatgcattgcatccagctccgccgcaagcccgacggcaggcatggctatgctacccctacgccacggttcgcccataacagatcccggcgaggtagaggttcttggcccacttgtccttgacgtgcgcgctggggaactgcgacgtccgcagcgtctcctgcgtctcgtcccgaggccggcgcctcggcatgctcaggatcagagcagactggtccatggtcgccgccatcgctgtgat

SEQ ID NO: 3327 - DNA, 522 bp, Hordeum vulgare
gtccttccgggcctgcaggcaattcggcacgaggtggggctcccgcgggcccggctcgggccgaagaagaaaaccacccaacgatgatgatgatgatgatttgagcgagtatagagagacattgttatgttgcagacaaggaaggaaggcaggttgtacacacatggtctcaagttgcaaccattcattctttgcacaccggttccgtggcaccgggaacgctgcctacaccacactaggcatgggggggtctgtatattgtcatcattatcatcgagttgggttgggttcaaattcaagggcaaaagtaggagggccctggagtttttcttcctcttgttactttcctccgtgggccctatcgtcgccttctttttccgcttgtcggtgtggaacatggtcagtcatatgttgttgttgtatatcggatgttttgtcattttgtcggagattatctgtcgatcgatcaataaaagtcgcagggttttgtttaaaaaaaaaaaaaaaaaaactcgagggggg

SEQ ID NO: 3328 - DNA, 454 bp, Hordeum vulgare
aaaccctgcgacttttattggatcgatcgacagataatctccgacaaaatgacaaaacatccgatatacaacaacaacatatgactgaccatgttccacaccgacaagcggaaaaagaaggcgacgatagggcccacggaggaaagtaacaagaggaagaaaaactccagggccctcctacttttgcccttgaatttgaacccaacccaactcgatgataatgatgacaatatacagacccccccatgcctagtgtggtgtaggcagcgttcccggtgccacggaaccggtgtgcaaagaatgaatggttgcaacttgagaccatgtgtgtacaacctgccttccttccttgtctgcaacataacaatgtctctctatactcgctcaaatcatcatcatcatcatcgttgggtggttttcttcttcggcccgagccgggcccgcgggagcccca

SEQ ID NO: 3329 - DNA, 232 bp, Hordeum vulgare
ggccaccttgcccgcctgcccaaaggcagcaggccaccaccttgctcgatctcatgattataagggcgttccacagcaagatcctgcgccgattgagccttggcaccgccataggcttccggatcaggaaggggacgttgaccgacacgcccgacatcctcgtctttgttgctcgcaaggttaacaagaagtggctcaggcctacgcagtgccttccgggcgccctcgaggg

SEQ ID NO: 3330 - DNA, 556 bp, Hordeum vulgare
gctacatggggttttacttctggcactcccaatgcatacaatgcacaaatcgcaatcgcctccaatgataacaacaacaacggcgaccccgcagcatacagaggggggcgacgaaaggaaccgtcatttctgcaggtctatgtccaccgtcgtcgtgtcggaccggagcctcttaggctcccgctcgcccaggtgcagcgagaagcagatgttgtcctccgccgggctctccaggttgcagctgttgttgttttccagctcgccgttgcctccttgctcgtcgcgcatcgaggacatgcccatcaggttcgggatgaactgccgctcctccacgttgctgctatttatcccttccaccgtgtcgacgcggaactcgccgggcccgaagggctgctccgtcgagttggcggggccgtcccgggggagctgctggatgttgatccccaggggctcgtagatcttgtccactttctcggcttcttgcggtgtggcggccacgggcgacaactcggtggccgtagaattggcagctgccacggcggctgctagggtgatc

SEQ ID NO: 3331 - DNA, 338 bp, Hordeum vulgare
cgatcgatctatctagccatcgttatggttatggggtggtggtcgtcgtcggcggcgatgtggctgctcgctgtagctgtcgcattcgcattggcattgagggcggaggcgctggcggccaactggggcacgcgggtgctgcacccgctccccggcgacatcaccgtgcagctgctcaaggacaacggcttcgacaaggtgaagctcttcgaggccgaccctgcggcgctcaaggctctgggacactccggcatccaggtcatgctcggcctccccaacgagctgctcgccaccgtcgcccgggacgtcgccgccgccgagcagtgggtgcagcacaa

SEQ ID NO: 3332 - DNA, 245 bp, Hordeum vulgare
cttttttttttttttgggtccaggggatgagctatccctttagcatcgatcttcccatctgatgcaatttgtatatatatgcaaatccaaacttactatgaatcataggaaggaaggaaggacaagtttgctcttggatgcatggatatatctccatctcatgcctacaagtagtacaactcacacaaggacaagttgaggtcctcatgtcatgaggtgatcgagagggtttagggtcagagtgc

SEQ ID NO: 3333 - DNA, 440 bp, Hordeum vulgare
  UNSURE (20): n stands for any base
gtctccccgggcctgcaggnaattcggcacgaggcccgtccagagttccgctgcaagcacggcaaggcctacctcttcgacaaggtgtaagtcatccatcgccatgcccaccatgcctcaatcttgctccgtttttatccaccatcgacctcacctctgctctctgctccatgctctgtttcatttcatttaccgtgtgctctgttgttcttgtctgtaacacggctgctgctgctgcgttatcattcattcagcgtgaacgtggtggccggagagagcgaggacgaccggatgatgaccaccggcctgcacaccgtccgcgacatcttctgcgtcgcatgcggagccatcctcggctggaaatacgtctctgcgtttgagaaggaccagaggtataaggagggcaagttcatcctcgagaggtgcaagatccactcggg

SEQ ID NO: 3334 - DNA, 370 bp, Hordeum vulgare
tttatttcaggtggacaccacattcttatatgtacacacgaacgacgacaaccggtctgattcatatggttgcacagataatagatagataagcaggcatggttcttggtctagggagcagctacatggtttgcactgccagggaagggaacgacgctgattaacactagtaatatttacagtcatgtcatgtctgcctgcctaatcaacttgatcctgcattgtcttgcaaggtcacacggcgccctggtcgtcgtcctcgctggagcttatgcgagcgtcgtgctcggcccacagctggatgcggtcgggagggccgcctccgcccgagtggatcttgcacctctcgaggatgaacttgccctcctta

SEQ ID NO: 3335 - DNA, 517 bp, Hordeum vulgare
cttgtttgtggtgactctggcaatgatgcagaattattcagtatccctggtgtacatggtgtcatggttagcaatgcccaagaggaactactccagtggcatgcagaaaatgcgaaggataatcctaagataattcatgcaactgagaggtgtgctgctggtattattcaagctatcgggcacttcaagctaggacctaatgttactccaagagatgatgtgtttccttacgtcaaggaggaccctttcaagcctacagcggccattgtgaagttctatgttctgtatgaaaagtggcgtagagctgatgttccaaaggctgattcagttatagactacttcaaaaacatcacagatgcaaatggagttattattcatccgtctggggtcgaactttcgatccattcgtccattgatgagctggcttcatgttatggtgacaaacaagggaaaaagtaccgatcatgggtggacaggctagttatcttgcagactgcttctgacagttggctcgtga

SEQ ID NO: 3336 - DNA, 562 bp, Hordeum vulgare
  UNSURE (33),(34),(41),(42),(56),(57): n stands for any base
cgtagcacattccactagtatatataccctggnngactggnnggtcatttactttnntagtttagcctctcatgacagcatcaagagacatcatccagtctagtatatgtatgtgtctgggagcacttattaacattatatgaacaagtaaaaaagaaattcacatgctttcggtacgatttcttatttcatcctcaagaagaaaaaactcctccccatgcgccggccggcggtctagagtttggacgactgctcaaccccgggatattctttgcgccatgtcttgtggatgtgtgttaccacgcaacccccagggttttcaggctttacactcagcgcaagagttgtaaaacagcacacccacgcatcaccttctgcctcccacaagtcgaatctcacgagccaactgtcagaagcagtctgcaagataactagcctgtccacccatgatcggtactttttcccttgtttgtcaccataacatgaagccagctcatcaatggacgaatggatcgaaagttcgaccccagacggatgaataataactccatttgcatctgtg

SEQ ID NO: 3337 - DNA, 518 bp, Hordeum vulgare
cgcctcggcgccctccggccacgcccgcgagcaggaggacgagcagtcgctggtggtggtgggcggaggcgccgcaggggtgtacgcgtccataagggccaagaccctggctccccacctcaacgtggtggtcgtcgagaaaggcaagttcttgtccaaggtcaagatctccggcggcgggcggtgcaacgtcaccaacgggcaccatctcgagccgtcggggctggcgagaaattatcctagggggcacaaggaactccggggatcgttctttcgcagtcatgggccacaggataccatgcactggttctcagatcatggtgtggagcttaagaccgaagatgacggtagagtctttcctgtcactgacaactctgcatcggtagtagactgcctgctgaacgaggcgagaagactgggagtttccctgcaggctggtaaatcggtgtccggtgcatccgtcgatgacaacgggaagtttgttgtggaagttgagaagcgtaccattgattttgtcg

SEQ ID NO: 3338 - DNA, 525 bp, Hordeum vulgare
tcttactgccagtgccagtttacaaggattcacaggctggtcttactccacaacaaaattgtcgctgcgacgcgaaaatacaattagtcgatgtgaatcttggtcatctttgcttgttttcgagctactcctacaatgctgccaagctacactcagaagcttttacaaagtttgtcagccaataagaatccttgaatcattgaatttccttaagatgcttgcagttgcaaacaagcctgctcttctttgaggatgctggttgatgccaatgtgcctatgcttgtcccagctatgtacccaccagtccatgcattctgaaagttgaatccgccggtgaccccgtcgacgttaagaacctctccggcaaagaacagattgggctgcttcttgctttccatagtgctaagcgatatctctgaaagtggaacacctccagctgtcacgaattcatctttgaattgacccttcccaacaacctcaaacatccactgttttaaacgaagggctattgcatttagatgattt

SEQ ID NO: 3339 - DNA, 452 bp, Hordeum vulgare
aagaactccattccatctgcggaggcaaaaaagatccagccggagccggagggcttgctcactagcggccgtccggcgagaggaaccgcccacccgccgggaaggggaaggcacgcggcggagggaggggagatccctgccgccgccgccatggccgacaaggaggccggcaacttggaggccgtcctcaaggaggtcgtcgacctggagaacatccccctggaggaggtgttggacaacctgcggtgcagccgggaggggctcacggcggagcaggcgcagcagcgcctccaaatcttcggcccgaacaagctggaggagaaggaggagagcaagttcctcaagttcctcggcttcatgtggaacccgctctcctgggtcatggaggccgccgccatcatggccatcgccctcgccaacggaggggggaagccgccggactggcaggactt

SEQ ID NO: 3340 - DNA, 441 bp, Hordeum vulgare
tttttttttttttttttttggcaggtaaacatatttgaaccaaacaacagctacacatctgaaagcagacaggccccaggaaggaagcatttcatgaccatactagatttatctacatgtggtagcaagctaaaaatgaaggggggaaacataatgtacatactggctgaaaacataaaaaacaaacaaaagaagatgggttgcgcgataacttaggtggtgccaaactgcatcaccagcgggcaacgttttaactacagtagtcatgtctcgagcactacgcggacgattacagtagtcgagttcacagatccactcttcactcgtgtcggtaaccaaccattaaattagggatttccccctttttttttcttcctggacaacgcagatcatcagacggtgtaggactgctggatggtctcgatgtcgagacccttgagc

SEQ ID NO: 3341 - DNA, 552 bp, Hordeum vulgare
gtccccccgggtctgcagggaattcggcacgagggcccgagcattaccccatggaggcaccccaggtcattttcctcaacccggcgccgatgcacccgcacatttacagcaacgggcacatctgcttagatatactgtatgactcgtggtcgcctgcgatgactgtaagttcagtctgtatcagcatcttgtcgatgctgtctagctcgccggcgaagcaacgcccagcggacaatgaccgctacgttaggaactgccgcaacgggaggtcgccaaaggagacccgatggtggtttcacgacgacaaagtatgaggggggaatcgaaccgattggctcttctggccaccccatacttgtcagccagccttccttccttaccatgaaagaaatctcttccaaggggagatgagatgagatgatttaggcttaaaaaaaatgtaagctaagcaacccctctatcgtaccgcagaccttaacatgcccttgtggtggtttgtacatgagctcaacacatgttgtcgaaacgtgaatatatcatcgctaccgacga

SEQ ID NO: 3342 - DNA, 542 bp, Hordeum vulgare
cttgcttattctatatatctctcatcgtcggtagcgatgatatattcacgtttcgacaacatgtgttgagctcatgtacaaaccaccacaagggcatgttaaggtctgcggtacgatagaggggttgcttagcttacattttttttaagcctaaatcatctcatctcatctccccttggaagagatttctttcatggtaaggaaggaaggctggctgacaagtatggggtggccagaagagccaatcggttcgattcccccctcatactttgtcgtcgtgaaaccaccatcgggtctcctttggcgacctcccgttgcggcagttcctaacgtagcggtcattgtccgctgggcgttgcttcgccggcgagctagacagcatcgacaagatgctgatacagactgaacttacagtcatcgcaggcgaccacgagtcatacagtatatctaagcagatgtgcccgttgctgtaaatgtgcgggtgcatcggcgccgggttgaggaaaatgacctggggtgcctccatggggtaatgctcgggc

SEQ ID NO: 3343 - DNA, 549 bp, Hordeum vulgare
gtcccccgggtctgcaggagggctgcctgaaaactcggttacggttcttcgcgcttggcttttcgaacacttccttcacccgtatccaaaagattctgaaaagttaatgcttgcaaggcagactggcttgacaaggagtcagatttcgaattggttcataaacgctcgtgtccgcctttggaaaccaatgattgaagacatgtacaaagaagagactggtgatctggagcaagactccaactcttcctccgacaatgtgccgaggagcaagaacaaagtggcatcttcagaagagaatgaagatctgaagaacgccagggctcgagtttgcgaaaccagtcagctaagcgagtcgagagcaagcatcgggactatgattgttggcgcggcgccggttggcttccagcatgctgaggccaaccctgatgacagtttcatgaacctgatgatgaaggagcagcgatccggtgaggcggatgggggcctcctcctccacaacgcggttgcgcagcactcggacgagaacgcgcggttcatggcataccactt

SEQ ID NO: 3344 - DNA, 543 bp, Hordeum vulgare
  UNSURE (472): n stands for any base
aagaatagcctcatttagcaatgtatactattatcctgaagtggccattactttacaatactgagcacaagcttttacacgtatagtaaattgcactttatctttacaaaagatttccatctttaccccccctatcacccccaccacctaagctttatattacatttcctgctataccccatgctctcctgtatcaaatggcaactacaaagctacaccccccatgctcttgcaggcatgctattattctgccactaggagttttacaaatgctgtcacccccaaccccaatatttgtgtcaatggtcctgatctgatgtatcgtcattcaggccacaaaatcatgcagaagaggcgattgctcgaagcgttgtcgttgatccatctggttcaaagattcgtagtcggaagatgcaatgccgacaccgagaggagcaccggcattgtagatgtcatcgtcgccgacaccggngaagtgtgcttgggcattcggaaccgagaggccgctgccagggtgctgcaggcccaacgtcagcgatacat

SEQ ID NO: 3345 - DNA, 441 bp, Hordeum vulgare
cccaggtccgccgctgcctgctctcctcccacgccgccgatgaagcccatcgtcgtccacgccgccgccgtggaccggcggtggctgctccctttggccgtcggctcggcgctgtccctcttcatcctcgtcctcctcaccaccgtccccttccccttcgtcccctcctccacgccctccccggcgctcttcgtcgagcacaagctcgccccgacgccgccggcctcccgcgtcgccggatccctccctcgcatagcctacgtcatctccggatccgccagggacgccgccgcgctccgccgcgtgctcctcgcgctctaccaccccaggaacctctacgtcctgcacctagatgccgaggcgccggaggccgaccgccgggagctagccgccggcctcgcggcgcacccggtcatagccgccgccggcaacgtccgcgtc

SEQ ID NO: 3346 - DNA, 385 bp, Hordeum vulgare
ttttttttttttttttttagaacacaatcctcagcctcagtctcaaatgaaaaatccatgacttagtcagcaatgagtaacaacagagatatccaaacttcagaagcatcatcagcagcctttacaagatgcaggcgtgggtacaactttcatcaccaagttaccgtcttcaggttcatgccgtcggcgtcgagtcgatgatacatcatcttgtggtctttagacttcagtagttctacaagtggtgatacaacaaattctacttacgctacgtagtctggtctggtctggtcgtacaacatcgtcatacaccgcacggtctaccacccacccgacaaaatggcgagctgcgggcggtcaaatcaaccgtgcgtgcatcgccggc

SEQ ID NO: 3347 - DNA, 509 bp, Hordeum vulgare
ggatcgccgggagaataggctgctccgggaggccttcatcttggagaggtttgttccgtccaccggctggatcgtcaaggccctgcagtgtaccgaggaagatctcttggcagctgctgggctggacgctgttgctttcaacaggatgcttgtgttcagcatacgcatcttttccctagccgccatcctgtgcctttttgggattcttccggtgcattatttggcacgaaagacgcaacaccttgagattccttcggaacaattgcatatgttcacagttcagaatgtggaagtgcaatctagatggctttgggttcattctgtagtcctctacataatatctggagtagcttgctttctcctatatgtggagtatgggcacattgctaggctgaggctccttcaccttaaacgcacaacactaaatccaggccaatttactgtgcttgttcgcggaataccaaagacagcaaacgaatcgtgcagtagtgatgtcgatgatttcttca

SEQ ID NO: 3348 - DNA, 554 bp, Hordeum vulgare
  UNSURE (14),(23),(62): n stands for any base
gattacttactatncttaacttnatttcctaatgcatgctgtactatacttgtatgtatgancctatatatatatatatatattgatgtacatttaattacatgagcagccaggtgaacgggttaatgattagttaatcgatgcgctaatgcggtattgtccgacctcttttctgtagtgcagatgacagtgatggatctcacggaattctgcagacggctaacaggaagtcctttcagcgttgggtgagacagatccctcgtgggctcttgttcctcgcaggtttcttctcctttgggctcgctcgagctacggccttcgtcttggtcctcatcattcccgacggtcaggattttctccatctttatatcttcagtgtcagggaactggcgatacgcagaacggagtccatggtgaatatgttccattcttcctgaccttacgtcttccctgtccaggtcgattaagtcctgcgtcggaaaagttttgaatagaggaagaaatcgggttctacaatactgattgaaggaaaggataaagaagataggaggtat

SEQ ID NO: 3349 - DNA, 544 bp, Hordeum vulgare
ggctgaggaattcggacgggaccatgtcggagatgaaggtggtttgctcctacttaggagaacaggagggccttgagctcttgaagactgcaattgaaaaggctggatacaccggcaaggttgtcattggaatggatgtcgctgcttcagagttctacaatgacaaggacaaaacctatgacctcaacttcaaggaggagaacaacgatggttcgcagaagatatctggagatagcctgaagaacgtgtacaagtcatttgtgagcgagtaccccattgtgtcgattgaggacccatttgaccaggatgactgggttcactatgctaagatgactgaggaatgcggagagcaagttcagattgttggtgatgaccttctagtcaccaacccaaccagagttgcgaaggcaatccaggagaagtcatgcaatgctcttctgctgaaggttaaccaaattggatccgtcactgagagtatcgaggccgtgaagatgtcgaaacacgctggctggggtgtcatgaccagccacaggagtggtgagac

SEQ ID NO: 3350 - DNA, 561 bp, Hordeum vulgare
  UNSURE (38),(57): n stands for any base
gcgccaacatgtctccgttttataagagtacgtactanttacacaatcaaaagggtntcatatggccgaatcaggtacatatccacaaggaccaaaattggagcgagttttgggggtcatatccgtcgttccgttcacataaacatgcgggacattcattatttcctcaaatcctacgagcttcaaccagagtacattccggaggttaaagaacacaccggttttcgcaaaaacctggagcaggtcccccttttagtagggctccaccggtgcgcggaacttgaggccggcgtacacggcggcatcgcccagctcctcctcgatcctcagaagctggttgtacttggcaagacgctctgagcggcatggagccccagtcttaatctggcccgtggacagaccaacagccaaatcagcaatgaatgtgtcctcggtctcaccactcctgtggctggtcatgacaccccagccagcgtgtttcgacatcttcacggcctcgatactctcagtgacggatccaatttggttaaccttcagcagaagagcattgcatgacttctc

SEQ ID NO: 3351 - DNA, 518 bp, Hordeum vulgare
tcctcctcctcctccggcgccgtcggcggcaggcattgcgtcgcgcagtaacagtaatcaaagtccaagacaatggttgcacaagcctttaccgtcgatttggacaagcctcttgtatttcaggttggtcatctggaggaacagtatcaggactgggttcaccagccaattgttagcaaggaggggccgcgcttttttgccaatgatgtattggagttcttaacacgtacgaaatggtgggcagttcctctcatttggttgcctgttgtttgctggtgcctgaatacatcgatccaaatgggccacacagttccagaagtagctttgatggttgtggcaggaatatttatctggacactggttgaatacgtgctgcatcggtacctgttccacatagatactaaaagttactggacaaacacggctcattatcttctgcatggatgccatcacaagcacccaatggatgggcttcgacttgtatttccaccaactgccgcagccatcttgtgctatcc

SEQ ID NO: 3352 - DNA, 554 bp, Hordeum vulgare
gttcgctgaaacactagcaagctggtaaaacttacaaattatatcaagcaatgcatgcaattacttggtcccaaaaattatactggacaccaacagccacaaatgaacgaccctggtgctatactagcagatagaaaaacctctctgtacacatgacaacatatgctcaagtctggaaccactctattcgcgacacatcgtcaaggatgtgacaagcacttcagtgacatctccgattaattgtttgttcgtccgttcaacccgtcatcaaccattggacaatcttgatatctggcattgcaaggtggtacaactcaagagctcttgtcgacggttttcgttgaaggcagcgttccaaatacgtggtcccacagggtcgatgttattccaaagcccttgttttgaattctgaagtgatggttaagatggtatttcttgagatattttgctggatcgaacgaggggtgggcgtgatgcaggtagtagtgtgtgcaatcatagatcacgtagcccaacaggccacctccaaacacgccaggagtggtagttgtagt

SEQ ID NO: 3353 - DNA, 554 bp, Hordeum vulgare
  UNSURE (13),(18)..(20),(37)..(39),(53),(54): n stands for any base
ggacttgcagggnaattnnncggcacgagggcttaannnatgaacaatgatgnnactcgtgccttgcatatatattaggagccatttccaatctattatcaaagataggtatatcaagcacagttggattaattggttctcgatattcacttggaaacaatattggactgggcacaccattgtccattcagcagcagttgcttgttcttttgaagcgatcccttaagagagctgatatgctgaaacttacaagcttactatcctttgatcacatctctcttgcaaaatttgatttgaagcatgtccaaaggccgttggtgtcctttggccctaatggttctacaaagcttagaacctgtcctgcagatgtctgcaagaatttaagattaagttcccatgtgctgtccgacttcggcacagatagcttatcaatttcgaatgataatggtagtttcagtacctcatggcttaggaatctgtctgatgcttccagatcttggtctaatagctcagcaaagactagaaaacttattgcaaatgactttgacaatttc

SEQ ID NO: 3354 - DNA, 525 bp, Hordeum vulgare
ttacaactgatacaaagctctctcgaactgtgccgaaagttgagatggactgatatacattcattcagcaatagaatgcatcaggccatgagtagctggtgagaccacccagttgttcttcctcgtacaaagctccctcgaacagtgctgaaattcagccagtgtgcatgccaaggtcctcgcccgcccaaccgatgaggcgactttgcagaggaagtcatggaaggagtcttgagatcaggtggacaaagcaggcacttctgtttgtgctcctgctgctacctcgctgcaatacatggccccgtcctaccagagcggttgattaactgtgcaatgtcagtaagcaagtgaatcctcctcgtcgcgcgggttctcaagggtggtaacgtgctccttgaaacgagccgcggcttcctccctctcgtctaacttgcccaggtggttatacgccatggccttcagatagtacacctctgtcgccatctcgtggtactccaaaacatgcagatcttcagctgcttgatt

SEQ ID NO: 3355 - DNA, 1174 bp, Hordeum vulgare
  UNSURE (1),(18),(22),(25),(29)..(32),(53),(62),(63),(71)..(79),(110),(111),(113)..(134),(137),(154),(1129),(1174): n stands for any base
nttccgcctaaccaatgntccnaanttgnnnnacattatgtccctgatagggntttcaaacnnccaaaaannnnnnnnntttttttttttggggggcccccaaaaaaacnncnnnnnnnnnnnnnnnnnnnnnnccntctcctcttttcttccncgggggggtccccctcccacaaaaaattctctcttcactcccaaaacatccccccccaccccccccccccccacccccccccctcaatcctcccccaaaccataaaaaaacaacaggcaccccaaaatttttttttttcccccccccaccagcactcccaccccacccccccccccccccccccccctccctccctcccaccttacttttactatctacttcaccatcctcaccttttctcttcaatccaccccccccccccacccccacccccctcctccccccaccctcccacccaatcccaccccccaccccacaccaccataaaacaccccccccttcccatccaactccctcctctcccctaccatctctatcccccccccctacccacacctcctatcccttacctctcccacccaccactcccctccccccactcctcccccaacccacccaaccccctctcatctccccatcaccaccctcacctatctcctctttcccccatcatcctctcctcatcccctctttctaccccctcactcacattcctaccacatcatacaacaccactcccaccaccctccccagttccactacatcattcccactctcacttacacccctccctcctccaccccacaccctccatccgcccttccaccccactctccttgtcccactccccacatctctccccacctctccactctccccaactcttccacctcctcctaccccccaccctacccaccaacacacacccaacccaccacccacactccacccacctcaccaccccattactcccactccttcccccacctccaaccaccttccctttcacacctaccactcacccacttcactcatccactcctctcccaacccaacactactctcaccatttcctccctcccaccaccccgtaaccactacccccctacactcctccccccacacctcccacanctctccccacctcactccccactctcccccctccccccttcaccn

SEQ ID NO: 3356 - DNA, 308 bp, Hordeum vulgare
atgtatacaagttgctttatatcactaacaagtaagagtcaaaatagatgggcgcagcaacgcgcgccatcaacgatctagttgattttatggggcgtctcccaaagcatgagcatagagtaactcgtaggcatcttggagatttcggcgcctcatataagtatatactcacaatctaccttctcacatcacgtcgaatggaccgtttatgcatacatacatacatacatacgtacgtagggcgaaaacgaaaaatcatacatacgtagggcgaatacagaaaatgatgactgcgatggaaaaaaaaa

SEQ ID NO: 3357 - DNA, 516 bp, Hordeum vulgare
ctctcgtccaccaaaaccatccgcacatcggtggcgcgacgagcagatggagcaggagggcgacgccgagctcggctggggcctcctcggcgacgcctacgaccgctgcggcgaggtctgcgccgagtacgccaagacattctacctcggcacacagcttatgactcctgaaaggcgcaaagctgtttgggcaatctatgtatggtgcaggaggaccgatgagttagtggatggccctaacgcgtcttacatcacacccaaggcgctcgatcggtgggagaagagattagaggatctcttcgaaggccgcccatatgacatgtacgacgcggccctctcagacacagcgtcaaagtttccaattgatatccagccattcagagatatgattgaagggatgaggcttgacctgtggaaatcgaggtataggacctttgacgagctttacctctactgctattacgtcgctggcaccgtcggtctcatgacggtaccggtgatggggattgctccgga

SEQ ID NO: 3358 - DNA, 534 bp, Hordeum vulgare
cactttgattctcactgtgtggtggtaacaagtgtttgagtacagcgcgacccgacatcggtccttcgagctaaataccgtggcgggcgtatggcaaacatgcacagctgaatatatacaacagccaacaaaaaatttgtagggtgacaggacaaaagaaaaaaaagacatctgatctacaggattgcttcgctttgcttatggtgaaagagccgccctcgcatatgcggccggcaacgacaggaacttcttcgccttgcccacatacgcacgcttggtgaagttgttgtagtcgttcgcctcgatggcgtccaggatctgcctgtacagccacagcgatgccaggaccggccatctgctcgcagagtctagatgcatgacgcccttctcggcctcatcaaagaagagcctggcgcgctgaatttggcccttcatgaacctcctccatttatccgtcactttccctctgaatatgtcctcttctgtcagacccgcttgtgccagctcgtccagtggaaggtatattctccccct

SEQ ID NO: 3359 - DNA, 548 bp, Hordeum vulgare
  UNSURE (46): n stands for any base
gtacccccggcctgcaggaatcggcaccgggttgtttgctggtgcnctgatacatcgatccaaatgggccacacagttccagaagtagctttgatggttgtggcaggaatatttatctggacactggttgaatacgtgctgcatcggtacctgttccacatagatactaaaagttactggacaaacacggctcattatcttctgcatggatgccatcacaagcacccaatggatgggcttcgacttgtatttccaccaactgccgcagccatcttgtgctatccgttctggaattttgtcaagctcttcactactacaactaccactcctggcgtgtttggaggtggcctgttgggctacgtgatctatgattgcacacactactacctgcatcacgcccacccctcgttcgatccagcaaaatatctcaagaaataccatcttaaccatcacttcagaattcaaaacaagggctttggaataacatcgaccctgtgggaccacgtatttggaacgctgccttcaacgaaaaccgtcgacaagagctc

SEQ ID NO: 3360 - DNA, 552 bp, Hordeum vulgare
gtaaacttacaaattattatcatgcatgcatgcaattacttggtccaaaaattatactggacaccaacagccacaaatgaacgaccctggtgctatactagcagatagaaaaacctctctgtacacatgacaacatatgctcaagtctggaaccactctattcgcgacacatcgtcaaggatgtgacaagcacttcagtgacatctccgattaattgtttgttcgtccgttcaacccgtcatcaaccattggacaatcttgatatctggcattgcaaggtggtacaactcaagagctcttgtcgacggttttcgttgaaggcagcgttccaaatacgtggtcccacagggtcgatgttattccaaagcccttgttttgaattctgaagtgatggttaagatggtatttcttgagatattttgctggatcgaacgaggggtgggcgtgatgcaggtagtagtgtgtgcaatcatagatcacgtagcccaacaggccacctccaaacacgccaggagtggtagttgtagtagtgaagagcttgacaaaattcca

SEQ ID NO: 3361 - DNA, 518 bp, Hordeum vulgare
gacaggacaaccagcagcggccgccacttcgtccacctccagctccgggaggaccgcttcgctgccaaatcgctcgtcaggcggcgggatgggggaggcttcgacgccggcgatcgccagggatgtcaccgagctgatcgggaacacgccgctggtgtacctcaacaaggtgacggacgggtgcgtggggcgcgtcgccgccaagctcgagtccatggagccctgctccagcgtcaaggacaggattgggtacagcatgatcaccgacgcagaggagaaggggttcatcgtcccaggcaagagtgtgctgattgagccaaccagtggcaacacaggcattgggctggccttcatggctgctgccaagggttacagacttgtactcacgatgcccgcctccatgagtatggagaggagaatcatcctgaaggcttttggtgctgagctgatcctcacagacccactcttggggatgaaaggagctgtccaaaaggccgaagagctggcagcaaagacac

SEQ ID NO: 3362 - DNA, 549 bp, Hordeum vulgare
ggcccatgatgctttattgcacactggctgacacatggaattcaaatatacagggcagacgtaattcaaatcgccagaaggccaacacagagtattccccatttgctacacaaagtgggactcaaacttgcaagggcttaaatgtcagaccaacactagcagggacaccaaaagcttttatttctgtagaggggctcctatgaacggagggatttgactttggaaaacagctttgcgcgcttgaggagtctcgggggtcactccaccaccatgctctcggcctccttcttgatggagtggaagagcaccgacgaaaggtagcgctctccgaagcttgggaatacaacaacaaagagtttccctgcattttcaggcctctgagcaaccttgattgccgcagctgcagccgcaccagaagagatcccaaccagcaatccttctttcaatgcaagagactttgccatctcaatggactcatcacttgaaacctgtacggtttcatcaatgatgtcaacatccaagacaccagggatgaaaccagctccaatt

SEQ ID NO: 3363 - DNA, 939 bp, Hordeum vulgare
  UNSURE (42),(939): n stands for any base
gatttccggggcttgcaggaattcgcacggggggtcatcctnctgcggccgccacttggtccacctgcagctccggggggaccgcttcgctgccaaatcgctcgtcgggcggcaggatgggggagggttcgacgccggcgatcgccagggcatgtcaccgagctgatcggaaacacgccgctggtgtacctcaacaaggtgacggacggatgcgtggggcgcgtcaccgcctagctcgagtccatggagccttgttccagcgtcaaggacaggattggctacagcatgatcaccgacgcagaggacaaggggttcatcgtcccaggccagagtgtgctgattgagccaaccagtggcaacccaggcattgggctggccttcatggctgctgccaagggttactgacttgtactcacgatgcccgacttcatgagtattgagagggagaatcatcctgaacgctttttggagctgagctgatcctcacagacccactcttgaggattaaaggagctgttcaaaagggcgaagggctggcagcatagactcccaattcttactttcctctgtaattgatgattgcttgctaacccagagatatactatgagacaacccgacctgaaaatgctgcaaggcacattgagaaaggatcatcgtcttctttctggctttgggacacgtcgtatcttttcttggtcttggaatttcctcatagagctaaagccttatgtcaagctttccgcgttgagccctacccgaagggttttttaaatggttgtaagtctggacctccctaaccaacggatggggctggtattatctcgggggtttggtgggggtctcatttgcaaactctcggtgtttaggtagtgttccttgtcatgcagacgcctctttttataaaagtgtttggggtgttttctcttgggcggtcgcan

SEQ ID NO: 3364 - DNA, 556 bp, Hordeum vulgare
  UNSURE (21): n stands for any base
gcaccatttgatgctttattnttaccactggctgacacactggaattcaaatatacagggcagacttaattcaaatcgctaaacgccagaaggccaacacagagtattccccatttgctacacaaagtgggactcaaacttgcaagggcttaaatgtcagaccaacactagcagggacaccaaaagcttttatttctgtagaggggctcctatgaacggagggatttgacttcggaaaacagctttgcgcgcttgaggagtctcggggatcactccaccaccatgctctcggcctccttcttgatagagtggaagagcaccgacgaaaggtagcgctctccgaagcttgggaatacaacaacaaagagtttccctgcattttcaggcctctgagcaaccttgattgccgcagctgcagccgcaccagaagagatcccaaccagcaacccttctttcaatgcaagagactttgccatctcaatggactcatcacttgaaacctgtacggtttcatcaatgatgtcaacatccaagacaccagggatgaaaccagctc

SEQ ID NO: 3365 - DNA, 552 bp, Hordeum vulgare
gtacccccgggcctgcagggaattcggcacgaggatccctaccctccccccttccccctctctatctcctctccctcctccgtcttgggggcggcgggccatggacgtgcaccacccgccgccctcggcgacatgttcccccacgagcccgccacggaaagtgaagacagcagcacagagtggctctccatctatttagaggactgcttgtctaaccctgcatcctactctgtctccgaagaacaagcatctgtaaacccgaagctgccacatccttcatcttccaatcccagaagaaagaagagaagcctggcctctgtcataagagatagtgatgaagaatatttcacgctgattgttgagccaccgctactacttgatcagaagcactggctagcagagagtgagctcatcctccccaagaaagacaaggaccaagaacttgtccaaaaacaggagcagcaacacgaggaagaatataagccctatacagtgcaggtcaagcaagagcaggtggtgatgaggtgtagcatttgtttgtccgaccaaaca

SEQ ID NO: 3366 - DNA, 555 bp, Hordeum vulgare
ggataacattcgcaatataatgggcgggcataatattgtatcaaccaaccacaggtgacgatgaatccaggactagagaaaatggttctctcaagcgaaagactgactgctagagctaacaaggagtttcaactgagacctaaccggattttcacgtccgattctttcctcctgactgatgatctacatgactacgaccccaatggcctctaagacccgacgcgacagactcgggagatgctcctgaccaccggcacaagttcacatatccgagtgcgagtgcgagtgcgagtgctcgttctcgttctcgacactcatcctcatctgcatcaccttcttgtgagaattggagtgcatgaagctcacgaaggttgggctgttggcgggcctgtactccggcagcagcctgccggacttgtacctcacgccgcacgcgttgcatagggtcttgggccctagagggccgctcctccactgcggtgttgtgtgggacaggcaatgggtgcaccgcttcacttcctcctccagtgggacctcctcattcacatatgtctt

SEQ ID NO: 3367 - DNA, 449 bp, Hordeum vulgare
cttcgcaatacaagcccggaccttgacacctatgggtgtggtgatgatcatcattcattggccgacacaattgtggaaactgatacatatcatgcgtgcagtgatgcaaagtcattgttcggcgagataagtccctctttgctttccttgaatcatctagagcacatggatcttagcatgaactgtttgctagggacgaatagccgtattcctcgattcttgagctctatgaagaacttgaggtatcttaacctatgcggcatgtcatttactggtagagttccttctcaacttggtaatctgtctaagttgcagcatcttgaccttggtcagggttatagcgggatgtactcaacggacatcacctggttaactaagctcccattgctgcagtaccttaggatgagcacaataaatctctcaagggtggatgactggcctggtacgtt

SEQ ID NO: 3368 - DNA, 464 bp, Hordeum vulgare
gttttgaagaattacacgattgatttaggtccagatacaaacccatcatgcaacaacaaagaaactaattaactcatcgtgatcgcagaaagaagttcatagtattcagcaaaagacatccatgattacagtccagaagaatactagtaaagaattgtaaaatcttacatgtatcaggataatctaacaacacaaaagtcttgcatataccacaataattacgccatatatgtatcagaagaactaaacatcttcatctttatttagaggtatataaacaaggcacacgagatgctgcttaggatcttcctcacccaggttaacagtccagagcacacacactggctccttcagaacaacaatgcttattctgcagctgtgttctttgcgaaccttgcccacttcacaactacaaatacatagacttgatcgtacgccttgtcaaagagccgaaagtaagcaat

SEQ ID NO: 3369 - DNA, 517 bp, Hordeum vulgare
ggccggcgccgggaggagagtggcggtcgccgccgtgcagttcgcctgcaccgacacggtggccgacaacgtcgccgccgccgagagattgattagagaagctcataagaaaggcgcgaacattgtcctcattcaggagctatttgaggggcactatttctgtcaagctcaaaggatggatttctttgggcgtgccaagccttataaagagaacccgactataatgagaatgcaaaagcttgcaaaggagttggatgttgtaatacctgtaagtttctttgaagaagctggcaacgctcattacaattctgtggccataattgatgctgatggcaccgatcttgggctataccgcaaatcgcacattccagatggaccaggttatcaagagaaattttatttcaacccgggtgacactggattcaaggctttcaaaacaaagtatgcaacaattggtgttggaatttgctgggatcagtggtttccagagactgcaagggctatggtgctacagggg

SEQ ID NO: 3370 - DNA, 542 bp, Hordeum vulgare
gcatcatcattatattgctttagttaaatatgttgctgccggtcacatcaacatcacatgacggtatttttattgatgttatatattggtgggaaatcaccaaccaagttggaaacgtactggcagatcgctatttatgcagggggaaagacatgaagatctaccgtttgtccgtttggtgttctcccagcattgtggagctcatttcctctttcataaaaagtggaacctaggatgatgatgatgtcttgccatccaacgtcagcagtactttgtatagatcagggcgcctgtccctgaatatcccccagccgtgtctcgtggatttgatctcgtccaagtcgaactctgccaccagcacctcctcgtccttgtcgtttgcgagcttcacgatttctccagttggccctgcgatgaacgagttcccgtagaactttatggtgctgttgccatgctcagtctcgacggtttcctttcctatccggttagaagcaacaaggggaaccaagttagcgccggcatggccttgcatgacacgcttc

SEQ ID NO: 3371 - DNA, 936 bp, Hordeum vulgare
  UNSURE (1),(2),(24): n stands for any base
nnggtcgtatgcgacttgtgcccncattgctggagccatacagaccgtggcgtcactctgtccagcgcctgctgttcctcgttgccccttctgcggcatactgctacagaggttgatgccggagttcctgctctccgtctccccggtatagaagctagggggactttcctgctcaagtgcacgtcgtctctttttgcagtattgtgcgtttgttctttattgctagagtctgccaaaaaaaaggatggaaagcaacgtcatcctgtcgacagcatgatttttttttttgagatgattggtcagcgtgtgcagtggcagggggggggggggtagagctccccccacagccagatagtcaaggcaaaaggaaatggttcaagagaagacagcgctgcacaatacttcatgtcccgtgttggaacgtgacccataattgtcgtgttggacaagaggcctggcggcttacggccttccccgctcttcatcatgttgtacgtatgaatgcccgctttttttttccttttgcctccgacggttcaaaagtcttgtagagcttgtctctggtcaagtgttttatcatatgcccacaacattactttccactgtttggccttggccatactagttcatgtttccctctttttgattttacccgcttatcaaatggcggggggaccaccccgcgggccttttttggtccctaaatttcttaaataatgccgctgtttatatttctttcttcttttttttcttcctcatctccccttctctcttttttctcccctctcttttcttttttcgcgcccgacctccttcgcctttccctttcttcccgctcccctccttttttctcctcgtctttcttttcccgtgtttttttctatcggtcctacttttcactgcgccgtttatttattaccacgaaaatgtaaaaaa

SEQ ID NO: 3372 - DNA, 492 bp, Hordeum vulgare
cttatgtcccacggctcaagcagtggaagtaatcttgtgaacatatgctaaaacacttgaccagatacaagctctagaagacttttgaaccgtcggaggcaaaaggaaaaaaaaagcaaacattaatacgtacaacatgatgaagagcggggaaggccgtaagccgccaggcctcttgtccaacacgacaattatgggtcacgttccaacacgggacatgaagattgtgcagcgctgtcttctcttgaaccatttccttttgccttgactatctggctgttcctcgagctctaccgaagctacagatgccactgcacacgctgaccaatcatctccccgagaacaatcatgctgtcgacaggatgacgttgctttccatccttttttttggcagactctagcaataaagaacaaacgcacaatactgcaaaaagagacgacgtgcacttgagcaggaaagtcccactagcttctataccggggagacggaga

SEQ ID NO: 3373 - DNA, 520 bp, Hordeum vulgare
gccttctagcaagctatatacctacatagtacagccatgtgcccccaccgtgatggcctcatcggccacctccgtcgctcctttccaggggctcaagtccaccgccggccttcccgtcagccgccgctccaacggcgctagcctcggcagcgtcagcaacggtggaaggatcaggtgcatgcaggtgtggcccatcgagggcatcaagaagttcgagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacgatggccggtactggacaatgtggaagctgcctatgttcggatgcaccgacgccacacaggtgctcaacgaggtggaggaggtcaagaaggagtaccctgacgcgtatgtccgcatcatcggattcgacaacatgcgtcaggtgcagtgcgtcagcttc

SEQ ID NO: 3374 - DNA, 553 bp, Hordeum vulgare
  UNSURE (20): n stands for any base
gtccccccgggcctgcaggnaattcggcacgagggtaccatccccagcaacaccttcgcttactacgatcaggttcttgacaccaccgccatgcttggtgccgtcccagaccgttactcatggaccggtggggagatcaatttgagcacctacttctcgatggctaggggtaacgccaccgtccctgctatggagatgaccaagtggtttgacaccaactaccacttcatcgtccctgaattgggccctgacaccaagttctcctactcttctcacaaggctatcaatgagtacaaggaggctaaggcgcttggcgttgataccgtcccagtgcttgttggaccagtctcatacttgttgctctcaaaggctgccaagggtgtagagaaatcgttctctcctctttcccttcttagcagcatccttcctgtctacaaggaggttattgctgagttgaaggcagctggtgcttcatggattcagtttgacgagcccacccttgtgaaggatcttgaatcccaccaattggccgcattctctgcagcttacacag

SEQ ID NO: 3375 - DNA, 491 bp, Hordeum vulgare
  UNSURE (46): n stands for any base
caccgccgtgctaccaccgttagcgctaggttggatgcgcagcagnagaaagctcaaccttccggtccttcccacgaccaccattggttcgttcccacagaccgtggagctcaggagagtccgccgtgagtacaaggcaaagaagatctctgaggaggagtacaccaatgccatcaaggaggagatcagcaaggttgtcaagatccaagaagagcttgacattgatgtgctcgtgcacggagagcctgagaggaacgatatggttgagtactttggtgagcagctctctggtttcacattcactgccaatggatgggtgcaatcttatggatcaaggtgcgtcaagccaccgattatctatggtgacgtgagccgccccaacccgatgaccgtgttctggtccaagatggcacagagcatgactgctcgcccaatgaagggaatgttgacaggccccgtcacaatccttaactggtcttttgtcagaaatg

SEQ ID NO: 3376 - DNA, 519 bp, Hordeum vulgare
  UNSURE (23): n stands for any base
acgtaacacaaactcagccacanatgaacaattcgccactcaagtttacaatacacactgacaaccgcctcaaaagccaccgaatcaagggatgagcacatcctgccgagaaacaactaccctaataaccaacaagtggacacgaggtccagattattcaaagtaaaacgccggccatggcaacggtgacatcctccttgcaattaaaagggggggagagctgctatacgagcactgcttactgcgccttggcgagctcggcgcggatctgcttggcggcctcgaccatgttggtgagggcgggcttgacctcggcgtacttgcgggtcttgagaccgcagtcggggttcacccagaggatgttggtgtcgagcacagcgagcatcttgttgacgcggtcggcaatctcctccttggacgggatcctgggggagtggatgtcgtacacgcccgggccaatgccagcaccgtacaccacaccctcgcggaagacggagagaagcttctcgtcggaccgcg

SEQ ID NO: 3377 - DNA, 519 bp, Hordeum vulgare
gccctcccccgtcgctcgccgccgtccctccccgcctccgcgcacccaggaaagatggcgtcccacattgtcggatacccgcgcatgggccccaagagggagctcaagtttgccctcgagtccttctgggatggcaagagcagcgccgaggatttggagaaggttgccaccgacctcagggcaagcatctggaagcagatggctggtgctgggatcaagtacatccccagcaacaccttcgcttactacgatcaggttcttgacaccaccgccatgcttggtgccgtcccagaccgttactcatggaccggtggggagatcaatttgagcacctacttctcgatggctaggggtaacgccaccgtccctgctatggagatgaccaagtggtttgacaccaactaccacttcatcgtccctgaattgggccctgacaccaagttctcctactcttctcacaaggctatcaatgagtacaaggaggctaaggcgcttggcgttgataccgtcccagtgctt

SEQ ID NO: 3378 - DNA, 557 bp, Hordeum vulgare
  UNSURE (38),(39),(71): n stands for any base
ttttgaaaccgtaacgtaacacaaaaactcagacacanngatgaacaattcgccactcaagtttacaatanctacactgacaaccgcctcaaaaagccaccgaatcaagggatgagcacatcctgccgagaaacaactaccctaataaccaacaagtggacacgaggtccagattattcaaagtaaaacgccggccatggcaacggtgacatcctccttgcaattaaaaggggggagagctgctatacgagcacggcttactgcgccttggcgagctcggcgcggatctgcttggcggcctcaaccatgttggtgagggcgggcttgacctcggcgtacttgcgggtcttgagaccgcagtcagggttcacccagaggatgttggtgtcgagcacagcgagcatcttgttgacgcggtcggcaatctcctccttggacgggatcctgggggagtggatgtcgtacacgcccgggccaatgccagcaccgtacaccacaccctcgcggaagacggagagaagcttctcgtcggaccgcgagttctcaatggtgatcac

SEQ ID NO: 3379 - DNA, 515 bp, Hordeum vulgare
  UNSURE (32): n stands for any base
tcagcccaatgaaatctggagatgtacagaanacatggatcccagctacaagtggacaaacttcacgctggaagaacaggccaaggtcatagttgcacctcggagcaacaacgagatggacgcggcaaagctgaagagagagttccccgagctgctatcgatcaaagactcattgatcaagtatgtctttgagcccaacaggaaggtcccagcaacttgaaagccagaacaggtaataatataggaaacatataccaagcaccaaaagattttaggaatcattcgtcgcggcgattcattagaatgtttttacgatacttggcagcatatctctgttacagattcacagcatcatttgaactatatatttggcagtctgctggtcgcagcaaagatatcttgtaccatgattctgtcaagaaacgaactaatgccgagcacctttaaatcctcttaccttttgtgtgtgaatgatcaggcggcctgtgctctgacaaaaagcatttgaacaagca

SEQ ID NO: 3380 - DNA, 515 bp, Hordeum vulgare
gcttgttaaatgctttttgtagagccaggccgcctgatcattcacacacaaaaggtaagaggatttaaaggtgctcggcattagttcgtttcttgacagaatcatggtacaagatatctttgctgcgaccagcagactgccaaatatatagttcaaatgatgctgtgaatctgtaacagagatatgctgccaagtatcgtaaaaacattctaatgaatcgccgcgacgaatgattcctaaaatcttttggtgcttggtatatgtttcctatattattacctgttctggctttcaagttgctgggaccttcctgttgggctcaaagacatacttgatcaatgagtctttgatcgatagcagctcggggaactctctcttcagctttgccgcgtccatctcgttgttgctccgaggtgcaactatgaccttggcctgttcttccagcgtgaagtttgtccacttgtagctgggatccatgtacttcttgtacatctccagaatttcattgtggctga

SEQ ID NO: 3381 - DNA, 286 bp, Hordeum vulgare
  UNSURE (3),(275),(278),(279): n stands for any base
ggnaattcggcacgaggcaaaagtcccgatcatgttgttgcagttcgagatgaatgctcgtaatcatgtgcagaagctaaaggatttgcatcgaaagggggaggaatgcaaaagtcaataaatgtcgtggcagttcgcgatgaatgctcgttatgatgtgcagaagctaaaggattttgcatcgaaaggggaaggaatgcaaaagtcccgatcaatgttgttgcagttcgagatcaatgctcgtaatcatgtgcagaagctaaaggatttgcatncgnnaaagggg

SEQ ID NO: 3382 - DNA, 536 bp, Hordeum vulgare
ccaggctatggtgtgtatacatgatggcataggaacgtggcagtacaaatgacaaggtaaatgagctcatagcttatataaatatagaaaaggagcagtgcataccaaatccttgagcctccgcacgctccagcctctacgactctgcttcaagtcgtgcatgtccctcgtacatgcgtccgtccgtaacaaaggaaaataagccaacatctgcttgaacaaatcaactctgaacacctgcacctcgaactggcaacgaccttgcttcagtccactgcgtgcggatgttggcaggaatacggcaccgtcaaattgagatgccacttaactgcacgtcacgaactcacgagcacccatctccaaccgactgccacgacacgtttgctctgtgtaggcccgtggtaaaaaaaatggtttcacagtgcactgtatctgtactattccccagtattttatttgacgggacagctgcaggggtggttcacagtgcatgtccatcacgtgttgacatggtgctactgtgaacttgttgaata

SEQ ID NO: 3383 - DNA, 387 bp, Hordeum vulgare
atccacatccccaccggcttgctccctctctctctcttgggcgatcaagcgcgtttctttgctgctgcttcttcggcggtcttgttggcgatgggggccgggatggtggaggtggagctggggccagggatgggggcggccgagtccgtgccgccggccaagaggaggcgggtggtggccctaaagaccgcggcttcggcggcgggaaggaggccgcggcgcgccaggaggccgtccgccatccagcggctcttccaggcctgccgcgccgtcttccgtggccccggcaccgtgcccgcccccgccgaggtcgccctgctccgcgccatgctcgacagaatgagaccggaggacgtcggcctaagctcggaaatggccttcttcagg

SEQ ID NO: 3384 - DNA, 320 bp, Hordeum vulgare
ttttttttttttttttttttttgaaatctatggatgatcttctatgtattgagaaaaaagatcaacaaagggatctcctggtcaaggtccacgtacacagctgctgcaaaagcaagcaagcaagcactcttacatggtaaactgccataactgattgagacatcatgcacaaactgagacctattcttatggctcaactaactagcttgctgctgtattcacaaggtaaacaacgattctgacaccatctggtttgagttgggttgacgcttgatagctcatcatcggtcgcaaaagggctggaaggaaaggatcatcga

SEQ ID NO: 3385 - DNA, 499 bp, Hordeum vulgare
aaaaagttgctcttctcgtgctcacgctacccaatcacatactcttcaatcggttcatgtgggactatgtcaggcagaccgactcgaagctacttctgacactgcctctcaacctgccatcgattataatgacagatgtactttctgtgcgggttttagggctgttgggagctatctattctctagcacagtacctgatatcaaggcggataagaattgctgggatgaaatatatttgaagttttgaggaaaatcttgtgtcttggcgcaactgctgtcagcctagtcttcaacttcctgaagcagatccttgtggtagagagaatcagagaaacaatgctcgatggtaatcacttttgtactggatgatcgttatactcgtttacccttgaggtgttgtactgtagatgttttgcacaggacataaaatgcatcaccatgggtcctttactatgggcttgtagcaagaaagaagcgaattgctatttttcacttgact

SEQ ID NO: 3386 - DNA, 505 bp, Hordeum vulgare
attagtcaagtgaaaaaagcaattcgcttctttcttgctacaagcccatagtaaaggacccatggtgatgcattttatgtcctgtgcaaaacatctacagtacaacacctcaagggtaaacgagtataacgatcatccagtacaaaagtgattaccatcgagcattgtttctctgattctctctaccacaaggatctgcttcaggaagttgaagactaggctgacagcagttgcgccaagacacaagattttcctcaaaacttcaaatatatttcatcccagcaattcttatccgccttgatatcaggtactgtgctagagaatagatagctcccaacagccctaaaacccgcacagaaagtacatctgtcattataatcgatggcaggttgagaggcagtgtcagaagtagcttcgagtcggtctgcctgacatagtcccacatgaaccgattgaagagtatgtgattgggtagcgtgagcacgagaagagcaacatttttcac

SEQ ID NO: 3387 - DNA, 516 bp, Hordeum vulgare
  UNSURE (32): n stands for any base
tctccgtctgcgacgtctccgtgcgagccggngggagacgctcatggagacggtgaagcagaccttggacggcaagctcgacatactagtaaacaacgtgggacggaatctggcgaaggcggcggtggagtggacggcggaggagtactcgcatctcatgtcgaccaacttagagtcggccttgcacctgagtcagctcgcacaccccttcctcctccacgccgccatcgccggaggaggcagcatcgttaacatctcctcaattgcaagctcacttggataccccaccctcgcactatactgcatcacaaaaggaggaattaatcagctcacgaggagccttgctgccgagtgggctccagacaagattcgtgtcaactccgtcgctccgggtgggatcaataccgagctgcaaaagagtgtggatccggaggtcactaaaagtacactgttgcgaactccaatgcatcgacttggtgagccagtggaggtggcgtcgacggtgtcgttcctttg

SEQ ID NO: 3388 - DNA, 551 bp, Hordeum vulgare
gagaacacagattaaaaggatccaatttttagacacacgaactacatgaacaaataccaaatccatatggatcaatgaagagaaataccgacataatcacacaccattcatcaaagagacacctcacacgcgcttcaacggcgctagatgcaccgccggggctaaaataattagccactaatggttcgacctccatcgacatagatgacctggccggtgatgtatgaagctgccggcatgcaaaggaacgacaccgtcgacgccacctccactggctcaccaagtcgatgcattggagttcgcaacagtgtacttttagtgacctccggatccacactcttttgcagctcggtattgatcccacccggagcgacggagttgacacgaatcttgtctggagcccactcggcagcaaggctcctcgtgagctgattaattcctccttttgtgatgcagtatagtgcgagggtggggtatccaagtgagcttgcaattgaggagatgttaacgatgctgcctcctccggcgatggcggcgtggaggaggaaggg

SEQ ID NO: 3389 - DNA, 518 bp, Hordeum vulgare
cagttcagagatccagcacttctgagcagggaaacccaagcagtgtctccagcctgtctggctcagaggtgacaagcttgtatgatcatgaagatgtggaccactaccacaactttgagcacctccgcacacacttcttcaccccgctcccgagcatcatggacggtgagcatggggccggcaaccccttcaagtgggcagcagcctccgatggctgctgcaacctcctcaaagcatgacttgagggggtaccggacagctgaaatatcaagagatggcgcaaaccggcagcatctgccggcattgtgtctagctccaggtcagggatcgtccctgccgtcatctggctgtccgtgggcaattcattcttggctcatggcatcggtagtgctttcgctcatcgcctacttgtcctcggaacttgagtgctagtttccaggatcctgtggtgagtgaaacaccccctttgccataaaaaatatattatctaggtaagtacaactgcctgctaccatcat

SEQ ID NO: 3390 - DNA, 544 bp, Hordeum vulgare
aaccatggccaaggtctcaatacatcactgaatttaggtgtcaacaccagagagtgcaaacaaaccaagtctacacacagaaccttcaagccaactattacaacacatcaccaagtttacttaacatacttcaatacttctccaaacaaacgccataccaatacttcatacgaactccgattccagtaccattccaactagtctgaagtttcagacattttattcaaacagaaactttaaacctgctaccgcgaaagggccggatgatggtagcaggcagttgtacttacctagataatatattttttatggcaaagggggtgtttcactcaccacaggatcctggaaactagcactcaagttccgaggacaagtaggcgatgagcgaaagcactaccgatgccatgagccaagaatgaattgcccacggacagccagatgacggcagggacgatccctgacctggagctagacacaatgccggcagatgctgccggtttgcgccatctcttgatatttcagctgtccggtaccccctcaagtc

SEQ ID NO: 3391 - DNA, 493 bp, Hordeum vulgare
cgcagagcccacgaggcaaaacagaagggccgccattctggatatggtaagcgcaggggtacaagggaggctaggcttcccaccaagattctgtggatgaggaggatgcgcgtgctcagacgcctgctccgcaagtaccgtgaagcaaagaagatcgacaagcacatgtaccatgacatgtacttgaaggtcaagggtaacatgttcaagaacaagcgtgtgcttatggaaagcattcacaagtcaaaggctgagaaggctagagagaagacgctctctgaccagtttgaggctaagcgtgccaagagcaaggcaagccgtgaaagaaagattgccaggagggaggagaggcttgctcagggcccaagggaccattcagcagctcctgctcaacctgcagcggcaccaaagaagtcaaagaagtgaagatctgacgtttaagctttctgtttactcggtgaaatcagtttggtcttatctaaattttcaagta

SEQ ID NO: 3392 - DNA, 546 bp, Hordeum vulgare
  UNSURE (20): n stands for any base
gtctccccgggtctgcaggnaattcggcacgaggtgcgactgaacctattgtcattcttggctttggagagatgggacaggctccttgcaaagtttttggctgcaccattatcattcgggctcgagcgaaatacagaaggatggccgtatgtcgcatttgatctaaatcctgctgttgtaaagtcagctagaaaatcaggattcccagtgttatatggagatggttcgcgcccagccgttatgcaatctgctggcatatcttctcctaaagctgtcatgatcatgtatacagggaaggaagaaacggtcgagtctgtcgacagattgcgacaagcttttcctgcggtccccgtgtatgttagggctcaagacatgtcccatttgttggatctaaggaaagcaggtgccaccgatgttgttctagaaaatgctgagactagcttgcaactcggctcgatgcttatgaaagggctgggtgtcatgtctgacgatgtatctttcctgagtaagcttgtgagggactcgatggaattacaagctcaggaa

SEQ ID NO: 3393 - DNA, 517 bp, Hordeum vulgare
gcttatgaaaagcttcagactcgacacaattagacaacccgaactcgctccacattatttgttctgctggagctggaaatgtaagctctacattcaggagcagcccatttcacagtccatgttcatatctgaagggcatcagcgatcgagctagcaaggctcaacacctcaaatggaggttgttggctgatggctttcaccgtttgagggcatgaatccgtgatccagaagtaagcaaactggtcacctggctcagcagaattagcagtcatgaagcgttcatatgactgattggggaacacagcatgagttacataggcgctaacttttgtagcaccatgagcagccagaactttctggcactctctaagagttccaccagattgaactaaatcatcaacaataacgacatgtcgcccttcagggttcccttctttaatccggactatcctcttgtcgccttcacggaccttcgcacagacaaccactgggaagttggccaacgacttgtggaagc

SEQ ID NO: 3394 - DNA, 517 bp, Hordeum vulgare
  UNSURE (23),(27): n stands for any base
cagtcaactaaaaaacaactcgncagnaagcaacaacatccgacacccaaatggaacaatgccaaaaacatgcagcatttccagcacaccataaacgcctaaccatattccagtaaagtgatattaccagttgcacatctcgagacagatcatgagtcgtaatacatacaaactttcgtgtcaatgtcatatgaaatgtgactaccatgtcagacaagagtaagtctggtgatgcatactgacatttcagcgaaaggaagttgcgagcttaatcttcagcttctgttggcgtgtagacagcttcaacttcagtgattgtagcctcggcctcaccgatctcagtgccttgttcatttgactccttcaactccgccagtgttgctttcaggtcggtcagtgcagcttcaagtcgcttatggcagtccgggaccatcatcctcgactcagccaaaacattttcctgctgcttgagatcataggtgtcggcgcccttctccttcatgtcggcggtcttggc

SEQ ID NO: 3395 - DNA, 362 bp, Hordeum vulgare
tgttgggggtatcaattttggtgctcaactgtgacaagaccatctcactgtgatgctatcagccagcaaatcaggacattcatccagatgagaaccaacctcaaggtggtagacaactctggagccaagcgggtcatgtgcatacagtccttgagggggaagaaaggagcgaggctcggggacatgataattggttgggtgaaggaagcgcaatctcttggcaaggtcaagaaaggtgatgtggtctacggtgtggttgtccgtgctgctatgaagaaagggcgcagtgacggcagcgaggtccagttcgatgacaacgctatagtcatcgagaacaacaaaggcgagctgattggcactcg

SEQ ID NO: 3396 - DNA, 448 bp, Hordeum vulgare
  UNSURE (2): n stands for any base
anattaaatgtgctacaaaacttgatcagcgggtggcttcctatagtttgattggttcacattcagctgcacactaagcaaatgaaaggtggaataaccagcaggggcctcctatagttttggggtacattcttccaaacacaaattaccaaacgaaaggtggaataaccagcacgggcgaccaaaacatccctggagcaaagttaaccccattccccggtaaataaaagcaagatatgactaagcagggtaaggtcttaaactatgtgctcagccaacgccaagatcttgagatgcttcttcttcctgagctcgtggggaacaggaccaaagacgcgagtgccaatcagctcgcctttgttgttcacgatgactatagcgttgtcatcgaactggacctcgctgccgtcactgcgccctttcttcatagcagcacggacaaccacac

SEQ ID NO: 3397 - DNA, 87 bp, Hordeum vulgare
catgacttatctatggcagcataagagttccaaaaccgatgagatgggtaatggacttagttagctacagttttcttcttacttcta

SEQ ID NO: 3398 - DNA, 552 bp, Hordeum vulgare
gctgctcctattctttgataaatggtctattaaatggacctactcaaatgtcctaatttttaaaagaatctccttagaagccctatccaaagaaaacagcagactgctctagtcttcaaaaattgtctcatcagaaaacaaaatacccagatgtcctaacctttaagaaagtatcattagaagtcttttctaaatgaaatagttggctgctcctagtcttaagaatagtttcatcaaaaacccctattcagatttcctaatcttaagagagaaaatctcattagaagacctatctaaatgttcctacaaggcaaccaatttagtcagcgagggacaaaaggtagcaaaatacagttgggttgtcccatgttacaagttacattttccacatggtccacactgcaagaacaacgtaattagcagcacgcaagacgctcatctgaagcaccttcaaataaacagccattcatgatatctgcaatcacccacataaaagtaaagttagaatctggattatcgcagatgccaacagaaacctattgtttgccaatg

SEQ ID NO: 3399 - DNA, 520 bp, Hordeum vulgare
  UNSURE (8): n stands for any base
gccatggngcccggctacgtaatttcgattgatattgccagagacatcgcatcccgtcacgcaaatcagtcactaaggctgttcaagatggaggatgtgagcatgggcatgtgggttgaagactacaacactaccaccattgccgccccggtgcagtacatccacagctggaagttctgccagtacggctgcgtggacaactacttcacggcgcactaccagtcccccaggcagatgctgtgcctctgggacaaactgtcgttaggccgcgcgcaatgctgcaactacagatgacacggcgctcatccatgaccgcttcacgagggcaaccgacgacttaactaggcggcatccgccagtcccactgccgtagtgtcattttagaagaacaccagggaccaggccagcatgacaaccaccagaccgcccgggtgtccatcatccttaactcacagttccctacatctgctccatcggctgacggcggcggagaccatggacctcaccattgtctgctcct

SEQ ID NO: 3400 - DNA, 542 bp, Hordeum vulgare
ttttatattagatcctatagaacacgacaccaattcagtatcaacgagacatcagctccctctgcaagccaagggacacaacaaccctacaaaccggagtacaaaattactcgcccctgtacattacacgcggaaaattttggctcctcgtgtttgcatagtcatcttcaatcaatgaacccaacagatagcgtcttccactacaagtagattcatccatccacatatccaaatgtatgagctccaggaggtgaagcaccattgatggcgtatcttgtttgtgtacaactgaggagcagacaatggtgaggtccatggtctccgccgccgtcagccgatggagcagatgtagggaactgtgagttaaggatgatggacacccgggcggtctggtggttgtcatgctggcctggtccctggtgttcttctaaaatgacactacggcagtgggactggcggatgccgcctagttaagtcgtcggttgccctcgtgaagcggtcatggatgagcgccgtgtcatctgtagttgcagcattgcgcg

SEQ ID NO: 3401 - DNA, 517 bp, Hordeum vulgare
ctttaagttcggcaaatggagcagctgcagcagagaggtatcatagtcgatctcgtgacacttctcctggtggacaaaatcagatgcaccataatttcaggcctcttcagcgtgagaaattgtccaagggaaaagatggttttgttgctgctgactttgcaactacagaaattcgtggtgctgtaccgttgaatccaatattgtggtttcatcaggcagaggagcgcatgtatttatgcgtttatcagcacaagaaccttactatcttgctagtgattccagcttcctcactgataaatggagaagagggcattgctcatgtgaagaggcatcttcttgaaaatgcatcacagaacattgtcagtgttgaacaaaaattatcacgaggatggggaggagaaaatgcctatcatgttggtggataccgctacatactctctgatccaaacagaaaagtatcaagagcctccccacctgggaaagtcatcaccctgtcaaaggattctctacttgccct

SEQ ID NO: 3402 - DNA, 540 bp, Hordeum vulgare
tttctctggagaaggttaacttttaaggttaagccatctacaagtccacagagaaccgcgcccgtaatacatacgagttagtagtcctccgtcaggcatttacatatagaaatgagttgttgttttccaaaaaacataaaatagaaatgagcatgttcgtaagtggtcgcagaacgttaatgctggatcctgctctgcattatttttattccaaagggcatgcagctgtacaactggtacgaatccagttatcgcatgagtaagatcgacatcaattacacacaggtaagggagtgatccagtcgagaaccatgtgcagtgctggactggatctcatactagcagtgcgttcagtctgtagagaatgccccctcgcagtacctgttgctgaatttctcaacagctgtagatgcgtagagaagtgtttcgccgcccttctctatagccatatagagttcttttcctcgagaaattttagcaataatccatgcattatttttcgctctgatgcatacttcataatccttgtcatgggtaggg

SEQ ID NO: 3403 - DNA, 518 bp, Hordeum vulgare
ctctccccctcccgacccggagctcctccaccgccgccgacgccgacgacgactcctgacgcgcgccgccgctcccctcctcctcgggtccctccgtccgcaatctccggagccccggttttcgagatcacaacaccatgctttccttgaggtgttgggcgcccacattcggtttatcggtcgacagagccgtcgtcctgcgcccgcgaaagttcaactccctagtggtttgcggcgccaggggtccgaggccgaggtttcctcgcgtgtggaaggccgacaagagaatcggaaccgtctccaagtcgcagaagctcgtcaaatgtattaaggatttgtctaatgtaaaggaggaggtttatggtgctcttgattcatttgttgcatgggagctggagtttcccttgatagcggtgaaaaaagcactgaagacgcttgaagatgagaaggaatggaaaagaataattcaggttatcaagtggatgttcaataaaggtcaagggaagacaatgggaagc

SEQ ID NO: 3404 - DNA, 524 bp, Hordeum vulgare
cagggattttttgttttgtttcagatcaagcacggaattcctcaattccatgtcaaacgccttacactgtagacataatttttgattcaatcctttacattctacattctccaatcctatgttaaacaccttacattacattgtcacacaaatttcatgacttctttgcttgggtgcttgtaagaacttggagagaccggtgaaatgatagttatttaatttctttccaacatcatgatatgatgtactgatgtctcccaatttgtagatggaataattcagacatgttctttgtagattccatgaaacaaaactagaaaccagccaattttacccttacctgctttcatggagcaggcacgaagcaccaaattcaagctctgagctatacaaattcaaggtctccagaagcagcatcgcctaatacattcctgtccaggcttgttttcggcgtttcttccaattcattgtcgagattcatgcttcttgcatcttccggttcacctctgttagagtttctttgt

SEQ ID NO: 3405 - DNA, 496 bp, Hordeum vulgare
aggacgtacatatatagttctcaacccctcgctcaaacaatcatcagctagcagcctcgaatcatcagcatggcttctgctggccgtcgtcccacggtgctcctgcagatcgctctcttcgtcgtcgtcgcggcggtcatcatcaacagctccgtctgccttgccgccggtggccacgacggcaccggcactgtagtaattggtccaggcactggtagtggtagcaacgacccaaaccatcctgttttcccgtcgccgcctggtaaaccctacaccggccgtgggtgccgcacagtttacggatgtagaccaccggcaggtggccaaccctgattacacccgtgcgcagacccccccatcttccaaaacaatgcaaggatgaaggatgaagaaccgaacgggcggcctagatgcttatattatatgcatgcatgcatgcctgcctccttctatgtatctgatgtatcatcacaagttactctactgatatgtacga

SEQ ID NO: 3406 - DNA, 544 bp, Hordeum vulgare
taccagttttattcgagtgcagtaggtggtatatacacgagatgatatgtactgtataaggtcgtacatatcagtagagtaacttgtgatgatacatcagatacatagaaggaggcaggcatgcatgcatgcatataatataagcatctaggccgcccgttcggttcttcatccttcatccttgcattgttttggaagatgggggggtctgcgcacgggtgtaatcagggttggccacctgccggtggtctacatccgtaaactgtgcgatacccacggccggtgtagggtttaccaggcggcgacgggaaaacaggatggtttgggtcgttgctaccactaccagtgcctggaccaattactacagtgccggtgccgtcgtggccaccggcggcaaggcagacggagctgttgatgatgaccgccgcgacgacgacgaagagagcgatctgcaggagcaccgtgggacgacggccagcagaagccatgctgatgattcgaggctgctagctgatgattgtttgagcgaggggttgagaactat

SEQ ID NO: 3407 - DNA, 350 bp, Hordeum vulgare
ctccgtcaagtctgcatccatccagtactgcatccagccaacccccatccatctacaagcagcagccaccaagtttctgtcaagatggggttgtcttcagccgctgatatcgatggggcgcagctgtgtatcttcgacctgaggagagggcagcaggaggggcaggagctcgacaagatcctcttcttccacccggctgactgccccatcctgctccagctctccgtcattggcctctgtgaaggaatcatcactttcacaagaatattttctccagaagatgactgtgaggtgatagaatctgacaaacactcccacgttttttaccaagctgagccagatatttggat

SEQ ID NO: 3408 - DNA, 533 bp, Hordeum vulgare
cccgcaatacatacgagttagtagtcctccgtcaggcatttacatatagaaatgagttgttgttttccaaaaaacataaaatagaaatgagcatgttcgtaagtggtcgcagaacgttaatgctggatcctgctctgcattatttttattccaaagggcatgcagctgtacaactggtacgaatccagttatcgcatgagtaagatcgacatcaattacacacaggtaagggagtgatccagtcgagaaccatgtgcagtgctggactggatctcatactagcagtgcgttcagtctgtagagaatgccccctcgcagtacctgttgctgaatttctcaacagctgtagatgcgtagagaagtgtttcgccgcccttctctatagccatatagagttcttttcctcgagaaattttagcaataatccatgcattatttttcgctctgatgcatacttcataatccttgtcatgggtagggtcactcctcttagctcttgacttctcaagatctacttctcctcttagcctgtt

SEQ ID NO: 3409 - DNA, 519 bp, Hordeum vulgare
cggatgagaaacatgagcgcagaagaggctgcagctgcagccgctcgtgcggttgctgaggcggacgctatcatggcggaagctgaagccgcagtgagagaagcggaggctgcagaagctgatgctgtagctgcacaagcctttgcagaagcagcaatgttgaccttaaaaaacaggagttcagcaaaactgatcattcgaggttgagacatcttgtgggagctgcttcagcgtccgctttcctctgaccttgttgtgcgtgcgtgcatgcctgctgaattccagcgcaaactaactaatgctttggtgttactggagtcatctgaagcgatggcaatcccgatcggtcatttgaaatcatgcaagtccattcagattcaagcggtgcaaacttgcttggttttctgacttgcaccttgaagctagtttcctttctccctcgtgccggtttgccgagggatggaggaaggccaaatcatatttaaccccaacatggcagaaccgtagatgggatctgca

SEQ ID NO: 3410 - DNA, 548 bp, Hordeum vulgare
  UNSURE (18),(19): n stands for any base
caattttgacaaatatannctggataccaaacgtccaaccgctgcttatccaagtaccaacacaaaaccaagatcaataatgcccaatgttgtattaccaactattttggcttggcaaaacttatagactgaatacatgaataaattctatacacatgccgcaattattgggtgccaaataacttgagctgggccaggccagatcaacaaacaccacgagcacaaaggcattgttttgctgggaggatcaccacggtgaacaaatttccaacatgccaatgacctaaaccatgatagtaacaagggtccagagagatggaatgaccatcacctatttattgatcttctcctcatcatcccacagacgtgcagatcccatctacggttctgccatgttggggttaaatatgatttggccttcctccatccctcggcaaaccggcacgagggagaaaggaaactagcttcaaggtgcaagtcagaaaaccaagcaagtttgcaccgcttgaatctgaatggacttgcatgatttcaaatgaccgatcggg

SEQ ID NO: 3411 - DNA, 525 bp, Hordeum vulgare
  UNSURE (33): n stands for any base
ccgggctgaggaattcggacgaggcctcgctcngaatcattagcagcagcctcgaatcatatcatggcttcaaccggtcgtcgtcccagggtgctcttgcagatcgctctcttcgtcgtcgtcgcggcggtcatcatcaacagctccgtctgccttggagccgtcgcaggctctggtgctctcgaccctaaccgccctgatttcccgtcgccgggtggtacttccggtggaccatacaccggccggccgtgccgtacaatttacggatgtcgtggtggaccacccgcaggtggtaaaccctgattacacccgtgcgcatggaccgacatatgtaactgggaaatggccgcctagatatgcacgcatgcctcgtcgtacttatcagcacaagttactctactgtcacgcaccaccttacacacagtaatgataccgtctcgtgttgtacgtgcctagttaattaaactcgaataaagctggattcttgcatgtctggaaaaaaaaaaaaaaaaaaaaaaaaaacct

SEQ ID NO: 3412 - DNA, 467 bp, Hordeum vulgare
  UNSURE (33): n stands for any base
gcatgcaagaatcacgctttattcgagttaatntactaggcacgtacaacacgagacggtatcattactgtgtgtaaggtggtgcgtgacagtagagtaacttgtgctgataagtacgacgaggcatgcgtgcatatctaggcggcatttcccagttacatatgtcggtccatgcgcacgggtgtaatcagggtttaccacctgcgggtggtccaccacgacatccgtaaattgtacggcacggccggccggtgtatggtccaccggaagtaccacccggcgacgggaaatcagggcggttagggtcgagagcaccagagcctgcgacggctccaaggcagacggagctgttgatgatgaccgccgcgacgacgacgaagagagcgatctgcaagagcaccctgggacgacgaccggttgaagccatgatgatgattcgaggctgctggctaatgattcgagcgagg

SEQ ID NO: 3413 - DNA, 552 bp, Hordeum vulgare
gtacccccgggcctggcaggaattcggcacgagggcaaggcaacctgccttacccacattccctgaatgtgcgttgcttcagtcaaccaggaagatcatgacaaatagaccagagattggatcaccgtcattccatttgacctggtaatgaactgaaaaagagactgtcaccgctgagaacgagacggcacagggagtggttcttctccagtgtaagctagctgctggaacccactgagttcaagtccgaaaaaggattggactctgcgacatcgaccgacgcgacgctataccggaaagattaaagaaaggtatagacttttttcaaatgaaatttgcgaattgaaaatttgggcaaattgactcagttcttttttccgaaaaaaggtttcccccgaacccccttccaaaacgagtagaagggaaaagactagacctattctatagataaagtctagctttccctactattttaaaaggaagattggaacaggaaactaattcaacggacaacggaaaagaaagctaagctaaagacaggactcgctggag

SEQ ID NO: 3414 - DNA, 548 bp, Hordeum vulgare
ttctgaattagatgaaatagcttgggcttcccttattctctcttttcagtccttttatttcctttccttcatccggaatggagaggaatcttgttgaaggaaaggaacggaggtagatcgatcctcagatcgtaggagaacaggacccctaaaaagctccagtcaggaaagccagggctctgagctcttatcccttcatgggtaagagcgaaagcccgcagtcctgggttctaggctgcttcagtagagtcagcagccgtaagcccaggataggggagacatggcctttaggccgtatcgacccgatgccgaaggactgttcctagcctcgaggagtgaatccgagaggcgtgactggagccactgaggggtactgttctccgtagagacgaggtgagatctaccggagagggggaaacaagattacgcggagtggagcgtactcctccagcgagtcctgtctttagcttagctttcttttccgttgtccgttgaattagtttcctgttccaatcttccttttaaaatagtagggaaagctagacttt

SEQ ID NO: 3415 - DNA, 550 bp, Hordeum vulgare
  UNSURE (20): n stands for any base
gtacccccgggtctgcaggnaattcggcacgaggggacggacacccacccacccacccacgccggatcgagcgcctcctcccgcccccgattgacctgcaaaacacactagattttatgatccaagaacgtgtggggagctcctagaagaagaaccaagttgatcctgcaaaattgggtagctggtccggcagggctggcttcagaagatcagccacggctctaaggaaaggaacccgcgtcacaccaagaaggggaagacaatgtgtccatcgctttcctaagtttctgctcgcatcgccttctttccacggtggccgtggtgccctcccatctgcaggggggcatccttctgacctcacctaccttgctggtggtggtgctgctgcacaagtctgaagtaggcttttagctttgtagttagttgagttcgtagtctatataataagaattgtaagtatggtgtcggccaccaaactagaaggtggatattcttttgacagcaagaactctcctctggatcaacctgaaggtgtgaagatacatcttta

SEQ ID NO: 3416 - DNA, 545 bp, Hordeum vulgare
ggagaaagcaagctttattcatcaacccggatgtcttagacatactgtatgtttatagtatttaggcataaacaccaaacacagggaatggaggagcacgatacacgacgtctatagttgcagttacattgtgggttattttacataatgaaccgacacacgaactgttgatggttgcatacagcgtaggcttaggtaacaaggtcatcagctatagcgcaacagagttttttcaggtcttcaaagtcaccatcttggaacgagaacgaagccatcctattggaaattccagtctcagaagcttgctcgaaatcaactttggtgtgataaacaaagtagccacagcactcccaggcagaaagatagcagccagtgaccagatttttcacctgggggaataagaaagcatttcttccattgttggatatcattaggctgtgtgcagtattgttctcatgcaaagctaagcatgctgcactgactacatcgataagtgcgtttacattgttgctggtgaacacaatagcttttagagggtaatcaac

SEQ ID NO: 3417 - DNA, 356 bp, Hordeum vulgare
  UNSURE (25): n stands for any base
gcacgcgcgcgcgcgcattacgggnggaatttgtattttatagatgacctgggctgcgactcttgttatgggcgcaagacaaagaacgaggacatacggccagggccactgcgtccagcaaatatcataaggaataaatttcctacctacaagaatggttcgaatggcatagtgatcaagctggcagatggcccagaagtgccgcctctcaaggaggttgttgctaaggagaccgaggaactgcttgatcgccgtcagcgcttctcagtccgtgagcttgcaatgaagtttgagaagggactcaacactgccactctgttgtctaaagaggttaaatggagacaagtggctttgtt

SEQ ID NO: 3418 - DNA, 360 bp, Hordeum vulgare
  UNSURE (16): n stands for any base
caactaacaacacatncaaacattttctcttactgtgtaacacgtcaaacttagcttactgtcgtcgcatggtatcaaaaacaagagagaaacggctagcaacagacatatcgcaacgcctgtgaagaagaacagcacgcgcagtcggagaacaacgccgaggcggctaaaacgatgcccacggtgccgcctctgagagctaccaccacaaggccacaggggaacaaaacccacaggctacaacatatcatgaaattacactaaaatgtacaacatcatggtcaccggtcggaccgcagctcggaggcacaagcatccagcaccagtgcgccgcccttcaccagggggtcttgtcgcccg

SEQ ID NO: 3419 - DNA, 441 bp, Hordeum vulgare
aaagatggacgaggaagggatcccgacgccgacggcttctttttttcccaaggggtcaacctgccgccaccttctgccggcaagtgtcttcagagaacaaattctccaacttgccgggattgcttgtcatgaagacgaggaaaaatcacggacaaagctactagagaagctcgaaacatgtaacaagcactaagaaggatgaattggtgacaatagtgatggagttcttgatggaacattgttctggtattatttacacagatcctgataagtcatttaagaaaagaaagcgcaagaagaatgtagcgaatctatctggtggcgaaccttccaggaaaaggaaacatgatggaactgtactggaaattcatggtgaagaggaagcagatgggagaaaagctgtagaagatgaaacaaattattccgaggtctgcttgaggg

SEQ ID NO: 3420 - DNA, 535 bp, Hordeum vulgare
tcttaagctaaaaggtcgacacaacaagccttacagtcattgacagcacaatttacacctgatacagtcttatggaacaccttcacaaactgtcctactggttgggattacagtggggctgaaacaagaacacggcatcagcttagtacagcccttcatcggaccacacttattgggcttggcagttatctttagccttcacatcgtccacgaactagcatgttcgcttgaacctacatcagtttgggtgttcagaatcttccgctttaccatcatcatccgcgccttggttcagaaattatattaccacagatagggtaatctcattgccactagcttcccaagatttgacatcttctgcttctgcttctggttctggacagcttacgtgttcgccgctttcattggctttagattcttcaggttcacagtcaccagcattttctgcattagcatttccagcatttccggccctgccttcttcagatctgccatctttggtgtcatcattttctccagattcgagatcttcaca

SEQ ID NO: 3421 - DNA, 518 bp, Hordeum vulgare
ctaattttttgtccgaagagagaaacgacaagtaaaaggaactcttaaatgaaaaggcacagtgaacctgactgttggaattagttttctctgccaagggttcccacgagttgttttgaagaaagaccaggctggagcacttcggcgtgcgaactccatcagtgcagggatcggcgacggaaagaatgtcgacctggattaccggagcaaattctgcgggtgttgcgctgctctttctgaaacatcactgaagggaagatgatcatgttcatggaagcagcaagttctgtgaaacccattctggagaagagaccctgaaaagagatggtagaaactggcggctgtgtaaccatgagaaatcttgcatccgaaaatgcactcactcgctgctctgtaacattatacactgatgctactaacatcctgttgaagaaactcctataatccaggtttgtcctgtaacacaccgcgtgccgcgctctgtaacatttcggggggataatagtgctcttgtcaaa

SEQ ID NO: 3422 - DNA, 496 bp, Hordeum vulgare
atttccccccgaatgttcagagcgcggcacgcggtgtgttcaggacaaacctggatttaggagtttcttcaacaggatgttagtagcatcagtgtataatgttacagagcagcgagtgagtgcattttcggatgcaagatttctatggttcacagccgccagtttctaccatctcttttcagggtctcttctccagaatgggtttcacagaacttgctgcttccatgaacatgatcatcttcccttcagtgatgtttcagaaagagcagcgcaacacccgcagaatttgctccggtaatccaggtcgacattctttccgtcgccgatccctgcactgatggagttcgcacgccgaagtgctccagcctggtctttcttcaaaacaactcgtgggaacccttggcagagaaaactaattccaacagtcaggttcactgtgccttttcatttaagagttccttttacttgtcgtttctctcttcggacaaaaaattag

SEQ ID NO: 3423 - DNA, 502 bp, Hordeum vulgare
ggggatcgtactactacttgagtctcactagcactagcactagaagtctagaactactaggcttgatcgatggagcaggtgacgaagctagcggggcagcgggcggtggtgatcttcggcatgagctcctgctgcatgtgccacacggtgacgagcctcctccgggatctcggggccaacccgatggtagtggaactggacgaggaccctagggggaaggagatggagaaggcgctggtgcggctccttggccggaaccctgctgtgccggtggtgttcatcggcggcaggctcgccggatgcaccgacaaggtcatgtcccttcacctcggcggcaagcttgtcccgctgcttcgtaatgcaggtgctgtctgggtgtagtgcatgtgcatgggagggctttgtagatattatgggtgtaatgcatgcaggtgctgcttcgtatgctacgtgttctctgttaccttgtatcaggtgatgacgaagactaaggcaaaccatg

SEQ ID NO: 3424 - DNA, 525 bp, Hordeum vulgare
ttagtttacataagggatattttacatgtctttgttgtttgtaggacagtaaactagttattacactgggacattgggtaacaccttgaccggacacgtcgacttgcatggtttgccttagtcttcgtcatcacctgatacaaggtaacagagaacacgtagcatacgaagcagcacctgcatgcattacacccataatatctacaaagccctcccatgcacatgcactacacccagacagcacctgcattacgaagcagcgggacaagcttgccgccgaggtgaagggacatgaccttgtcggtgcatccggcgagcctgccgccgatgaacaccaccggcacagcagggttccggccaaggagccgcaccagcgccttctccatctccttccccctagggtcctcgtccagttccactaccatcgggttggccccgagatcccggaggaggctcgtcaccgtgtggcacatgcagcaggagctcatgccgaagatcaccaccgcccgctgccccgctagcttc

SEQ ID NO: 3425 - DNA, 478 bp, Hordeum vulgare
acgtgatctacatcaaggccggggcgtacatggagaacgtggaggtggggaagaaccacaagaacctcatgttcatgggcgacggaatgggcaagacggtgatcaaggccagcctcaacgtcgtcgacggctccaccaccttccgctccgccacagtcgctgtggtgggcaacaactttctagcccgcgacctgaccatcgagaacgcggccggcccgtccaagcaccaggcggtggcgctccgcgtcggcgccgacctctcggccttctaccggtgcagcttcgtgggctaccaggacaccctctacgtgcactccctccgtcagttcttccgcgagtgcgacatctacggcaccatcgacttcgtcttcggcaactccgccgccgtgctccagagctgcaacctctacgcccgccggcccctccccaaccagagcaacatctacacggcgcagggccggacggaccccaaccagaa

SEQ ID NO: 3426 - DNA, 554 bp, Hordeum vulgare
ataagtattactttcttagatagcacaatatatagtttacatttatacgtacgtgtcaaaactaaaacaaataaacggaatgacgatgacattttccgcacaattggccgaggcacctggctagttaacaaaaaaccacataaataaacaatataagtataaccaaatgaacacataagccaccaaacttaattattgcggtgaaaagaatgccacaaaactaataagatgaatcaggcaggtgcccctccgctccactggggtattggattggatgtactcgaactcaggacgaattgggtgctttatatgatatgatgatagaagaagaattggtcggtcacagcccggcggagaatgggatggacgtgccggcgagccagacgtcgccatcgatgaaggagcccaccgtgaaggtgctggcctccgatgcgctggtgatgacgcggtaccccttccacgtcaccctgccggacgtgccggcgccgggtcccgtgttctggtactcgccgtagtagagcgtgtcgagcgcgaaggtgccgtcccacgcgagc

SEQ ID NO: 3427 - DNA, 542 bp, Hordeum vulgare
  UNSURE (16),(27),(31),(40): n stands for any base
gtcccccggctgcagnattcggcacgngggnagctccagnagcttaggcgggagcacgcggggcgcctcaccgtgctgccgctggacgtcaccgacgagagcaccatagaggccgccgcggccgcagttggggagacccacggatccctcgacctgctgatcaatgccgccggcatcctttcgatcccaaatgttatacagccagagacctcgttgagcaaagttcagaagtcatccctgctactggcatacgaagtcaatgctgtcggtcctattctggtcatcaagcacatgcgcccgttcctgaagatcggtgcgagcttggaaacagggaaaggtttctcgttggttgcgaatatgagcgctagggttggctcgataggggacaatgctctgggaggctggcattcgtacagagcttctaaaacagcactgaatcaattgacaaagactgcatcagtcgagttgggcaagaaggacaacatcgcctgcattttgctgcatccaggaacagtcgacaccgatctctcacggccgttcca

SEQ ID NO: 3428 - DNA, 552 bp, Hordeum vulgare
atgcagtgtgtgtacttaatttagtagactgtagggcaccagtgcttatacatataccaaggaaacaagtttaacttgtaaagttgtactcagcgctaaacatcatgtatgcataattttcaagtagtttgggagaaaagggaaatatacttcacatgcttttcatatcagagatcttactagaggtgggttcaggcattgagtttaaggctaaaaataaacacaggtggttctgaagaagaaaattagggtagaaatgatcactgactggaaaacagtggtcagtggtcaccaaggaatttcttggccatcccaagcgaagaacttcccgttgtcagtcttcttggcattgtcgatgatggacaggagcttctgtacagagaactccctcgtgaagagcttatccttggccacatttctctggaacggccgtgagagatcggtgtcgactgttcctggatgcagcaaaatgcaggcgatgttgtccttcttgcccaactcgactgatgcagtctttgtcaattgattcagtgctgttttagaagctctgta

SEQ ID NO: 3429 - DNA, 549 bp, Hordeum vulgare
  UNSURE (90): n stands for any base
gtctccccgggtctgcaggcaattcggcacgaggcacggaagggaataagaagtgggcatgtgcccgggagcaaatgcgttccttttccnaggtgcttgacagtacacaaaagctattacctgcagatgagctccgtaagcgatttgagcaagaaggtatatcacttgatcaacccattgtgacctcttgcggcactggtgtgacagcatgtgtattagctttgggccttcatcgcctcggcaaaactgatgttgccgtgtacgatggatcatggaccgaatggggtgctcaccccgacactccagttgctactgctgtttagtctcatacgacgtgtatggaggaccatcttttgtgccccaacttgtcggcgatgtatgaaggtcacaaggcaaaggaaactgaagagtatgggtgggtgtaaggttgtggaagcgaatgctgttgggcgttttcaatgtaaattatcgaaacagaggaaaatggaacatacactgtgtgaatcaatagttgatgacctcttgtgatgacgacccacctttctttgg

SEQ ID NO: 3430 - DNA, 539 bp, Hordeum vulgare
gttttggttttatttttttattatattacctctggcatggaaaagagatccaaagaaggtgggtcgtcatcacaagaggtcatcaactattgattcacacagtgtatgttccattttcctctgtttcgataatttacattgaaaacgcccaacagcattcgcttccacaaccttacacccacccatactcttcagtttcctttgccttgtgaccttcatacatcgccgacaagttggggcacaaaagatggtcctccatacacgtcgtatgagactaaacagcagtagcaactggagtgtcggggtgagcaccccattcggtccatgatccatcgtacacggcaacatcagttttgccgaggcgatgaaggcccaaagctaatacacatgctgtcacaccagtgccgcaagaggtcacaatgggttgatcaagtgatataccttcttgctcaaatcgcttacggagctcatctgcaggtaatagcttttgtgtactgtcaagcacctgaggaaaaggaacgcatttgctcccgggcaca

SEQ ID NO: 3431 - DNA, 518 bp, Hordeum vulgare
cggcgcaggaggcaggaccacctccagtcctccccgatgcggcggctagggctttgaccgtgtgcccgtctcctgcccggctccggccgaccaccacctcacttcacttcactccgctcaccactccactgtcgtcatcaccatttcttccgccgtgggggctcgtcctaggcggattcgatcgagatggtcaagatcgaagattgtgatggggatgtcgccgccgacccgccgcagcccaatccggctccggcgcccgctgccgtcaaggctgaggaggcgattgatgatggtcagccaagctcttcatccagttatttaaggtcacattttattggtatgggattttcaccagtgctggttgacagaatgcttcggaaacatggtgatcatgattctaacgctatattggagtcacttttatctcatcctaattctgggtctgaatcgtcaagttccttgggcagtctatttgattccgataatgaagaaaacaattctaatcaggacatcaagcc

SEQ ID NO: 3432 - DNA, 551 bp, Hordeum vulgare
gataaagagacagtagtctctctagctggataaagagacagctcaaagttctcttgctgtcgtgcacgtctccatcctaccatttacaagttatgacgccatcccttgtcgaagatagatggtgaaggacacataattatgccaggcaacaactacttaaaaagtgcgtgcatactcctcactctattaagaacacgaacgaactcaaaatattttttggagtccatccccatagctgcattcactgtcgtcccacctctacaagaatcgtaatttccgccaacgaccaagtcaaacccgccaaattccttaaataggtcctcaagaacatcggtctttagcttccatatgccaggtagttgtctcagcactccgctctgctctgtttttgcccaccatcttttcagaattttcctgttcacatcagattcttcgatagacaccacacacttcagaggaataccgagacgatgcagcgcaacttctgcacccccaactccactatagatggatagtaccctcaaaccatttggatatatgtcttttaggac

SEQ ID NO: 3433 - DNA, 478 bp, Hordeum vulgare
aaagatttcatcggcgaagacttcaggttcttgcagaagcacggcctgatttgattgcttttgaaacaatccccaataaattggaagctcaggcttatgttgaacttcttgacgaatgcaacataaatatcccttcatggttttccttcaactcaaaagatggagttaatgttgtgagtggggactcattaatcgaatgtgctaatattgctaatgcatgtgcaaaggttggtgcagttggtataaactgcactcctccaagatttattcatagcctgatactctccattcggaaggtcacagacaagccaattctgatatatcccaacagtggagaaagatatgatgccgagaaaaaggagtgggtggaatccactggtgtgtcagacggcgatttcgtttcttatgtaggcgagtggtgcaaagatggggctgcccttatcgggggctgctgcaggacaactccaaacaccatcag

SEQ ID NO: 3434 - DNA, 554 bp, Hordeum vulgare
ttgcaggttaatattctcctaacaacctcagaatctgtataacatacatatgcctcaaactgtcttaataggtaataaggggttgtgaacttcgctgcagatcatttcactcactccttagtacaacttcgctgttactgcttgctatcactccttggtacagcagctacatcttactgttcgctagagacacaccgccgtttcgcaaatgtaagtgcacagctatctcattttgcaggagaacgtcacgcagctattactaaatctccagggcatgttggcaacataacaccaggagtaaccagtctgaaggagggtacaactctgtgccgcaaatacctaagccgcagggtagtattggttaagagatctacttattgctctgatggtgtttggagttgtcctgcagcagcccccgataagggcagccccatctttgcaccactcgcctacataagaaacgaaatcgccgtctgacacaccagtggattccacccactcctttttctcggcatcatatctttctccactgttgggatatatcagaattggct

SEQ ID NO: 3435 - DNA, 517 bp, Hordeum vulgare
atgagagggaggccaacaaggagatggtcgtctacctcatagacgcctcgcccaagatgttcacgcccgccaacgccgccaaggcagatgaaaagcaggagacacatttccataccatagtgaactgcatcacgcagtctctgaagacgcagattatcgggagatcccgtgatgaagttgcaatatgtttctttaacaccaaagaaaagaaaaatttacaggagctggctggtgtatatgcttacaatgtcacagaaagagagcaacttgataggcctgatgcaagactgattaaagaattttcttgtgtagaagattcttttatgaataacattggaagccggtatggaataacctctggatctcgagagaataccctgtacaatgctctttgggttgcacaggcactgctgcgcaaaggatctgtgaagactgtgagtaagagaatcctcatattcaccaatgaggatgatccttttggtggtattactggagcagcaaaggctgatatgattag

SEQ ID NO: 3436 - DNA, 551 bp, Hordeum vulgare
tggggcctggaacacactttatcaacgtaaaaatgggtgcttcacaaggcactagtcatctaagacagccccatcccaagttgcgtgccacgggagcacatacatggtttcaaacaaactaacatggaagtcacgctggcacccgatactgctatacaaaatcgccacgggccaaacagagaggattgtctatcatccatggctacataggatgcacactagacgtcttgcatatcccagtcaaggcttcgtgtttctcacttgcctagatgagtcaagatcctgctgatgatggcgtctttcttgccagaaaccgggaggccatgcgccgtcaggtaagtttttagatccattaccgtcatgtccttcagctttccattgtctgcaaggtctgcccaatcataagctgcgcttttctgtgaagctgcatcagcaattgctttcctcttctttgaggcaccaccttttgctgccgctgcctcggcttcctcttggtcataattttcaccaaacactgcagccttaaattcttctatagctttaactactcc

SEQ ID NO: 3437 - DNA, 524 bp, Hordeum vulgare
gttacgaggcacggcgacgtcgccgggaaagtcggagacgttccggttagtgcgcaacgccggccagaacaggatgcggattatggcggcaaacgggctcttcttgcaggcgaacaaagacagctcggtgacagcagactacggcaagagcacaagctggggcgacgatgacccgtcggtgtttgcggtgaccagagtgacggggctacaaggggagtaccaaatctgcaacggatatgggacggcaaaggccacgccaattctcaagaatcactggagcacatatatagtggaagatgactttaggttcatctccgaaaacgggctgacagcagtgaggataccagtgggatggtggattgcgagcgaccccagtcctccagcaccttacgtcggaggttcacttcagacattggataaggcattcaaatgggcagaggagtacaatctgggcgtcatcatagacctacacgcagctcctgggtcacaaaaccccttcgagcacagtgcctccaaggacggct

SEQ ID NO: 3438 - DNA, 551 bp, Hordeum vulgare
ggtaaaaagttagcactacatttaaggaatgagacatgtatagaaaatggccaaataatagaaatacatttattcaccttcaatcatttttttctagagatgcatcagtcgttctacaaagttatttcgtgtggcgcacgtaggaaacatatcctagattttcaaggagatgtacccattcttgatcatccactccatactccagtggttgtttacattcttgagggtccaataagcccatccaaacgttgcctttccatacacatccatctgtgtatttgcaaacattttgagatcttccttcgttgcattgggcacctgccactcagccacccattcgcctacaaaggtgagaggaccgttctgctttgtgacagtgctgagagcgcttgaatagttggtcttgatgaaatcaatgttttgctgcacggtaaaagtatcaaacatgctgttgaacaacacgtagtagtgcacatcaacgacggccttgggtaacccaccggcgaactcaaggagctccgtcgggtctggggacgataaccggttggaca

SEQ ID NO: 3439 - DNA, 493 bp, Hordeum vulgare
caggggcaacgagcagttcaagtcggggaactacctcaaggccgccgcgctctacacgcaggccatcaagctcgactccgacaaccccaccctctacagcaaccgagctgctgcatttctgcagctggttaagcttaataaggcacttgctgatgctgagacgacaataaaactcaagccagaatgggagaagggttatttcaggaaaggatgtgttttggaggccatggagcagtatgaggaggcaatatctgcttttcaaatagctttgcagcacaatccacaaaatacagaagtctcgagaaagatcaagaggcttactcagttagcaagggaacagaagcgagctgttgatgtggagaacctgcgttccaatgttgacatcgggaagaacttgcagtcattgaaaaaggagctggctacaaagtatggagatgcagaaatgggacaaaatatattctcatttgttatcagtgtgattgaatcagcgata

SEQ ID NO: 3440 - DNA, 554 bp, Hordeum vulgare
caaaagtaaatctgagccaagaatctaatggtatatccaacatatattttccttcttacaaatcaaagaaaggcaaccaacataataaccctgccaaagcttgttacacttgaaatcaaatcaccgcatacagtgacaaaactggagtgcaccacaccgatacaggaccatcggtttacagaatctagcatttgcttcttcctgtgtgagaaaacacccccgtgccttttcgaccgtatacctaccgggaggaatgcggatcaaccaggggtagtagaatcaaggagatgtcattgaccgtgcatctcggcccttcaagcactggtttcgttctctttgaatatacggggaaggatctcgtggatggtaatgtccaagggctcagggctcctgcacaatgctcgtcccttctctgttgtgctagcaacaaaccatatcttccgtaaaattggtgattcaaattgtacaaagaacccatcactctggtctagcttccattttcttgacccttgccctttccagacctgtggataggagatgatgctcttaggtgc

SEQ ID NO: 3441 - DNA, 553 bp, Hordeum vulgare
  UNSURE (20): n stands for any base
gtacccccgggcctgcaggnaattcggcacgagggaaaaaaatcgtacaatactcatgtaattgatgtagatggtaacagtcctgtgaagattgtaaaaactgagagtggtggtattctgaagcgccagttttttcaattgacaataccacaggttgtaggaggagaagacatctttgccacaattagatggtcacaaaagttgttgtatgataatggacagttttctgttgatattccgtttcggtttccacattatgtgaaccctttacctaaaattttcacaaaaaaggagaaaattcagttaactgtgaatagtggtgtgagtaaagaggttttattgcaggggaccagccatcccttgaaggaaaaaatcaggcaggctgagaaattatttttcttgcatgaagctgtggttgagaattggtcaatcaaagatttcaacttttcatatagtgtttactcaggtgatgtgtccggtggagtgcttgtgcagcgctcaacattacgtgactatgacgatagagacattttcagcatttttctcttacctg

SEQ ID NO: 3442 - DNA, 543 bp, Hordeum vulgare
ttaactagtctggtgggacaagtagttactcatcttcgtttaatttcgcttagctcgctttacatcgccagtgaatcagacggtttattaccggccgatattgacaaagaggcctcacaatcaagcagtacatataaataaatatatacgtgacgcgcaatcctatacagcaatactatgcacactttactgtacaacacaccacgcctcttctcgggccgtcgtcagtccgagctgcccccgccgcagcacagctccgagcagcactcgaagcagccgaggaaggagagggcagcgcacatctgcaccatgacgatggcgcactggtcgttcatcttgctgcagcagttgatgaagcacatgcagcagcagcagtccgccacgcggccgcagcagccgcccaccgccttcccgaacatgtcgaatttatccggcgcccttgtgtcgccgaaccccgaggttaggttctctgtcgtcgccggcacgttgccaaagccgagtgtcaagccctgaagcggcatcgctgaaggctcctctggtttc

SEQ ID NO: 3443 - DNA, 485 bp, Hordeum vulgare
  UNSURE (3): n stands for any base
ggnctgcagaattcgtacgaggccgcctcgcccgccgccagcagcatctgatggcggcggtgttagcggcgcactgctcctgcgtttcggcttcgatcactgcaggttttggaagtgctctgagaggaataccaaaaggatattatcctcatttttacaatatccaagcatcaatatataatggacttgttcataggaggaaaattcctcttccattgagatgctcttttcgctccattcaaacaagaaataaccactcatcagttgttgtacctaaagattattgtgaaacttacatccagtttttgagagacaaacggatagttcctgattcagatcctccaacctccaaggatgtggacctactgtaccagtttatagataagagtaacaagctcatggtattaactggagctggaatgagcaccgagtcaggaattcccgattatcggagtcctaatggagcatacagttctggtttcaaa

SEQ ID NO: 3444 - DNA, 551 bp, Hordeum vulgare
gataacttgggtctaccttttccggatacataacaaatgagtcatcacaaaaaatgattttacacttacaacagccatgataatgctctatacaaactggaaggtcatgaagttctgacctgtttatagaatgatctacagttacttatataagtctcacccatcttcttccctcataactggttccttcaaacactgtaaatgttcagcctatgcttggtacagctagacttcccatctgaagtactctgggaagtatctccccacatctcgcattgattttcaaagatataatgctatcagccctcgtgcccccaatgttaatcgccgcgattgcagcatttgcttcatgtgcaagtcttgccagcctaaaagcagacattgtcattaccgctgaaccaacaacgagaagagcatcacagtttcttgcagcctccttgacgctatcagctctctcactcggaacattatcaccaaacatcacaacatcaggttttagcactccaccacactgactgcaactaggaatgtcaaaatcttgctcccagaac

SEQ ID NO: 3445 - DNA, 50 bp, Hordeum vulgare
tttttttttttttttttttttttttttgtttttttttttttttttttttt

SEQ ID NO: 3446 - DNA, 334 bp, Hordeum vulgare
atctctctctcgctcacctatacatcatcatctcctctgcctaacaagctaagcagctcagctcaagcatcggcaatggagggcaaggaggaggacgtgcgtctgggcgcgaaccggtactcggagcggcagccgattgggacggcggcgcagggcggcggcgcggacgagaaggactacaaggagccgccgccggcaccgctgttcgaggcggaggagctgacgtcgtggtccttctaccgcgcggggatcgccgagttcctggccaccttcctgttcctgtacatcagcgtgctcacggtgatgggcgtggtgggcaacccctccggctcca

SEQ ID NO: 3447 - DNA, 518 bp, Hordeum vulgare
ctcaaatctcaccttgtccactctctgccccttcaactttttggatccaagaaccagccagccttgctggattcgcatctctcctgcaatggcgtccctcctggaggtcttcctgggatcctgttcgtcctcggcgccgccggtggactgggaggcggagtcctacccggagtacggcgactacgccgtgctccccctgctcgtcgccttcttccccgccctgcgcctcctcctcaatcagttcgtcttcgaggtgttagcaagacgacttatatttggaaagggacatgccaagcttggtgaaacagatgaaaggagaaagaaaatcaataaatttaaggaatcggcatggaaatttgtttattatctttctgcagaattgttttcactatctgtaacatacaatgaatcatggtttacaaacacaagatacttttgggtagggcctggcgagcagctctggcctgaccaaaagatgaagctgaagcttaaggctgtgtacatgtatgcagatgagt

SEQ ID NO: 3448 - DNA, 529 bp, Hordeum vulgare
  UNSURE (13),(24): n stands for any base
aaaagacatcttnacatacatatnggagattaatatcacgatgtaagatttgcctcaagagcctcatatatttaatttacataaaagatacatcaaggaggcttgttccagtagcaccgagatttttgccttctcagttttcattgtgtgcctgaatttcctcctaatggatatgctaactagttcctccttgacattctcattctttatacaacccgcttgcaccattctcatttccaactgcgaactatacagttcttcagttaagcatccaacaacctgcagcttaatcttcatggtcattttcgccttcagaatctgtttaacagcacaggtagcttataatgaatccataagaatattctgctgacaaaaataataaaccaaggaaatcagcaagaaaagaatcactgaccggatcgaacatcctcgccaacatgacctctggactgaatttgtttgacaagcatccggtaaatcagtacccaccaatatatgtgaaagaccagaagtgaaaacaagagagtgt

SEQ ID NO: 3449 - DNA, 520 bp, Hordeum vulgare
  UNSURE (15): n stands for any base
gcttgcttacagggnaaatggaagaaggtttttccattgaagagcaattaccactgcaagggtacacatgcattgctattgtaggtattaaagatcctgttcgcccaggtgtgagagagtctgttgcaatttgccgctctgctggagttacggtgagaatggtcacaggcgacaacataaatacagcaaaggcgattgcccgtgaatgtggtatactcactgaagatggtctggctattgagggaccggatttcagggagaaaactcttgaggaactccttgtgcttgttccaaaaattcaggtaatggcccgatcatcacccctggataagcatacacttgtaaagcatttacgcacaacattcaatgaagttgttgctgttactggtgacggcacaaatgatgctcccgctctgcatgaagcagatattggacttgcaatgggcattgctgggactgaggtggcgaaagagagtgccgatgtcatcattctggacgacaacttctctacaattgtaac

SEQ ID NO: 3450 - DNA, 534 bp, Hordeum vulgare
tctttttggggtctgaatcccagccagacatcaatattacaggtgccgacgagcaggccctaagccctagcaccaagtacaaatgcttcttacacaacaatatgatgcaaatctgccacactcgtaggctttaaaacttgtctagtgcagctcttctcaggcttgctctccatgcatcccaaaagaccctgcatggaggattcaggtccacacactacggaatcggtcttttcgccgcgcgtccttcgcatggtgggctgcccttttcatcaggaggacccaacaggaatgagcttgacgacgacggcgatcggcatcccgacgaggccaaggagcacgctggcgagccactggagactggtgagaggcgtcgtgttggcaaactcgccgaggaactggaccatgatgaactggaagacgaccgtgctgctgaggacacacatgaagacatagttgttcagaatgcccttgagcacattgagcttctccatctccctcgaacttatctcattgaacacctggcagaagacgaat

SEQ ID NO: 3451 - DNA, 518 bp, Hordeum vulgare
cgcctcgcgcattgctttgcagagggcctgcaggcgcggatggcgggcacaggtggcctcgtacaccagtcgctcatggcaacacgcatctcagctgtggacatgctcaaagcttaccagctgtacatggcagccatctgtttcaagaaggtgtttttcctattctcaaatagtacaatctataatgcctccctggggaagaagaagatacatatcatcgattatggtatacaatatgggttccagtggccgtgctttctgcgacggatatcacaaaggcctggagggccgccaaatgttaggatcactggtatcgatctcccccagcctgggttccggccaacagagcggattgaggagacagggcgcaggctcaagaagtatgcccatgagtttaatgtgccgttccagtaccgcgtcatcgcgagggcaaagttggagtcgctccgcaaagaggatttggacattgatcctgatgaggtactcattgttaactccttgcttcaattcaagaactt

SEQ ID NO: 3452 - DNA, 529 bp, Hordeum vulgare
aagtttttatacaaatgttactggcctgccacagtgcagcacgcacccacaacacagtgactagtgtcaattacaacctgatcaactggctggattgatcgcaggcacataccagaattcagcaaacaacatccatccagatcaggacacccaagtctaaaccctacaaagctaggcattaggcagcaacatgactgcagcaacatctaattcacatcacataaaaccatatgcatatatcttgggctacccatctctcttatgacctcaagaaactgcatccactgatccaaggctacttaactagaccatggtccatacacaacacacagacattatattgacataactagagctataagcattgtcaagtgaaaatgctagctaaaatttatgagctagcatcatttgccgtccatgtcgagatggcatagaggatgcgccctttccatccttgcaagagccactgctgatctacatcaatcacaaagtccttgtggtagcagttcttgaccttgtctcttgctag

SEQ ID NO: 3453 - DNA, 518 bp, Hordeum vulgare
ggagcggctacgccgcgagcgttcccgggagcgtggccttggggtcactcggtacgagtggcgtgcccgtcggtctggcggcccctcttctcgtgcgggcattgtcgtgcctctcccctcaggggtttactttcaggacctgtctggctctgaaccagtactcatgctacaaagttcttccacatcaccaattattgacccacatctatctcccgatgggaccatgattgcatatgtcagggatgatgaactgcagtgcaagatatataacttcggttttgatgatggcgaaactaggcaattgacctacggtgcaagagaaagtggaaaggtccatggacttgctgaatatattgcgcaggaagagatggaaaggaagatgggattttggtggtctcctgatagtaaacaccttgcatttactgaagtagattcatctgcaattccactatacagaattatgcatcagggcaaaaattctgttggtttagatgctcaagaagatcatgcttacccct

SEQ ID NO: 3454 - DNA, 478 bp, Hordeum vulgare
catgtccctgcacttgcggataaatacagatggtgggaaatgaataaagtccacgataccataccaactatcccacgtttaagttacacagggcaacggcagatttctctacaacgcaacttcataggcttctctccacaaaatcacagatcctctcctccatatagatccggtcgtctagctgacgtggcatgtgcctctcatcagggaagaggaggatctcgtacgacttgcgttccgccatcaaactgttgatgagcctagccgtgtgcctgaaatgcacgttctcgtcaatcatcccatggatgaggagcagcttccccttgagattcttcacatggtgcatgattgacccgtactcgtaagcatcgctatgctccgagggcagtcccaggtacttctctgtgtagaaggtatcatacccgtcccatgcagtcactggggcaccagacacggcgcagcagaacgtgtcgggaaa

SEQ ID NO: 3455 - DNA, 471 bp, Hordeum vulgare
agcagctcctcccatttcttctctatccctctatctctttccatcaatcgttttcggatccttgcattgcgtttggattcaccctgatagattcagtgtttcagcaatggtgctaggcctccgtactaagacaaagaaggatgctgccatccatgtagatttcaacatcttcatccaggagataagtccatggcccccttctgaatctctcaagtctttgcgttctgtggttcttttttgggaaaatggtgaacgcaattcagggaagacaaacaccgttgcaccttcagtccgctcaggatccacatcagggaagatcgaatttaacgagttcataagcatacaggttgtttttcagaaggaggactcatctggaaagtggcaaaagaacttgcttgagttgaatttatacgaaccaaggagggataagctgaagggacagcatttggggactgcaacactagacttggc

SEQ ID NO: 3456 - DNA, 541 bp, Hordeum vulgare
acatacaatatggcaaaaggtactccctccgtcccgtaatataaaaatatttttcaaacggaacttgtacatatgtacgtctgagacataagaggaagtcagtactggttgtctagcttccacacctcatggaggagcctgtacctcgccgtgtatgagccgctgatctgcttcagcttggcaagcggattcgatggcgccttggagatgaaactcagtggtgagctcagctcatcgagctcgtcatcactcgtgttagacttgcggaggactgccgatccgctcttcctaggatcaccaatgatgcttaggattgtgccaggtgcagggtaagagtacacgataggtgaagcactgcatggtatcgcccgtatgcccttgtcactgctctccagatgatcctccaattctagagcctgaagcaaggaatcttgaattgggtctgggcaaaattcatctggtacaaagccaacaagtatgcttctgacgatcgatgaactaaaggtgggacaaatctctttcctggtactggtttccatga

SEQ ID NO: 3457 - DNA, 534 bp, Hordeum vulgare
ggcaattcggcacgaggcaaatccttcggtgcttccgggactcaagtcggcgaggtggtcttcaacacctcattgacagggtaccaggagattttaactgatcctagctatgctggtcagtttgttttgatgaccaaccctcatattggaaacactggtgtcaactctggtgatgaagaatccataaaatgtttccttggtggcttaatcatacgaagcctaagtatatgtacttccaattggaggtgcacggaaacacttgatgaatatttgagaaagaggaacattatgggcatatatgatgtggacacacgtgcaataacacgcaggttaagagaagatggcagtctcattggtgttctaagtactgaccagtctctgaaagacgcggaattgctgcaaatggccaaaaattggaaaattgttggtgttgatttgataagtgatgtttcatgtgatgctccatatgaatggttagacaagaccggttcaggatgggagttcaatgacaatcagtcaagtgaaacctttcat

SEQ ID NO: 3458 - DNA, 552 bp, Hordeum vulgare
gcctaaaggattttattctttaaactcaacaaatagtacaataccactagttactttataggtgtagttcagctgataagagaaataacaagaaaaatacaaactcctcggagctcgctgcacggtccaacaacaagccaacagtacaagtttcgcaactcatgatggtcgccaagcatcccaacctttcttccactcacaatctgttgttcttcatcagctccacaaattcaccaaacgccaagtctgagtcatggggccccggggaggactccggatggtactggagagacataagcttcatcttggggaacacaagaccagcacagctctggtcatttaggttgatgtgtgttacttgtactccttccgggagcgattctgggtccacagcatagttatggttctgtgcactgatgtctacacgtccggtcctgttgtcacgaactggatggtttcctccgtgatgaccaaatttcattttaaacgtctttccaccaagagcctgaccaatcaattgatgtcccatgcaaatgccaaatactgggacct

SEQ ID NO: 3459 - DNA, 518 bp, Hordeum vulgare
tgcagtgtctgcagcgattcttggcctatctgtgctcctaattactggagttgttacatggaaagagtgtttggcggagtctgtagcatgggatacccttacttggtttgctgcgctgattgcgatggctggctacctcaacaaatatggattgatttcttggttcagcgagactgttgttaagtttgttggaggtctcggtctgtcctggcaactctcattcggtgtattggtgctgatgtacttctactcccactacttctttgctagtggtgctgcacacatcggagcgatgttcactgcgttcctgtctgtggcaagtgccttgggcacccctccgcttttcgctgccatggttatgtcattcctttcaaacctcatgggtggcctgacccattatggcatagggtcagcccccgtcttctatggagcgggctatgttccgctggctgagtggtggggctatggatttgtcatctccgttgttaacatcatcatctggcttggtgctggaggct

SEQ ID NO: 3460 - DNA, 550 bp, Hordeum vulgare
ctaaaagctcttatatttaggaagggagggagtataaaataaacagaagaaactacataacatcagataccacttgccagtaactgccagaaaaacaattgtacgggtacaaactaaaagaatggatcatgtcgacaaaacttgtggtcagctcaacctgtgccacttgcaaatgttttgctcgtttcgttcgccctcgtcgaaataggaagtcccacatttactgtgtttctcaccacaaaccaatcatcttccaccagaagcctccagcaccaagccagatgatgatgttaacaacggagatgacaaatccatagccccaccactcagccagcggaacatagcccgctccatagaagacgggggctgaccctatgccataatgggtcaggccacccatgaggtttgaaaggaatgacataaccatggcagcgaaaagcggaggggtgcccaaggcacttgccacagacaggaacgcagtgaacatcgctccgatgtgtgcagcaccactagcaaagaagtagtgggagtagaagtacatcagcaccaa

SEQ ID NO: 3461 - DNA, 554 bp, Hordeum vulgare
  UNSURE (22),(26),(27),(31),(32),(40): n stands for any base
ggtaccccccccgggccttgcnaggnnattnncggcacgngggctgaccagtagtcatatgcttgtctaaaagattaagccatgcatgtgcaagtatgaaccaatttcgaactgctgaaactgcgaatggctcatttgggcggccgcaggggcagggaccgcagtgggatcccagacagatgttcctgcaggatggtgtcattccacttcctgtgagggatagcatgccgctgccagtgagggagaagaatggtgggcaccatggtgccatgctgaatggggcagatatgaaaggatatggtgatgcatctcataatcatatcatggttggagcaacacgaaacgatagtgacgaacacctaaagcactctcagtcagaggcagacaccaaatgcgccaaacagcaatatgctcagaggtctcgtgtccggaagctccagtacattgcagagctcgagagcagagttcaagccttacagacacaaggggtagaagtttcagctgaaatggattttctaggtcaacaaaatatcatgttagacctggagaacaaa

SEQ ID NO: 3462 - DNA, 495 bp, Hordeum vulgare
aacatttggcgcacagttctcccgggtgtggcacaataacgataggacctgctcaagtcccattcgtgagccaaactaacaagaaatgcaacactaaatgaatgaattacaaccttgatctgcaagaaaagcatggccctatgaatagaaaaaagaaaaaccaaacaccttcgactggtcgagcgtgtcaacaatggttatgcgcttacaggtgactgtcaggtgcaaattccaaaataaaatgaacatcagatccattattacctttccggcattattcaccatggggtttgattccagattcacagtcaccgctcccctcatcatgcaaccaacaaccactaaatagtgatgacacagggggtagcagttaagcttaactctcagaatcacaagctcgaaagaggcttaaatatgaaagtcggggacagcatcaggccctgagtttgaatcattgtgtttcagatacatgcttgcaaattgtgaatcgaggtc

SEQ ID NO: 3463 - DNA, 514 bp, Hordeum vulgare
ggctgattaacaaggaggagttccgttggcgctcttcaagacgagcaagaaggagagcctcttcgctgatcgtgtattcgatttgttcgacacaaagcacaatggaattttagggtttgaagagtttgctcgtgcactctcagtgtttcacccaaatgcttcagttgaagagaaaattgacttttcattccagctatatgatcttaagcaacaaggcttcattgagagacaagaggttaagcagatggttgttgccacacttgcggagtcaggaatgaatctgtctgatgaaattatagagaacataattgataagacgtttgaggaggcagacacaaagcatgatggaaaaattgacagggaagagtggcacaatctggttcttcgacatccttctttactgaagaacatgactcttcagtatctcaaggacatcaccacgacatttccaagcttcgtctttcattctcaggtcgacgatacctgaaattcttgcagttctttcgaatcggaa

SEQ ID NO: 3464 - DNA, 544 bp, Hordeum vulgare
  UNSURE (498): n stands for any base
gacaaacaatattaagggctgtttgcatttctgtacacacagcagagttctcagagaattggacctgatcgctaaccagccaaaaaacaaaaacggggagaggagaaaatgggaatttcagataagagataacaccttgcccgaaggctcccaacagttctaaattcttcaaatggaagaagcaaagttatttaacaacaatttgcgttctcaaattcaacatccttcagagcagcaatgcctctatctctcatccgatccaatgttccaaacagtccgatgccaaaaccttacaaaattactgcaagcttatcttcttatgttccgattcgaaagaactgcaagaatttcaggtatcgtcgacctgagaatgaaagacgaagcttggaaatgtcgtggtgatgtccttgagatactgaagagtcatgttcttcagtaaagaaggatgtcgaagaaccagattgtgccactcttccctgtcaatttttccatcatgcntttgtgtctgcctcctcaaacgtcttatcaattatgttctctataa

SEQ ID NO: 3465 - DNA, 525 bp, Hordeum vulgare
gtcagcagcagatgatgggtaggggtggtggtcgtggttaccgctatccaactgggcgtggcatgcctgatcctgctatgcatggtgttgggggtgtgatgacatccccatatgagatgggaggcatgcctatgagagatgccggtgcgtcacagccagttccaattggggcattggcttctgcacttgccaattcacccccagagacgcaaagaatgatgcttggcgagaacttgtaccctcttgttgatcagctggagcacgaccaggctgccaaggttactggcatgcttctggagatggaccagaccgaggtgcttcacctgcttgagtcgccagacgctctcaaggccaaggttgctgaagccatggaggttctccgcagcgctcagcagcacaccaaccagtcccccgagcagcagctggcttcgctctcgttgaatgacggcctcatctcttcctgagctaaacagcgacaatttttgcaccatatcaaacttatctagactgaaaatgacttggttt

SEQ ID NO: 3466 - DNA, 551 bp, Hordeum vulgare
gtgagaaagcacgatgattcggtgacaaccctgaggacaccttaaacaaaataaccaatccatgcaaataaaataagccaatccatgggaagcctaaaagactagttcaactactggcaaaagctaagtctcaaataaaccaagtcattttcagtctagataagtttgatatggtgcaaaaattgtcgctgtttagctcaggaagagatgaggccgtcattcaacgagagcgaagccagctgctgctcgggggactggttggtgtgctgctgagcgctgcggagaacctccatggcttcagcaaccttggccttgagagcgtctggcgactcaagcaggtgaagcacctcggtctggtccatctccagaagcatgccagtaaccttggcagcctggtcgtgctccagctgatcaacaagagggtacaagttctcgccaagcatcattctttgcgtctctgggggtgaattggcaagtgcagaagccaatgccccaattggaactggctgtgacgcaccggcatctctcataggcatgcctcccatctcata

SEQ ID NO: 3467 - DNA, 519 bp, Hordeum vulgare
gggaaggctggcggaggggcgaagaagaatcaggagagggagctgcatggcgacggcggcgcgattcttgcgaaggacgctgcgagcaagcgagggggcgtctcgcttgttatctacctctcacagtataattaggcgtgttgcatacactaccggaggaataattgatgttggccagccaacacccagatctcatcccgagttattagctgatgaggagattacaccaggcatcacaagtgaggagtacatatgtagaagaaaaaagcttctggatgctttaccagataagagcttggccataattgcatctgcagatcagcagatgatgactgatatagtgccgtactccttcagacagaatggtgattacctgtacattacaggttgtacgcaacctggtggtgtagcagttttaagtaaggaaactggtttatgtatgttcatgccagataaacacaaggaggatgtagtttgggaaggtccgactgctggagttgaagcagctgtcgatttctt

SEQ ID NO: 3468 - DNA, 546 bp, Hordeum vulgare
gttcaaactttgtctatgaaatattacagaccgtacagcaggcgtgttttgccatttaggttttcaggcgattccgattcctacatctttgacaggaacggggaaagaaaatgtatggatgtaatgtcgattctgcatgatctccggtagaaaggatcatcatgtcgccgctatctgcaagatcgtctcagctgcaagcagctctcgcctcatgggcttccgccatggagccacagccgcccatgttcatcagggtggtgaggtgggggatctccttgggcacagacgccgtcaacacctcgtggccggactcggtgatgaggacctcgtcctcgatccttattcctatgccacggaacctgtccggggccttctcattgagtatcgggaccgggggaatgtagatccccggttcaatggttattacaacgcctggctccaaggttttgtcgctgctgaggctcgtggagtcatgaatatccattcccaacgaatgacctattgaggttggattcaaataattgtattggatagatttgccctttc

SEQ ID NO: 3469 - DNA, 378 bp, Hordeum vulgare
atgaggtgtgaggagttgggatgggcgatggcctgtggtgcaggtgcagatggagatgaaggagagacagcggtggcggcctgaggaagacgccatcctccgctcctacgtccggcagtatggcccacgtgagtggaacctggtggcgcagcggatgaacgcgcccctcgaccgcgacgccaagtcctgcctcgagcgctggaagaactacctccgccccggcatcaagaaagggtccctcaccgacgacgagcagcggctcgtcatccgcctccaggccaagcacggcaacaagtggaagaagatcgccgccgaggtgcctggccggacggccaagcggcttggcaagtggtgggaggtgttcaaggagaagcagca

SEQ ID NO: 3470 - DNA, 334 bp, Hordeum vulgare
tttttttttttttttttttttgattggcatgatccatgaccggccgataagaagtgaaattaaggcagtagcaaccgcagcggcttacatttttctgatgagctagactagagtgacaagtgaagcttccaacagttgtgacaaaagagaagaaaactaaagaacaagcatgcatgcgatgccatcgtcttctctggggtttggtttggatgctgcgcgtgcaagaaagcaaaccggcgcgccgtcagcggccgttcatctcgccgggtggccagcggcggcacgaggagccgacctgctcgaggaacttggtgaggcgggcgtgcttggtggc

SEQ ID NO: 3471 - DNA, 517 bp, Hordeum vulgare
taaagaaggaagaagagatgcttctggctgtaaaagaaagaaaagaaaaggatggaaatgcatttgctcgagaaatgctagatgagcgtaggcaaaaggctgaagaatggcaccataatgctgccagccgtgcaccatattccaaaccagctgctccaatcacttgtgcaacttttgctcaagacgtcattgaaggcagagcaagtgtttcacaagctcatgaccacaaacaccaacccctgatatttggacctgcaagtcttgttggtgggggactcaccagtgagagggaaagaatggcagcacaagtttttcagcctagtttcaggatgccgacaatgagcatcgaacaagccggcctagctgaaatgaaaatgatggagcaatggcaagaaagtaccgccaagatgattcaagaggcaagctcctcttggcacaaggatgacactagtttggcgcaggacgacgaggacgcagaagaggagaaagcaagggcatgggatgactggaaggatga

SEQ ID NO: 3472 - DNA, 551 bp, Hordeum vulgare
aggggatattgatgaaatgatgcacttgcaccaacgtttctacaaataatgtactctggtcaatactcttgcaaacgtgaggggaaataacagaaatgttatatggtatatgaacatcagctacatgtggtatcttcagtgcagtgtcaatagcttttaaattagccacatggagtaagcttcttgttgcctgcgccgcgtgggttttcatccttccagtcatcccatgcccttgctttctcctcttctgcgtcctcgtcgtcctgcgccaaactagtgtcatccttgtgccaagaggagcttgcctcttgaatcatcttggcggtactttcttgccattgctccatcattttcatttcagctaggccggcttgttcgatgctcattgtcggcatcctgaaactaggctgaaaaacttgtgctgccattctttccctctcactggtgagtcccccaccaacaagacttgcaggtccaaatatcaggggttggtgtttgtggtcatgagcttgtgaaacacttgctctgccttcaatgacgtcttgagcaaa

SEQ ID NO: 3473 - DNA, 305 bp, Hordeum vulgare
  UNSURE (16),(37),(288),(293),(305): n stands for any base
gtcccccggctgcagnaatcggcacgagggcgctggnagaccttccgacggcggtcgggcgtggggccgcaattaagcagggcggcgctggggaggtcgttccgccggccacacacgctcgctccggtggctagaagctctgctgcatcgcttctttcagacaacggccaagcaaagaagaaggagaaggctcgggctactgcacatggcagaaagaagaggaggaggaagaggtcaagacgatcaacgacataatcaactcggccccgtcggtggacgacgatgagngacgnaaccatggtttn

SEQ ID NO: 3474 - DNA, 552 bp, Hordeum vulgare
aattgaactgaaaaggataacgttgaacatgaactgaggaaacattcgcaaagttcagactgggcaaccttgtctgctgttgttgaaaactgtatgtatatccctatatatcgtcgcagacagagccggcggacagaaacaataacaaaaacaggggattccatccagtgattagctttgaagaggataaattcctctggtgtagccactgcaggcgacattggacggctccaccgatgttcttgttactccgacgaacgtacagttcatgcagccgatgcgtatgggcttttgcttcgtcatcctcacgcttgccatgctcgtcgccggctggcacgctcgaggtcactccggtcacgcgcgaggtctgggcaacactagagcacggcacctggatgtgtctgctgtttctcatgcggacgggtgcgagactgggagagtggaggcgggagtagctgccagcgcgatgaagcctcttgcagcacgctcgccggctccggcgcagtcgtgaggcgggccgcgagcctcgctcctatcaggccccctcctgct

SEQ ID NO: 3475 - DNA, 510 bp, Hordeum vulgare
tccctttgtttcttgcttctccctttccccctccccctcctcctccttgacttcgccgccgtctcactcgcccgtctgcttgctatctcttggggagagctcggagcgggggagctcgccgacgcagcggcgcaggcgaggacgctgagtttttttgagtttcgggcaccatggggcagaggctcctcttattggtgaccacttgtctgtgggccatttcatgcgccgtgccgcaccatgcttcctcgcgtgacggactgctaaggatcaacctcaacaagaggagctcgacccatgagtctctggccgcggcaaaggccgcgaggcagcacggcgccctccggctgaagagcggcaattcagacagcgacatcgtgcctcttgtcgactacctcaacacccagtactatggggtgatcggcctcggcacgccgccgcagaatttcacggtgatattcgacaccgggagctccaacctgtgggttccctcgtcgaaatgctatttctcga

SEQ ID NO: 3476 - DNA, 494 bp, Hordeum vulgare
ctggcctcggtaccgatgggagcacgggctcgaccgacgccgtgcttacaacgaggcccgaagtcaacggctgcgccgaggacgtcgtctccggcgcgctgcagagggccacaccacggggagccgtgcaagagggacgtcaatggggagagacatcacggccgaagccgcaacggtaggtgaggtcgctcgaagtcggcgtcgaaggcaatcctttggttctccgttcttagaattttgtggcctcgatgctctcggttgagaaaagtgctgataatggagtaaaacgagattgaacgaaagtaatggacgatcagtcttcatttctattgattcttaagttaatatacatctggaagatgtgcgaagaagaggtgtccgttggcaatggagagagaggagacacgactattcggattggacacattccttgaattaatatactaattaatttctaacactgttttcagcttttatggtatgcttttggatct

SEQ ID NO: 3477 - DNA, 386 bp, Hordeum vulgare
ttttttttttttttttttttttttttttgccgaaaaaggtttttgcctcactttatctataaagcaaaccgccagagcacaacaactaacataagttcaacccacccacacgaagtagcacacgacaaaaatatggggcatgtgtcacaaaacatatgaaaatcttaagagcatgcagttatgaaaatgcagttatagaaaatgcccaacatgtgtcacaaaacaacaatgactgcacaataggcataactttgcctacatggcagtgtcacaaagctgccgaacatttcttggtgtcaccaagggcgctgagccgtggaaggcaacttccgtgagcttctgtgcggtgatctccgtgggatgcacaaagtcccagaaaatgtggt

SEQ ID NO: 3478 - DNA, 389 bp, Hordeum vulgare
cggccagtctcaggcatcggcgcacctgagcagatcgatcttcaccgttgccatcggtggcaacgacatactcaactacgtccgtccaagccttgtgaaccatgtgctaagcccttgtcctccaactcagtctcctgatgagttcgttgcctcgttggctctgtcactgaaagaccagctgcagaggctgtacaaactcgggatgcgcaggttgttcatcatcggagcagcgccactggggtgctgcccggtgctgcgtgggaaggtggcgtgcgacggagtagcgaactacatgtcatctcagtacaacatcgcggtggcttccctactgcggaacatgagcgacaagtacccggatatgctctactccttgttcgacccatccactg

SEQ ID NO: 3479 - DNA, 518 bp, Hordeum vulgare
ggctctccaagctcagccccgacctcaacatcctcatcggcggcaggaaccgggagaaaggtgaatctttggcatctaagctcggtgagcaatccgagtttgtggaaattgacactggcaacgcggccatgttggagaaagcgctagaggatgtggacttggttgttcatactgctgggcctttccaaagggaagctgaatgcaccgtcctgcgggccgcgatatcgaccaagacagcatacatcgatgtttgcgatgatatggactattcatggagagccaaagcttttcatgaagaagccaaagcccaaggtgttccggctattacaaccgccggcatatatcctggagtgagcaacgtgatggctgctgagcttgtggatgctgcaagaagtgaagatggagaacctgagagactaagattcttctattatactgcaggctctggtggtgctggcccaacaatattggcgacaagttttctgcttcttggggaggatgtaattgcgtataacaaa

SEQ ID NO: 3480 - DNA, 555 bp, Hordeum vulgare
ccgtatatgtcctaggataacctcctttggatcagtctctatcatccatgaaggcttgttcatcacgaagtttgttgttccttgggatgcacgctcaagaagcagcttccttgattcaattgctattccctctggctcttctggaaaccaaacacctggttgcgtgctcccctccagaactgcttgaacaaatgcagctgttgaatgacccaccgatacagatagtttcctatgagaaaataatccaatagtattccgaccattcgaacattccaagtctactctcatggacacacgctcccctacaatgccatcaatggctcgaacaagggggtcaattttttcaaccaactttctgaccttatctttgtcccttaataactcaacgggtaaaaagttagcgaaagcctccattccccaattccagaagaaaggagcagtaccaaatcgagcactgacagttgggacacctaaaaatttatgagcactcttcacttcaggcaaattcagtaagtaaacatctctctttctgaccccttttccgaaatcaatgtt

SEQ ID NO: 3481 - DNA, 473 bp, Hordeum vulgare
aggagaaggcgaggaggaggaagaagatgccttgcctgaacgtgtcgacgaacgtgaacctggagggggtggatacctccgccgtcctcgccgacgcctccagcaccgtcgcaaccatcatcggcaagccggaggcctatgtgatggttgttctcaagggttcagtgcccatggcattcggaggtacccaggagcctgcagcctatggcgagcttgtttccatcggagggctgaaccctgatgtgaacaagaagctgagcgctggcattgcttccatcctggagtcaaagctgtccatctccaagtcccgcttctacctcaagttccatgattcaaagcgctcggactttggatggaacggaaccaccttttagatgagtcatatggcgtggagtcctgtatgaacttcagagttcctaatattctgttcattgcctatttaaggagaaactgcggcagtaagacatcgtgtc

SEQ ID NO: 3482 - DNA, 402 bp, Hordeum vulgare
aaccttggtccccttttgtgccacaaaagtccaggctcaaaaacactggccattaatctgacacgagtcttactgccgcaggttctccttaaaaggcaatgaacagaatattaggaactctgagttcatacaggactccacgccatatgactcatctaaaagtggttccgttccatccaaagtccgagcgctttgaatcatggaacttgaggtagaagcgggacttggagatggacagctttgactccaggatggaagcaatgccagcgctcagcttcttgttcacatcagggttcagccctccgatggaaacaagctcgccataggctgcaggctcctgggtacctccgaatgccatgggcactgaacccttgagaacaaccatcacataggccttcggct

SEQ ID NO: 3483 - DNA, 518 bp, Hordeum vulgare
cacgaaaaagcgtatggcgatggaccaggagggcaccacagcccaccagcggcacggcggcggctccatcaccgacgacgccctctccctgttcgcctcccgcctctcgcaccacaggttcggagacgaggagctccgggtactggaggcggcgctctccaccgggggcgatgttgccgcgctgctcagcacgcgctcggcagcccggaaacttctgcgggagagcgtggccggggcgtgcgccgcagctgcggtcgagggggacggggcgaggctctccgtcgccgacttcttcgcgcgcgccttcgccctcgcgggagatgtcgagagctgccttgctatgagatatgaagcgctggttctgcgagaggccaaatactccgacgaccttcaattgcatgtattccatgaagaatggttaacctttgcacatgactctcttgataatgggttctacaccattgcttccaaggcttttgcaagtgctcttgtgcacattcatcccagccacttgaacg

SEQ ID NO: 3484 - DNA, 534 bp, Hordeum vulgare
ctccattttgcataataagacgtatgccatgacatagttatcttacagagaaaaatataaagtggtcttcttttgatcaaagcacttatcattgcaatctgagaaggagacacatacagaggtatggatgtactgtatttaatgaaggaacgttaatgacggagaggaacaaccccagctatctaggtagccttttgtaccaaaatagcttggaaagatgatcaagtcactcttcgcagtcttggagagatccacactgataaatgctcgaaatcaaacctcttctaagtttctcttgcggctaagaagtagtttttgtgtgttccttgttttgatccccagcctaaacatcaagttcgccggtaacttcggtttttctgaatgtaaattgcactcttcactaacgcctgaagttttccttttcatgtattcagcggattgtgtctgaacagaacgctgtgcagataatgacttggccaaggtttggagtcctcttatatcattgaccttgttcttcttcagtgtcgcattagt

SEQ ID NO: 3485 - DNA, 526 bp, Hordeum vulgare
ggcacgaggacgcggcggcgccctgcctagttatccccgcgcggcggcggcgatccggtttcctatcccgcgaattgcctttgtccgattttcaatcaaatcgaaattgcaacccgggacggcggtcacctttgttgagttcaattaaatagaggggtgaaacctgccccgatatcttgtatcggcttctggagggtatcatggggctgctggagctcaaccggttgatgtccatgcggcagcgtcggcgccaccggaaaatccaatcccgtagtatgtcgattgcttcaccggctaaacgaaagggctcgctcggtcaacaagatgacaatccccaagctcgcaaacgaaggaagtattcgctgccggaccttccaaaggacatctggcatgatatactgtccctgctgtcactgtcagatgttgcccgagctggctgtgtgtctcatacatttctaagctcctggagatcccatcccaacctcaccttaagcaaggaaacactgggcctgactggaaatgcatg

SEQ ID NO: 3486 - DNA, 476 bp, Hordeum vulgare
atagaatgtttcatcaactgaaggtacacgaccaactaaaattgcaacataaaatcaaaaacaacacatgaatacacttgtatttctaaggcctggatggccaggcgccatcatttaattttatggcaacgtttgcagagcttcttcacacttaactggaccgtggagggaaccttctccatgacatatttacgaatagcccacagccctttgttttttgtgcatgattatactcctgctttttgggttgcattcaccctttttcccaacacaggacctatcagcgtccccataactactattatcgtacatggcgtccaacgtaaggcgctcgagtgaagttgcattctcaagaatatggcaagttagttcaaccatgctctttgcagagcagaagcccattatcctgacgttcttgaggttgcaatggcgatgtcccagcatctgtctcatgttcgagtctccgtcagagatca

SEQ ID NO: 3487 - DNA, 518 bp, Hordeum vulgare
  UNSURE (499): n stands for any base
aggcgaaggcgaaggcgcaggcggcgaccatggggcactccaacgtctggaactcccaccccaagaactatgggcccggctcccgcgtctgccgggtctgtggaaactcgcatggactgatcaggaagtatgggctgatgtgctgcaggcagtgtttccgcagcaatgccaaggacattggcttcatcaagtaccgttaattcacctggtcctggtaccctgaagtgatgctaatcagggttgaagtaatggaacgcttgatagaaggcttaattttaattccagtaatgtttgctcagtactctccgagtgtctttatgttttgaaggatacttaatgatgtaattgttgaacatgagttaattacccctggaggaagccatttatcattcggagatgcatatgtttttcctcttatcactgtcattgattggtagaagtattgtgccaaggacttgtaagcttaacgaataagtttatttcatttcaatcagttaanaaaaaaaaaaaaaaaaaaa

SEQ ID NO: 3488 - DNA, 496 bp, Hordeum vulgare
  UNSURE (25),(33): n stands for any base
tgtttgaaatgaaataaacttattncgttaagncttaccaagtccttggcacaatacttctaccaatcaatgacagtgataagaggaaaaacatatgcatctccgaatgataaatggcttcctccaggggtaattaactcatgttcaacaattacatcattaagtatccttcaaaacataaagacactcggagagtactgagcaaacattactggaattaaaattaagccttctatcaagcgttccattacttcaaccctgattagcatcacttcagggtaccaggaccaggtgaattaacggtacttgatgaagccaatgtccttggcattgctgcggaaacactgcctgcagcacatcagcccatacttcctgatcagtccatgcgagtttccacagacccggcagacgcgggagccgggcccatagttcttggggtgggagttccagacgttggagtgccccatggtcgccgcctgcgccttcgccttcgcct

SEQ ID NO: 3489 - DNA, 518 bp, Hordeum vulgare
ctgtctccttccttcccccctcctcctcctccggcgacgtccctctcgctctcgctctccctgcccggcttggacgcgcccgagccagccccggtggcgcagcctatgcccatgcccatgccgccacctcctgttcctgctcctgtacagcccgccgcagcgcctcagatgccgcccccgtccatgccgttccatctccagccgcccccgccgcctcaaccacgcgcggcggcgcccttcaacggggagttcctgtcgatgatgcaggagatgatccggatcgaagtccggaactacatgtccggcttccacccccggtcgccgacaagcgcttgacgaccatggccaacatcgagtaccagcacgcaaacaagaagcagcatctcgagaacaaaccaagatcagtctgcctgcctgctcgactcaagagaagcaattaatgaaagaggcggcaagtgaagaggagaggcgaagaagaagaaggcctgtttagatcttgatcttgtttcccaacaata

SEQ ID NO: 3490 - DNA, 547 bp, Hordeum vulgare
tggacttggcctcgcctttttccccccgtctcgtttgatttctttttccctttcctctgtacaaaaaacagtctctatccagcaagcaacatgtttgcctctgcactgcctagcttattcggcacactagtcacgaagttttctccgtctcagtctctcgacagccaacgaactgccatgatcgatcgatcgatctcgagcaaggaaaacgaaactaatcaagacacatggaactaaggaattattgttgggaaacaagatcaagatctaaacaggccttcttcttcttcgcctctcctcttcacttgccgcctctttcattaattgcttctcttgagtcgagcaggcaggcagactgatcttggtttgttctcgagatgctgcttcttgtttgcgtgctggtactcgatgttggccatggtcgtcaagcgcttgtcggcgaccgggggtggaagccggacatgtagttccggacttcgatccggatcatctcctgcatcatcgacaggaactccccgttgaagggcgccgccgcgcgtggttgagg

SEQ ID NO: 3491 - DNA, 566 bp, Hordeum vulgare
  UNSURE (15),(31): n stands for any base
ggtacccccccgggnccttggcagggaattncggcaccgagggggccgatatcattacctacccctacccctgccggcctcccccaccgccgcctccgccaaccaccgccggcctccgccctcgccctcgcccccacagctggtgacctcgtctacctcccctctcctctcccctcctctcctctccttatcagaagagaagagaagagaagagaaaagggtggtcgggcgaccatgccagatgcgcccacaaccggccggcgaccacagcacgtcatcgtcatcgtcatcgtcgaaaactcttcttccacctccctcccagattcatgtgctgctctcggtaggtgcacgccaaaccctagccgcagcccgcagcgctagctgttgctgtcaaagtttgcccggcacaagcagctccgctaccaggacacggacggaccgctcaaatccatggatttcttcgattccgttcatgcttgccggggaatgaattgattggatgcgaaaattgcattttgctgcacgggcatgacggagtgaacctcatcgactcgccgcatctggga

SEQ ID NO: 3492 - DNA, 497 bp, Hordeum vulgare
tataaatttacggttagtggttgacataccacaattcttgagttacatcggaatttcttgggcaattctacaaacggggacgttgatgtggatccgacgcgaactggttgtgtcacggctcgatgttcccaacagctacccacggcacacaggtcgctcgcggccccgtcgtgcttgtggacggccacgacggcagaacgactccgcctccatgtacccctcgtcctcctcccaatcttcttgtttgcttcattttccattctcatctctgtgcgcgggtgtgggttggggcatcgactggtgtaagttggacattagcaagggcaacaatcaattccgatgcagtgcgctggacggggaggcctacatctgcaaggcaaaaaggaggccgtgctcaggagggaccagaggtctatgccacgatgccggtggtatgcccacaaggagtgaattaaatgatccatggttgctcccagttttacacccatagaaaactt

SEQ ID NO: 3493 - DNA, 517 bp, Hordeum vulgare
cggaacctcacacaatgattggcagagcagcccacatagaattcctggagactgacatctacgccaagttcatcatgtggtccttccctgaactattccgatgacgatgaccatgaccatgactatgctctctctgtaatttgggaaggcatgacgttccaaacaaaaccaaaaccaaaccaaacctggatactgcactactgaccaagaaaggaatataaaggtttcgtcaccaagatggatagcactgtaaagttgcctagcagtaacattttgccagtttgttagatttgatttgtataaatagtcgatttgttcatttcgatttatagtcctgtagatgtgccgtcaggtcttgataatccaacgtcttctggtgtggtgtattttagggctaccagccagtttaggaggcccaaacaggcagtgagcttatgtcaaataagcatgacatgtgttttatctttttttaatgatcaccacatcaggcagagatcattgtgtggttcttgtcatg

SEQ ID NO: 3494 - DNA, 547 bp, Hordeum vulgare
ggatcttgtgacaaattaatgaatatattttgattcttacaatctcaataatgcatttgtacatccaaagtcaaaagtcgtacaagtttgactgcactctccggcatccaatgaatcctcaacattcagttacagatcaacaactacatgacatgacaagaaccacacaatgatctctgcctgatgtggtgatcattaaaaaaagataaaacacatgtcatgcttatttgacataagctcactgcctgtttgggcctcctaaactggctggtagccctaaaatacaccacaccagaagacgttggattatcaagacctgacggcacatctacaggactataaatcgaaatgaacaaatcgactatttatacaaatcaaatctaacaaactggcaaaatgttactgctaggcaactttacagtgctatccatcttggtgacgaaacctttatattcctttcttggtcagtagtgcagtatccaggtttggtttggttttggttttgtttggaacgtcatgccttcccaaattacagagagagcatagt

SEQ ID NO: 3495 - DNA, 329 bp, Hordeum vulgare
gtacctccgggcctgcaggaaattcggcacgagggcacagcgaaccagctgcgaccggaggacatttacgttaatggggctaagttgtcaccggaggagctagctttgctgcagggatgctcgtgccctccttctaggctccgccctggcttctattggtacgacaaggtatccggcttctggggcaaggagggacacaaaccccattgcataataagcgcaaatctaaatgttggaggtgctttagctcaaaaggcgagcaatgggagcaccggaatcttggtaaatggccgtgagattacaaaatctgagctgcaatacttaagtgg

SEQ ID NO: 3496 - DNA, 549 bp, Hordeum vulgare
ggcgtgccccatgtgaaggagaccgataatgatacatacagatgcaagaattaatcggaataggcaggcctcttgcctctcattctacgtgtgaacaactaataaacaaacaaaccatacaataaattacaaacagaagatgagctgggaaagaagaaccaaaatgggcaaagctctaaaaaaaaaggtcgtcgccggagagggaaatgcacaactatttacacctcttcttcgtcttctgtcacgcgagcaaatgtttggtcgccgtcagtgggagtaggagctcggctcgtcgccgctgtataccgtctcgctggagccgaaaacgggcttctcctcctcccacttgacgatctcccggccgtagcggatcgccgagcagacagactgctggtccagggcgttcacgtaggacacatagagcttccgctctgtgagcgagtggaacagccgcttgaatttcatgccgatgtagtgcgccgccatctgcgccagcgacgcaccgttgtggctgccgcgcttgcttctgctggttccatcaatcaggtt

SEQ ID NO: 3497 - DNA, 518 bp, Hordeum vulgare
gcaggattcactgttgctcattgtgatgctggttcaacttatggatcgaatgatagccctgatcttgtcagtgatcttaatgacaagatacatgactcgattcatgatctccaattaccgataaaagaatacccgttggagctgaagccgcttttgtatgcatttggctttaagcatttgagtatgacgaccattagggcctttttattatactatttaccacttctggagcctcgtccgcccactgatgacgatgacgatgatgatctgcttcaagatgattcagagaggcctccggtcgacctggttactcccttccataattcattgaagcaaatcgcacgcgaggtttctgttgtaacaacaagaagagtattcgaaaggatcgcggttcgtcatgtttcagcaagaacagcatggaagcttctcaaagatgctgcaaaatcatcgaagaggaaagctatgagggggatgtcaattccagaatacacatactgtgttgccagaacaactttccg

SEQ ID NO: 3498 - DNA, 559 bp, Hordeum vulgare
  UNSURE (14),(15): n stands for any base
gtaaagatggttcnnctttgagttcaaatctgaagcacagtaagcgaagtaagcatacataatagctagttattcattgtgccaaaagtaagcattacacaatacccaatgacattgtgccacgaaaagctattaaccatgcatagttattcatcagctttgagctccaagttaggccaacgaagatcctgacagtgtaggctccacttcatgttcttcaaaaccaggcaggctagacgcaaggttggatgacctgggtttcttaactgtgtagcgggagatggtggtctttacccttctagcgggaactgtaacttctcgaaaataaggatagcaacaactggtcctgcaaaatctccaaggatacaaccaatccactgtccatgcactggatgcaggaggacaccaaggcctgctccaatcgaggcaaaaaacaaagagaaaccacatttgatggttacgctatagatacttctcccgaacaatctgagtttttccttctcgtcgaacaattcctcgtcattatcaggttgacgaataaaacatttgtagacctgga

SEQ ID NO: 3499 - DNA, 1108 bp, Hordeum vulgare
  UNSURE (1)..(20): n stands for any base
nnnnnnnnnnnnnnnnnnnntttaaaccacttacatattttggggtgttaaaaaccaaattgtgagtggctctcaataacctgagtcgtattacaattcaagtgaaattaaccctcactaaagagagacgccttacaattcaagtgaaaataaccctcactaaagtgagtcgtattacaattcaagtgaaattaaccctcactaacgtgagtcgtattacaattcaagtgaaattaaccctcactaaagtgagccgtattacaattcaagagaaattaaccctgacgagtgtgagtccggtcgcactttatgtgaagtgaacccttactaaagagagccgtgttacaatttatgagttaaaatcctttaccaaagagagtcgaattaaacttgggagaaaccatctcttactaatgtgtgttgtattatagttcctgttgagtttatccctttctattgtcacttacctttttttttcaccacctactagcctctttctcgcagttttttattttagttttttatgcgaagcggaattttgtgctcatgttaccgcctttttttccctctcctgctctttttctatttccccatcagcgttttttttttttttgaaacacccacttgacagccatctgcttactctttattgcgcctccgtcctctccttattttatgcttgttgttatgccccctgttcttaatttccacgcctcgcgtgcctttagttattgtggattatcacaccctctcgcttttttggttagccgatggtcatcttaccattcactctcacccgctttatatccgtcttcgccgcgtatggttgcaagtgattatcttttctgtcgtgtttgagccctctttttgtagtttctcccggtatttacttattagattgtttacgttttcttgtcctttattgatatgactacgactataaagtgtgcggagttagatttaggaagcacattaggagtagtgagaaccttccgcatcggtatgccgagctattattttcccactcttatccctactgatacttacataggtacctgatgtgtgcgcccgacgcgtttgttattctacttcccgctcctctgtactt

SEQ ID NO: 3500 - DNA, 517 bp, Hordeum vulgare
gcgggttgacgatgcgggtgacgtgcgagaaggtggtgggaatcgacctgggcactaccaactccgccgtcgcggcgatggagggcggtaagccgacggtgatcaccaacgccgagggccagcggacgacgccttccgtggtggcttacaccaagggaggagaacggctagtgggccagattgctaagaggcaggccgttgtcaacccggaaaacaccttcttctccgtcaagcgcttcattggacgcaagatggctgaggtagatgacgaggccaagcaggtctcgtataacgttgtgcgtgatgagaacggaaacgtcaagctcgactgccctgctatcggcaagcagttcgcagcggaagagatatccgcgcaggtcttgaggaaattggtggatgatgcatctaagtttctgaatgacaaaattacaaaagcggtggttactgttccggcgtacttcaatgactcacagagaacagcaacaaaggatgctggccgtattgcaggactggaagt

SEQ ID NO: 3501 - DNA, 534 bp, Hordeum vulgare
ggcaattcggcacgaggattgacttctcctctcctctcttctcttcccctcccgtcgtcgggtaagcgcaagtacggtgttcgtaatcggttccgatctcgcgctcccttttcgctattcttcgtctgattgtattccaggctagggttctgtcttggtcgaggtgctcctcccgtcgatgtcgaggtctagctagtcccggtgttttctcctcgtctgttccgttgatattggtatcgtgttctgaaccttgctgctttggtttagggtcgaggctaatctactttgatttgacttctgatctgatttagggatctatcatgctctggttgcgatgtgatttagggtcgcgtcttatcctttatattattatcatggtcatgattgcttattggatttaaggttgtgatgagaaatggagattatatttggcgtgaataacgaggtctgtcggtatagatacgtggaggtggagcagtttgttttgtttcatttctgtttgttctggaatctggaggattggtctggtcggtt

SEQ ID NO: 3502 - DNA, 551 bp, Hordeum vulgare
tgtgactgtctcaacccgttgtttttcgcccaaaaatataaacaccttgaactgaccaagccaaaatgaaaccacaaccttcaatctctcattcggatcatgtcaaacatctccacggaaccaactaaaccgaccagaccaatcctccagattccagaacaaacagaaatgaaacaaaacaaactgctccacctccacgtatctataccgacagacctcgttattcacgccaaatataatctccatttctcatcacaaccttaaatccaataagcaatcatgaccatgataataatataaaggataagacgcgaccctaaatcacatcgcaaccagagcatgatagatccctaaatcagatcagaagtcaaatcaaagtagattagcctcgaccctaaaccaaagcagcaaggttcagaacacgataccaatatcaacggaacagacgaggagaaaacaccgggactagctagacctcgacatcgacgggaggagcacctcgaccaagacagaaccctagcctggaatacaatcagacgaagaatagcgaa

SEQ ID NO: 3503 - DNA, 517 bp, Hordeum vulgare
cctcgtgccgacggccacttcctcgtcggcggtggcggtatctacgccgcagggagtggcggagcggcgggggatcccggcggcttccttcgtcgaggatgtcgagacctacctccgacaggctgggctcgaggtcaactccgcactcgccttcctccaagaaaggttgcagcagtacaaaatggtggagatgaaacttttagcacaacaaagagaacttcaggcgaaaattcctgatatagagaagtgcttggatattgttgcgacgttgaaagctaaaaaagctttgggtgaggcactcatatccgattttgaattatctgagggaatctattcgcgtgctaaaatcgaggactctgactcggtgtgcctatggttgggtgcaaacgtgatgctggaatactcctgcgacgaggccaatgagctcctgaaaagtaacttggataatgcaagggccagtttagaagtccttgttggtgaccttcatttcttgagggaccaacaaacaataacccag

SEQ ID NO: 3504 - DNA, 552 bp, Hordeum vulgare
  UNSURE (49): n stands for any base
taacgaatctgtaaattttgtttcaataagcgctaaacaaatacatgtnagcccaaaacagaagcgaacgtcatcttctacaccacaaggtctagagttccaacaccataaaactgaatgcgattgatacatttctgtcacgcggccaaggcaccatcaccagcaaagggcacacatactatgacgatagactaaatcgctaaaggcggcaagaagtacaaaaataacccgatttcattggctgcgcacaccttatgatgatcatgttcctttcatagcaggctgtttgcttctccgctggtgcacgtcccagttaaatatccgagcaatcgtaacctgggttattgtttgttggtccctcaagaaatgaaggtcaccaacaaggacttctaaactggcccttgcattatccaagttacttttcaggagctcattggcctcgtcgcaggagtattccagcatcacgtttgcacccaaccataggcacaccgagtcagagtcctcgattttagcacgcgaatagattccctcagataattcaaaatcggatat

SEQ ID NO: 3505 - DNA, 418 bp, Hordeum vulgare
ctcaccacacagaggcttccggaaagccctagccagatcggcatggcatccccgccgccgtcgccgccggactgggccggcctccctgatgatgctcttcttacagtgttcgggcgcctgggcgcgccggaggtgctcatgggcgccggagtcgtttgccgcaactggctccgcgtcgccaccggcgagcccgacctgtggcgccgtgttgacctatccgactgcttcgaccccaccattgacatggtggccatggcgtgcgcggccgtcgaccgcgccgacggccgcctcgagcacttcgccgccgattgtttcgtcaccgatgcgctgctcttctacatggccaagagaactaatggcttgaaaagcctgcggctagttaactgcatgaaagtctcagacaaaggcttggttgctc

SEQ ID NO: 3506 - DNA, 347 bp, Hordeum vulgare
tttttttttttttttttctagtaaaatctctatatttagaaacggagggagtgctccgtatgtaataaggtacataatacatactggttacaaaggagaagacaacgctagcaaaattcccaacacaaaaaggaaccgaatccgccgcgccttcttatcatggaagacatgcacacacggacatgttcgacttgtaccataaacaggactggtttatgggctctagatgaccattgcaaacttctctgagttgccatagacgatcagcacatgcccattggtaacccatctatcataaagccaaatgaccaagagctacgtccagatcctgatcctcctggtcatcc

SEQ ID NO: 3507 - DNA, 518 bp, Hordeum vulgare
agcagaaggaaggagaggggagaacgatgctgcccacgacggcgtccaagggccggggggccgcccgctccgccccgccgctcttcggtccgtatctccgccgtattgtcaagtggcagcaaatggatatcgaatacacgttttggcaaatggttcatctttgtacttcaccaaaagtagtctaccagcacaccaaatatcacaagcaaacaaagaaccagtgggctcgggatgatcctgcatttattgtcattctaattcttttccttgtgtttgcgacatcagcttactgtgcagcgtttgcagagagtgcgccccatgctgctttaacaatcatctcggttgtgtttgtccatttcttgtttgctgggctagttttggccacactttgctggtttcttaccaattcttatctgagggaggaacctaatagccatgtggtcgaacagcgtgtcgagtggctgtatgcatttgatgttcactgcaactcgttcttccctgcattcgtcatcctatat

SEQ ID NO: 3508 - DNA, 545 bp, Hordeum vulgare
tagcttacaataaaattgtacacagtccttgggccttgaatcaaaggaaacaacacatatatgaacaagttggcaccaaaatggacgtcattcaaaaggcgctcgctgatggccttccgcaggcaccaaatatgctctgagcttttctgaagctcaatcttccccgatagcacaagagatctaagatgctatttcaaactgtatgtcccaatctgccattagtttttgtcaccagtcttcttttacttaacgtactagttaccactcttaccggaagtacaagctcagaaagtatcgtgttggattaaaccctacgagtatcatgagtggcgatagaatgatgacaagtccaatcgggtacaagaaaaatgttgttcggtccaaaaatggaagaacatcatatcctaggaagttcagatagtgataataagaaattgccaccatgaacaggaggtttgataatagggcaggcaagaatccatgtgcgatcaacagaggcgacaaaaagtattgaagcacatataggatgacgaatgcagggaaga

SEQ ID NO: 3509 - DNA, 517 bp, Hordeum vulgare
ggtcgagaaatgctagtaaatctgaaataagagtgcctatcggaaacttgctcggagctatcaccctgatgtgaacaaagagcctggtgctgaacaaaagtttaaggatatcagcaatgcttatgaggttttgtctgatgatgagaaacgcgcgatctatgataaatatggagaagctggtctgaagggttctggcatgggaacgggagattactcaaacccatttgatctctttgagtcactattcgaaggatttggtggaatgggtggaatgggtggggggcgtgctgctcgtaacaggccaatgcagggtgatgacgagagctacaatttggtcctcaacttcaaggaagcggtgtttggtgtagagaaagagattgagataactaggctggaaggctgtaatacttgcgatggaagtggcgccaagcctggcacaaagccaaccacgtgtaaaacttgtggtggtcagggccaggtggtctcctccacaaggacaccacttggaatattccag

SEQ ID NO: 3510 - DNA, 554 bp, Hordeum vulgare
accaaaatgccacatgttcgtgttacaggttacaaaatgctcataaaatgttgcagcactttctgcaacaaatattgagaacctttgtgcagtaataatttccctaacactttcaaagatacaagaatcacattgtcaaaaatagtctaataagctcggctaaagcatacgacaggctattgcaaaaagttcaccatacattcggtgatttgtggtgacctacctttctgtaagcttaaaatgaagatacagacatggctttatctctctcagttttcctccatgacaatgagtgcagaatgagcagagttcctacaataacaactccaactgtcactttgtcgctgcaatttgcatcaaaattgcctatcgcacaagcaccgaaccaaccaatcatgattcagttatcatctcctactgtttgccggttcagctttgttgagatttgcaagctcttcgatcagctttctttcgtcactgcttagacgctttggaatctcaacctggacacgtaccagctggtctccacgagcgttagacttaccaagaagtgg

SEQ ID NO: 3511 - DNA, 432 bp, Hordeum vulgare
caatcccctctcctcttttttctcctctactccacgccgcctctccccctccgcacccggcgcggcgaccggcagaggagccggaggaggcggcggttgctcggcccccggtccgcggagacgacgacgacgacgacgccgccgacgaggacgacggtgacagcaacaaggcggtgaggtgtggtgcgggccgacgatggcatcgaccccgccgccgcgagatctcgcgcgcctcgaccccgccgcgccgcccacgcgagatctcgccggcctcgccctcgccgcagaaagatctcgccggccccggcctcgccacggctctcacgcggcgacgccgtcagaccaatcgcctgaccggcgcagttcatcatcatccgcctgtaaagatttcctccgcaagtttgtggacaacgagcttctcacttgcagcct

SEQ ID NO: 3512 - DNA, 475 bp, Hordeum vulgare
ttttttttttttttttttaacgcacaaatcaacacccagcaattgcaggacaggaaattgaacagcatttacaagaacttaggtgcacctgaccactgcaccccctcaccaaaagaataatttagtcagaacaaaatgctgctaactatgcctcaccacctctaatcacaattcacaaatccattctggtgcaatttcaaaaagaaaagtgagcaaaaatttgccgactaccacacactttgagatccacatttgcctaccacttataagtttcaacattcaaggtactaatcaagatgacatcagccaaagcgcagctcaccaacttggaggagagaatttccagagcacatcctgttgcagatatcctcaaggatctccactgcattcttgggagggtaatacagtcagaaatccaagttgagatcagcagcaggtcaccagattggacgttttcaagtacccgtcgggtgaa

SEQ ID NO: 3513 - DNA, 519 bp, Hordeum vulgare
ggtcctcattcaatggatatgatctctaagcatttcccccctctactgccactttcaactcgacatggaacttaacaatgtcccagtatcttgagtttctgaggactacaggatcctccttcatgctgaatgctcaaccgtactatggttatgtgaaagggcaaggtgtattccctttacagtatgccctgtttcggtcactcaatcccaacagtcagattgcagatcccaacactaatttgttctataccaatatgtttgatgctatggttgatgccacatacaactcaatgaaagcaatgaatttcaccaatattcctgttatggtcacagcatctggttggccatggcatagtgcacgaaatgagccggctgctgatgttgataatgctctggcctataatacaaatctcatacgccatgtactaaataactctggtacccctagccagccaaataatcaagtaagcacatacctgtttgagttgttcaacgaggatcttcggtcaggatctgttt

SEQ ID NO: 3514 - DNA, 550 bp, Hordeum vulgare
gtgtcaccttgcatgttcattctctaggacaactaaaactgagcgatacatgtcatctacctcaataaagtgagacaaataggacgccctttctatctaaggacaagaggcgcaacaaattccacacatctcatccaaaatacaacgttcggttacaatgtttacatgagaagtagaacgggcagcagcatggcgattagccaagtcaaccagaaagattgagactgtgaagcagaactatcttggctcacaggtccagaagccgtactgccattggcaccggtgcttcctgcgaatttacatgaaccatggcttggatccgtagatgatatcgttgctgtgctattaaagttgcatgttccgccacttgcttgtgttctatgataataatcgttgaaggcatacgaagcaacagctacaatgtcatctggtttgtagcacggctgcccaggttgaattgcgctgcagtttgcagaaccagggccacatgcccaatccaaactttgcttcaatgcactatggggtgcacttgaatttgccacacaaaaca

SEQ ID NO: 3515 - DNA, 553 bp, Hordeum vulgare
ggatccccgggcctgcaggtgaacatcgtcgctggtgaaccttctcctgtttggtcaacttcttctgttttcgttcaaaacaatggcatacgatgtgctccatgatattagcaaatacaaggatcgttgaaaagtcaaggtcagagtaattaggctatgggatgccattaacctcaacaacaatgaagttattagccttgatatgatactacttgatgaagaggcactatgatacatggcaaggtaatgaaacatatggttaacaagttcagaccattgatccaagaaagtttagtctacatgattgcaaaatttaaggttacatctgcaatgaatttccgtccagttgaaagtgaaaagattttacatttcttgcacacgacaaaaattcaagagataaaaggtctaaaaaataccagaatggcaaaacaaagcttcacgttttgtagtattgaagttctttccacaagagatgaccagaatatttacttatctggtatgattctatttgtttcgattattaatttccatgttttccacatattaataccac

SEQ ID NO: 3516 - DNA, 540 bp, Hordeum vulgare
acatgagctcctttaaaaaaatgatatgtttagcacgtatagtcaaacatgtttcaatcaagtttcctttgcccatctggagacacgggatgcagccagtacgtttactcagcatcatctcattaggcagggaggccttcatcgacacatcaactcaactaacaggctaacacagtccgatcttctttcacatccgatctgcagttttttttttatcgtgaatgcactatatatactcctctcgagtctctaaaacgtcttatattgatgaacagagggagtactatatatatatatttccatggttatccctgtagtcgcacctgtagatgacagtaagtactctgcatgcacttgatatatcaaattatgtataaaaacattcctagaaatacttacccattgttaatacaaatacaaaccttccagttttctgacagtagttgatgttactatgacaacatggcccaaagagtcttcatcaatttggccaaccttactaccgcatagtctaatgttattttttgatcctcaatttga

SEQ ID NO: 3517 - DNA, 550 bp, Hordeum vulgare
  UNSURE (20): n stands for any base
gtctccccgggcctgcaggnaattcggcacgaggcacaacttaagattgctgatgagactgaaaaaggaatctatttgaagaagtttaacgagacagaacaaaaggttgctaaagagaatagaaaggaaactgtttcagaaggtactgctcaggaggaatgtaagtattattcaacgcccggaggatgcaaatttggggaatcttgcagatacctacattgcgaagggaaagaaaggaaaacagaagttgcaaaggttgagctgaattttctaggtcttccacttcgtccaggaggaaaagagtgtccgtactatatgcgcactgggagctgcaaatttgccaccaactgcagatttcaccatccggatcctactaatgtggtttcacgagatccattgttggagcatgagaatggtgatattccacaacaaaatgttcaagcatcctctcagctgaatgttccattatggtctgctgaccaaagggcattgaatgagcaccgtgttccttctttagctccagcaccctcatacagtgcgggaatgatcc

SEQ ID NO: 3518 - DNA, 547 bp, Hordeum vulgare
ggttgtttaaaatttgcttttttctagattaggaatacatgcatgatagatgaaaagtgggcttttgtgacgcaacaattgtgtccgaaccgtcaagtgttgtacaatataaagggcagcaatgatgtatccaagcctgtttagtttctatacgaatcccagcggctattcacccaacttcatgcaacttcgttgctgacttgcaaaccaaacccctaccgtcaacatgaaaaccctgcaactttcaattgcgctattttacaagtagaagttattccaagcatcatggcgaccatagaaaaaaactctgccctgcttgctagaccgggtagtttcctgaagtgaggtattgagcagagagaggtggccctgctgcggatactggatggccaaaattaaaagggtgattgtacatgcaagctggcccaaacttgcagactccatagcgttcatagtatgtgcacatgggctgatcaggtctgagtggcaagccgagaggactaagagctctggctgttggtggaggcacaagtgaccttggatggtg

SEQ ID NO: 3519 - DNA, 552 bp, Hordeum vulgare
gtccccccgggcctgcagggaattcggcacgagggtggcatcctcgcaatctcttaataaatcaaaatcagaggcgcatagtaattcactttcaagttctataatttcgaattcaagactaccttcttcatggaacgatgatacaagtgcagtactgaaaattactgaaggacggcaagtatcagaacgagatactttgtccaaaaccttgaagccatatagacctggtattgcaaaggaaactcaagctgtgacatcactggagtcttcgttggacatagacttttctacaataccttcagcctggaatgatgatgaagttgtagcatcagatgagacctcgaaaggaagtgaggaaaagcaagttgtaaatgaaaagtttattccttcagcatcctcaaaaccaatggaatcgggccagatagggtctaagtcatcaacatcaccaaagaatggcgaagttgtaaacagttccaagcaaaatcttgcagattgtgtgccacattcagcaatatcttgttctgttctaaagagggacgatgttgagagtag

SEQ ID NO: 3520 - DNA, 518 bp, Hordeum vulgare
ttcttcagtttgatgccaaacaattgtcagctcagttatagatgattgtcacatttgctttcagtttttggtccaacaaaccccacaccaaaacatgagctttctatgcaccacaggacctaccagcggcaagttacaaaatcatgtacaaaggagtccctcgattccccaaggcaagaaaacatttacacagctacaatggtgaaatagaacagaagctaatcggtgtctcccttctcaagccagcttccatatacttcaaggaccacctgtttcatgtattgacttcgcctagaaaggaaccttgtgcttggaagatatagttcaaactcaggatcgtgtcggcccatttgcatcaactgccttccagtagaactttcacgtaccagttcattagcacaaccattagacaagcactgtgcaaccagttactttcagaacaagacacagcccaaaatagacgccgagaggtcaatattcaccttcaaagacaattaaagtccaaaggttctgttata

SEQ ID NO: 3521 - DNA, 546 bp, Hordeum vulgare
gtttccgggctgcagaattcttccgaggctcgaacctcagatctggtggcccattgccgtgccgcggcggggaggaccggaggcaaaagcggtcgaggagtcgaatgccgcttctgggtgcgcataggcggttagcataggagacgaccggcgcaagaggaaaggttctcctacacagtctgcgtaatcgactgggaagcttgaggctctgtaatgcctcaccgaacagaaccccatgctcgtccaggatgattgcgctcgagcaaacgattaagcaattcacgaaggaatcaccgaggaagtgtgatgaagcctgagctgggactaagcttcgattccctcggagaggcgtacgacttctataacttccactcgttggaagttcaattcgggataagatatggtatacgtaggttgaacgccgagaggacggaatcaatgtaggaaatcgtctacggatgcttggggaagcctgaagcagagaacatcgggtcttgtcaatgtgagtgcctggcacttatcaggctcctgagggatgcagacacc

SEQ ID NO: 3522 - DNA, 543 bp, Hordeum vulgare
tggtctctatatcttggcatcagttttacaagtaaccaagtatgcggatcagttcaaagagattttgcacagttcatgcgctggaggaacaagcgtggagcattcctcactgaaatacaccagaaaatccccggattataagatacacaacttaattcaaatgacatctacacactaccaagtcgtcacgtgcatgtgtctggatcgcaaggtttgtccgcctcacagctccactcttttcaacgacatagcccaggcgttttcaaactcgtccactatgagcatgtggttgacaaccttgtggaactccgccctgaactcgttgttcttcgtgtacagaggtcccaagcactcgttagctttcttcagtatgtgccatttgcaccacctgtacacagtctaacgatagattttacttatagccacctccatagctctgttctgatctgtcaatattgttttaggcgttggtccacccatcactctcaagcagtggcagagcttgaagctcagtcctggcctcctgggcggggtggagtggtg

SEQ ID NO: 3523 - DNA, 495 bp, Hordeum vulgare
accaccaccaccaccgataccatcatgacgcgatcgccgcctccgctcccggtggaccacggctgctacgcggcgtgcagcaacccggaggtcacccagcagcacacgacgatcaccatgcgccgctcgccattcgccgacgtcgccaccgactgctcctcgtcttcctacgcctccagcatggacaacatatccaggctcctcgacggtttcatgaagagctccccgcccaccgccaccgacgtcaaacccaacatagccgtgttcagcgaccctttcatgtccttcgaccgcatgaccggcgccggcgcggggctggctttcgtccctggcgttcagcagcagcagcagcagatgccggtgttaatggggggcatgatctatgatgatgaggccacgggacagcagcagcagctccaacatcagttgccactgtgttcgatcgagaagtggcttctcgacgaggcggcggagcaggtcgctgacctgatggag

SEQ ID NO: 3524 - DNA, 523 bp, Hordeum vulgare
  UNSURE (8): n stands for any base
ttcactgncttatgttcatactacgtacaattcaacaacgggtaagctaagccgaaacacttcagctagcaagtgtacatatcacccagaaacaaaaataaatttcgccacaaaaaactatattcaagaacagacatgacaacccttagccgcatcatgcttgcagatcatacgtaacgtctcgcctgttatttatttcctgttactgtcttgttccttctggcaacaacctggctttcttctcatcatcccatcccatgcaccattagtaatcgtctctctgaataactacttagtctctcttccagggagtgttctctctggtaatttgatggtgtcatcggagcgatctccaagaagctagctagaacatgtaactaaacagaaattacttaacctgtctattatatatagatgtatatgcatgtaattaactacagtatgtatttgggaaagtggcatggttcgttggtttgccttttccagctagtaccacagtagtacgtactggctagtatagcaa

SEQ ID NO: 3525 - DNA, 524 bp, Hordeum vulgare
cacagtccaaagttgattggtggatcaagtgaaggtggtgcatctgtattcaagctggagtacaatggccagcctgcttgtttagcacaatctccccaattatacaagcagatgagcatctgtggtggctttggccgcgtgtttgaggttggtcctgtatttagagcagaaaagtcaaacactcacaggcatctgtgtgagtttattgggttggatgctgagatggagatcaaggagcactactttgaggtttgtgatatcatagatggcttatttgtagcaatattcaaacacttgaatgaaaattgtcagaaggaacttgagacaataaataggcagtatccatttgaacctctgaagtacctagagaaaaccttgaagctgacgtacgaggaagggattaaaatgctgaaggaagccggaactgaaattgagcctatgggtgaccttaacactgaagctgagaagaaacttggtcggcttgttaaggagaagtatggcacagaatttttcatcctctatcg

SEQ ID NO: 3526 - DNA, 543 bp, Hordeum vulgare
ataattttattttgttcgagattggttatcaacataagcagctttgtgagtattaacagaagctccaacacacactgacggtgctacacattggccacgccattaactcaaacgtaatgaaccacgctgcacccatcatcgctgcacccatcatcgtaggttgtttcagtactcgactagcagattggtgaagatgatgacaaccatgggtgcaagctgtcgacgcagaaaggaaacttatggcgcgagcctctgtgggtcgcgagggaaaagcgatgtcttcctgatgttgttgagggcgcagaacagcataaccactctctccaacccgaccccgaaaccgccatgaggaggtgcaccgtagctgaatgattcaatgtacgatgcaatagtactcgcatcaattccacactcgattgcacgtttcctcagaagttcaggcgtatgtattctttgcgctccagaaataatttcctcacctcgaatgaagacatcaaaagagttgctgtaagctggatcatcgtagcaaggcatggtgtagaa

SEQ ID NO: 3527 - DNA, 421 bp, Hordeum vulgare
  UNSURE (16): n stands for any base
gtcccccggctgcagnaattcgcacgaggttcaagttccctggctgcagaactcttgtcgtatcaaggttgaagttccccacgttagtctcccggacttacgaaatgaaattactcggcgaagaggaggctttgtctgtcttctgcagtgctgccttcgatcaggagtctgttcctcagactgctgacaagaaactggttaagcaggttgctgccgagtgcagagggcttcctctagctctcaaggttattggcgcatccttgcgtgatcagcctcctatgatatggttgagcgcgaagaaccgcttgtcacgaggagagtctatatcggactcacatgagaccaaactcctggaaagaatggcagcaagtgtcgagtgcttgtcgggaaaggttagggaatgtttccttgatctgggttg

SEQ ID NO: 3528 - DNA, 550 bp, Hordeum vulgare
tctaattgacagtgtattgactacccatcctgcatttaaaccagggaaacatatacacatcatttgtacatggtgagcctggaggcagagcatccagaacatcagtctacaagccagtccaggttgtaacactcctctgctacctgcacacgaagatccgggatgacctgctcggcttccctccacagcatcgccgtttcctcatcacacacgacgtgcccgagggacttcaacgacgaggaggacctcgggaggctcctcaaccgcgagcattcccgcatgtcgatcttctctaggtttgtcaagtgaccaagctcttccggaaggtctgtaaggttaatgcactgcgatatgtccaggtatttcaacctcttcaggctgcataccgaaggtggaagcttccacagtgccgggcaggcgtagacccgcaggatgctcaggcagtgcagcttgcccagctcatatggcagctctgtgaggtcatggcagtttgacaaggagatgctttccagagagctgatttcacataaactaggtggcagctccttca

SEQ ID NO: 3529 - DNA, 464 bp, Hordeum vulgare
gtcgccatgagcacccgccccttgctcttccgccggccgcacctcccagcgcgagctgctaacttcaccccatcttcctcgcctgctacggagactcgtggagccaggccgggggccgaggtgaggcggtcgctcctccgctcgcgcccgatcgtgctgtcatctgtggccgtggggagtcttgttgctgctggtgctgcgaatgctgccgacctcggggattctctgttaggatcatcgggacttctcttggctgacttaggcatcggagattggtttggaggtttattattttcagctgggcagcaagctaatgaggctgttctggatcagttgtctgccctcagtttcactagcttggcagtaatttttggtgctggacttgtaactagtttgtctccctgtacactcagtgttctgccattgactctaggatatataggtgcttttggctctggaaaaga

SEQ ID NO: 3530 - DNA, 542 bp, Hordeum vulgare
tttgcattcctataaaagccaataactggtgatactttcttgccatttatgtttagctactttacattgcaagacatatgttggcatgtgcaacagtggtgatccttgtctagcagctcttgttcaacaatggcctacaattctacagttcacatcaccattgatgtcgcagggaacagcttgtccagtagggtataaacacctccacccaatagaaatgcaccactgatggggtttatccatgtggaatatcttctgaatgacagcaaactctgcaatgctccagcaaaagaggctgcaatgagaagaggtgcaacatagccagttgtatatgtcaacaacaaacttcccccgacaattggatctcttgaagtggcaacatatcccagaagggtggcaaggacaggtgtactgcaaggtgatgccgctaatgcaaatgtaaggccagcaagatatgcttgtacactggaaggcaagttagctgcagcagatcgagggtcataatcgctgaaaaatgagggaagttgtagctcaactacctc

SEQ ID NO: 3531 - DNA, 518 bp, Hordeum vulgare
ggagcttggaaagtatggcagtatagaaaatcaacttttatgccgtcaacgcattgaggaagtggagcctatgattggattctgttcacgcaaacttggtggatctgctctgcaagaacatgagctcctagatatggaaaaggaggggcctgcttatgacctttttaaagctaagattgaggctgtattatctgagacaaggtcacagcaggcggcttctatgactgagtttaactggcttggtcgccgatttccaattaccagtgcaaagacccgtgtctccatattaaaagctcagcagctggagagagatttaaatggcgcagccacagaaccaattccagcggacaaaaaacttgctatatttgataaactattttctgcataccacgaagctcgaagctgcatccgcaatgatttggcttctgctggcaatgctgagaatataagagacgaattgaatggtcttgacaaggctgtcagtgcagttttaggattgagaaccatagaacgtaacc

SEQ ID NO: 3532 - DNA, 549 bp, Hordeum vulgare
agtcgatcattagttatgttcatacggtataacggattgtaagcagtgacactcaaactgatgtattttgaaacagtacaaaattttgcctatcaaacttggttcaacttagaaaccttccagatatcaagcagcactgcgttgagcagcacaggcaaaaacaaattgatccaccaaagtaatgtatcaaaatccaagagcaaggtgatcctgaggaattaaaccatgcgctcttctttttacccccagaatctgcggaggagacccttcttttccttcttcatcctgttctcaaggttcgggaactcaattgtgttgtatgccatatcaagaacaattgggttgcagggaactgattggaacggtggtgggaattgtgaaatgcgacatggagctttggcgctttgctcaccaagtgctgattcatagctccctaggatatcaaggaggtatttagtatcctttcttttatcgtcgccaagtgatatagttgagactcctttagaaagtctttcaggagcactctcatcctccatgatacctgttgca

SEQ ID NO: 3533 - DNA, 519 bp, Hordeum vulgare
  UNSURE (11): n stands for any base
ctgctgcccanaaggaagaggaatcattgcactcgatagaagccaataaggaaaaggctgctcaacttcataatgaggctaaagcaattcaagaatcgcttctgcatatgaaggcagctacagaacaattacaggaagcagagtcgcaagtccttgctgagaagggtgttgccaggaatacatataaacaggatttggaagaaactgagataaaattgtcatatttgagaagtgaatttgatcctgctgcttataaaaccattaaacaaaagctagatgagaccaactctgagatttcatcaatgcagaaaaagatagaagatgcccgtgttctagatttagaaacagttgcttctatcaccacagaattgaatgatgcgaaggaaatgttgcagaaagtagctgaagaggaaagcacacttcggaacttagtagaatcactgaagctggagttagcagctgtaaagcaggaccacagtcaactcaaagagaaggatacagatactgaatccattgttg

SEQ ID NO: 3534 - DNA, 551 bp, Hordeum vulgare
ggctaggagtaagaaaacagtccataaaaaattatacataggatgcagttatgtcaggaacatactacatgcaaccataaatatattacataaagtatggcatccaaccatctgtattatacaaagtggaaacatgaatgagaaccacaaaaatatcaatgtgactggaaatccacaatgatatcatacagatttttccccaggtgatggagaactgccatcgacatggctcttcttcttatgaaagatgcctgtgatgtttggcaacacaaatcccttcctcaatagcgttctgttgctcctttgatgcccatcattcttctcggtggctttcccagaagaagccttctgtacagatgaaggtgtggttgcgtgtgcttgcccttctgcagaagacacggactctgcagctttcttctgttccttttcacgccacctcttaagctcaccttctacagccttctttgctgcttcagccatctccgccctcttcagtgcctcctctgttgctaattccatgtcctccatctttctccgggcagttttcattt

SEQ ID NO: 3535 - DNA, 520 bp, Hordeum vulgare
gggttttccccagcacacaacccagcgcactcccctgcctctccctccttgggatcctcccagattgatcccacccaacgtcgacccaccgtcatcccgaggccctgacccttgcccctgtcctcaagcctagagcctgagagcccgcagcgcgcagccatctgcagctcccccaagcctctggatgcgtccgctcacccgcagcctccttcgtccgtgcgggcataggagctctcgcgaagaaggccctgccggagccccgcacatgccggcctcgcttgtagtctcccgctcgtgcatggacgcaaccgtccctaccagcgcccgcacgccgtgttcgtcgctgcatgctgtagttgcaggtcgccctgtgctcttcctctcgctctcccatctctatttctttctctcccttcttttcatctctctctgttctttgtcgttataagcagaagcagcacctaaagcttcaaccgaactgggacccgatgccgaccatgtcagtgcctggatccagcag

SEQ ID NO: 3536 - DNA, 436 bp, Hordeum vulgare
agaaaatgcggtgcctcgaattcgaaccccaacctctaggttcaatgcaggcgatgattacaagctcgcctagtttagtgcgtttgaacaaaaacatggtcatgttcttttgaactagggccaaattaggtgtttacatcgtagattcagtgaagtgagtgagacaaccggaccttggaagagctaaggcgaggctagcgcggctggaggcaagctgttgccaccaaccaggcagagggcttagggaagcctagatctcggacgaggagctcgacggggctcggttcctgctggatccaggcactgacatggtcggcatcgggtcccagttcggttgaagctttaggtgctgcttctgcttataacgacaaagaacagagagagatgaaaagaagggagagaaagaaatagagatgggagagcgagaggaagagca

SEQ ID NO: 3537 - DNA, 457 bp, Hordeum vulgare
gtcctcccgggcctgcaggcaattcggcacgaggcggtgttcttgatctgcctggcagcagggtgcagcatctgttggttaacacggtctgcttcgtggtctgcatacgcagcttctccgcagccaaccgccccctggccctctccctttccataagcttcaacgggctcagcgctgccttctacaccctcttcgccaacgctctctccccgtattccccatccgtctacctcctcctcaatgccatcctccccctcgccgcctccatcgttgcgctcccagcgatcctcctctgccatccacatgaccacagcagcctccgcagtgtgccaaagcatgacaggcgtgtcttcctctgcttctacaccattgcattcgtcaccggcatatatttactgaccttcggttctgtcaccacaaccagctctgctgcaagggccgtcctcatgggcgccat

SEQ ID NO: 3538 - DNA, 554 bp, Hordeum vulgare
  UNSURE (36): n stands for any base
agttaaggcaacccaccttggcgccttcaagttgancattagtgccctgtaaacagaacagtagttctaccttttacatagggctgctaatctcataacttgctgcccccttgttgaatttcgtgatggtagtaattacatgtattgcatctaacccagtccacccagaaccaaaccaaaacttgtacaagcttagccatgacttcagaacagtgaggaacaaacaaggagttcctttctcaactcaagacttggctatggtgcttacaactagattgaccagcagcagtagcgtaagcctgtcttgttctcaagaatagggctatgcttgatgccaagcccagcaatgtgatgcaaccccacacaaagaatgtgtttgagtagcacttcgcacccatgcacactatcatggtgtcaaccgtgccagtgagtttgtccagtaccatactcttcaatccatttgcatcatataccagggcggcaatctgtccatagaggagtgagccaagagggatattggtgatgaggatgttatggttcacaccgatgctatt

SEQ ID NO: 3539 - DNA, 518 bp, Hordeum vulgare
ttttctttcagttggaaatttggctgaattatatgattcagttgatggttcaggttttggtccacattcaaaagtttctcccaacaaatcgtcttctaacttgatgacaagaactatgtctgggccagcaacctctgagacttctctaccagttgatcggcccatgagattgtcagaaattcatgttgctgctgagcatgcattgaaacagacgatatctgatcctgactttatgacgtcactttcatcaccagaagaatttgagaatagatatatggagcttactaaaggcgcagctgacaattatcaccgctcttggtggaaaagacatggagttgtgcttgatggagagattgcagctatatattttaagcatgggaattatgatttggctgcaaaatcctatgaaaaagtgtgtgctctctattctgcagaaggctgggaagagctgttggcagatgttcttcctgatcttgcagaatgccagaagattcttaatgacgaagctggttatctgg

SEQ ID NO: 3540 - DNA, 555 bp, Hordeum vulgare
ggatttgcaccaaggtacataatatacaccgtgcatgtaacctatagaaaaaaggaacagtctccaggcaaatacagaacaccttgtatctcaaatggggaggctctaagcagctatcgtaatggcacagaggtggctcatgaatcaagccggtatgcagtaggaggtgctgagggtgggaggaagcacgcacaccaggtggggacctgccgggttgcagctgatattcgcatcgcctacgtcgggcaggcctagctgtggcgggtgtacataccccgacaccagcgggacacacgtcacggcgatctcgatccttgatccttgtgtttctgagaatgaaatgtgaccgcttttcctcccagcaaccatccagttctgtggattagcgtccacctgataaagtatctcatcatcggacagagatgcctcctccaggtccttgagcctttcaacccgccatttcatgttgactaattgaccaaccctcaggcaatcggtagaaaacggaaggaatccaactgccaggcatggatccagaacagggcgcttcagttt

SEQ ID NO: 3541 - DNA, 517 bp, Hordeum vulgare
gcctaggcaaggctacaaaaaaggcatactgtttcagaggataaaattcctggtgagaagtcaagtgtggcagctaacacagaaaatgtgaagaaagctgttcaggtttcttcagacacatcatctgctgttgttacatcacatgatgatcccccagcccacaacaagaagagtgccaggaactcgagaaataagaaaaaaattgatgatgctccagctacttctaaatatccacccatggttcttagtcagcagaatacaccaagcatctccagtgagccaaaaataaaaaccgctggtgttatcattagtagttctatacttcctgctgaaaataccgtgcttactgttggaagtataaccgtgggtggtatttcatttggatctttcaaccaggagcgcctgaaattaccagaggaagctcagagcactgcaaatagccggccaaaacctcagcaagcaaaaggatcgagaaagattcaacatgctacccgacctgtcgagaagccacatggga

SEQ ID NO: 3542 - DNA, 551 bp, Hordeum vulgare
taaatgctgaaatatttatttgcctacctgttgtgaatgactcgacatcagcgagttcctaaatctcaacaatcatgggggcaaagcaagatcattcttctcggtaagaattaggagctggagctggggctggggcaggattccgcttgacaaagtgaccaccaggggggcggtggccgcgctccctgtacactggtcctggagctggaggccctgcactttgttcatcggcacttgggttctgctggaagtctgagggtttgttggagccaactggctggtattcaagatgagtgctacccctccgcctttctgcatttgcgccatggcttggctgcccagcatcataaccccttcccctgtgtgtgccgcttcccctgtgatacctcccgttgtgctgtccctggcgacgggttgcatgattaagctgctgctgttctgcattttcatgactctcgctcttctggttctcttccacatgtgtcatgtcacctttaccttgattactattacgattgctgctgtcttgcagagcagcgctgtccaccaga

SEQ ID NO: 3543 - DNA, 532 bp, Hordeum vulgare
gcccactctcttcaccagggagaaaagaatcgagcccagcaactattccaatctttgagatctcagcttcctcttccttttcctgcttcggcaatgcctccaggggccgcaaccctcatgctgctgctactgctcgtgtaggggagaggaggccatggcgccatcaccattggcagcctagacatggacatgtccatgggggtggaggcagtgtagatgggctcggagcctgcggcgcacgggcagctgctatgggaggccgacggcggcggccggaggtacattagctacgacgcgctgcggggggacgccgtgccgtgctccaggcccggggtgccctactacaactgtcgggtcagcaccaccactaacccctacacccgctgctgtgattccatcacccactgccgcgacgacgactcttcctaggtgctccctccgtcccaaaattcttgtcttaaatttacatataaatatatctagtcacgttttagtatttacatacattcatttttagataaacttaagacaa

SEQ ID NO: 3544 - DNA, 546 bp, Hordeum vulgare
acactcaattagtctattacaattgttgatgtctattacaacccacaaccccagatatgccaacttacaatatttactatccgttacactcaaatagaacaaacaactctttgctgagtagggtttcacgggttcacactttcgcacttttaactttcttagccatggagctcctgtaaaagacgaaccaagtaaaaggtttacacacgacaatacttgctatttatagatcagctttcaacttgataattatgtactccctccgtcccaaaataaatgtctcaactttgtattacctctagtataaagttgtacttagcttgagacaattattttgggacggagggagtacaccataaataaattgtttctgtttagtacaagttcatttagtactcatctcctttatttgtgtccaattagtgcatgctcatttaatgatgcaagcaagctccaaatagcttgacatgcatcatgagatgtgagtaaaaacatcgcccctgcgagatccagccacctggcgcatgtatgtgtaggtaccgatag

SEQ ID NO: 3545 - DNA, 1045 bp, Hordeum vulgare
  UNSURE (1)..(6),(18),(19),(22),(24)..(26),(28),(29),(31),(32),(35)..(37),(39),(40),(43),(44),(61),(62),(82),(85),(971): n stands for any base
nnnnnnttgaaccccaannatncnnncnnanntgnnngnnacnntatgggaccgtaagggnntattgcaaaagaccaaaatngtnctctccttggggctttggctcctccccaaaaccccaatcgccgccatggttcgtcgtccctccattgcttatttcccgtggtgcaggccccttcccttacttctgacctcgcccttctcctcccctctgcggcgtggacctctccaacccctctcctagccctctgacagccggtagtcgccgggggggggggcgcccgatttttttttttcatggcttgggtctccctcctcttgtttctctcccccggctccgtccccttctgcgtttgctgccttttgtccccttgtgctttttcccgcgctgcccccggctctccgctctccgttcccgctttcgccctttttccccggttttttttctttttctttctccgcccttctttccgtttccttcgttgttcccttgcgcccgtctcgccctgtcgtctgttttttctctttttttcctcttttttttttttctcttcttctccttcctcgcttcgttcctgtcctctccccttctctgttccgtcttccttttttctcttcttcgaccgtttgtctcccttccctgcttcgtccctcgtttccttcgcccctctctccccctccctttctccttccctcctacctctctttctctctttttttctgtcgtgtgttctccggtctctttatgttgtgtttttatagccgtgctgtgttccccccttctgttctcgtgttgtcctctcccctgtcgtccccgcgattctgttccttttcgctccctttctgcttttcccccctccgttcgtttgcgccctcttttgttgttttgacgtctcctttctatgtattctctgctggtttgccgtcttctttctgtgttcttttattttcgttctccttctcgtgtctanttgccgcccctcctccgcctcgttctatcgattttctctgtttctacacttcttattgattaaactaattaaaa

SEQ ID NO: 3546 - DNA, 542 bp, Hordeum vulgare
aagcgtggttccttattgaagaaaatgcgagccgggttcgtcagcatctcatacagaacattactatacactcacacataagcatattgaaataatatgcaagaacatcgcagagcaaagctttagggcatatatcacatggtcggcttgcctggggttgaagaatactcccggaagaggtgctgagagtccgcggaaaggatcgccagacatcgctctctctcgaagggggctgattggagacaagggcaaaagggtcattttcacagtctcaccaccttgtgaaaatgctatcaacatgacgggatcgacgagacgaagccgagggttttggaatcacctcaatcggagtcccgagcaaaaagataagacccgatgaagtttagggacctatccataaaaataaattcctacaaacaggtccctgactggaaacagaacgcgcctccgggccgagtacgcttttcaaaagagaaagcgaattccggagaatacattttcacttaagcgcgggggcccggggctgatcaacgcctcacagg

SEQ ID NO: 3547 - DNA, 519 bp, Hordeum vulgare
tgacgacgcagttccacagccagttgtactgatagaccaagactcagaccgtgatgcgaccattgtgcagctgagttttggagatcgtctgggggcactacttgatacgatgaaggcactcaaggacctgggccttgatgtgacgaaaggaagtgtggcaactgattcatctgtcacacaaacaaagttccacatcatgcgattagggcgtaaggttgaggaccctgacatgttggaaacaatacggctgaccatcattaacaacctcctgcagtatcatcccgaatcaagcgaaaagctagctatgggtgaattttttggaattaaagcccctgagaagaaggttgatgttgaggttgcaacacatgtaattgtgcaagatgatggaccgaaaagaagcatgctttacatagagacagctgatcggccaggcttactcttggaagtaatcaagatcattactgacgtaaacattgatgtggaatcagctgagattgataccgagggcttggttgccaa

SEQ ID NO: 3548 - DNA, 546 bp, Hordeum vulgare
gtaacctggttttttacatgccattaagtatagtacggacttacagaccacactcgacacgagtgaatgctttcaatgtgattcttctaggaaaccatgggatggggctgctaaagctcccaggggccagatgtccgaccataaaacataactgcatcagacggcccagttttaatgcattttgggaacacatgtgccagattttgttttgcttacaacagatattgcagtgcaaaaggcttcataggcaggaacacgaaatgagccgccacagaacaatcatcaatagctgtcttcatctgtctcgggcctccggaggtaatagcgcaaacaattaaccagcacctgagataacgagctgttcagttttgcgcctctgtaactcacatgaaacttgtccttggcaaccaagccctcggtatcaatctcagctgattccacatcaatgtttacgtcagtaatgatcttgattacttccaagagtaagcctggccgatcagctgtctctatgtaaagcatgcttcttttcggtccatcatcttgcac

SEQ ID NO: 3549 - DNA, 541 bp, Hordeum vulgare
ggctgcaggacttcggcacgaggcggagctgtcccgcctcgccggcaagatgagcgtgtggctcatcccgcagcacttcgccatggccatgctgctcccgctcacccgcttcctgcagagccagctcaagaactgggtcaccgccgccaccgcgggggtcacgctcgcgctccacgtcctcgtcacctacctcctcgtcacccgcttccagctcggctacgccggcgtggtcgtcgccgccgacgtcgcgtggtgggtcgtcgtgctggggcagttcttgtacgtcgtctgcggcggctgcccgctctcgtggaggggcttctccgtggaggccttcgccgacttctgggacttcatcaagctctccaccgcatccggcgtcatgctctgcctggagaactggtactacaaagtgcttgtgttgcttacggggtacttgccgaacgctgagatcgccgtggacgccctctccatatgcttgacgatcaacggatgggagatgatgattcccatagggttcctggcggccactggcgtgcgg

SEQ ID NO: 3550 - DNA, 518 bp, Hordeum vulgare
accgtcgcatgctcgccgcctccgccgtgccgccgctccccccgctcccccgctcgtgcgcctcgtggggacggtggatcccatccacccctttctcctccagggaggggcctggttggcggcgggggacgagcggaggggcggtgcatccggcgatggcgcggccgccgatcctctccgtcgcactgccgtctgacacggggcgcgtgctcagcatccagtcccacaccgtccagggctatgttggcaacaaatctgctgtctttccgttgcaactccttggttttgatgtggatccgataaactctgtacagttttctaatcatacaggatacccaaaatttagaggtcaggttctcaatggcaatcagctgtgggatcttattgaaggactggaggaaaatgaattattgcactatacacatttgttaacaggttacatcggctctgtttcctttttaagtacagtgctacaagtcgtcgacaaattacgatcagtcaatcctgatcttatatac

SEQ ID NO: 3551 - DNA, 477 bp, Hordeum vulgare
tctcctccccatattggtggataaatcagttgatgccatgatggctaggcttcgtggattttatgtgcaagcaagagaactctctgagagtgaaatcagtgcttcatctgctttggttggactattagatggtttgttgcaatctggagtttcagctgcaccaagaaaaaagatagaaatcagtgaacagaaaaagaagaggatgaagtccgatacggatacaacaagattttcttctgcatctatgaggagccaacttgaccaagctgcaaaccttaaaggagagcaggttgcagcgagggtaaagtcggatgatgaaaaagacgagtggtttgtggtgaaggtcatacatttcgataaggaaacaaaagaatttgaagtactggatgaggagcctggtgatgatgaagagagcgcccaaaagtttgagaggaagtacaagttacctatgtcatatattattccatttccaaagaa

SEQ ID NO: 3552 - DNA, 525 bp, Hordeum vulgare
gtgtgaagtgaggcaacacatattctgataggggcgatcacttaattgttctaaaacaaccctcaatcaacttccattacaactcttaactcgagatatatgtgcatacatggcatgcaagccaactctaactctcgatatatatacatacaatggtagtagaataatatgaactgcgccatctagtgggctgcaggtaaaataagattaccgcatcatcaggcttgaaaactgtcatcttcgtacactctatcatttgctagtgcaaggcagatgtccaccgaggtttttcattgccgatggccctctgggagcgcaaccactctgtaaaatggaacagctctctctggtagattcccatcctcttcgtcatcatcaaataagagattgtaatcatcagatttcctcttacgatgagaggctacggtggccctatatagtgctgttgtgccaggataaacagctaagacttgccgaccctgtccaaaatcctgagcactagacggatctcctttctttggaaat

SEQ ID NO: 3553 - DNA, 507 bp, Hordeum vulgare
  UNSURE (20): n stands for any base
gtcctcccgggactgcaggnaattcggcacgaggcaccgtggtgctcaattcaatgatcactgtgtactcaaactgtgggcggatagaagaggcgaaaagagttttttcgatgatcaccagcaagagtgtcatatcatggaattctttggttgttgggttgagccagaatggacatgcaattgatgccatggagctgttcagcgagatgcatcgccttggtgtgcgactcgacaaggttgctatagctagtgctctgagtgcatcaagtaatatttgctccataagttttggggagcagattttttctcttgccactgttcttggcctgcagtctgaccatgttgtagcctcttcagtcatcgatttgtattgcaaatgtggcaacttggccaatggttgcaagattttcagtggaatagataagcccgatgaagtcatgtggaactcaatgctaattggttatgcttccaatgggcatggacgcaaggcactggaactcttggagc

SEQ ID NO: 3554 - DNA, 496 bp, Hordeum vulgare
agcaaaatttgcctcctgctcatctgttttacagaaatggtttatggtggaaaaacaacttctccaagataaatgcacaaacaatatactcctacaatttccaacacataatctctaactgtcaatccaactgaaaccaggatttttcacaatccttctctcacgcatcatacccctcatttctgctgatttcacccaatccccttgagcagcgagcacgctggacagctgcacatacagactcgaatgtgatgaccctgattcctccatctgcttcagtctctttgacatcttctgaatcagagcttcattgccctgagctttgcaaccaccaacaactgtagtccaacttactgtatcagctttaaagggcatattctctatgaactcaactgcttcatctagccgacctgcccggactaacaggtcagtcacacatgcataatgctcagctgatggaagcagacagaaatcctcctgcatttgcttaaaccat

SEQ ID NO: 3555 - DNA, 930 bp, Hordeum vulgare
  UNSURE (1),(2),(33),(38),(46),(54)..(56),(73),(75)..(79),(103),(104),(108)..(114),(116)..(133),(136),(138),(146)..(148),(161),(178)..(180),(190),(197),(198),(209)..(214),(218),(220),(221),(233),(235),(239),(241),(261)..(263),(278)..(302),(317)..(323),(345),(350),(412),(428),(438),(439),(660),(755): n stands for any base
nngggtcagctgaggcttaggactgagtgtggncccancatgggcntgcgaaannntttgggagcacacaaantnnnnnttttgggttggggggccctcccanncccnnnnnnnannnnnnnnnnnnnnnnnnttntntttttttnnnggggggggggccnctcaaaaaaaaattttnnntttttttttnttttttnnttttttttttnnnnnntttntnntttttttttttntntttntnttttttttgggggggggggnnnttttttttttttttnnnnnnnnnnnnnnnnnnnnnnnnnggggggggggggggnnnnnnnccccccccctcttttttttttnttttnttttttttttttttttttttttttttttaaaaaaaaaaaaaaattttttttttttttttttncttttttttttttttntttttttttnnttttctttcttttttcctttttttttttttttctttctcctttttccctttcttttttcttctttttctttttttttttttttttttcttttttcttttttttttttttttcttcttttttactttttttccttctttttttttttccttttcctttctttttttttttcttttccctctcctttttcattcttctttttccttttcttccttcttttttnttttctttttctctctcccctcctttctactttttttttttttcctcttttttctttcttttttttttctttttctcttttccttttttttttcntctttttctcttctctcttttttcttttcttatcctctttccccttttttacttctctctttctttctttttctttacacttctttatcccctctcttcctctttttttttttccctccttttctcttcttccccattttcttctctttctcttcttccctttcttcttctcctt

SEQ ID NO: 3556 - DNA, 530 bp, Hordeum vulgare
  UNSURE (21): n stands for any base
cctgtataatatctacttagnaaacatccggtaacatcactagttcagtacatctcaacggtgtagtaaaacaaactggtgcagtacacgataatcttttacgcacagagctatgtgtaactattttgtaactcgcttattggaccgacaaacaaatttgcatcaccgggactggccgtcctctcttattctgaaggtgcatgaacgaatgcggctgcgaaaaaaaggagcaaatcaagcgctcccgcggacagctttgtagcactctaggctgcagagggggagcttcagcttcgagtccctgtaccggtacgcgttcgtgcaagacggtccggcgcacttctcacgcggcggagggtagctgcagggtttggagttgaagatacttgggaggcctacatcttcagggaacgtaaccaccgtgcctgtgggccccatgacccaccggatagagctcctggcaagttcttgcgctctggctgccttctccttctcctctcgctccttttgcttcctctcttctttcttct

SEQ ID NO: 3557 - DNA, 518 bp, Hordeum vulgare
aacagagtcacagtgactgatgtgaggtttctacatgtggtattttatatggctgagagagcatggagtcatgctatggaaaagaaaactgctggtccaaatgcaccgcagcgtatctacatgttgggtcgatttaggaaggcagtcaaatgggcagcacttttctcacagttatgttctataaaaggagattccaggacatctttggaagccgaggcatatgcttcatatatgaaaggaactttgctttttgagcaagagaagaacatagaggcagcaatgttgaatttcaagaataccaggactgtatatgaggagcttggaaagtatggcagtatagaaaatcaacttttatgccgtcaacgcattgaggaagtggagcctatgattggattctgttcacgcaaacttggtggatctgctctgcaagaacatgagctcctagatatggaaaaggaggggcctgcttatgacctttttaaagctaagattgaggctgtattatctgagacaaggtc

SEQ ID NO: 3558 - DNA, 548 bp, Hordeum vulgare
tctaaagtcgatcattagttatgttcatacggtataacggattgtaagcagtgacactcaaactgatgtattttgaaacagtacaaaattttgcctatcaaacttggttcaacttagaaaccttccagatatcaagcagcactgcgttgagcagcacaggcaaaaacaaattgatccaccaaagtaatgtatcaaaatccaagagcaaggtgatcctgaggaattaaaccatgcgctcttctttttacccccagaatctgcggaggagacccttcttttccttcttcatcctgttctcaaggttcgggaactcaattgtgttgtatgccatatcaagaacaattgggttgcagggaactgattggaacggtggtgggaattgtgaaatgcgacatggagctttggcgctttgctcaccaagtgctgattcatagctccctaggatatcaaggaggtatttagtatcctttcttttatcgtcgccaagtgatatagttgagactcctttagaaagtctttcaggagcactctcatcctccatgatacct

SEQ ID NO: 3559 - DNA, 518 bp, Hordeum vulgare
cgtcgagaggaccaccctcgccgtcgacggggcggcgcacgtcaaggcgtcccctacggttcttggactcgagggccaggacagtggatgggtagagctggagttcttccatcccgacccctccggtgatgactggatcggtgtcttctctcctgccaatttcagtgctgcgatttgtgagcctgagaataagaggcaatatcctccagtgctatgcacagcacctatcaagtaccaatttgcaaagttcaagaatgacgggtatagtaagtctggaaagggctatctgaagcttcaactgatcaaccagagagaagatttttcatttgcacttttttctgggggactgttgaagccgaagctgattgctgtctcaaacaaggtggaattcacgaatccgaaggcacccgtctacccacgtttggcgcaagggaagtcttggaacgaaatgacagtcacttggacgagtggatacgacatcaaagaagcagttccttttgttgaatggggtgaaaaag

SEQ ID NO: 3560 - DNA, 550 bp, Hordeum vulgare
gtgctatttttgttgagcaaacctttattgatgtgactacaaaattatgtacagtaactagcttgttcctcttagagccccccgtcgatcgatccccccatctggaagtattggaccttcaggaagccagcgaagtcctagggcaattgtcgacggagcaggcaaggacatctcggtagtcgcgcgagatcgtgaaatgatcatacacattgccgtcacggctcttcttgtactcaaacaacaaggatgaatgattgaaagccgtgagcttgccgaaaccatggtcgaaatctctgaaatgactccattggatcttcgaagtggtgaagtctgaaaggcttgcaccggcgccaccgacaaccacatgcgtcgttgcctggaacgggccgctatagtgattggatgcattaacaacacactggctctggtacactggacatgtcctttcataattgtggacatgaccgtagaaggcaagatcgaccttgtacttctgccagagctcttgcagcgcttctcgtcccattggttcctcaaacgtgccttcgaa

SEQ ID NO: 3561 - DNA, 552 bp, Hordeum vulgare
gtacccccgggcctgcagggaattcggcacgaggaagtctggaaaaactgaaaaagaggcacatcaagcattgaaggtcatctaaattatctagggctatacttgtcttttgtagcattgtttcaggtcaactataatgatgaaccagctgtgtttcggaaaggatctagtgtttatcgagataaggtcaaaacagaagactatgggaatcccataaaaagaacccgtgaggcaatcacagtatcaaattttgatctcataggtcctgagttctgggaaacccatcaatacattcttggagaagcatcagactacctgtgtgttggggggaaagaaaaatatggatatgagtatgtgaagaagttcgacaacatccataagcttccatgttctaattggaccattgttcgtattagcgcctgccaatttgatcagtgaggacttctagtttcctatttatttaaacacacacggcaataccatttagataattatatcttcttatcaacatggagaattattttttcccccagattctcactgatccattca

SEQ ID NO: 3562 - DNA, 486 bp, Hordeum vulgare
atttaaaaacatgttcagaaattcaaaaaatgttctgcttgttccggtctagattaccaaaactccctttgtctttctagcaaagatagcaaccttcaacctatcaatattcgctttgtgaatttctttacaaagaatgcaaccatatgcatcagagaaacgaggataatatggcacatactaatcaacctatagaatacataaggatcatcatcttctgttgaaaacatgagaatgcgttgtccaaaagtgtggccccatgtctacgtgggccaccgccacatcccaccgctcatcttcactggcttccaccttttgacggtaagcacatgaaccctttcgaaacatagccggttcattgttgtagttcatttgaaatcgctggaaaagtaactcattcttgtcctttggtaatgtgtccttcagtatctccttagctttgttttcgtcttctccagatttcactaacatccaaaagcatgtcgc

SEQ ID NO: 3563 - DNA, 518 bp, Hordeum vulgare
cttttttttctttagctacggcctacgggtcgtgtgacgtccagtgcggggccgcccagaatcctccgcggggacgagagcgcgccgccggtgacggccaccctctctgcagggacgggacacgagagcggacggcgcggagacagggcccgaggtaggggagcgggtcggcctccccgggctttagccatcagcccgccaccctcgcttcccacaaggcggcggcctggctttggggcacgacgacgaatggattgccaatcgaggccgactcgtctcaggacggctaccgccgccaccgccgcgtgtgtgctgcctgtacggcaacacatatcttatgaaggcacgggacaagctccatcgcggcctcacaggagcggcatatgatgcagtagtcactcttggcatgtggagtctacaggtggaaagaactgtgttagtcaagatatgattctgagcctaactaactaacgtggcaagcaatgtaacacagaagaagggggcacttactaggtact

SEQ ID NO: 3564 - DNA, 547 bp, Hordeum vulgare
tgaaagagtactatatatgagctcacgctttgtgtttacgcatcatctagaagcagctgtgcattttcttatgttcagttgatgcaatattgctgtaatcgtgccaagcctaacaagctgcatcttgtacattagaaaaacttgcgatgattgattccttgtgcaggccggagatatgaatgtcacgaagatgcttctgatgggggatgttgatgtcaatgaaaccgaccccgaaggaaacacggcacttcactggtgcctcagtagtagctcaagcacacaggagccaaggtgctcttcttcaaaattctggttcattaacagctaaactgtaagatggttgttctcgctatttccaagtgtccttagttgtcttctgtctttgtgcaggattgtgtggctcctgctgaagaatggtgccagagttttccaggggaacaaactaggtctcacaccagtgcacagcgctgcagctaagggcaattacaaggctcttcaggtagcctctgttacttacttttcaagtgcttaataataccactgtggc

SEQ ID NO: 3565 - DNA, 473 bp, Hordeum vulgare
attcttctgttgaaagctgttggttacacacccttcaaggtaaaaccaggcaaaggacatttgccaacatcctacacaaggacatcagattccccgcaagtatatcggtgagcctcccagctaggcagctgatctacaggttgctgcacagggatcccgcgaatagaatgggatcgtatgaggggtcgaacgagataaaacaacacccgttcttccgcggcatcaactgggctcttgtgcgcggcacggctcctccgaagctggacgctccactgttttccaaggacgtgggcaagggaatgggcgatgctgccgccgccgataatggcaccgacatgttctgaacgaagaaggtggatggaaagacatgccaaagatgtagtatctcggccgtgctcgctcaatcatgggtcgtgtgttgttggttgttgctggctgttttctttttctgttcgtactcgtagttaggacgg

SEQ ID NO: 3566 - DNA, 548 bp, Hordeum vulgare
gttagatgcatcttaattgctttatttaatatgatcccgatacaagattactccactgcgctcaacaactccagcgcttattccatctcctaccgtcctaactacgagtacgaacagaaaaagaaaacagccagcaacaaccaacaacacacgacccatgattgagcgagcacggccgagatactacatctttggcatgtctttccatccaccttcttcgttcagaacatgtcggtgccattatcggcggcggcagcatcgcccattcccttgcccacgtccttggaaaacagtggagcgtccagcttcggaggagccgtgccgcgcacaagagcccagttgatgccgcggaagaacgggtgttgttttatctcgttcgacccctcatacgatcccattctattcgcgggatccctgtgcagcaacctgtagatcagctgcctagctgggaggctcaccgatatacttgcggggaatctgatgtccttgtgtaggatgttggcaaatgtcctttgcctggttttacctctgaagggtgtgtaaccata

SEQ ID NO: 3567 - DNA, 296 bp, Hordeum vulgare
tttttttttttttttttttttttcctaaaaccgacctttccatgtttatttgctcggtcatatgtgtcattaggcaatacagttcttccatgacaatatagtatttctagtgttcttccatttacgataggcaccacttctgtactctatacatgtggggtgacacagatcttgacctgggattattacatagtgaccatggtttccttcttttaaatgtgcacctccgaaaactgaagatgatggtaaaaaattgtgcagatccaaccaccatctcttgtgtaggaaaaggggtg

SEQ ID NO: 3568 - DNA, 366 bp, Hordeum vulgare
gaaaggtgaagttgaagaacgtatcatgggccattgcaggtttagctttgaagcgaactaaagcttcgcttgagaggagtgaattggttacaaattctattcccatagctattgactcgagccatttccatggcaccgttcgacaagcgaaaagtgaagatgacccaaattcttggagttcacctggtggagagaagtttatgataagagggaagacttacttgacagattacgccaagattgctggaggtgatcctcttctaaagcttattgcagttgattggttcaaggttaatgagcgctttgactcagttgccttgcacccaaaaagccttgttcagtctgaagctgcaaagaagattccct

SEQ ID NO: 3569 - DNA, 281 bp, Hordeum vulgare
ctcacgaaatcccatcagctcaccaagaaatcctcggacgcgaagcatctctctcgcggcatcgccatgaaaggccgcgcggttaagcttcgggaggcgcacaaggcgggctcgggctccccggccttctgttcagtcgcctggtcccccgggggacagcacgtcgtcaccgcgtccgccgccgacgtcgccatcctgatccacgacgccgccgcggggaccggggcccgtggctctggttcagccgcggccgtcgccacgatccggctccacaaggacgg

SEQ ID NO: 3570 - DNA, 441 bp, Hordeum vulgare
ttttttttttttttttagaacatccaagctacaaagtttattgtccgaaaagtacatccagactgcaaagtaaactcaggagctgtccaactacactaccagaattttaagtggaaaggaaaagcactccatatgttagttaaaggtgactgactgccagtttccaccctgcaggttcaggtccaaatgacaagaaaaaacaattatactttcaccttcttgctgttggctttatcaactttctcgctttcaaccttcatcttttttatggaatccaaaagcgatgatgactgttctttgttggatgaagattttgcaaatgggttaagtgaccgttgaggctctcctcggctgccgtcttcactgctcttatttttagcaccagcctgatcaatgcctcctttcagaatctgttcagctgtactcacgcccgctgttcca

SEQ ID NO: 3571 - DNA, 543 bp, Hordeum vulgare
  UNSURE (10): n stands for any base
ggctgcaggnaattcggcacgagggccctcgcagccgcagcggcgcgcacacctctccctccttcgtgaaccaacgccgccggcggcaagagcacaggatggcgaccgtccccgctcccgcagccgagaccgcggcctccacggcgcgcacggtcaaggatgtgaacccccacgagttcgtcaaggcctactccgcgcacctcaagcgctctggcaagatggagcttcccgagtgggttgacattgtcaagactgcaaggttcaaggagctgccgcctactgacgctgactggtactacatcagggctgcctcgatggcaaggaagatctacctgaggcagggaattgggattggtggattccagaagatctatggtggccgtcagaggaacggttcacgccccccacacttctgcaagagcagtggtgctgtttcccgcaacatccttcaggagttgcagaagatgggcatcattgatgtcgaccccaagggtggaaggctcatcacctcccagggaaggcgtgatcttgaccaggttgctg

SEQ ID NO: 3572 - DNA, 550 bp, Hordeum vulgare
cataatagcatgcgatctacttaacgaagtcttgctaacaaacacagggagggtatcataattcaaaactgtagccaaatcctactacggaacacaatttcatagatgggacttcaactgatcagaattcagcaggaacagttccagcaacctggtcaagatcacgccttccctgggaggtgatgagccttccacccttggggtcgacatcaatgatgcccatcttctgcaactcctgaaggatgttgcgggaaacagcaccactgctcttgcagaagtgtggggggcgtgaaccgttcctctgacggccaccatagatcttctggaatccaccaatcccaattccctgcctcaggtagatcttccttgccatcgaggcagccctgatgtagtaccagtcagcgtcagtaggcggcagctccttgaaccttgcagtcttgacaatgtcaacccactcgggaagctccatcttgccagagcgcttgaggtgcgcggagtaggccttgacgaactcgtgggggttcacatccttgaccgtgcgcgccgtgga

SEQ ID NO: 3573 - DNA, 520 bp, Hordeum vulgare
  UNSURE (13),(14): n stands for any base
aaacgcgcgacgnncattgcgggcttcgcacaagcccggaggcaaggcaagggtggatgctgccgcgcgtcctcacctctccccgcgaataatctggtctcatggcgaagcaacactatgcaaccagcagccttgtgataggctatgctttgtgctcgagcttgctggcgatcattaacaagtatgccgtcacaaagttcaattaccctggcctcctgactgcgctacagtacttgacatctgctgctggtgtttgggcccttggaaagctaggttttctctgccatgaccccttcaacctggagactgccaaaaaatttgcaccggctgctgttgtattctacctcgccatatttacaaacacaaacctccttgttcatgccaatgtggacacgtttatagttttcagatccttgactccgcttctggttgctattgctgacacaaccttccggaagcaaccatgcccttccaagctcacattctcgtccctcgtaatcatattgggaggagcagttgg

SEQ ID NO: 3574 - DNA, 553 bp, Hordeum vulgare
  UNSURE (52),(53): n stands for any base
tatacagatatatgagatgtccatataggtattgtgttacaaggtttacaanncaggcatcattcctaccataaaaacagtaatttaatctagttttcttccagtagaaatgagtaccacggacagaaaggaccttcttctagttgtaaagaaaatattgtgtactaccactggcactgcctattgtatggttctgttgcgaagggcctattaaacagaattaaaggacacacctgtcgatctaaagctaagagtgtcactcttcatgcactggggcactcaagatgaaataagctcctgtttctcctcatcatactcagcactggcactttcatccttaggttgctctgttgttgtttcatgctgtgctgatgcaatatttccttttgcagtaactgattgctgatagagtaccccaccagcaagagtgaatagcaggctaaccaaaccgaatgcactggcgtgcttgtcccagatcgtcacattgattgccactgtgaggaacttgttcacaaccccagtcaccgtgaatgccgtggctgagattgctttc

SEQ ID NO: 3575 - DNA, 375 bp, Hordeum vulgare
accacctatccgccgcctccccccatcctccacaaacccacgcagctccagcggcgcaggcgcatcccagctcaccggcggaaatgggcgggccaggcctctactccgggatcggcaagaaggccaaggatctgctctacagggactaccagaccgaccacaagttcacccctcaccacctacaccgccaatggcgccgcaattactgctaccagtacaaagaaggctgatctgatactcggtgagatccaatcacagatcaagaacaagaacatcaccgtagatgtgaaggcaaactcggcatcaaatgtcattacaacaattaccgctgacgatcttgcagcgccagggctgaagaccatcttgagctttgct

SEQ ID NO: 3576 - DNA, 355 bp, Hordeum vulgare
tttttttttttttttttttttttttttgttgaatgctgaatcaagttcaggattttcagagcttgaattattactgcaaagtgtggctcaacggacaggcactacaccgaccaaagacaaaattcctcaggaatgaaacacggcagttcttcaaatctaacagactgcgacaacgcgcccaaggcgtgtgaaattccatccgaaaccgaggaacacccctgagagttcagaaaagagagggcttgatttcgccatcaaggcttgagagcaatcgcaatgccgaccttcgagctcttctcgatggccttggtgtccacctccgccgagatggtgcagagcgacttcggcctgaact

SEQ ID NO: 3577 - DNA, 545 bp, Hordeum vulgare
  UNSURE (16): n stands for any base
gtcccccggctgcagnaattcgcaccggggggcagcaaagtcttttcttgtgcctacttggttaatatatcacggccagaacatcggcgtatacctctaaatcaccagaaggctctttgtttcagtgggcttagaggagccatggcttttgcgcttgctctccaatctgtgcatgaacttcctgaaggacatggaaagacgatattaacagctaccacagccattgtcgttttaacggttcttcttattggagggtcgacaggcaccatgttagaagctttggatgtaattggtgatgaaaatacatcaatagaaacttacgaggataacaatggttacattcccccaacttatgaggaaggcacatcgtctggaggaggattgagaatgaaactcaaggagttccacaaaagcacaacatcgttcaccgcccttgacaagaactatctaactccatttttcaccagtcagactgatgatgatgctgatgatttcggtgatcagccccaaaaccagagacaagggttctatgaccaatagcagag

SEQ ID NO: 3578 - DNA, 559 bp, Hordeum vulgare
  UNSURE (24),(25),(33),(34),(51): n stands for any base
ttcatgttcgcacaaacaaaaagnnacaacggnncaaacatacattcaggnaaccacagaggcaagacgagcttacctttaatacactgtcacttcacgacaggcatttccgtgacagcgtaattatggccctaatgatttcagatttcactggaaatctggagtacatacatcacagtaatgttcggctcacgcggtacgttcacttcacaacaagggttttccgagccaacgcagttggcaatgatcagcgctgagctgttggaaacaaatgatctggtgtaaggcagcggctttgggtcaacaaagtccgccgcagagctttgccgtttcagctggagccccaccatgcaccatctgagccttgtaaatatatacaggaggcatgctgtcctgatcaggcttatgaatctatcctacagtatgctctgccatatgctactcaactagggcaaaggtgtgtgtttatatcgtttaatggctccaatctggatcccacgttctacgatatcgttaggtccattggcacttggcaccgtgtatagctagtcgtgctcaa

SEQ ID NO: 3579 - DNA, 465 bp, Hordeum vulgare
atgctcgttagatattaatctatacttatactaattacaggctttcaagaaattcccaggtaaattagtaaatatgagcggttaatctggtaggtccaaattataacggtgtagattagttcgttaaaaatcctgtgccgtgaggttttttgtactattttcatagagttatttgcacggacacatccaagatttaaaaacaatttgcatgcaagtgttttgtcttattatatcaccaaacatcttatcttactttaaaaaaaaggcccatcgaggctcatgtcttcatgtcatctgttctcaataaatcaccatacctaaaagaaactccatcaatcgctgattagatctggagtataactaccttgcgtcctgtgagcatcctacctaacacgttcctcagccaacggccgccgccgccgctcgagatgtctttattggatccgccaccccttactctcggct

SEQ ID NO: 3580 - DNA, 548 bp, Hordeum vulgare
  UNSURE (33),(34),(70): n stands for any base
aacatattaaacaggtagatttatcaaatacannatagaagattagtctccgaatacaattcatcatatntagtctcctaatacaattcatcatattagtctgcgaatacaattcatcaataatgctaaaacagggtactatataaacactcttatattttttccatagcgagagacaaatgagacaacaaacaacgagcgagtaggccagagacaatttggcatgatatgcaacctgagagcgacaaaaacaaagcatggattccaatggtgaactatgaggtgcaactcgacgggaaggaccgaagggctcggagatgcattaggcacgggaaatgtgcatctcataaagagatccaatgttccagcaggaaccaggcgctcccccttcctaactgcgccattcagtagcatagcccgagctttggaggcattgggggtagacaaaaacatgtatagagtgtagacttcatccttccttccactactgcttctccaagaggattggccagaggaaatctcagcagctccactccctgtcagcaacg

SEQ ID NO: 3581 - DNA, 412 bp, Hordeum vulgare
ataagagaatcctatccagacattcagatgatttcaaattgtgatggttcatctaaaccacttgaccatcctgctgatctgtatgacttccatgtctacaccgattctaagacattgtttaacatgaagggtacgtttgataaaacttctcggactggtcccaaggcctttgtcagtgagtatgcggtatggagaactgatgcaggtagaggaagccttcttagttcactggcagaggctgccttccttactgggctggagaagaacagtgatattgttcatatggcaagttatgcaccgctctttgtaaacgacaacgatcaaacgtggaatccagatgctatcgtcttcaactcctggcaacaatacggaactcctagttactggatgcagaagtttttccgcgaatcta

SEQ ID NO: 3582 - DNA, 363 bp, Hordeum vulgare
ttttttttttttttttttttttttttttactgcaaatcggcctgatatggactttatttagtactgctgtatgtatgagtatctcctctttcttacactgtacagtgagtgctttatcaagatataagcataattactgacaagctcctccatttccatatcacgcctcgtgtattaatcctgtttccacgtgtcactaacgccgtgtcgctgcttcacatctctgcgacaagctcggactgagcaagcgcaaggtcgaacgaggagaaggagtgggcagcgagcgtgacctgcatctgttccgcggcgttatgcaactgacttgtcacgggcacgaccttggttgggttactgaaagaattt

SEQ ID NO: 3583 - DNA, 10 bp, Hordeum vulgare
  UNSURE (1)..(10): n stands for any base
nnnnnnnnnn

SEQ ID NO: 3584 - DNA, 529 bp, Hordeum vulgare
  UNSURE (14)..(20),(61)..(65): n stands for any base
atacatttcgatcnnnnnnnggcacaaacgaacacatgcattttgcaacagttcaggagannnnntcgaacactacatacatacactaatctacagctgctgcagaaggaacccatcgaagcctggttcatacacacttccacttgttgcaaacctcctcctccgaagaaagaccagcttgggcatatgttagaggaaacctcgttgagtctgcattctggcaaggtgcccgcggcaaatgcaaaatgatgccactgaagttacagcctcattggttgtaagaagccatatgaaccacatactgccaacatcttcagttgacgggtacgtacatgttatatcggtgtgcagtagcagtgcagaagtcggaaccacaagggcatgcatcgccttaccgattggattttgccttgttttgcatatgtggctccgtgagggaagaacactggcctggagtttcatcggttaaaactgccataactcagagatattcgttcgaatcatcttcggcatcgtcctcatcgtcgct

SEQ ID NO: 3585 - DNA, 535 bp, Hordeum vulgare
gtcccccggctgcggattcgccgggccctctcctttgctcgcctcgccgccgccacgctcccccgtccgctctccggcgcggcgcagccgccttttccccgccacctctctgccgccgtacgtacacctctctccttcgcctcctagctgccgtctccaccttccctctctcgtttcccccttccaacgagtgaaccatcaacctcgtaagggggagatggtgctgcggcgggcggcggtggagtcccctaagaaagtggcggctctggtcgacctggtgaacctgccgacggcgctgcgggagttcgcgggcggccggtcccagatgtcacacctctccttcttcctcggcgtctggtcgcacatcaagaacaacaacctccaggacccgaccaacaggaacattgtaaactgcgataacaagctgaaaactgtgttgttgggcaggtctaaggtggagctctctgaactcccaatgcttgtcaagttacatttcccaaaagttttcaagtcataagaataataagctgtcttt

SEQ ID NO: 3586 - DNA, 544 bp, Hordeum vulgare
gcaaagaagagggggctatcatcataaaccctacaaagcttgacgggcagataggaagatctaaccaacaatttcaggcctgcattcaatagccgccctcccacattcagttcaagttcaatacacaatatgccaagcaaaagacaggaagcaactatggtactacatgttttttttcccacctgaacacaagctgaggctactaaaaattgaaaggaaaaaagaacgtaccaaaggggttaggaggactcatacattgtttacacataagccatgcatggaggtttcgtaaaagacagcttattattcttatgacttgaaaacttttgggaaatgtaacttgacaagcattgggagttcagagagctccaccttagacctgcccaacaacacagttttcagcttgttatcgcagtttacaatgttcctgttggtcgggtcctggaggttgttgttcttgatgtgcgaccagacgccgaggaagaaggagaggtgtgacatctgggaccggccgcccgcgaactcccgcagcgccgtcggcagg

SEQ ID NO: 3587 - DNA, 517 bp, Hordeum vulgare
ccacacaccgcctcccccccatcccctcccaaatcccatccagccagatttggccgctgccccgccgccagatcggagcgcggccccggtccgatcccgctcgtccctccacagggacatgggaatggaggtcgtcggagctgaagctgcaccagcacaggttaaagtagctgatgaggaagtggcccttttccaagacaaggaaagtcaagcgactgcaagggagcgtgaggaagcagctgtttttggttcagacaatggcaaagctgcggcaaatgccccaaatggctctgacatggcacctccaaaggatgcagcggatgagtggcctgagccgaagcaaacttacacattctactttgtcaaggtccgctcatttgaggaccctaagctgagagcaaaacttgagcaggctgagaaggacttccaaaataagatccaagctcggtccaagattattgaggctataaaagctaagaagactgagcgcgctgctgttcttgctgagctaaggccg

SEQ ID NO: 3588 - DNA, 549 bp, Hordeum vulgare
tttatatggcaatctattctcactttaaagtcactgagttcactggcagtacaagtaccggtcgaaattaactgtgccaaccaaaattaactgcaactttttatctgactccacccaacaaacagaacagaaacgaatagcttctccagtcttttcagttcattcaggtcttcggcagaccacgcactctgttgctctcacctgcaaaattggtctagtaagattcatactcgagggcggcgggtgcacgggccttttccttacatcagttgctggtgctcgccgggcggtagtactggtagtagcccagcgccgcgagcagggcgacgagcacggccacggcggatatcaccacggctggggtggcccatgaccggtacgactgggctttcttcctcttcaggatcgcctttggcagcggggccttggtcttggtgactacattccggggccgtacgttctgcttctgttctttgttcaatgtggttggagtaaactcatcctctgcttgggcttctgctgcctcatcagacttggtgtccgagtcag

SEQ ID NO: 3589 - DNA, 517 bp, Hordeum vulgare
ggcaactgaagaatataggtcaattgtcttccaagaacacgcttcgtcgagtatttccgccttgcgacaccagagacggagtatggcaggatgaatattggaagcaggccatccaagagaaagccaagtggtggcattgaatcactccgtgcaatcccatggatctttgcatggacgcagacacggttccacctcccggtctggctgggctttggcggtgccttcaagcatatcctcaagaaggacatcaggaatttccacatgctccaggagatgtacaacgaatggccgttcttcagggtcaccatcgatcttgttgagatggtgttcgccaagggtaaccctggcattgctgccttgtacgacaggctccttgtttcagaggggctacagccactgggtgagaagctgagggccaactatgaggagacccagaagctgcttcttcaggttgctgggcacaaggatcttcttgaaggtgatccctacctgaagcagcgtctccgcctccgtgatg

SEQ ID NO: 3590 - DNA, 561 bp, Hordeum vulgare
gattgacattcttaataatattacgacacttggaaacagtataaacgcccaatccagtacattgttaagtgttccaagtacgactaacaaacagattagaaattatcatcgtttgcctttatttataaatattatattatacttgcgaaatgccattattcctcactgggtagaggggcagatgtagcagctacatccgcaagatacaagcaaggcccacggccctcgataaaaggaaatatctcatcaaggtacaaaatgaagatgatccagcaatctccccttgccctaaccggtgttctgcaaaccggcagcaattcccttcatggttaagatgagggtatcctccagccccggcgcgtactcactcgccgggttcagcgtcacgagctcggcagccggcttgctcgtgtccatcacctccttggacagatgggggcgcaatgcaacatgatagtctgggtcacggatcctcttcaatgtgtaagcttggcagacgttcatggtggtgatgtatgcatcacggaggcggagacgctgcttcaggtagggatcaccttc

SEQ ID NO: 3591 - DNA, 468 bp, Hordeum vulgare
  UNSURE (42): n stands for any base
aagaagctgaattttctgatgtgcataattcaagatcagggnaaaaaaaaggaggatataggaaacacctcatgccacccaagagaggtcaatctatcggataatgtacctgcacggagaaaagctgaacctaggagtaagcaaaatgctagatcaggaaaagctaaagagactagagagaaggctacatgtgatttcagggaggatagtccatcaggaaaagcagaagagagaaggcagaaggtggcatgctctgtcagagaggttagtccatcagatgaccaccttgtgaagaaacaagatagacctggagaagagaaagcagccagaaaggccaacttcccggtgaagaaacaagctaagcctagagaagacaaagaagctaatctatcagttaaccgccccctgaagaaacaagctgaagctacctctcaacaaatttcttgaccagggaaacagaatagcagg

SEQ ID NO: 3592 - DNA, 531 bp, Hordeum vulgare
ggatgctgacactgaaaaacacgcatcaaacaccagatattcgttatccgaagggccaaggtgccatgaaataccctgccgcccacggcttctgaccatacaggctatatatagcaagtacgatctttctcatctcctgtacaatccgcactaacaaggaacaagtgaaacaggtcgcaatggaaagcatgtcagagattttcgcacagcaggcatggcagcattggcatcgacaaaacagcgagtcatcatctgcatccccattcatccatgacatcctaattacagaagtcactttgagcaagtcggtcagaaataataactgcatggcttgggtaacttgaagaagcttcactaatcaaatatgaggtggccctctgccagaaggatgtggccctctgtaggggtgctgtggaggcacgtcccttccatatccaggcacatcatgaacacctcgcactgtgtggttcgtttgatcgaggggtggagcatgtctgtccattgccgagcttcgtggtgcattggcaccca

SEQ ID NO: 3593 - DNA, 523 bp, Hordeum vulgare
cacaacttgtacagatgagggctgctgggcgaaaaaggacgcagagttactccaaacggttgaggacgatttgtcttcagatgatgataatatacaggatgaaggggatgaagcttacctgcaaacttacggcagcgacgatgaggacgatgccgaagatgattcgaacgaatatctctgagttatggcagttttaaccgatgaaactccaggccagtgttcttccctcacggagccacatatgcaaaacaaggcaaaatccaatcggtaaggcgatgcatgcccttgtggttccgacttctgcactgctactgcacaccgatataacatgtacgtacccgtcaactgaagatgttggcagtatgtggttcatatggcttcttacaaccaatgaggctgtaacttcagtggcatcattttgcatttgccgcgggcaccttgccagaatgcagactcaacgaggtttcctctaacatatgcccaagctggtctttcttcggaggaggaggtttgcaacaagtgg

SEQ ID NO: 3594 - DNA, 558 bp, Hordeum vulgare
  UNSURE (18),(19): n stands for any base
gcttttttaaaatacaannttcctcattttccacatgagaacataccatttcgatccaaaacaggcacaaacgaacacatgcattttgcaacagttcaggagaacggatcgaacactacatacatacactaatctacagctgctgcagaaggaacccatcgaagcctggttcatacacacttccacttgttgcaaacctcctcctccgaagaaagaccagcttgggcatatgttagaggaaacctcgttgagtctgcattctggcaaggtgcccgcggcaaatgcaaaatgatgccactgaagttacagcctcattggttgtaagaagccatatgaaccacatactgccaacatcttcagttgacgggtacgtacatgttatatcggtgtgcagtagcagtgcagaagtcggaaccacaagggcatgcatcgccttaccgattggattttgccttgttttgcatatgtggctccgtgagggaagaacactggcctggagtttcatcggttaaaactgccataactcagagatattcgttcgaatcatcttcggcatcg

SEQ ID NO: 3595 - DNA, 517 bp, Hordeum vulgare
  UNSURE (20): n stands for any base
ctttgatgatcttacccaanatgatcaagattcagtacgtttgttggcagttgaaggctgtgccgctcttggaaaattgttagaaccccaagattgtgtagcacatatccttcctgtcattgtcaatttctcccaggataaatcttggcgtgtccgttatatggttgcaaatcaattgtatgagctctgcgaggcagttggccccgagcctacaagagcggacctggtgcctgcatatgttcgtctccttcgtgataatgaagctgaagtgaggatagcagctgccggaaaagttactaagttctgtaggatattaagtccacagcttgcaattcagcacattctgccatgtgttaaggaattatcatcagactcgtctcagcatgttcgctcagctttggcttcagtaatcatgggaatggcccctgtcttggggaaggatgctaccatcgaacaacttcttcctatttttctttctttgctgaaggacgaatttcctgatgttcgactcaacata

SEQ ID NO: 3596 - DNA, 555 bp, Hordeum vulgare
cgtgtcccggttgctaattatacaacattaataacaacaaaaggggaacggagcccatccattatcagcatggaagtataggtcggttactgggctagaaagaactcttggactcataaggtaaattacatgtactccaaagctggactaagaatagcttctaaagaacgtgacagcagcagcttagttagctagacatcatgatttggtcacaagcctgcagggcctggtttgcatagtatcgtacatccacatcagggtcctcgctgagctcgacgaggcatggtttcacagtcttttcagcgacagattgatcaaggattggcacaagcgactgaagaactttcgcgacattgaacttgatgttcggcactctgtccttcgatgaattgatgacaacagggagaagcttttggcatgttatttctgcacccatgacaggggctagcaacgaaatggcttggaggatggtcatgcgatacagataatgtgggttgtttatcttctccaacacctgaggaataatatgttgcattgcccactctggaccaaact

SEQ ID NO: 3597 - DNA, 518 bp, Hordeum vulgare
ccgagtcgtcccagccttttcctccggcctccccacactaccctcgagcgccgctcccctcggcacccgtacaaatccacgccgccctcccacgaaaccctaaccagaacgccctccacctcacgagggaggcagtggcggcgtgggcaaccgcggcaagaggagtaaggagacgagaaggagcagcagctggagagggctgcggcctgcgcggcatttgcggcgatgtccgcgtctatgtgtcggaagcgggcgtcctccttctccgaggaacacacccacgctgaggcgtcgtcctcaccgccctccaagcgcgcacgcttccgcgcagacggcggcagccccaggccgcgcggcgtcgtcgactccgacctggtggccgtgatccgtgcgcggttcccttccgtgaggcttgagttcattgaaaaggctctggaagaatgtgaaaatgatttggattcagcaatgaagtatttacttcctctacacttagaacccacaggatataatgtggatcc

SEQ ID NO: 3598 - DNA, 543 bp, Hordeum vulgare
cacaacatggaaaaaccgcatatctgtgttgatctaatgtgtttttctacttactttcaaacttataacattatgtctgttcttagacaacagcacgactcaggctgggctgccttccctccctccccatgggagagggaatcagcacactatacagaggtacaatggtctaacatcaccataaatcaacctgtggtatcacttgcctataatatcttaaatatagccagtaacaacaagacctgcaacttgtcctcatgctgagacctggtattgggcttctggtttcacaaaatgtcccgatgaaagtgccctggaatcgagttgccctgctgagattgtctgaggtgcatggacaaggcgtagttgtttatctcgagacttctaatttgttcccggtactgcataaccaactgctttagttgctgaagctcctggtttctctcgtcatgctccttctggcgttcatgttgaattgccacagctttcttaagaatagtattttctttattgacagcttcaaattgttccttgtacagcaaa

SEQ ID NO: 3599 - DNA, 511 bp, Hordeum vulgare
  UNSURE (27),(37),(38),(54),(55): n stands for any base
gtcccccccgggctgcaggcctctagncaggctatanntacctacatagtacanngctatggcccccaccgtgatggcctcgtcggccacctccgtcgctcctttccggggctcaagtccaccgccggcctccccgtcagccgccgctcgaacggtgctagcctcggcagcgtcagcaacggtggaaggatcaggtgcatgcaggtgtggcccatcgagggcataaacagctcactgacgatgggccacatataaagtgccattgcagttttgtcaactctgacattgctttgggttttccttctccatttatctttcttatttgttcctaagaatatgtgtatgtccatgttcatgtaccaacatggctcgagaaaacatgcttgtatgtgaatgctgtcggtggctatgtatatgcacgtacgcataatattatacaataatatgtcaactatatacgttttaatggtaaccaatggaaaatatctccaaaaaaaaaaaaaaaaaaact

SEQ ID NO: 3600 - DNA, 466 bp, Hordeum vulgare
  UNSURE (37): n stands for any base
gagatattttccattggttaccattaaaacgtatatnagttgacatattattgtataatattatgcgtacgtgcatatacatagccaccgacagcattcacatacaagcatgttttctcgagccatgttggtacatgaacatggacatacacatattcttaggaacaaataagaaagataaatggagaaggaaaacccaaagcaatgtcagagttgacaaaactgcaatggcactttatatgtggcccatcgtcagtgagctgtttatgccctcgatgggccacacctgcatgcacctgatccttccaccgttgctgacgctgccgaggctagcaccgttcgagcggcggctgacggggaggccggcggtggacttgagcccctggaaaggagcgacggaggtggccgacgaggccatcacggtgggggccatagctgtactatgtaggtatatagcttgctagag

SEQ ID NO: 3601 - DNA, 401 bp, Hordeum vulgare
gtcattcatcactgatcaccagcacagccgcgcgcatccaccgttgctagcaaggtcgaccaagcagcacagagatggctgctgccttctcctccaccgtcggggctccggcttctacgccgaccaacttcctcgggaagaagctcaagaagcaggtgacctcggccgtgaactaccatggcaagagctccaaggccaacaggttcacagtcatggcagcggagaacatcgacgagaagaggaacaccgacaagtggaagggtcttgcgtacgatatctccgacgaccagcaggacatcaccagagggaagggcatcgtggactcgctcttccaggcgcccacgggcgacggcacccacgaggccgtcctcagctcctacgagtacgtcagccagggcctg

SEQ ID NO: 3602 - DNA, 519 bp, Hordeum vulgare
  UNSURE (505): n stands for any base
tgagagatgaacaggacaggccggttctcccgtccactggccaattcagccacagactggccatgcctcctgctggatgtgttgtcaggcgcagccgaggaggattttttccagccaaagctggtgctgaacaacgtcgatgccctgaggaaggcgatatgcgaggacgatacaatggtgcctgcagctgtgtaccatgacagcttcatttggagggtgatagcactcggtgctaatgaacagtgcttaccggtcattatgtccacgtcagatggatactattcttcccaagcattcgtcgattttggttttcctaatatcttcatttctcgtgagacgtttggttggacaccacaagaagctaagctgcatatggtttctgagttcttcagtgaacaggagtggaaagtcgttgatgagcttcttggaccaaacccacgacaattatgtgagatatatatgctgaaacagaaggcgaatggcccagaggttttgcatgacacanacattgaggaaatt

SEQ ID NO: 3603 - DNA, 543 bp, Hordeum vulgare
gtcccccggctgcaggaatcggcacgaggccgcaccgggtgggcgtgtcctctccccagctccaatggcgcgccgccgcgtgctcctctacctcaagcctttcgacgtctatcctccacgaccgctccccggcgcctcctcgcccaccttcccgccaccgcctccgccgccgcgcgccgccaagcccaagatcttaagttatctggacgatagatgcagagtccacaaggacacaatcaatctctgtaagagtgtactacagggcaagccccttgactggatctcagtgcagcgaaatcatttgtcaaatccaatacatgatgtggaccttgtgattactgtcggtggtgatggcactcttttacgggctagccattttttggatagctcgattcccattttaggtgtaaattcagatcctacttgttctgatgaggttgatgagttaactgaggaatttgatgcgagaagaagcacgggatatctttgtgcagctactgccaggaactttgaggagatacttgatgcaacccttgctggcag

SEQ ID NO: 3604 - DNA, 531 bp, Hordeum vulgare
gtggtactgttatttcatttaaagagcctgctttaacaggtattctggtaaaataacttttaagaccggcgcatctgcaggagatctcaagtgtatccccatgctggattgaatatgctactatgagaaccatcaatatacacagcaccctcttgattgtaccaaacaacaagcatatgttgttcttgcttaactaacccatggagcagtggtttgtcggcatccgttggtgaaatgggctcccttatcatatactgaagctcacgacttgatattggcatcataaatccccctgccgatagcatggcagcagttgatccagtagctgttgcaaccctgagaccgcttgatctagaattaatcaaacgtgaggtctccccattgcttctttttcttaatgagaagcgtgatacacttgcaggacaggggtgtgacaccaatatatcattcagagcataagttggtaactgggatccgtttagtttcactgatattcttgacagctctgaatagtgtctactgccagcaagg

SEQ ID NO: 3605 - DNA, 522 bp, Hordeum vulgare
ggagaaacccttcctgaaaaggacaatacacaagtcgtgaagaagccagatcatgggagagcagtgagggaaaatgttcctgaaagcaaaacaggtgcgcaaagttgcaaggtgacgaagctcaaacgaaaacgccaaggcaaggcgttgccctgttcgtctgaggtgcaggaagacatcaaacgtgcagtggatcttcagaccatgcttatgaaggatcgtgagaagatgtcagaggtacagctccgtctctcgaaagagaagcttgagttcgccaagctaaagcaacaggaagcaaaggacaagaaggaaacaacgctttacgagaagtattcagagctgttgatggctgacacctccagattcagcgactttcaaaaggcagagtatgagaaggcggtgaagcgcatgggtgagatgttatttggtagagatgataggtagcttaatcgttaatttagtaggttatatcaaacgcttctgctgaagtgctaatttgtcgatgttgttatacctgctgat

SEQ ID NO: 3606 - DNA, 527 bp, Hordeum vulgare
aattctgacagcctacctttaggaacttacaatttgatgcttccaaagttcaacttcaatccatcagccatcaaattatgttctccctccagttttaggacctggagagttggtcatttgaaatctaggcaagagctggatctaacaagggctgatgaaagatagacagtacaggtggtgttacttaaacggcgagcaggccaaatcagcaggtataacaacatcgacaaattagcacttcagcagaagcgtttgatataacctactaaattaacgattaagctacctatcatctctaccaaataacatctcacccatgcgcttcaccgccttctcatactctgccttttgaaagtcgctgaatctggaggtgtcagccatcaacagctctgaatacttctcgtaaagcgttgtttccttcttgtcctttgcttcctgttgctttagcttggcgaactcaagcttctctttcgagagacggagctgtacctctgacatcttctcacgatccttcataagcatggtct

SEQ ID NO: 3607 - DNA, 517 bp, Hordeum vulgare
cctcgtgccgaattcggcacgagggttcgctgacgccgcttcctttggtacttccccttcctcctcccctcccctcccctccgccgcgatcgaccacgaaaccctagccctagccccgccatggccaatagcaacctcccccgccgcatcatcaaggagacgcagcggctgctcagcgagccagctcctgggatcagcgcttcaccatcggaggagaacatgcgctacttcaatgtcatgatccttggcccaacgcagtcgccgtatgaaggaggagtattcaaacttgagttgtttttacctgaagaatatccaatggctccgccaaaggttcgctttctcacaaaaatttaccatccaaacattgacaagcttgggaggatatgccttgatatcttaaaggacaagtggagtcctgcccttcagatccgaacagttcttttgagtattcaagcactcctcagtgctccaaatcctgatgatccgcttgctgacaatgtggcaaagcactggaaag

SEQ ID NO: 3608 - DNA, 546 bp, Hordeum vulgare
gacgggagttacgtagagcagaaaggcaccataacttcgggatgtttattacggtacatcactcacgtaatatacatgcacacgggtccatagcatcccaactagggtaataatatacatcacactcggtacaagcgatgcgaggaaacttcacatttcactagttcatcaggacctctccattttaaaccacatgatagtcgatttcacctccacctcaccaagactactgagcaatcagtcatagcatgccagagctcatgcatcattagcatagacacgggtccactctttggctgtttccacagcttctgtctcgttggctttccagtgctttgccacattgtcagcaagcggatcatcaggatttggagcactgaggagtgcttgaatactcaaaagaactgttcggatctgaagggcaggactccacttgtcctttaagatatcaaggcatatcctcccaagcttgtcaatgtttggatggtaaatttttgtgagaaagcgaacctttggcggagccattggatattcttcaggtaaaaa

SEQ ID NO: 3609 - DNA, 550 bp, Hordeum vulgare
gtacccccgggtctgcagggaattcggcacgaggcaggcctgggccgggaccccgttgctttcgccaactactttaactttgagatcttacattgtcgatgggccatgcttgctgctcttggtgttgttgttcctgagttgttagatctatttgggatagtgcattttgttgagcctgtctggtggaaagttggttatgccaaacttcagggtgatactcttgattaccttgggattcctgggttccgaattgctggtggtcaaggcatcatcgtcatcgctatctgtcaagtccttttgatggttgggccagaatatgcgagatactgtgggatcgaggcgctagaacccttgggaatatatcttcctggggacataaactacccaggtggagcactgttcgatccattggggctgtccaaagaccctgttgcgttcgaagaactcaaggtgaaggagataaaaaatggtcgtctagcaatggttgcatggatcggattctacatccaggcggctgtaaccggcaagggccctgtgcagaacctcgccg

SEQ ID NO: 3610 - DNA, 535 bp, Hordeum vulgare
  UNSURE (12),(20): n stands for any base
aactatacaagnaatcttantagcctgtgtacgcagtacctatttgctaactatagaaatttcctagcagctacaaactgataaatgtaaacgctgtacataagcagttgaaatgtctcaaagaaagggggataaaatgttgttgtggagtggatccgacaagtgctcggcgaggttctgcacagggcccttgccggttacagccgcctggatgtagaatccgatccatgcaaccattgctagacgaccattttttatctccttcaccttgagttcttcgaacgcaacagggtctttggacagccccaatggatcgaacagtgctccacctgggtagtttatgtccccaggaagatatattcccaagggttctagcgcctcgatcccacagtatctcgcatattctggcccaaccatcaaaaggacttgacagatagcgatgacgatgatgccttgaccaccagcaattcggaacccaggaatcccaaggtaatcaagagtatcaccctgaagtttggcataaccaactttccac

SEQ ID NO: 3611 - DNA, 438 bp, Hordeum vulgare
agcgccggggacgagattcaagaacctggtctccagggaatactacagccacaagaagaaggtgcactctgtagcatggaactgcataggcacaaagcttgcttcaggctctatagatcatactgcccgtgtctggagcattgacccccacggccattccaaggttaaagacattgaactgaaaggccactcagatagtgtagatcaattatgctgggatccaaggcatcctgacacagttgccactgcagctgctgacaagtcaattcgcctttgggatgcacgaagtgggaaatgccaagttgttgaactcagtggagaaaacatcaacatcacatacaaacatgatggcactcacatagctgttggaaataaggaggatgagctaaccatagtggatgttcggaagctcaaacccgtccacaaacagaagttccc

SEQ ID NO: 3612 - DNA, 551 bp, Hordeum vulgare
aaatttgatctattttactttaatatgttctagtaatgttctgtcggataagatacaatgcaagttgttctctagtaaccacataaggtacaatacaacaacactgtttggttttgggatgtttggtttgcgaaaatcacctttggcagtcacagctcggtccatcacgggataatctcttaaatttggtcaaattacctaatccatcatttagaactagcttagtgcacattctacacctcaaaccaaacaagggtgcattcactatccagtccctcaaccaaacacctcattcaagccgacaaaaaagtggaattacatttgtaaggccagatgtgtgaatctacatagacaacttgctggtgataatctggtccgcgtcagattatgtgctttcaaaaccaaatattcggaaaacaccgtcatcagtctggtacttattcttgtcatctcctgcataagccaggaggttgtatttagggttccactcaacactattcatagctgctttacatggaatctgatgaattgatcgtccagtctgaatattg

SEQ ID NO: 3613 - DNA, 388 bp, Hordeum vulgare
atgcaaaagttgctgcagacaaggtcttgttccagagttcgagattacacttgaagctactcaccatggaccacttaccagtacacccacgatgtttgttgagataggaagtacacacgaatactggggtagacaagatgctgcacaggccattgctctagttctatggaaaggtcttggtcttgaggaaggaaatgctgttggaacttggctggggagcggtgaaaaggttctactaggaatcggtggtggtcactatgcccctcgtcatatggatattgtcatcaaagatggcgtctgggtgggtcatctcctgtctggttactctttgccaatggatgcaccggctcaagtaaatggaaagagttctggtgaggttggtgggatg

SEQ ID NO: 3614 - DNA, 548 bp, Hordeum vulgare
tgagatcgtctctatatattcctggttttttttctcttttggcgcaaaagtcagtccttctaagacaaacgggaggaagcaccaagtcttgaaatcggattatttaaacacagtgctctatatctactcaatttgtgcgtgccaagccctagggaggatgaagtcactttgacgactttgcgctgtgggagcagttaaatttttgtgcacaggaaatcattgggttttcctatcctgatattttgctcctgcaaatagctcgtgatggcgttcttctgccagcccttgaagctcttctgatcaagatgtgctataacttcaccaccgggaaatcctgcctttgtggcttcatacgaaacttggatggaatgcttccacatcccaccaacctcaccagaactctttccatttacttgagccggtgcatccattggcaaagagtaaccagacaggagatgacccacccagacgccatctttgatgacaatatccatatgacgaggggcatagtgaccaccaccgattcctagtagaaccttttcaccgct

SEQ ID NO: 3615 - DNA, 1230 bp, Hordeum vulgare
  UNSURE (1)..(3),(12),(18),(27)..(30),(40)..(42),(44)..(47),(52),(59),(60),(66)..(69),(71)..(73),(98)..(107),(120),(122),(129),(144),(148)..(178),(187),(219),(232),(236),(259),(525),(1000),(1204): n stands for any base
nnnaaaattccnaaaaancattagaannnncaaaaaatgnnngnnnnacaantattaannccgttnnnngnnntttttttacaaagacccccaaaaannnnnnnnnntttttttttgttntnggggggncccccacaaaaaacncccnnnnnnnnnnnnnnnnnnnnnnnnnnnnnnnggggggggngttttttttttggggggggggggggccccttntccccccttttanttcnttttttttttttttttctttttnttttctttctccttctttttttttttttttttttcttttcttccttctgtttctttttttgcctttctttctttcttggtgtggggtggccgtcctcctttttttttttttttcttcccttccccctcttttttttttttttcgtttcttttggtgtgggggggtttttttttttctccccccccctcctttttttttgttttttttttttgtctttcggttttttttttttctttttttttttctttttctcctttttctccccntctttttttttcttttttcttcgtttctctctcttttttttcttttcttttttttctgttgtttttttcttttttttctctcccttttttttttttttccttttttctttttttttctttttgtcttctttttgtttctttcttttcttttctttttttttctctttttctctttttttttttttttcttttctttttttttttcttttcgtttttcctttttttttttcttttcttttcctctttctctttctgtttttttccttcccccttgttttttttttttttttttcccttttttttccttctttcttttttttttctcggcgcccgcgtttttttttttttttttttttggttctttctcttttttttcccctttctttttttttcccttttttttctcttttccccttttttttctctttctttttttttctttttctcttccttcctttctttccttttttccccntctttcttttgttttttttctgtcttttttctttcccccctccttttgtttttcttttcttttttccttggctctctcttttcttgctttttttttttcctttttcttcttctttttttccttctcgtttccctctcctttctctcttgtcctctttttccctttttccctcttcttcctcttttttgttccgtttgctttggnctttcttctttttttttgtttttctt

SEQ ID NO: 3616 - DNA, 550 bp, Hordeum vulgare
gtaatggcagtgctttagattgacttgaagtagtctacaaatacaggccagggtagctaacaagcagctacccaaagaatagattataacccaacataatcaaatacgcagttcgggtaaaatttggttaggtgacatacaaagtgtcccggagattattgctggtgctgtattcggaactcgagctgcatctgtggtgccaattaccaagtccaaggttattgctgcagcaacttgacgagatcgtacacggagtttgtgtaaagatctggatggatggtatttgaggcatcctgaagttctggtaaggtagtcacacctgacagaacaaggagggtcttgcaaccagtattctgaccaaatagtatgtctgtgtctagtctgtcaccaaccatgcacattctcgaagtttccaaattgaagcttttcaataggaagtccatcaaaaagcttgaaggttttccaacaacaatgggctctttctgcaccgagcaacttactgcagcaaccatagttccagctcctggccattcttgggcggatgtcatat

SEQ ID NO: 3617 - DNA, 380 bp, Hordeum vulgare
ccatccaccattgtgttccagcttgcattcgacacatcgtgttcgtgctagagagagctcgtatccatggctagagagatggagaaggcaaggaaggccacctcccctaagagctcatcaactagttcaggtccgaaaagcccaacaaggaacggtgggtccccacctcataagaagaacatccccgaggcacgaccaaaaaatgagcagcaaaacttccgtaaaggaggtcaagactcggcaactcatgatgaaagcaaacgccgttctccaacttcacaaacctcacccaagagatcgacaaagcacgagcaaccactgagctactgcaggcttcacaccgaggagcgggccataaggcgagctggttacaattacca

SEQ ID NO: 3618 - DNA, 326 bp, Hordeum vulgare
ttttttttctgttttttttttttttttttttttttttttacaaatccggagcttttatcattatcatcaccagatcgagagacacacacatacgtaaagccagcacgcatgcatgcatgcattacatcctgatgttccatcgaccttttctttatcctcctactggtctttagtggcgaaattcaaaggaacaaagcaagagaaatcaagaaaagaagagatagagagagaaagcactattggctatgtacgtggcgtgaaaacgatcggcagcaaagtaagcggctgaatatttggcactagcactacgcgtgcatgcatgttgc

SEQ ID NO: 3619 - DNA, 517 bp, Hordeum vulgare
cacccgtccaccccccagcgtattccgcagccgccgccccgcgcccttgccgccgttgccagcctaatcttttggcaacacacacagagctgccacacgccatggaggagacgaaacccacccccgcaccccccctcttctccttctccaacctcagcggctccttcgggttcgggtttggcgccgctcccggccctccccctccgcctccgccgccagctgtcgaggtcctcctctccgaggaatcgcccatcgcggccggcaacttggagcctgtggtggttgacgactccctatcgatttacaagggaagagttaacacctctgatgttttcggggtaaaaaactctgatttggttccaggaaaatatgaaggtgggttgaagctgtgggaaggatcattggacttggtgaaaaccctaaattcagacatcaaagatgatcgactgcttatagaaggcaaacacatactagagttaggatgtggacatggcctccctggtatctatgccgctct

SEQ ID NO: 3620 - DNA, 550 bp, Hordeum vulgare
ggagaagggtcaccgggtttaagagtcgtaattcagagataggaggactcaagtatttgtatgacttctcaagagtaaaacatgggcttcttatcggaataagagctcataaacagtcaacttgaaagtgaaactaacagtgcattaaaacaccatgaaacgactaaaccaaggctgacactctaccagtatagagccaagtacacgtttgtatctgatacaacaatcacagaggctatgctagtctacttgaatgagaatttccaaacctccctaacattggatgatccatcagtaacttcagcaagcaggtccgactgcagggcaccatcttctgtaaccaagcgtagaaattgccttgtgccaccacctacaccaaagtaatgctttttccctgccatataaactacaccactagggtagtgtaagcacttcttgatgagcctgtagagactaggaagtgaatccaatgcataaacagtctcagccatcaggatgatatcataacctctatacccttcattttctgtttgaagattggttgttttat

SEQ ID NO: 3621 - DNA, 551 bp, Hordeum vulgare
  UNSURE (20): n stands for any base
gtacccccgggcctgcaggnaattcggcacgaggcctactccacttcggtattcatgaagaaatgctaaaagatgttgttcggacaaggtcatatcaaaatgtcatcacccagaataactttcttttcaaggacaaaatagtccttgatgttggcgctggaaccggtatcctatcacttttttgtgcgaaggcaggagctaagcatgtctatgcgattgaatgctcccagatggcagacatggcaaaggaaattgtgaagacaaatggattttctgaagtcattacggtaattaaagggaaagttgaagaaattgagcttcccgtcccgaaagtagatgtcataatctctgaatggatgggttatttcctcctgtttgagaatatgctggacactgttctttttgcacgtgataaatggctggctgacgatggagttgtcctgccagacaaagcctctttacatcttactgcaatagaagatgcagaatataaggaggacaaaattgaattttggaataatgtgtatggctttgatatgagctgtattaag

SEQ ID NO: 3622 - DNA, 551 bp, Hordeum vulgare
cataaattgcgagcgtggtgatctattatggatccattttgacacaacgtatacaacaattccaaaaaatccctgccacacaacacaagatagatttgcaacatagcaacctacataagcatgccagtcaaactctactttctactttgttgcctaggtgcctgacaagcgcatgtttaaaatacaagacccgaggaacaaatatcattttttgtgaaacacaagataatcagtcaaccaaaattgagtggactgcacaaccgctgagttcctcgcattggtcatcgcatcttgtagtgttgtgttctagacaccttgcacctattgccatttatggcgtatttcagcgtaatgtcgatgtctcgagggttcttcttgttgttcgcaactgtcatgctgcccgacagagtctccccctcgcagatggttactacatcctcgagatacagaacagtctgcttccagtgagtggattttgatctgggccctgtcgagaagcccatcagcttatggcatttggtgaatgacacgttgaaataagcaacaagagc

SEQ ID NO: 3623 - DNA, 518 bp, Hordeum vulgare
gccgccgccgctgtgttctctcccgcgccgacgcagccatggtgaagtactcgacggatcccgcgaatcccaccaagtccgccaaggccatgggccgcgacctgcgtgttcatttcaagaacactagggaaacagcgtttgccctgaggaagatgccgctgaacaaggctaagaggtaccttgaggatgtgttggcacacaagcaagccatccccttccggaggtactgccgtggtgttggacgcacggcccaggttaagaaccgtcagccaaatggtcagggacgctggcctgccaagtctgctaagttcgttctggatcttctaaagaacgcagagagcaatgctgaggtgaaaggtcttgatgtggatgctctctacatttcgcacatccaagtgaaccaggcccagaagcagcggcgcaggacctaccgtgctcatggacgcatcaacccctacatgtccaacccatgccacattgagctgatcttgtctgagaaggaagagccggtgaagaag

SEQ ID NO: 3624 - DNA, 539 bp, Hordeum vulgare
aacccaacaccataagatacgatgaaaaatttcaaaacacaaccagatcgaatccattagaagagactttcacaaagtatgagctagcagtatttagacgacagataacagggcaaaaattccactcagccaaaccagatgctacaaagtgctctaacgaataggtggacagatgatgtagagcttccttctctaggccttcctggcaatctgggactcagcctccttcttcaccggctcttccttctcagacaagatcagctcaatgtggcatgggttggacatgtaggggttgatgcgtccatgagcacggtaggtcctgcgccgctgcttctgggcctggttcacttggatgtgcgaaatgtagagagcatccacatcaagacctttcacctcagcattgctctctgcgttctttagaagatccagaacgaacttagcagacttggcaggccagcgtccctgaccatttggctgacggttcttaacctgggccgtgcgtccaacaccacggcagtacctccggaaggggatggctt

SEQ ID NO: 3625 - DNA, 1157 bp, Hordeum vulgare
  UNSURE (1),(58),(60),(552): n stands for any base
naaaggttaagcgcacatagattccggagtggcaggccttccaacacgtatgttgcgngngcgcacaaccagagagagagagagagagatataggagagcgcgcgcgcgagagagagcccaagagagagacagagagcccgattgtgtgtgtgcgattgcgcagagagagagatagagagcacagatagtgagcgcgctcttccctcttcttttctcttttcctctccccttcttcttccttttcctttttttctttctttttccttctctcttctcctcttttctttttgtctctcctccttcttttttttttttcccctccctccccccccccctttcttttctttctctttctcctccctcctttcccccccccccctcttctttccttcttcttccccccctcctctcctcctttctcctctccccctccccccccccctatcccccctctccctcccctttcttctctctcccaacctcttttgttcttttccttttctctttcttttttttcacctttttctttttctttttcttctttttttctnttcttctgattttccccgtcttctcctctccctcctcgccgtctgttctccttcttcactcttcctctcctccttttctctttcctttttttctccttctctctcatctcttttccctctcttcttctttttttttctctttctcccttttttattttttccgcttctctcctttattctcttcctccctctttctcctttctttcgtttccctctctttcctttccctctttccccatctcttatgtcttctctcttctcttcccttcttttttctttcttcttcttctcttctttttctattcttcctccctctccttttcttctcttctttctttctctctccttctcttcttttctcctccctcttctccccctcttttcttctcctctttttccccttcccttcttttcctcctctctcttttctccccctttcccctttcttttccttttcctcccttcctcccccctcctgtcttcttttttcctctccctctctcccttctcctcttccctccctttcttcctcttttttctctttttttctccccctccctctccttctctctttcttctctcccctctcccttttcctccccctt

SEQ ID NO: 3626 - DNA, 535 bp, Hordeum vulgare
tttatatggcaatctattctcactttaaagtcaactgagttcactggcagtacaagtcccggtcgaaattaactgtgccaaccaaaattaactgcaactttttatctgactgcacccaacaaacagaacagaaacgaatagcttctccagtcttttcagttcattcaggtcttcggcagaccacgcactctgttgctctcacctgcaaaattggtctagtaagattcatactcgagggcggcgggtgcacgggcctattccttacatcagttgctggtgctcgccgggcggtagtactggtagtagcccagcgccgcgagcagggcgacgagcacggccacggcggatatcaccacggctggggtggcccatgaccggtacgactgggctttcttcctcttcaggatcgcctttggcagcggggccttggtcttggtgactacattcctgggccgtacgttctgcttctgttctttgttcaatgtggttgctctctctctctctctctctctctctctctctctctctctctctc

SEQ ID NO: 3627 - DNA, 482 bp, Hordeum vulgare
atcgatgaagcgccatcacttatgaagaacatttactggaaggagtttggtcttctcacgtttgtgtggctagcattccttgctattcagataacaaagaattacgctcctacttgctccacgtggtactgggtcttgaactttctccagatcccggtctctgtaggagtgactatgtacgaagcactgggtctgatgaacgggaagagggtgctgtcatcaaagggagatgagcaaactaccctgaaatttcatcagctctgcatatactgcttcttcggtgtcactgctgggcttgtcggcggtctgctaggtttgggaggtggtttcatcatggggccactgtttttggagcttggcatccctccccaggtttcaagtgctaccgccacattcgcgatgatgttctctgcttccatgtccgtcgtggaatactacctcttgaaccggtttccagttccttatgctgcttactttgtcgc

SEQ ID NO: 3628 - DNA, 304 bp, Hordeum vulgare
tatctattacaagattggtacaatgagataggcacggtgaattgactttaaactgaaaattcagaaatcagttccagaaaaaaagtgcactccaacatgtagcccagttctaaccccaagctgcgacctccgatttttagcgcgctagattaccttctgattacatggctaaacatttgaaacctgaaccacctatgagtcgaatcttcaatttaattctggtttccttctggaatgactgcacatgaactttaagcctgcttgcatcctatgcatcatacttgcagaggttctcaaaccccat

SEQ ID NO: 3629 - DNA, 541 bp, Hordeum vulgare
ggtctgcaggcaattcggcacgaggccgctgtcccgatcactctcccttccagaagcttggaccggaggaaggtgctgagagggcggaaaggaggccatgggggaattctccaaggaatcttgcccgtctgtgaagaacattttgctactggattctgagggaaagcgcgttgctgtgaagtacttctcggatgattggccgaacaacgcatctaggttgacctttgaaaagtccatttttactaaaactctgaagacaaatgcacgctcagaagctgagataacattgcttgatggtaatattgttgtttacaagtttgtacaagaccttcacttcttcgtcactgccggagatgatgagaatgagctaatcatagcaaatgtgctacagggttttgctgattcggttggtcttctactcaggggtgacgttgagaagaggactgcacttgagaacttggacttgatacttctctgcattgatgagattattgatggcggcataattcttgaaacagatgcgaataccattgcggggaag

SEQ ID NO: 3630 - DNA, 549 bp, Hordeum vulgare
gagcaaatagtattacatattcatttaagaagaatccagacaaatctgtctgtccagttgcgcttctggttaagtgaccgctaccaggcctatagcatagtagccagacctcaaacacacacaagttgtaacaggggtgacagaagaagcagtggtttctcacttcagaagagatcttgcaaagtgttccctggctgtggccagagcttgggatattgtctgctcagagaagggaacagaaccgtcagcagcattggttgcaaccttccccgcaatggtattcgcatctgtttcaagaattatgccgccatcaataatctcatcaatgcagagaagtatcaagtccaagttctcaagtgcagtcctcttctcaacgtcacccctgagtagaagaccaaccgaatcagcaaaaccctgtagcacatttgctatgattagctcattctcatcatctccggcagtgacgaagaagtgaaggtcttgtacaaacttgtaaacaacaatattaccatcaagcaatgttatctcagcttctgagcgtgcatttgt

SEQ ID NO: 3631 - DNA, 544 bp, Hordeum vulgare
  UNSURE (3): n stands for any base
ggnctgcaggcaattcggcacgagggggccgatgattttaaaattggccaggatttgcttctaagcatcaaagaggacactgaatttactatagtacgggaaaacataaagaagaagcttgagatgatatgtgatgaggttgttgtcaatcccagcaaggcccttcggaaacttccaagagtacaacatttgtcagctcaattagctgcaagattaagaaatgaggacgacgagtttgacatcctaaatgctcttcatccaagcccagctgtttgtggcttgcccactgaagaagcgcgccaattcatacgagattatgaaattttcgaccgtggaatgtatgctggacctgttggttggtttggtggggctgaaagtgagtttgctgttgggattagatcagcactacttggaaaaggatatagcactttagtttatgccggtgccgggattgtcgaaggtacaaatccatcttttgaatgggatgagcttgatctcaaagcatctcagtttgcaaagttgttgaagtatcaagaacatcata

SEQ ID NO: 3632 - DNA, 544 bp, Hordeum vulgare
ttatgcttgcacagaagctccgatatatagcattgaacaaccggccggagaagaactcaaaagaatggtaatatacacttgcactaaactggtttgttacaatcattgtacataattatctaatatgcttttatttaatcttttgtacgctccacgactatcatcactgtcatctcctcgaatcgatatttttgtgattgcatcttcaggagccatgcaaatcaggctgaaatcctttcaagtttactacgcacacacacaaaccgacgaactccatttagaatcttcccatcaaatcaaaacttccctctttctaagcattgtaatctctgatgacttattagttacagttcaaatcaatgtccccatgtttcctgcctcttggtagaaaatatgatgttcttgatacttcaacaactttgcaaactgagatgctttgagatcaagctcatcccattcaaaagatggatttgtaccttcgacaatcccggcaccggcataaactaaagtgctatatccttttccaagtagtgctgatctaatc

SEQ ID NO: 3633 - DNA, 536 bp, Hordeum vulgare
gaggaattcggcacgagggctcgtgagcaaggcattgttaaaaggagacgccaattcggttcgatcttggcgccgtctgcgaaatgagcctgagtggaagattgcgccgacggtgctcaccctgtgcgagcacctgtttgtgagcttcgcggtgcgcctgctgcaccgggaggccaccaaggccatagcggaggtcacgaccaaagtgaagggaccacccactggaggcgaagacgaaggtgaatcgtcgtccggcggaggagccctggttaagcggagcaggctgtggaccgttgggaggttcgcagcttccggcgtcgtcgcttacgtggacggtcggctgtgccgccacatacccaacccaatcgccaggagaatcgtgagcgggttcctcctgagcttcatcgacaggagagacgacgagtaagcaggcaggctggcgatcaccgcctgcaatgcatccacgcgatagctggccgccatgtgtagccagctttgtacaacagttttggccccggcatgtgcatactttgcgc

SEQ ID NO: 3634 - DNA, 549 bp, Hordeum vulgare
ggtatagcacttgtattccatgagaccataggccatatatatacatgtacatgtggtggattatatgcaggaaaccccttatatattgggataaatacaaaagggtacatgatttatattataactctaacaagctgtactttatacctgtggtagatgtgtgtgcatgcgttcttcctgtgattgactatagaaagaaggaaaattccaaatttcaggccaaactaaaagcgcggcgagaaaaaacggacgaaatgttccgtgcgcaaagtatgcacatgccggggccaaaactgttgtacaaagctggctacacatggcggccagctatcgcgtggatgcattgcaggcggtgatcgccagcctgcctgcttactcgtcgtctctcctgtcgatgaagctcaggaggaacccgctcacgattctcctggcgattgggttgggtatgtggcggcacagccgaccgtccacgtaagcgacgacgccggaagctgcgaacctcccaacggtccacagcctgctccgcttaaccagggctcctccgccgga

SEQ ID NO: 3635 - DNA, 554 bp, Hordeum vulgare
  UNSURE (19): n stands for any base
gtccccccgggcctgcagngaattcggcacgaggagatatgatgctcaaatcagcgtatttggatctaagcttcaaaacaaactggaggaagcaaaaatctttatggtcggttctggggcgcttggatgcgagttcttgaagaacttggcactaatgggtatttcttgcagccagaaaggaaatctgactgtgactgatgatgatgttattgaaaagagcaatctgagccgccaatttcttttccgtgactggaacattgggcaaccaaagtccacagttgctgctacagccgctatggtaattaatcctaaacttcatgttgaggcgcttcagaacagagcaagtcctgagactgaaaatgtgtttaatgatgccttctgggagaaccttgatgctgttgtcaatgcccttgacaatgtgactgcaagaatgtacatagactccagatgtgtatatttccagaagccactcttggaatctgggactctgggtgctaaatgcaatacacagatggtcatacctcacctaacagagaactatggggcttcaaggg

SEQ ID NO: 3636 - DNA, 552 bp, Hordeum vulgare
gcaaccataaaacatgcattcaatccacgatgacacattttagttgtaaacgcatcatgcaacagatgatgttgtgcgtgtcttgtgaatcgtgatgtctggtaacaactccagatcagcccccaatgatccaatcgacatcgagatggtagaaaggaaaatcagtcagtaatgtggcttaagcccccactcagcttacagtcactaatgcaactcatgacttgtcagtcgatcaggcatgaccaaccacaagatcatgtgaacacagatgaagcgcttcttcagcggaagtagacagacacaagcgggatgtcgacatcgttgtcatcgtcatcctcacaggccaccacgacgtcgagatgacgccggtaagagggcacctccatcttggccacctccctggcaacatcaactaccttcctgtcaagccgttccttgtgcctggggaacatagagttgtagagcagcgaggtgccacaggatatgctgtaagcgttcagacccttctccttgagccactccaggagctccctcagcgtgatgttgcccgtt

SEQ ID NO: 3637 - DNA, 519 bp, Hordeum vulgare
gtccccaaccataattcacagagacgttaagagtagtaacattttacttgacaagaacatgagggcaaaagtggcagactttggcctatcaaaacctgcggtcgatgggtctcatgtatcaagcatagttcgtggaacggttgggtatcttgatccagagtactacatctctcagcagctaaccgagaagagcgacatctacagttttggtgtcattttacttgagctaatctctggccacgagccaatctctagtgataactttgggctcaactgccgtaacattgtggcatgggctaggtcacacatcgagagtgggaacatcgacgccatcattgacgcatcgctagatagcggctacgacctgcagtcggtgtggaagatcgcagaggtgggcatcatgtgtgtcaagccaaagggtgcgcagaggccaaccatctccgaggtgctcaaggagatccaggacgccatcgccatcgaggtgcagcgggaggcgccccaagtccagcaactcatgtc

SEQ ID NO: 3638 - DNA, 552 bp, Hordeum vulgare
ctcaaatcccaatttggacataagctagagctagtgtaattcacagctttcaaatcatcaccaggaaacagaaagactaactaacacatgagcatctccttctccttgcttacatgaaaagcgtctctaatgaatcctggttctacctgaggcccggccgcatgagcatttcatcaaacgacgcgttctgctccaaatcggcgctgttgtccgtgttgattgagacagaacccatggacctcttggacatgagttgctggacttggggcgcctcccgctgcacctcgatggcgatggcgtcctggatctccttgagcacctcggagatggttggcctctgcgcaccctttggcttgacacacatgatgcccacctctgcgatcttccacaccgactgcaggtcgtagccgctatctagcgatgcgtcaatgatggcgtcgatgttcccactctcgatgtgtgacctagcccatgccacaatgttacggcagttgagcccaaagttatcactagagattggctcgtggccagagattagctcaagtaaaatga

SEQ ID NO: 3639 - DNA, 289 bp, Hordeum vulgare
cccaagcttcatttttttttttgcgattcacctgctcccagctcccgctgctccggtgcaatagtgattctttgcccgtgtgaggagcgctgctatcaggcgtgggaagcagagcggctgtttagagaaatggagtgcggcggcggagaccccggggagtacgccgcggtgctgaagaggaagctgcaactgtactgcgccgccgtggccaagaccatggaagctaaacctatagaatcttctttgagtggcctcaactcacaagcttcggacacttcgccattggttt

SEQ ID NO: 3640 - DNA, 531 bp, Hordeum vulgare
  UNSURE (26): n stands for any base
gcatgaagtgcaggttatttaccttnaaaatagtatatacaaagttcagcatccagatatgcaccggacgcccacagcctccatattttacgacaaaacttagcccactggagcattatacaatccagttactgggctttggcagggacttcatcgtccgaaaaaatcgatgtgtcctcggagtgcactgaatctctatggatcctcttctgcaggttctccaggctcgcgacgcgtcgaagagaggctggccttgagtccatctcttccccactgggcaaaggggttgctacctctgagaggtcatgtttgatcagatcatcttcaagtaaaccctggaggaaatggctcatgctttcctcagtgggagcagcatcagcagaagctgcaacagacacacatgaagctgtgggcacgttgtttgatgtagtggagaacatcaagcttgctccagttactctcctgacagcttcttcagctatattcacctgaacacaagtactttgttaacatagaaaagaaaacaaaaat

SEQ ID NO: 3641 - DNA, 518 bp, Hordeum vulgare
cctcgtgccgaattcggcacgagggcagcctcctgctgcagctccgcccccgcagcagcatctggaggagtggaggcggcccgggcgaagggcttgcaacttgtagcatggtaccttctgtctcttgacaagcatccggtggcgaccaaggctgtcacttctgctgtgctgaccctggccggggacctcatctgccagcttgtaattgataaagtgccagagctagacctgaagagaacatttgtgttcacgctattggggcttgtcctggtggggccaacgttgcatttctggtacttgtatttgagtaaattagtgacaatcagcgggacatccggtgtcatttctcgcctgttacttgaccagttcatcttctctcccgttttcattggtgtcttcatgagcttactcgtaaccttggagggaaagccatcacttgtagtgccaaagcttaagcaggagtggttctcttcattgatcgcgaattggcaattgtggataccgttccagtttttgaa

SEQ ID NO: 3642 - DNA, 547 bp, Hordeum vulgare
  UNSURE (4),(16),(17),(37),(38): n stands for any base
cagnatattacattanntgtaattctgcggaaaccannggaacaagcttccatcacaaacggacatgcagattgtacaacgcatgtttaaccggcatctcaggctgcactcaacaaaaaagatggacactagtttacaatactaagcaagtgttccatcggccgagtaatacagacaagacgctaggataaactgataataggtttattctttcagccttacatctccgcatgttgcaaccggccaggtaccctgccttatagtctactctctcacctatttgactactccgcaataaccttcttatgagctttatatgacaaaatcacgttccatgcaagggctacaaaattagcggcaagaacctggagcttctgtgggacaaaatagaaattcaaaaactggaacggtatccacaattgccaattcgcgatcaatgaagagaaccactcctgcttaagctttggcactacaagtgatggctttccctccaaggttacgagtaagctcatgaagacaccaatgaaaacgggagagaagatgaact

SEQ ID NO: 3643 - DNA, 488 bp, Hordeum vulgare
cctccgacgacgttgcggactcgtccaagtccaccaccagcgacgaagaggacgacaacccatgggcgctcagcgacgacgaagaggaggatgaataccaagggaagtactgcccttttacagttgacaattttccaagggttagcagtgatgatgatgagcagacagtcgccgtgtatatgaatccagagatttcgatccgaggcccaagaccgcttaggagatttccagcatttaagccagaaagtcggcattcatgtgatctggagtatcgacttgccgatgaatctgaaatcagtttcagcaatgttgggactgttgattgctcgcataagggtcattgcagatcaatggacatggtgcagtttattgatctcaaaatcgctggctatcagcatgcccagcctggatgtgccaaaatattcgggtttttcgcggcgcgggatcgggtcgaacctttgcgcaattatgtctacaggcgtgaaatt

SEQ ID NO: 3644 - DNA, 555 bp, Hordeum vulgare
taaatgttttgcagatacattaactcttagttaggaacaaagtggagtgctcataacatcaaggcagcgaataatccaagttcaagctacatattagagtaatttgtataggaagctgcgtgtcaatccaaggttctccaggtgattttcaccaaaatcgtggtaaattcgtcaagattcaccactttatctactattccatgatagcaagtgtcgaagctgtcttcccatgcaccacaggggagcagtttctgagaaagtccgtcatccttgggggtcccttcgatacgaagatacacgcagctgcgtatcaccacggctacaactgaacttattttgcagccagcttccgcaacaccctggtagagacgaatcacatcgttgtaaccactggtcttggcatagagattcagattaaggccacaatcaggagcacggagtatctcaacatcaacgaatgcctggactgcattaaccagggctgcaaacttgacatccagtgaacacttgtccccataaagacgccgattttgaatggatgattttgttgtgtac

SEQ ID NO: 3645 - DNA, 517 bp, Hordeum vulgare
cccagaggcatttttttaagccacttgtcgcaacagagaactcgtacatcccacaactttacaacgagaacttcgagtttgaagaatgcacatttgctccagttccatccccagcttctgctaggccattcattgtaacagatgggagaagaatcattagtaaatcgcgctatgaaccagtgccggtaccctttaatattgggttcgacaaggagggttgtcgaaatggctcagaagtgccagaaagtgtggttggaattgctcctctacctgagctgaataaatccaaaagggacagcagggtaccgcaaggtacaaggtttagtttgcctggctcccaaagcgaaagatatagtaaaccatcaaaatcagcaggtttactggaacgaatgctcatgttctccagtggggttggcattggtattatatcttcctctctatcaagcaaaaaagatcttgattcgttgaagggcacactgaagcgaatggagaacttggttcaggatttgcaagatga

SEQ ID NO: 3646 - DNA, 547 bp, Hordeum vulgare
tccactacatgctatataaaatttaacggtatataatatagtcctgcaacctaatatccacagaaaacaacattctttgagcatgtatgagtacaggtgagccttgcttagttctctctacaatctgttggatgagcatctcactatcgtggtcatcctcgtcacccgactcgtctccatcgctctcttgagctctgttagggtccccaatgttcacagcctgctcccaagtgctgtcctctttcagctctgtagcgctctcatcttccaagccccagatcaagctgcggtcaactgaataatcttcatttacttgaggcctcccgtttgtacttgtggtgcaaggggagtcagcaatcctcatgaattcttcataggcttcatcgtaggcttctagtgcatctccagctagatttagacagaacggttcggcggaggagctagcttcttgtataaacaatgggctatcctggttggaggacgaacctgaatcactgtttgagcacgtccgctcagagaagactcgctgtctcgccatgatgtgcag

SEQ ID NO: 3647 - DNA, 543 bp, Hordeum vulgare
  UNSURE (3),(11): n stands for any base
ggnctgcaggnaattcggcacgaggtggcaaccaaggttagtaaccggaggtctcgcagatggttgaatgatcgcttgctgattgagcttgtccctcgtcttcatgttgaagaaatcaaaggcctctttgcccctccgccatttggtgaggaagcaccactgtcagcattttgcaggacaagtgttggtgagtgggatgccttcaggagcattgacatggacgttgaggcaagatttatgcaacggatgaaacaatcatcagcgaagcagaagaatcttatgaatgaagatgagttaattgtgctgaatgcttggcgtcgtatagattgccaaacaagagaagctatgaagagaaacttcctacctgaactgcttgaaatatatgaagagcggattagggccttcattgaagacaatattgataaagatgtgcttgtgttgaatgtccaggacccatttcagaggttgctattacatggtgtgtgtgagttctacaacgtaacgtcgacgaccacgggtactgtgcaagatggaaagccgtgg

SEQ ID NO: 3648 - DNA, 544 bp, Hordeum vulgare
tacaagtacgttgaaaacattgtttggcaccaccaccagtaggctggcagtaaggtttaacgcaaaacaggtacagtgcttacttagctgtgaagcgactcatcacttgcgtgccttgtcatctctttaaacgaagcatggtaattaatttacatatgtgtacatcctaagcaaaacctaaagaaacaactttggcttctcccaggagcatgatcattggacgacattcctttgtatttgtccgaggaatacggggggtcctcacgagacaacgtgtgacccgttcttctttgttctcaggaaactgaccaatgtgatcctgggggcaacacctgtgcccgaacgcttcttgattgtcgttgtcttccacggctttccatcttgcacagtacccgtggtcgtcgacgttacgttgtagaactcacacacaccatgtaatagcaacctctgaaatgggtcctggacattcaacacaagcacatctttatcaatattgtcttcaatgaaggccctaatccgctcttcatatatttcaagcagttca

SEQ ID NO: 3649 - DNA, 464 bp, Hordeum vulgare
tgcgcgcgcctcactctgtgggccttcgtcgcggcaaaaactacggaggagagatggcgccgctcgtgccgccgtcacaaccatgggtggagaaataccggccgaggcaggtgaaggacgtcgcgcaccaggaggaggtggtccgggtgctcaccaacaccctcgagaccgtcgacttgccgcacatgctgttctacggtccgcctggcactttttttaccaccactgcgctcgccattgcctaccagctctacgggccagagctctacaaggcacgagttttggaacttaatgccagtgatgaacggggaattaatgtggtgaggacaaagatcaaggattttgctgctgtggctgttggttctgcacggaaaggtggttatccctgcccaccatacaagattattatactagacgaagcagattcgatgacagaagatgcccagaatgcattgaggcgtact

SEQ ID NO: 3650 - DNA, 550 bp, Hordeum vulgare
ttacgcacattcattggttgagaaaagagtgaattcatcacacttaaaacatcacaaaccaacctaaaaatagcacaagagtatgatgagaatgaggttatgcctctttgacgggaaggagacgcaagatatatttgccagagtttgcagacagccggcagcaatatcaccgttcatctccatcatcttctcttagaagacaagcagtatcaccgttcatctccatcatcttctcttagaagaccagcccttgcgggatgttaaacagcgcacggattgtctcactagccatatctaagagctgtaaatactcatctgccccatcgaccaagcacttatcagcttccccaagctttctacatattcttgccttgtgctcatctggaatatcatccgcattaacgatcacatctagaaactgcgagagcagctgggaaactggatatccgtctgcaataatattgctaacttccttgtttgccacatcaaattcaccagatttgcatgctacaagcaatgacttgacagtatcttcagggatagcccctga

SEQ ID NO: 3651 - DNA, 518 bp, Hordeum vulgare
gcgagctggaaggaagttgactggtagagccagccaccgtccatcttagcctggcaggtgcttctcaggttccatggcttccagcaagggagcggcgtccctgctctgcatcaagctcgtggtctgcctctgcttcttcggattatgccaaggcaggggcacggccaagccgccattcacgctgaagaatctccctcccctcgagaaggcgagcagcttccccgcgatgcgccgcgagaggtacgactacattgtcgtcggcgggggcaccgccggctgccccctggcggccacattgtcgctcaagtacaaggtgctcgtgctggagaggggcggatccccttatggcaaccgcaacatctcctacatggagaacttccacatcggcctgagcaacacggcgccggactcttcgtcgcaggccttcgtctccaccgacggcgtcatcaatgcccgggcaagggtgctgggcggtggtacctgcatcaatgctggcttctacagccgagccagctcaa

SEQ ID NO: 3652 - DNA, 547 bp, Hordeum vulgare
caatttaatgggccatattgcacgagacaaatagttactgggtacagatgaaactcctagactgtcttacattggtgattacactggatcccagcaaaaattagtgatttcttttctaggtcacacacacatcataaaaggcaggtgttcaggaatctactacactccagctgctggtcctagccgttcccttaagatcttcactccaaagtacctgcccatcatcatgaccgtggcttgagggttggtccctggtgacctagagaacgttgagccatcaacaacgcggagccctgagactccaagcacccggtgctgctggtcgaccaccttccctacatgacacccaccatggtagtgccagatggtgattaccgtgtccttgcaaaattgctctagggattctgtggtattggtatgcttgggtatcagattcacattagcctgcacgctcatgttgagcaccctttccatttcatatccagcaccatcaggagtcagatgagcgaaactgtttgtcttcagtattttctcaatggtcttgatg

SEQ ID NO: 3653 - DNA, 457 bp, Hordeum vulgare
aattcaaacccgacacagcaccaaaccctcctcccccatcccctccgcctctccgttttctccccgcccgccgctcgccggcgcagctcgagatccgtctccgagcttccctcccttatcgagctgccggccgacgatggagaccagcacccctcgcaggccaccagcagcagacgctggcgcggcgtcctcctacgtctccatgtccccttccccctcccacaccccgcgctcctccaccaaggccaaacgaccgctcaacaacggcgctgccatcgtcgcctcctccccttccccttccccttcccttgccaaggggggcggcggtggcggcggagttaacatccaggtcctcctcagatgcaggcctttaagcaaggaggagctgagcataaacactcctgtggtgatcacttgtaacgagcagaggcgagaggtttcggctgcccagacattg

SEQ ID NO: 3654 - DNA, 415 bp, Hordeum vulgare
tttttttttttttttttaaacgcatagtaatattacatttcttgcatatagtcttctacgacagagataaatgctcaacattacatttcttgcatatagtcttctacgacagagagatcaactagctcaggccataatgcctccaaggttgatcttcaaactacagagtcaacccccaacgtctcaagaacatgaaaaagtccgggctctgtgtctagttaattgtagtgagaggaactctctccatctcaattgccaaatctaagcgcttcgcgttcccagccacgagtttcgacggagttctgctgtcccggaatgacttgacgaggtcttccagtggagttaccaagccctcgatcgattggcagctggggatgttaacctggcgccttcttggtgttgaacaagttggttc

SEQ ID NO: 3655 - DNA, 518 bp, Hordeum vulgare
atcgacttctgatggacaagctattgcgtacgttcaattaaagatcatatcattgaattgtgatctcctcttgatactatttatcattttgttacctcacttaccatcacaactccgagatgattgatttgctgccttatgtactataacagggcatctgttctggattatctagttcatcgtgtgcagtgtctaggcctgttttctacccactaccataagttagcagtggaacatgaggatggcaaggtatcactttgccatatggcatgccaagtaggcaccggagaaggaggtttggaagaagtgactttcctttacagattaacagctggttcatgtcccaaaagctatggcgtgaatgttgctcgattagcaggttatttccaagccagtatttatgttttctcactgcgtttacatttactcaaatttgaatgctctttttgcctgaggcttcagtaagttggcccaaatggaaagactaagtgctgcatgctcattttgttgtatccatc

SEQ ID NO: 3656 - DNA, 527 bp, Hordeum vulgare
gtagctatatatacaccactctgatcatctactacttaattacattacatactgggatgccgcagttagagcaacatactagtcactcagttgggcctactaaactaagcaccctcctcggcttcaaaattgtgcaggccaggtggccatccttggcctttgggtaaacccatgcatatcatatctcaccgccgcaaaaccacgtgctgccccaaatgcttcagatgagcttgcaaaatcagaagtagatccaagaacttccatgagcgcacgcgccaataccgcatttccaaaatgatgccgatccaaaagggacaccaagcaggcaaaagaaagaactggggcaaatctcctctgattaaatgggtcatgcaacttgactatgcttccatagcttgcaccctggcacgcatctgtacttcacgaatcctgcttaagcttgctgcctcgtcttctttatgattccctgccttcacaatacggaacaaatccttgatggtagcaaagttatcctcctgtgtacagat

SEQ ID NO: 3657 - DNA, 319 bp, Hordeum vulgare
cccccctctctcccctcgcccccagaaacggaaaaccagcccagcggcagcgtgccaggggaataaaatcctagtcaaatactgacggggaggacgaacatcacagcagcagaaatccggccttgtgaagcacggcgccgtccagccagccaaggcggattcttgacatgcgagactgatggcggcggcggaagcgagagctgcttggcaacgggccgccaaccgctgcttgtttcaggaggatgcaaagagggctcccaaactggcctgctgtccaccgtcgatgcagcagcagcatgaagcaaacagcgggaacccc

SEQ ID NO: 3658 - DNA, 552 bp, Hordeum vulgare
  UNSURE (26): n stands for any base
aagttgcagtacacattggtcaaacntcaaacaaacttacttacagtacaggcttacacaccgttcaagtcgactgattttgaagttccaccaccactcaggcacactatttacaccttcaacccatcacccatggaaccaacaggtgtgccagaaatacccatttctggcaaatatgtacactaaaaccttcctatatatacacgaaggcgtggtgtggatcgtggagagatatcaccagcaaggcttccaaatcatcaggcttgtatgagtacttctaagaattcaaccattttcattctcctacttcatgaagcagatatctggagatttacctaccacctattcgttgaactgcacgctaggtagaagaacttacaacctgggcagcagccacccaaaggtccatccaaggagcaaccctgcgccgacgatgccaacgccaactgcaaacatgatggccttgcagaagccaccttccttgttctgcctcctgcttttcttctttgccctgccttttcgctcctcttctggctccgccttctcctcctt

SEQ ID NO: 3659 - DNA, 388 bp, Hordeum vulgare
aaaagaaaaacgtgtgcgctgttctcaaaaaagaaaaaaaaaacaatttgtgcgcaggaagcaaaagctgagtatccatgccaacacagctccggcttctccggcgaggctaccaagccgccgccgccgccgccgcggcggcgtccaaggcagggccgaagaggaaggttcttgaggggaccccggcggcgctcggcttccggatgccggccgagtgggagccgcacgaccaatgctggattgggtggccggatgctcaaggattctggagagatgcggctgcccccgctcaaaaagcctttacaaacgttgtagatgcaatctcaaggtttgagccagtcactgtatgctgtaacgctggccagtacgcgagggtagcccatttgat

SEQ ID NO: 3660 - DNA, 403 bp, Hordeum vulgare
tttttttttttttttttaataaaataaagaagcaacgaaatttatttcgatggctaaaaatgaaatacaaataataataaaacaatttactccgatttatatagcgggtcggctaggtccagccaaaacttagaggggtaaaagtacttcactaagggtttactccacaggatcctcctttatttttaggtttttaggggatcggttagagttgccctgagaccacgagacacttcaggcatgaactgtctatcagcaacagtaccaccgtatatgctggtatttcccacttcccttttctttttcctgtccatcatcgtgccagcttctcgccccttccctcagccctgaccctacatggtgtctgcatcagagggatgagggcaaacggcaggttgctgct

SEQ ID NO: 3661 - DNA, 484 bp, Hordeum vulgare
agaacatctgctctaggttctgcaccgcctccccatatagcagaagatatgctggaagcagttcgtgcactggatgctcaaatcctccatttcttgcaacccaatcggacctttccttgggagatgtgtaccttcgcaatgcccgcgcttcagatagaggccaacattatttgtcaaaccttgacaggtttaaccttcatggaatggacaatgtgcccagaaatttgtctctgggaggcttccctggagcttcttcctcacaggggagaactgggagcaggcgtaggaagacaaccaagcttcaaaattcatactatgacaacaggtcacactggtgccaagaactaccacggatgatgccgtctcagccccttcccaccaaccaacaaccaatcaacagccttcctcagtggcttaccaagggtgccgagaccggtaaaagctggctcaacccagagatgtggtcgagcgtgtcacaggcgcc

SEQ ID NO: 3662 - DNA, 551 bp, Hordeum vulgare
ggcaaatgctgcaaaacattccctgctactcaaactagtgttccaccaacttcagcatcaaagacaacaagtttgttaactgacacaacggaaggggctaacatgcgcaagatcatgacacttggcacacggaactcagctatctgacaccgtctcttcagacgacgcaccggtgtcgctcggccctgctgccatagcagcggccctctggttcagatccaaggtgtcaccgctggtccggaaaagcttcttgcctagactgcgccactccgctttcctcttcagcgcgagcttcaaagacgcgtcgggcatggcatgtggtttcttgttgtcggggaaaagaaaggcggcagctctcaggctgtcattcagtggatctgcagcagaatggcctggcgcctgtgacacgctcgaccacatctctgggttgagccagcttttaccggtctcggcacccttggtaagccactgaggaaggctgttgattggttgttggttggtgggaaggggctgagacggcatcatccgtggtagttcttggcaccagtgtg

SEQ ID NO: 3663 - DNA, 527 bp, Hordeum vulgare
ggcacgaggcgaagcagaaacttatggtcaggctgcttcaaaccttgttgcgggaggcaccctagaggcaacaattcagtcaattcttgaaatgggcggtggaacatgggacagagatattgtgcttcgtgccctacgtgctgcattcaacaacccggagcgggctgttgagtatttatattctggtattccggagccgatggagattcctgcaccaacaccaagtgcccagccagctgatcctgcccaggcttcactagcaactcaacctgcagttgcctcctctggtcctaatgctagtcccttggacctcttccctcaagcccttccaaatgcttccacaaatgctgctggtgagggaaatctggatgttttgcgtaacaatgcgcagttccgaagcttactttctttagtgcaggctaaccctcagatcttacagccactgcttcaagagctgggaaagcaaaaccctcagattttgcagttgattcaggacaaccaggctgagttccttcgtttaatcaatg

SEQ ID NO: 3664 - DNA, 559 bp, Hordeum vulgare
  UNSURE (21),(22): n stands for any base
tgcaggaaccttttatacganntgtcgttaagtctgtaaattaacatttcaagacaatctagagtatgtactaatagcaaggcagaaaagaattacagactaaggaagtgacaaaatctcaaaaagatctctaaggcctgccctgtgagtgcgggagtatcaatctccccacaatccttgctcccatgggcttgtgcatgtaattcagaaacaacttgcttgccttactgcggcgctccgtcgtcaaactcgttcatgtggtctaacaggtagtttgcggctagggtctcatccttgttgcaggcaaagtaaacctccagaacaagcgcccggtcaaagcccattccctcaagacgaagtatagcttcattctcctcaggagtaacagctatggtctgaggcactccctcagcaaactgctctaggagattctcgtcttcatcgccctcagctggctcattgattaaacgaaggaactcagcctggttgtcctgaatcaactgcaaaatctgagggttttgctttcccagctcttgaagcagtggctgtaagatctgag

SEQ ID NO: 3665 - DNA, 408 bp, Hordeum vulgare
acggacctgaaaagctttgccttcacaagaaggagctcactttaagtattcatttgatgatgaagcattttgtgcagataatacaaagttttcagtgacttgttattttgcaaggcagtttgcttcacttagaaagaagtgctgtccaagtgatgttgattacatacgctcactcagtcgctgtaaaagatggagtgctgatggtggaaaaagcaatgtttactttgcaaagacaatggatgagagattcataattaaacaagtcaccaagacggagctagactcttttgttgggtttgctccccactacttcaggcacttgactcaatcattgacttctggaagcccaacttgtctggccaaaatattaggaatttatcaggttaatatcaagggcttgaaaggagg

SEQ ID NO: 3666 - DNA, 362 bp, Hordeum vulgare
  UNSURE (26): n stands for any base
agagttaaaacctgtgacaaactgangctgttacatgttaaaacctgtcatctttgtcctacaactgtcggtatagaagccgggttacatcgaaaggagccggcgcatctcggcgttaaaaactccgccatcgatcaccaatttacatggagcaagccatatgaatatcctacagataagtaagctgccacaatgatgtgatctgctaaaaaaaagaacacaaacaaccaaagaatggctatccgtatcgattcaccgcgtccttggtcaaaaaattaccatggaggaatgaacgatgcggtttctgctgacaggtgacagatgaaggaacgatcttcaagaggaccattggtcggggacgg

SEQ ID NO: 3667 - DNA, 695 bp, Hordeum vulgare
  UNSURE (1),(15),(347)..(349),(380),(426),(431),(433),(623): n stands for any base
ntgtcagagactggncctagttttccccgggatctgtcagggcacattcggaacgagggctctttgccgcgatggacgagactcctacggaagcgaggcttagcgggatcaggcaggccgtgctactgcttgagaggtcccatccttcggcatcgctacctactctggcccgggtctgagtccaaagagagctggccgaaacgggaatttgaccagcaaaagggggggtttcccaaaaaattttgggaacggcaaaaatcggggtatttttaaaaggcccccggaaagatttgtgggggcgaaattttttcccccccatatttcttttttaaaaaaaaaataaaaannngtgggggggggggaaagggaaaacaacgccntttattttttttaaaaaaaaagaggggggggggtggcggcgagcangcggngnggggggggggaagaaaaaaacagggggggggtgttttccccccccctttttaaaagaggagaggaaaactttttttttttttttaaaaaaaaaaaaaaaaaagagggggggcggggtggaatttttttttgtggtggggaggaaaataaaaaagggggggggttttttctttccgggggggggggggggnataataataatattattttttttggggggggggggcggtgccccccccccgcagacgccgggttgttttttt

SEQ ID NO: 3668 - DNA, 552 bp, Hordeum vulgare
ttgacagtgcgactgatgtattattgggtttttaccatgtaaaggtatggcaatcgccaaacaatctatgtaccagactatcgatcaacctatcaagtatgcaaatgacatatccctgtgactgagttacaacaatatgaagtccaatgtaacagtagatttgaggggagaatgggggcccgcagtccaacaatcaagaggaagcagctgtaaatggttcactagcctccagaagcttgttaagcaagccggtgaacacaatagaatcggtctcattgggcttgaatttaaggagagcagaaggtactaggccttcatcttgcaacgtgcgtgcccgctctcctgtatttggagaatgcggtaacacacgtgacctaggaacagctggacagataagatcaaattccaagcctggctgcttcaaagcggacgcaacaaactcatatagtgaactagtagcctccgctggaaggaatacgccctggagaattactccatcaggaaactgaactcggatgacagcttgtttgtacttctgtcgagcagccagtg

SEQ ID NO: 3669 - DNA, 517 bp, Hordeum vulgare
gggagaccaagcacgtagccggcgccaggtggagaacaacaagttctgcgtctccgtccacttcagatgcgtcgacgaaaaggtaggcgacggaacggaacacaacggaaatgggtgctgccaccgcgaatggcagccgctttccttcccgtttatagctcctttatcaccaccacctgtatttttttgtttacttaaccaccactagtgctataaaactaaacttcccttttgtccctagtggattagtggggaggttagttaggtttaatcacttaactagtgactgatcagcatcatgatgaattgatgatgtgctttaattcagagctggggcgcgctggcggagacggtgaagggggtgatgcgggagtacccgaagctgcgcatgtcgcaggggcggatggtgttcgaggtgcggcccaccatcaagtgggacaagggcaaggccctcgagttcctgctcgagtcgctgggcttcgccgactgcagcaacgtgctgcccgtctacatcggc

SEQ ID NO: 3670 - DNA, 555 bp, Hordeum vulgare
atttacttcagggtttctggtttcttttattcctgggttcctccccttgtacgtggacgtaccagggtaatttacatgcatgcatagtcgttactcggtaggtatacatccccagaaaaagaagggcgtggttagaacacagcatgtggcgccacaatgccccacaggctcgccgtggtacggttccttcttctcatccacgtagcctttggctttcatacgatgacgatgagcaggggattcatcaactaactaagctacgcgtagtgaattaattagcccggccggccgatcctcgtggtcgtccgatcaggcgtgggcctgtcgccgcagcctgaggcgcgccctggagagctgcttccactcgacgaggcggaggaggaactccatgacctcggcgggctcctgcagcgagaaggatgcgctggtgtccttggggtgcttggagacgaggatcccgacgccctggcccctccgccgcagcaccttgaaggcgtcctcgtcggtgcggtcgtcgccgatgtagacgggcagcacgttgctgcagtcggcgaa

SEQ ID NO: 3671 - DNA, 514 bp, Hordeum vulgare
ctcgtccagacccattacaggtggctgtgcagcaacttgaacaagctatttgtaatttccacgcgaaagaaacccaggcagattatctgacaatgtttcaactaccagcactgaggactgcttcaccagtggagaaacaagcaggtttagtattttctagggaagtgtttgatatatttcaggaacaatttgctgagtcctttgggtatcatgcagagaggctcgaggataggatgctacacaagtaccgcctgacagtagatgatggtgacgaggaggcacatatcgtctctttcagtccagatcaaagtacagtgtgctgtagttgttgcttattcgagagctgtggaatcttgtgcaggcatgctcttcgagttttcatcatcgaaggagtgcgttttctcccaaaggcctatgtcttgaaacgctggacaaagcatgcaaaaagtactgtcaccttggataactacattgaactaaggggatactgtgaggatccttcaacttcaaggta

SEQ ID NO: 3672 - DNA, 552 bp, Hordeum vulgare
aattggtccagcctaccagtgccattataaaaatttcccaagagggcatgtgttcctacattctttttgaacggtaatgtctgaaacgattcattagcacccttgctgttactagatgcactgaaaggaaaaagaccgtagccagtcacagcgtaagactaccagattgaatgatactacaactatacaaggtcagaaaaggtgaaatcgcattatgttcaaattcacaatatctggtcatctactgccattgctctccacgagggaattttttaatgctggcctctttatgctcttgccagaggtaccattagctgccccaaatttcttgactggactttgtaatgatgtacaattttgtgaaatttgctctctaatatttcttataggcattatttcatcaagagccttgcacagtgcctccttagcaattttatagcgctcggtggatgttgagccctcttttgcacatttgattgcatcatagcaaagatcattgtaccttgaagttgaaggatcctcacagtatccccttagttcaatgtagttatc

SEQ ID NO: 3673 - DNA, 541 bp, Hordeum vulgare
gccccggctgagattcgacgaggccgcctgacaagtgggcgtggcccttccaatcttatgtcgaatactgatctttctgacaaatctagcagaccagtccctttggcaaatacttctagagggctttcaccgaggaagatttctgcttctgaagatgcgggtaaaaggttgaatcaatcactggatgacgtggcaaggagactggctattcatgcaaaaagaaaaggtgaacagttagattctgtcagtgatgtttattcacagacaacggaaagatctaaatatgtgagccgtccaagcaggacaaccactttgcctgttcctgttcttcatcgctcatcatcaccaaacaaggtcttgtcagccgcatcctctgcttctagggcttttcagagtccatcgaggacaagaccttcaacaccttgcaggtcacaaagtgctggaagtattcaatcaggtgttatagctcctgttgttagctacatgcttgatccaagaaagggaaagaaaaatgccagccaaattgagaatatccatcaac

SEQ ID NO: 3674 - DNA, 562 bp, Hordeum vulgare
  UNSURE (9),(13),(37): n stands for any base
gtacccttncttncccttcgaatttaactttgtatanttctcttttcagatgtcaaaaaaattaccagcggaaaagaatggggcactcactaccctcgaaaagaaactaaaaggaggagggaaagaggctagaagtgcactatacggtaaaagccatttacacacgaggagacctacaatctatcatatctaagaactgtgagttgttatctgcacagcatcacaccttgatcggcaggggatgtttaatactcttccgttttgttatttcctctctacggattcctcgtctgtttgcacagtatgttcttatagtcacaggctcaacttgcacaggtgtacctattcaagaagattgtggtgtatatcgtatagctttgcccaggttgttaattcatctggacttgcataagatgtgtccgcaggctagactcctgtacctccagttctgcggccatagctaagagttctctgcattcgtcaagcatgaccttttcttgtgctgctacgactgaaagctccgagaccaaatatgtcctgtcttcaaccttagaaagcatag

SEQ ID NO: 3675 - DNA, 503 bp, Hordeum vulgare
aattctgtacgaggcctcgtgccgaattcggcacgaggggctgatggggtcgctgcactcgctcgtcgccgacggcagcccggcgacttgcaagaaggcgcggtcgctgatcagcatgatccaccggcattacgagctgaccaggccgtcatcaccgccggtgccgctgccggtgccaacaccggacgccggtgaccgttacgttcggctcgtgctatagcgccgtttgcgaccaggcgtctccttctcctagctagtcttatgtaagtacatcgtacagcgtgatggatacatgaccatttttgctctcggtcccattctcagctcgagttttagaagagctgagattgaattttgtttcatttcccctattccttgtgttatacgctccctattgctatacacgtgcatacaaagattagagttgcagtttgtaacacctttgttgtacatatttgtgtgaaactggtttgtgtgtcttttttttcgaaaaaaaaaaaaaa

SEQ ID NO: 3676 - DNA, 470 bp, Hordeum vulgare
gaaaaaagaccacaaacacgtttacacaaatatgtacaacaaaggtgttacaaactgcaactctaatctttgtatgcacgtgtatagcaatagggagcgtataacacaaggaataggggaaatgaaacaaaattcaatctcagctcttctaaaactcgagctgagaatgggaccgagagcaaaaatggtcatgtatccatcacgctgtacgatgtacttacataagactagctaggagaaggagacgcctggtcgcaaacggcgctatagcacgagccgaacgtaacggtcaccggcgtccggtgttggcaccggcagcggcaccggcggtgatgacggcctggtcagctcgtaatgccggtggatcatgctgatcagcgaccgcgccttcttgcaagtcgccgggctgccgtcggcgacgagcgagtgcagcgaccccatcagcccctcgtgccgaattcggcacgagg

SEQ ID NO: 3677 - DNA, 542 bp, Hordeum vulgare
ggctgcagggaattcggcacgaggttaagaggtaggctgacttgggtggagcaaagagttgctgtcagagctttggggcatttggctacataccctagtacattccctgctgttgctgatcatggagaagtgcttgaacttgcaattcaacttgcctcaagctctctagaaattgtgtactctcacttttaccaattcgtagatcggagacttggctaccactgtgatcttcttacacgtggtatgggtggtgctgaaatggaatctcgtaaagccgaggaatgggctagccaactgcagtgctggtctttgcagctcataaactgctttgcatttaagcctgagtttctccatgatatctgcaagcctgaatttctagctaagttacctggtatgtggggtggacttgtgaatgagaactcacctgctggtgttggtttactaagaacaatctgccagagcaagcttggccgaggtcatgttgctaatatttctggtgtcatcgaggctttatgcaacattgctcgttcttcagatgactg

SEQ ID NO: 3678 - DNA, 551 bp, Hordeum vulgare
  UNSURE (35): n stands for any base
aatcgatgatgtttaagatagaaaaaggtactgtntctgttcaatttacaacaccaatcaagagcaagacaacattcccaagagtctgtcatagcgactcacatagacaaaagaacacggcgagggcaacggctaaactttagccttgctccccatgcagataatatcacaatatgatgacactagacatacttttgaaagctacatttttatgagctttcagtagcagactcatctagtttccacaacttaattttgctttggtaggccagcagctgcttctgttgttgttgctgcttccgacgacaagcacaatgagagcaagcttaccagataacgattaataacaccaaaacctgtttctcagcttttctggtacgcatcttccctgtgaccaccactcttccattcagtttcatcatctgcttctctcctttcatcatcctcaccatcgctttcactcactgtctcccactctgagtcatcagcctcttgagcaaatgcatcactagcatctccctcacaatggattccaccatgttttagggatg

SEQ ID NO: 3679 - DNA, 519 bp, Hordeum vulgare
gtccggatccgcgacctgagttgtaagtgctccctgcttcgagatcttctcttatgtttcgttgtttttgtcaatctatgcgcgacgagggcctcattttcgtgctgggttcgttcttcgttgggggaattggccgctctggacggcgccgtaggccttccgtcttccaacgggcatgctagccccacaattctgaagctggactgggggagcaggggactgctgccgctggagagcttgatggtcaagatgctccagcagaatttaggatcgaccatgctgaggctgaagatgattctgctccacctgcggtggaatctgtgcttaatgccaaggatggagaaagtgaaacaagtgctgccactgaggttgttgatcctgaagaacagcaggatggagataatgctccagcagagtccagtggttcagatgagcccccccccagacatgctgagtctgtttccgttgtcttgaagtttgagggcagcgtcgagcagagcaaaggagaagaagttgttg

SEQ ID NO: 3680 - DNA, 510 bp, Hordeum vulgare
taaattgtacagtgtccatattttattttcgagaggtaatttggaccttgctcgcaaagtttcatattgagaaatccttttcatttagttcatcaacaattgtttttatggaggaacagccaagcccgtttgcgacaacttcctcttctgaaggtcctttagaagtcgcttcacaatcgcttccatccaatacttcaggctcagtagtcagtgcttctatttgcagccctttgctcccatcagcatcgatctcaggagcagatgtgcaagaatcagcaatctggtcaacatggtcatgcccgttgctcccatcctgctccaccagctctgtgattgcagcatggtcatggttgccctcgtcagcgttaatcacgggatcagcagtagtcacacttgtgtcagcatcatgctgtccagtcacccccgaaatagctgatccatctgtacctggcttcatgatctcagcaacaacttcttctcctttgctctgctcgacgctgccctcaaact

SEQ ID NO: 3681 - DNA, 463 bp, Hordeum vulgare
ctcctccgaatcccaggccggcggcgacctcctcttcctccgccccttcccccggcgaccctaacctccccggctaatatggattcagagccctcatcgcagaacccaacagacatgacagcatttgtgcaaaacctcctcggtcagatgcaaacaaggtttgagtctatgtcccagaacatcgtgtcaaagatagatgaaatgggaaccaagatcgacgagctggagcagagcgtcaacgatctcaaagctgagatgggcaccaccgacgtacctgtcaagaagcccgacgaggcaaagcctgccgaatccgcgtaactcagatgtaggcatatgagatttggttgtaaagacttggtggctatctgacagaagtttcggcattcatgtgtatctgatgatgttttcccatggaccatagctcttgtactaccgagtgtgctacctaaaaaaaaaaaaaaaa

SEQ ID NO: 3682 - DNA, 441 bp, Hordeum vulgare
ggtgccactcggtagtacagagcttggtcctgggaaaactcatcagatacacatgaatgccgaaacttctgtcagatagccaccaagtctttacaaccaaatctcatatgcctacatctgagttacgcggattcggcaggctttgcctcgtcgggcttcttgacaggtacgtcggtggtgcccatctcagctttgagatcgttgacgctctgctccagctcgtcgatcttggttcccatttcatctatctttgacacgatgttctgggacatagactcaaaccttgtttgcatctgaccgaggaggttttgcacaaatgctgtcatgtctgttgggttctgcgatgagggctctgaatccatattagccggggaggttagggtcgccgggggaaggggcggaggaagaggaggtcgccgccggcctgtggattcggaggag

SEQ ID NO: 3683 - DNA, 899 bp, Hordeum vulgare
  UNSURE (504),(509),(532),(535),(537),(543),(550),(552),(556),(558),(559),(562)..(899): n stands for any base
gtcccccgggctgcaggcaattcggcacgaggcaaagttccatttctctggtcacgaggaacgccaatcagtatgtccctccagtggtggcaccagttcaagtcaacaccaccgaagagcccctacggcacgggcagagacctcttctgccagagatagaaatgccgctggcaacacctccaacactgccagcgtgtctctccagaagctcatggtgtgctttgtgcagctgacggccaagttcccgctcgtgataatgtttcttctcatagttctctatgccgtccctgccagcgccgcggttctgctcctgtatgtccttgtcacgtttttgtttgcgctgccgtcgtttctgatcctctactttgcttatcccaccttggactggctcgtgagagagatattcacttgagccgtgctgttctgaaatgtaagtacagtttatgtagctttgtgaaagtgaaacaaagcttggatatctgttccaaaaaaaaaaaaaaaaanctcgngggggggcccggtccccaattcnccntntagggngtcgatnanaaantnnaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3684 - DNA, 544 bp, Hordeum vulgare
atgtagtctcaaagtataccaaacgtaccaatttgatacaaacttacaactcttttagataaaagggagactagacgcagtatcccagttttccactagcagcagaaactgatagtagtttatttccacgcagttacaactcttttaagtagataacttggaccctgtttagcacatatttcttgtccagctagagataccagctaagaacccattagtggaaagtactttatccatttcctgaaaaaccaacataaaccttcttgatgtgactaatcttgctctggtgtacctcccattcttcttccgactgaatcttctcaagaaaatcatcaaccgtgctctccaggtgcaatgcttcgagcttccggaggaactcaacaccttgaggcatctccttcagtgatggacaacctgttacggtaagacggaccaggttcgccatagagccttcttctatctcaatctgtctgagttgtgatgcaccgtgtatcacaagcgactgaagttttggaaatgatcctgcggagaagaacatctcctc

SEQ ID NO: 3685 - DNA, 183 bp, Hordeum vulgare
  UNSURE (8): n stands for any base
accaccgnagcagaggttcgtgagatgcagcagctagacttcagcgaggcaccatgggacgaggcagccggcttcgccctcaccaagtacccgtcctatgagatcgactgggactcgctcctcgccaccaattagcacccagttcatcttcgtcagctactactaccagtaccgtcttttagc

SEQ ID NO: 3686 - DNA, 551 bp, Hordeum vulgare
  UNSURE (34): n stands for any base
aaataatattccacattacacgattttttgatgnagctgattttacatgacaaggtctcccactgttacaatctgcagagcagcggaaggaacagcacctagctagaacaatggacagacttcaccggccggagtcactgaccagtgaccgaccaccggagacgccgggcacaaaaacgccggcttatagtcatccgggagggactaaccaaaccctaccacaaagagaacgaatcataggtctacacaatgaacaaggattagagacttagagctaatccgctaaaggccggcgcagaatgtctaaaatgccatctgcatcgcggcgacccattaacctagcatcatgacacgctaaaagacggtactggtagtagtagctgacgaagatgaactgggtgctaattggtggcgaggagcgagtcccagtcgatctcataggacgggtacttggtgagggcgaagccggctgcctcgtcccatggtgcctcgctgaagtcgagctgctgcatctcaggaacctctgctgcggtggtggtgggtgatggtga

SEQ ID NO: 3687 - DNA, 518 bp, Hordeum vulgare
caggagtgggtcgcgtcgcatcgcatcgcacccgcgcggtgggatggagcggggtggcaccgccgcgctcgcctgcacctttcgctcctcctcctcctcctctccggtctcccactgctcgcctctcctccgctctcgtggacgcccgcccgcgcccgccggggctcctcacctcctactgccaaccggccggcgcttcagtcaaaataggtttttagaaacaagcaaggggcttaagcggtactcgttgacgacattcagcccatttgggcgtccaactagtctgaacgatgctgatttagtaaaagataagatgctaattgattgtggagaagagcaagactgtgtgcttgatgggatagtcgccttgggaaaatttgatgcccttcacattggccaccgggaactagccatgcatgcttctaaatcaggaaatccttttcttctttcttttgtgggaatggctgaagtactaggctgggagtataggcctcccatagttgctcattgtgatcgga

SEQ ID NO: 3688 - DNA, 541 bp, Hordeum vulgare
agtaagttcctgggtagatcaagtcttttgtggcaacaaaaatcctgcttaatcgtgaagcaatgtagtactaacaaacaagatatcatcctcgttgtaagatgcaacaaagtatgcttgtgaactatagcaacaaagaaggggctagctctggaaacacctttgaaaatgtacagactacaatgtaccaggactaagacatgctggaagattgagtctcttctttggtctcaatacatacagctgctagaagacagtcacagctctttatttgccggtccacaggaaagaaggccgccgccttcgtgtccccgcttctcttgctgtgtgcactaatgtctaacattctccaggacaatccttccatcaaaccatgaactggacttcggattgatgaaccttgaccaggctgaaaaccaggctgaatacacacctccgatcatttctgtgatatatcttccatctagggaaacaaaaaatctcccgcctaaggtttcgactcaaaattgtccaaaaggttaccaggtatacaaactacgac

SEQ ID NO: 3689 - DNA, 543 bp, Hordeum vulgare
  UNSURE (3): n stands for any base
ggnctgcaggaaattttgcacgaggtggtactctgttcgacaatgctgcagtcatgcagtctaggaaagaattttattcggtgctcgatgttttgcgaatattccaacagatttgtgaaggactgaagcacatgcatagtcttgatccaccatatgcccataatgatgtcaagcctggcaatgttcttgtaacccgccaaaaaggacaagcgcctcttgcaactttgatggattttggaagttcgcgacctgcaagaaatcaaattcgttctcgttctgaagcattacggttgcaggaatgggctgccgagcattgttctgcaccttttcgcgcacctgaattgtgggactgcccaagtcatgctgatatcgatgagaggacagacatttggtcgctaggttgcactctttatgcgatcatgtatggtgtttctcccttcgagtatgctcttggtgaatctggaggaagcttgcagctcgccattatgaatgcgcagttgaagtggccacagctaccaagccctccctaccctgatgcacttc

SEQ ID NO: 3690 - DNA, 526 bp, Hordeum vulgare
ttttcgtatgcagcgaacattttgtacaagataagcaagtaatatagtaacatccaagagttaggcaaccacatgttgtaacagcctaaaagttacataaagaatcgacactgtgcctattccaaaggatgaaaaggcctagagcatgggtcttacaccatgttccctttgcaatcgtataaagaagaaacaagtcagaacagaatatgcaagctggctttaaggcgagtatttctccacaagcttgtcaacgtggagaagtatgtcattgatgtgaggacgcattgcgggttgtggctgaagcatccaggtaacaaacttgtgaagtgcatcagggtagggagggcttggtagctgtggccacttcaactgcgcattcataatggcgagctgcaagcttcctccagattcaccaagagcatactcgaagggagaaacaccatacatgatcgcataaagagtgcaacctagcgaccaaatgtctgtcctctcatcgatatcagcatgacttgggcagtcccacaat

SEQ ID NO: 3691 - DNA, 519 bp, Hordeum vulgare
  UNSURE (7),(19): n stands for any base
ccggggnaagcacctcggngtcgtcggcctcgggggtctcggccacatggccgtcaagttcggcaaggcgttcgggatgaccgtcaccgtgatcagctcgtcgccgaggaagcgcgaggaggcgctcgagcgcctcggcgccgacgcgttcttggtcagccaggacgccgagcaaatgaaggctgcggcggggacgatggacggcatcatcgacacggtgtcggcggggcacccgctcgtgccactgctggagctgatgaagccgatggggcagatggtggtggtcggcgcgccgagcgagcccctggcgctgccagcctacgccatcatcggaggcggcaagcgcttggccgggaacggcgtgggcagcgtgcgcgactgccaggcgatgctggacttcgcggggaagcacggcatcaccgcggacgtcgaggtcgtcaagatggactacgtcaacacggcggtcgagcggctggagaagaacgacgtgaggtaccgcttcgtcatcgacgtcgccgg

SEQ ID NO: 3692 - DNA, 472 bp, Hordeum vulgare
tagatgcaactagctccaatctaacccttatgtttaggatactttagggctagttgaacccaaactagctcaaactaactctagctcatagatccaaacagggccattctagagtggaacatggccagaacacacaacatgcgaagcaattatttcaccagaaaattctggaaatacacacacaccgacccatggaaataacaagaccacgtatcacgaccccacgtggccggtgaccgctgcgtgtctacgtctcggagcactaagcggcggcgcccagctggctgccggcgacgtcgatgacgaagcggtacctcacgtcgttcttctccagccgctcgaccgccgtgttgacgtagtccatcttgacgacctcgacgtccgcggtgatgccgtgcttccccgcgaagtccagcatcgcctggcagtcgcgcacgctgcccacgccgttcccggccaagcgcttgccgcc

SEQ ID NO: 3693 - DNA, 518 bp, Hordeum vulgare
tgtttttctcctctgtgaagagaagcccaacctgataactatcaaatgtaatatcttccacttggaattcaggcagaggtaagcctactgcgacatttatgttactaaaaacacataattgaacgcattgacactaatacgccctccgtccgaaaatacttgtcctagagatgaatgtatctagacttattttagttatagatacattcattatgtttatttttaagacaagtatttccggacggagggagtatgattttttgggtctatgtgccatatgccacctgcaggatctatccacaccatggcacaaagctggtacaaccttgagatctttctctatctttccttttctccttccgagaaacgtagtcttgagatcttttcagatagtggacacatgcaaatagttacatatacaagtccaagttctagcaaagttgaaacaccagtttgtggtttttgtgccaaaaccaaaggtgtcatcacaaacagataataataacaatatatattag

SEQ ID NO: 3694 - DNA, 311 bp, Hordeum vulgare
tgtgatactaatttaggaataagagctgaaacattatgccactgtgtatattcaactggaaaactcctaatttcttttagcaataatgtgtacaaaaatacttgcccggtaaatagaaaagaaacttaaggaagacataagcctgacggacttaaggggatgagagaacaaaaaatttatacagcgtcactgataagaacatcagactagtctacttcccaattgcacactggttgccaatgaacgttcaatatctggtcaaaattcatcatggtttgtcgcttgctatgtccgtgtttgttccatgtttt

SEQ ID NO: 3695 - DNA, 248 bp, Hordeum vulgare
  UNSURE (3): n stands for any base
ggnctgcagggaattcggcacgaggggcgtagatacataggagagcgagcgcgcgagctatatatatactgtatgtgtgagccatagtatagtacgatgcctgttcatgctctctgcgtgcatggaaccagagcttagttgatcgatctagctgctttacatgctctgttccagtcgacttttcttcttccgttgtaaatatacgaaaatttagttcgtgcatctactcaaaaaaaaaaaaaaaaaaa

SEQ ID NO: 3696 - DNA, 193 bp, Hordeum vulgare
acgaactaaattttcgtatatttaaacggaagaagaaaagtcgactggaacagagcatgtaaagcagctagatcgatcaactaagctctggttccatgcacgcagagagcatgaacaggcatcgtactatactatggctcacacatacagtatatatatagctcgcgcgctcgctctcctatgtatctacgcc

SEQ ID NO: 3697 - DNA, 516 bp, Hordeum vulgare
tgaaaacctacaccgagacaacggacgggtcagtcatcgaggacaaggagacagcaatcgtctggtgctacaaggacgccgaccctgattttggatcttgccaagccaaggagctccatgaacacctggagagtgtcctttccaacgagccggtatcggtcaaagctgacgtgaaccatgttgaggtgaagccacagggcgtgagcaagggcctggtggcgaagcggatgctgtcggcgatgcaggcgcgagggctcctgcccgacttcatcctgtgcatcggggacgaccgctccgacgaggacatgttcgaggtgatcaccaccgccgtggacggcccctacctgaaccctgaggcaaaggtcttcgcctgcaccgtcggccgcaagcccagcaaggccaagtactacctggacgacaccgcggacatcgtgcggctgatccaggccctcgccaacgtctccgacgaggtgcagggcggccctccttcctatttcttcgcctgcgccggcacca

SEQ ID NO: 3698 - DNA, 560 bp, Hordeum vulgare
  UNSURE (19),(42): n stands for any base
ggcaattaaaccacagttnacacgggagtctattgtacacanatcggcgaaacaacaacaccaccacgacaacgacgaccgaccactactactactaatactaaagcacagcacacgattatgcgagccgacggcacggtccattagtcctagggtatttcctgaagcgcggtcttattcaggccggggctgtgctggtgctggtcttctttgccggctttccccctcaattcagcgccctgtcgtcggtgctggtgccggcgcaggcgaagaaataggaaggagggccgccctgcacctcgtcggagacgttggcgagggcctggatcagccgcacgatgtccgcggtgtcgtccaggtagtacttggccttgctgggcttgcggccgacggtgcaggcgaagacctttgcctcagggttcaggtaggggccgtccacggcggtggtgatcacctcgaacatgtcctcgtcggagcggtcgtccccgatgcacaggatgaagtcgggcaggagccctcgcgcctgcatcgccgacagcatccgcttcgccaccaggccc

SEQ ID NO: 3699 - DNA, 552 bp, Hordeum vulgare
gtctccccgggcctgcaggcaattcggcacgaggctacaaggtgtgccggtatctctttgtccgttgtgacaatgaaccagctccttggaccagtgatcttcatggtgaccggccaagacccctgcccaagattaaggagctgcaaggtgcaactgacatacatgaaaggaaaggatccccctcgtgggactatgatgcaaaggaaggctggaagtgggtgaagcctgcaccgatcagcaagaagcctgcccagtcaggcgatcctgaggctgacaagcaattcaggaaacaccggaagcgtgctcatatgtctatgaatgataggctgttgaaggagtttgggtgttccatttgcaagaatgtgatgacagaaccagtcagtactccgtgcggtcataacttctgcaaaacctgtttgttggatcaatacaacgagagggaatctacgagggaaagaagcaggaacggccgcactctgcgtgcccagcagattgtaaagaagtgcccgtcctgcccaactgacatctgtgacttcctgaagatcccacata

SEQ ID NO: 3700 - DNA, 490 bp, Hordeum vulgare
gtacccccgggcctgcagggaattcggcacgaggcggagccggagtcgctgcggtggttcgcgcaggcggagctgatgcacgggcggtgggcgatgctggcggtggccggcatcctgatccctgagatcctacagaaatggggcttcatggaggagttctcctggtacacggccggcgagcgcgagtacttcgcggacccgtggacgctcttcgtgacccagatggcgctcatggggtgggtggagggccggcggtggatggactacctcaacccgggctccgtcgacatcgagccgcggttccccaaccgcaagaaccccaccccggacgtggggtacccgggcgggctgtggttcgactggggcaactggggccgcggctcgccggagcccgtcatggtgctccgcaccaaggagatcaagaacggccgcctcgccatgctcgccttcgtcggcttctggttccaggccgtctacaccggccagggcc

SEQ ID NO: 3701 - DNA, 546 bp, Hordeum vulgare
gtcccccggctgcagggccgcccggcgcccgcccgacgccccttcgccggcctggtcgtctgcgtcactgggctgtccaaaaaggcgaggagtcaggtgaaggaggccgccgagaggctgggaggcgactacagcggcagcctgcaccccaaatgcactcacctcgtggtgcagagcttcgccggccgcaagtttgagcacgctctcaagcatggtcccaggaatggtctttttgttgtcacgctgggctggtttgtcgattgtgttcgaaggaacatgaggctggatgaatccttgtacagtatcaagaacattggggagaacggcctgcctcttggggaatacaaccggcttgttggacttcctgttaatgagaagtcatgccttccaccaatgatttttcaagacaaagcatgctcgggcacaacacataagcaccagcttcagcctcatagagaagaacctgaacatgatgtgttcgtttttacgaatgacacaatctacattgaccctgggatatctggtgacatgaagaagaagatatcg

SEQ ID NO: 3702 - DNA, 392 bp, Hordeum vulgare
aactctactaaacggcaccgagtacgggtgccgttcatgccctaatcacaagctcatatacattgctatagttctctctgctaaggcgctttagtgcctcgaagcttctccggcttcccaaaaaatctactcttttgaatgctattacaaagcctgatcctgcgcattcagtacttttgtacagggaacgaagtcgatcggcatgccgtgaatgcgtgtgcagggctacgctcctctcgtctgttgacatgttctcctggtagaaattgtagatgtgatccaacactaaaaagagtgtgaagccgccattgctgaagaatgtccttgaagaaggtccaagctcgccaaaacgatccagagggaagagtatggtaaagaaatggttcttaaaa

SEQ ID NO: 3703 - DNA, 72 bp, Hordeum vulgare
gccccggctgagaattcgacgggcaaccggagggcctccctaccgcggataaccgcttctcggacatgagct

SEQ ID NO: 3704 - DNA, 719 bp, Hordeum vulgare
aatgggccttttatttgtcccggaaataaatgtcgtagacatacatgagaaaccctaataaattgctggatcacctacatatatagccatacaaccatacagaggaagagtacacgcacggggctcactgcaaccgtagtccttgtggtttgtattcacagcaaagtttcagttcctgtataccccaatcttcaggttcttgttcgggctgaaaacaccttattcatgtctggcgaatcgagactgtactcgccgatttggcgcttcttcatgccgccacgacagggtaggaggcgcaggtagcaatagcgcacatgttcttgcccatttccatcttgaagtaaccattgtcaccccagtcggcgccccacgagttcttgatgagccaatacgggacgccgttctccacaccatagccgactgccaagacggcgtggttcacgtcatcaggggtagtgccacaatggtcgctggtgtaaactccgctcttgtactgcctgaaaccgtcaatcacctgaaaggccacactcactgggcgaaccaacccaacggcgttcttcagttcatcctcggcattcagtgtgatgtttactgagtccaaaacctgaaccgcagcattttcagccttgtaatggcagacaccattgacacccttgtaagggtaggactccttcggtgtcgatcccgccattgtatttgatgtactcaaacgcctggga

SEQ ID NO: 3705 - DNA, 540 bp, Hordeum vulgare
ggtctgcagaaattcggtacgaggcgtctgctcctcctggtggctgctgctcttcctcttcacgccatgccggcctccttcccgcagtacgtcacggaggccatcaccggcccgctaccggacccgcccggggtcaagctgcagaaggaggggctgcaggccaagcaccccgtcatcttcgtgccggggatcgtcacgggaggcctcgagctctgggagggccaccactgcgccgaggggctcttccggaagcgcctctggggcggcacattcggcgacgtgtacaagaggcctttatgctgggttgaacatatgtcattggacaatgaaactggattagataaaccaggaataagagttaggccggtcacaggccttgtcgcagctgactattttgtccctggctattttgtttgggcagtcctgattgccaatttagctcggattggatatgaagaaaagaacatgtacatggctgcttatgattggaggttatcattccagaacaccgagacccgtgatcaaacattgagcagaata

SEQ ID NO: 3706 - DNA, 550 bp, Hordeum vulgare
gtagcaatgaattgcacaatatttatatcaaacaaaggaacctacaaaagtatcacagcttgcatctatacattttaatatacaccgcggtttcacaataacgccagtgccagagcaaaaaccattacattatcaaatcaaaataataggattcgaccagagtaaaatttgcttcatcgccacaaatcacatgatttcctactaactacaatttcagctttatcttctcggaccatttgaatatatcagaatacacctgatcaccaccaatttcctcaccggttgccccagcagcaatcctgataatatcctccattaaagcaaagttccccataatatcaacatgggcaccactctgtgtgcccctgccttcgaggagattcgagggtggagaatgattatactctctcacgtaagtcttgctgccagcagggttgaagcgagtttttccacgccatgctttggcacacatataccctgaactaagaactggaacagtctcgtcaccattcgacatgtaaacaccacctttcaagcagctattctcatc

SEQ ID NO: 3707 - DNA, 423 bp, Hordeum vulgare
cccgcccgcctacccaacccagtaaaatactgccacctatccgccggcgaaacgaaatggcccacgcccgcgtcctcctcctggcgctcgccgtcctggccacggccgccgtcgccgtcgcctcctcctcctccttcgccgactccaacccgatccggcccgtcaccgaccgcgccgcctcgacgctcgagtccgctgtcctcggcgcgctcggccgcacccgccacgccctccgcttcgcgcgcttcgccgtcaggtacggcaagagctacgagagcgcggcggaggtgcggaggcggttccggatcttctccgagagcctcgaggaggtgcgctccaccaaccggaagggcctcccctaccgcctcggcatcaaccgcttctcggacatgagctgggaggagttccaggcgacccgtctcg

SEQ ID NO: 3708 - DNA, 383 bp, Hordeum vulgare
ttttttttttttttttgaactatgaatgggccattttatttgtcccggaaataaaatgtcgtagacatacatgagaaaccctaataaattgctggatcacctacatatatagccatacaaccatacagaggaagagtacacgcacggggctcactgcaaccgtagtccttgtggtttgtattcacagcaaagtttcagttcctgtataccccaatcttcaggttcttgttcgggctgaaaacaccttattcatgtctggcgaatcgagactgtactcgccgatttggcgcttcttcatgccgccacgacagggtaggaggcgcaggtagcaatagcgcacatgttcttgcccatttccatcttgaagtaaccattgtcacccc

SEQ ID NO: 3709 - DNA, 555 bp, Hordeum vulgare
  UNSURE (20),(41),(55): n stands for any base
gtacccccgggcctgcaggnaattcggcacgaggggtacanatcctccccccggngccccaagccttggccgatcatcggcaacctcaacctcatcggcacgctcccgcaccgctccatccacgcgctctccaagcagcacggcccgctcatgcaactccagttcggctccttcccggtcgtcgtcggctcctccgtcgagatggccaagttcttcctcaagacccacgacgtggtgttcaccgaccgacccaagaccgccgccgggaggtacaccacctacaactacagcgacatcacctggtccccctacggcgcctactggcgccaggcccgcaagatgtgcctcaccgagctcttcagcgccaagcggctcgagtcgtatgagtacatccgcagggaggaggtgcacggtctactcggcgacctgtatcgcggcggcgccggtgccggccgcgtggtggtgctcaaggactacctgtccacggtgagcctgaacgtgatcacgcgcatggtgatgggcaagaagtacctggagaaggaggtgagggacgag

SEQ ID NO: 3710 - DNA, 485 bp, Hordeum vulgare
acatacattttttccacccttccttacacatccctatcatttagtctacgaccatagacgatacaatattagaaaaagattatagaaaaaaaatataacaacacaagtaataataattacacaacacctgagtgcacacatatattgaatattcaagcctcggcatatagatgagccggtagcttcggctccacgacggcctccagcgggaacttacgtggtgtggacaagccgaatatctcctccatgttcagctctacaccgtcagggagcctccaagtgaacccgtgcagcaggtttgccaagcttacctggatcacctttagtccgagactatacccgggacacatcctgcgacccgacccgaatggaagcagctcatagttttgccctttgacgtcgagtctgctgtcgaggaaccgctctggcatgaattcctccggcgcctcccacaactttgggtcgcggccaatagaccacaccat

SEQ ID NO: 3711 - DNA, 518 bp, Hordeum vulgare
ccctagcgctctctcccttcgcctctccacccggcggcggcggtcgaacgagggcacccggcggcggcagagcgacgaataggtgctttccaagcctagacagaggactcaacccgtttcccgggcggctttgtgttggatcggaggaggatgagcaagatggggccgatcagggttcccaagaccatgcgcgccaagcgcgagctcctcaagcacgcgcccaagctcgttgagaatggcaagaagatgcttattctccatggtacaaagaccagcgcagttttgaactctgtgctggcagatttttttcacctgaagcgtgatcatgctgtcaagttcaccaagaagaacgacagcatcaggccatttgagagcgggggtgaaacttccctggagttcttctcccttaaatctgactgcagccttttagtgtatggttctcattcaaagaagaggcccaacaatcttgttttgggaaggacttacgatcaccacatatatgaccttgttgaagtagg

SEQ ID NO: 3712 - DNA, 537 bp, Hordeum vulgare
acagtcatctttggtcggctaatatcaggggctaataacaacagtataaaacaaaatacttgtaacatatgaatgctccaatgttccatgcttatgtctgatagagaagctgcctcgatactgatgccgaagtccgtacacaggtttgatatgatagcctaaaagatggtaccggactatttaccactcaatctaacaacccaaagtcgttaactgaccagttacatatactagccttctccagtggtcactcagggttttcacccaccttttgcttcttcgagtgctccttgtttttcttggcatcacggcgctcccgcttcagaccctttatgttgcttgttacggtcaattttgaaacctcctggtctggaatgtagattctgccccgcttgccttcaattggatgatccgtgacatttttcaccttcttagcatgaccaggagccttcatagcttctttctgcagactatcagctgcttgtcggtgccgcctaagtaccagatccattgaaggaccaacttcaaccagctcca

SEQ ID NO: 3713 - DNA, 519 bp, Hordeum vulgare
ctaaagtcctgacatgatgaaagttttggacacacgaaatacttaagtctgacctccatcatattactgagattgtgatctgatactttgtgcgttttgcagctgcaaggatgagggtggctgcaaacgagaaggcagaggctgagaagattgtccagatcaagcgtgctgagggcgaagcagaagccaagtacctgtccggcctaggtatcgcccgccagcgccaggccattgtggatggcctgagggacagcgtcctgggcttcgcagtcaatgtgcctggcaccactgcaaaggacgtgatggacatggtgctgatcacccaatacttcgatactatgaaagagatcggcgcgtcctccaagtcctcggcggtgttcatcccccatggccctggcgcagtgcgcgacatcgccacacagatccgcgacggtcttcttcagggccagtctgcctctgacaactagcagtttgcttcagggccagtctgcctctgacaactagcagtttgctttgccg

SEQ ID NO: 3714 - DNA, 542 bp, Hordeum vulgare
atgcaccacattttataacacgcttatatcacactgcattccacagggttaatgggttttgttaccgcacatcaacctaaggcatggcatgccacgatccacatatggttccatataagttcttaataataaggcatgcatcatattagacagtactgtaggcaatagctagcaaaccacaaaccaccgccagcttttaaagttcatgccggcaaagcaaactgctagttgtcagaggcagactggccctgaagcaaactgctagttgtcagaggcagactggccctgaagaagaccgtcgcggatctgtgtggcgatgtcgcgcactgcgccagggccatgggggatgaacaccgccgaggacttggaggacgcgccgatctctttcatagtatcgaagtattgggtgatcagcaccatgtccatcacgtcctttgcagtggtgccaggcacattgactgcgaagcccaggacgctgtccctcaggccatccacaatggcctggcgctggcgggcgatacctaggccggacaggtacttgg

SEQ ID NO: 3715 - DNA, 517 bp, Hordeum vulgare
cggaggcaggctagcgagcgaaggaaggagcgaggaagctagctgcggtggtttgttgtgcatggaaggggcggggagcggctgcaagatgggaggaggagaggggatgtccggccgtgccggtgctggtgccgccgcggcggccaaggagaagtccggcttcgccaccacctgcagcctcctgagccgctacatgaaggagaagaagggcggcgctctgcagggcctcgttggcctcgacatggcgccgccggccgccgtcgtcgtaggaggaggagctttccagccgcccaccaccatgaacctgttgtcggggctggaggagccgaacacagcgggcgtggagctcgcactcgagaaatctagtgttcgacagcttctcaaggccccaactgacaaccaagatgcgagagaggatgcgcaccagctcaccatcttctatggaggaaaagtggtcgtggttgacaacttcccatccaccaaggtcaacggattgctccagatggccaacggcgcc

SEQ ID NO: 3716 - DNA, 551 bp, Hordeum vulgare
  UNSURE (24): n stands for any base
gcaggtaaagtgtgcagcatgaantagtgacaattacaactttcagtgacatgttgaggaaggcaaaccatctgtaatatgttgcaaactcgcaataaaatgaccatgacagtagtcctagtagacctatagcctgccaaactgccgtgagcataacagctccagcagcaaacaatggtgcgaacagacggcatatgcttaaatacgtagtatctactatagtaattgttactagaaatgaataaccaacacccgattattgtcgcttcaaagctacgagtaaactaccaatactagtagtaacatccacgctccccgtagatcaattgccctatagatttggagccaagtcaagtgttcatcatgtctctttcttgcactgtcaatttgtcacttcctggcctagccccagccaggcgttgtcaccattagcttgcttggacggagccgccgatgagctgctaatttggtaaggcgccttcgccactatcctgcccttccttttctcgagaaacctgtggagtgagttcctcctcgctataggcagatca

SEQ ID NO: 3717 - DNA, 519 bp, Hordeum vulgare
ttttccaaatctccgtattaaactaacaatctgaaacccctagccccaagagcaagaaacctctgctcctcccagccagtggcttagcatcagattccctctctcagcctcagggcacagccaaaacagcagtgacagcacagggcggctgcgaagccagtcccactttttctcgatttattgctagttttctcgcttcccctttggtgcttgttcttgtttagttagttaaccgcccgtacccaccgccaatccccaggccgccgcctgctcttgccaaaccccaaccacccgcagcagtcagcaggacccgctttctcctgcctatctttgtctcttcggccttgggattgattgctaacggttcttgaaaattcttcctggaagcaagctctgttttagttttctcattcttctgctgccgtcttgccaagttcgtggggttggataacgttgcttgctcttgctctcgaaggggaggaactttccttcaggaagggattgagcagagttttgggt

SEQ ID NO: 3718 - DNA, 518 bp, Hordeum vulgare
ttcgttcatcgggtcggggatgggcgggggctgctgctgggttgggctcgcgtccaattccccaccacagccagcacaagtacgcctcttttttattgttccaggagtgggatttgcctttgcgctgtgagaggagctatttccgcgattctcattagggctccctccgtcctccgtcttcgtcttcgtcttctcccccacgctttactctttcgctatcctccctttgcgcgccccgaatccaatcctccccccacctccgccgctccccgtccggatccggtttcgcccgtcccgccggcccccgattcggccgccaaaatccgcgtccaggggttccatgaagtgacgccctgccgaggtgaatttccgcgtcttcctcgcagtttttgcctgcggccatgtcgcaaatccagagcttgtcaaggagctgcgtgctgctcgcggtgctctgcggcaagcacgccgataagcagcagcgcaccccgccggggaggtcggggccggaggcgaagcgg

SEQ ID NO: 3719 - DNA, 353 bp, Hordeum vulgare
ccgctcgcgcctccatcctccgcgcccccttccttccactcgcgccgccgccgctcgtccccgcgtcggagcctgctgtttaggaaagtcgcgctcagagtgcaaccatgtgtggcgtggcgtgcggtgcggcgcagggaggcccggcgacgatggcggaggaccgcagctggatgtacacgggccgccagagcaggggatcgatcaccgccgagtgggtcgagaaggcgaccgagttcgtagagcgggccttccgaggtgtccctccggagcgcgaggccttcgccgtgcggtgcccctgcgcgcggtgccgcaacatccggtcgaggtccaagtacgacatgcaggtgcat

SEQ ID NO: 3720 - DNA, 295 bp, Hordeum vulgare
tttttttttttttttttttttttgcagagattaaatcgatctagaagaagattaactagccgattaattcacccacacagctagtgcttacatcggccttagccgcccatttcttatccgccaagtacatcagcagctaaagcaggctatttaaagtaggtagccgttacatttcttttgagaactaggtagccgttacacgggtcaatgaacccagtctgtgcccgccttgcgcttgggacgagcagtcggtccagctggtatttgaactccatgcgcgctggctgtcgttgcc

SEQ ID NO: 3721 - DNA, 521 bp, Hordeum vulgare
  UNSURE (4),(5): n stands for any base
gcgnntgttcggaagaatcaatacagagggatccgccagcgtccctgggggaaatgggcagctgaaatccgtgaccctagcaagggtgtccgggtttggctcgggacatacgacactgctgaggaggcagccagggcatatgacgctgaggcccgcaagatccgtggcaagaaagccaaggtcaattttcctgaggatgctccgactgttcagaagtccaccctgaagccaactgctgctaaatcagcaaagctagctccacctcagaaggcctgcgaggatcagcctttcaatcatctgagcagaggagataatgatttgttcgcgatgtttgccttcagtgacaagaaggttcctgcaaagccagctgacagtgtggattcccttcttccagtgaaacaccttggccccaccgaggcattcgggatgaacatgctctctgaccagagcagcaattcatttggctccactgactttgggtgggacgacgaggccatgaccccggactacacgtccgtctt

SEQ ID NO: 3722 - DNA, 512 bp, Hordeum vulgare
atatatacgagtacctaacaagcacattacatcaggcatatgacccaaggtgtttattaaactccagcctccaacatgcacccaatcattatatagagacgacatacaacaacagaatataaacatgaccatacggttcccactgctagcagcatacagtctttagcataactatggtttcatccgctacagaacgtagcagaagccaccgatccttctttcatcttggccacatgcaccaccaattcttcatcttgcccacatgcaagggacatttgtgctgtccgcagaccacattgacaagaaccatcaataaccaccagctgccatgaacagctcatcgaggctccagagatccccactgcttgccccatcctcatggtcaaaagcagggatgtcttgtgcaccatttccctgaggcagcacggctacgccaaagttgttcctcattctctttggagctccgccttgcaggtacgcgggctcgccgtacgccggcatggcagcagcac

SEQ ID NO: 3723 - DNA, 888 bp, Hordeum vulgare
  UNSURE (11),(16),(18),(20),(29),(30),(32),(42),(43),(80),(690),(732),(744),(821),(836),(846): n stands for any base
gtcccccgggnctgcngnantcggcacgnngncacctgttanncatagttcagcacctgcttctacagcagcgcataggnaaatcaacttcagggccatctcatgctcaatcgatcattcagctgaatcctcttccaatgaagaaacatgggtgtgatcggttgcctatccaagtgtgctctgaggaggactttttgaaggatgtgatgcaatttttaattcagaggggccaccatcgactcgttcctcatggaggtctagctgaatttcctgatgcagtccttaatgcaaaacgccttgatctctataacttgtacaaagaggtggtgtccaggggtggcttttatgtgggcaatggtataaactggaagggccaagtcttttcaaagatgcgaaaccataccgtaacaaatagaatgaccggtgtcgggaacacactgaaaagacactacgagacctacttgctggaatatgagctatcgcacgacgatgtggatggggagtgctgtttgctttgtcacagtagcgctcctggagattgggtgaactgtggtttatgcggcgaatgggctcatttcggctgtgatagacggcaagggctgggcactttcaaggattacgcgaagacagatgggttggaatacatctgcccccattgtagtatagcgaattacaagaagaagcctcctncgccccagaaagtaaccaacgggtttgcgaataccgtgctgnctttatcacggnatggttaatcctctttctttttcttccttttctggtcttcgcctctccgccctaggattcggggagatgagcccggnggttagggtataggncctgataganaccgggaaggcttttggtaggggtgatctggattatcatccc

SEQ ID NO: 3724 - DNA, 516 bp, Hordeum vulgare
tcaacaggtgcttacactgaatctggccaactactgcagtaagtagcctccctgtgttgtcggttgttacatgctatcaaagacttaagctcctacactgaaccaaattaatgggatgataatacagatcaacactacaaaagccttccccgtctctatcaggcctataccctaaccaccggctcatctccccgaatcctagggcggagaggcgaagaacagaaaaggaagaaaagaaagaggattaaacattccgtgataaaggcagcacggtattcgcaaacccgttggttactttctggggcggaggaggcttcttcttgtaattcgctatactacaatgggggcagatgtattccaacccatctgtcttcgcgtaatccttgaaagtgcccagcccttgccgtctatcacagccgaaatgagcccattcgccgcataaaccacagttcacccaatctccaggagcgctactgtgacaaagcaaacagcactccccatccacatcgtcgtgcg

SEQ ID NO: 3725 - DNA, 439 bp, Hordeum vulgare
  UNSURE (12): n stands for any base
gggactgcaggnaattcggcacgaggcaagcggaggcctatgagcaaaacattccgcaggcttcttgaaatgagtgagaggcagacttttgttggacctccagaaacggtgagggatcatgtaatggctgccacgagggccctcaataagggtgaccatgaaaaggctttcagtgtcatcagttctctggatacctggaaacttttgaggaacaaggagcatatccttgagatgctgaagcttaaaatcaaggaagaggctcttagaacctatctcttctcttactcgtcttgctatgagtccctgagccttgatcagctcactactatgtttgacctcagcgaggcacacgctcacagtgttgttagcaagatgatgatgcacgacgagcttcatgcaagctgggaccagccaacaaagtgcattgtattccagaacg

SEQ ID NO: 3726 - DNA, 549 bp, Hordeum vulgare
gttggcaaacaacttgcagaaacaggaaagtggaaaatagtaacttgatgtcaaatacaggagtgaatatgtagtcctcgctcccatgatacaagccagacaactattactcaagacttctgggtaagatttatgacagataacagaagctacaaaaatatagcaaacgatgacaagttctgaacggtgcggaaacaatgcttcaagacaaccttgctcggaatttatcgcagatctatcagacttctaatttctaccgggcctgtttaggttcaccatgcgtccattgccatcccctctagacgaggaaccagactggttgcgagaccttccatcctggaaccgagaaccaccaccatagccgccacgggaaccctggccacccctgtcattttggtacccaccgccctgcccagagcctcctctgccagcatagccagacctcccaccgccgcggcgaccgccttgtgacgatacaaagttctcctgccactttcccatattggacgagtcttgatcacccctgcgcctgggtggtgcaccctcaag

SEQ ID NO: 3727 - DNA, 539 bp, Hordeum vulgare
gtcccccggctgcaggattcggcacgaggcacagcacaagttagtgacacagcaacctggggagggagagaggagagaacacagagagagatgagaaggaaggccaccttcacggtgggaaaggccaagggggtggtggcatcgctgatgcacaggaggcccttccagcacatggtgctgaggaggctgagggagctcaagaagatagtcccggacgcccgggacgccgatgtcgacgtgctgctccggcagaccgccgagtacatctgcatcctcgagctcaaggtggccgccctgcggaggctctccgccatctacggcgcgtgatgggatgccgcgcctccgtctcggtccggcccaccgcagcgcccatggttagaggttttgagccccagagtggatgcaattgtgcattagttgggtaggaggaacatttcttgcctgctcatctcgtgtaccccccacaccccctccagtagtactacgttttgtgagctgtggctcctgtgtgcggtcacacatgggagtttgtttggcag

SEQ ID NO: 3728 - DNA, 522 bp, Hordeum vulgare
agccttgccttgtagtaacaatggccggcttctgctgccaaacaaactcccatgtgtgaccgcacacaggagccacagctcacaaaacgtagtactactggagggggtgtggggggtacacgagatgagcaggcaagaaatgttcctcctacccaactaatgcacaattgcatccactctggggctcaaaacctctaaccatgggcgctgcggtgggccggaccgagacggaggcgcggcatcccatcacgcgccgtagatggcggagagcctccgcagggcggccaccttgagctcgaggatgcagatgtactcggcggtctgccggagcagcacgtcgacatcggcgtcccgggcgtccgggactatcttcttgagctccctcagcctcctcagcaccatgtgctggaagggcctcctgtgcatcagcgatgccaccacccccttggcctttcccaccgtgaaggtggccttccttctcatctctctctgtgtatctctccctctctccctccccaggtt

SEQ ID NO: 3729 - DNA, 513 bp, Hordeum vulgare
ggcggctggggacgacagactggaacaggataagggctgcctccaggacgccaaggtctgcaagtccctcgaggacaggaaggagacgctcgaccagttcatggcctccgatctctcccccattcagtccggctgctgcaagcctccgatcagctgcggcttcacctaccaaaacagcacgcagtggaccgggccggccaagtcgacggagcccgactgcagcgcgtggtccaacgacggggccttctgctacggctgccagtcgtgcaaggccggcgtggtggccaccctcaagcgcaactggaagcgctccgccatcatcaacattgtcttcctcgtcttcatcgtcatcgtctactccgtcggctgctgcgccttcaggaacaaccgcagggatcaccgcaacggcggcgggtacaagcagcagggtgcttacgcttgatcgcttcttggctcggttacttatcgctttgatggatgcgatcgtcgtgctcgtgtgtctctaggatggcc

SEQ ID NO: 3730 - DNA, 564 bp, Hordeum vulgare
  UNSURE (44): n stands for any base
tatatattgggaataaattaactccagaacaaatctgttacttntataatgggtctgccatagtatcaaagaactgaaaatatatgcacaaccctcctcctgacacagaataaacctaactagaggtgatagagcacagaatatataatctcgcctgtacaaagctagatcaggccatcctagagacacacgagcacgacgatcgcatccatcaaagcgataagtaaccgagccaagaagcgatcaagcgtaagcaccctgctgcttgtacccgccgccgttgcggtgatccctgcggttgttcctgaaggcgcagcagccgacggagtagacgatgacgatgaagacgaggaagacaatgttgatgatggcggagcgcttccagttgcgcttgagggtggccaccacgccggccttgcacgactggcagccgtagcagaaggccccgtcgttggaccacgcgctgcagtcgggctccgtcgacttggccggcccggtccactgcgtgctgttttggtaggtgaagccgcagctgatcggaggcttgcagcagccggactgaat

SEQ ID NO: 3731 - DNA, 10 bp, Hordeum vulgare
  UNSURE (1)..(10): n stands for any base
nnnnnnnnnn

SEQ ID NO: 3732 - DNA, 603 bp, Hordeum vulgare
  UNSURE (12)..(20),(147)..(151),(173)..(184),(246)..(252),(279)..(284),(386)..(390),(414)..(420): n stands for any base
acttttattgannnnnnnnncagatgattgttacgttgcctggatgtatttagaagacacgcatagttgaaacaagctggagcagccactgagagtaaagctcatcatacagcgatattatacaaaagaatcgcctactcacttggnnnnnggttcttacatcagtcaagaannnnnnnnnnnngcctggcctattcagttggatccagtctgctggtttcttcataacctagccgaatgcagtgnnnnnnntcccatggccagacagaaaaaacactnnnnnntgcactactaccatggttctccccaagaaatggataccctgaactattatgagccattgaacaaactcgctggcacctttgcattatgtggcatgatctttnnnnngtgaggtggatgaagccatgattnnnnnnnatatgacaagaagttctcgagcttgctggtgtagatatctgcatattgatgaatgtgataggcaaatgatgattcctttcctgtgtctgtaaggaatgttgcaccaaaagaactattaaacagatctcgcatgccagatcgacattggcgcctttctgcattcaactcatcaagcaatgttct

SEQ ID NO: 3733 - DNA, 948 bp, Hordeum vulgare
tcttccccgggctgcagggagtttcggacgagggggacagatgaatatacgcgcacgcagatatggatgtgcgggctcgacagagcggctactatgagcggtgtgcaccgaccatcgtcactggcggcgggggtggacacatggtcactggccctctccgcaccgggcggatcatgcattgcagactgacttgccagctcggagcgtgatgcctgggaactcgttcagttcatcggcgtccttgatcaatgaagaaagctctgaagggctgatgctgctccacacacgaggactcaaagacaggagataatacattgcatgcggaccactttacaatgttcacaaagaagtgagctggagtatacccgagaggccccagtatagtgacatgcaccgtagggcggactgtccagaaacggtaccatggatgaagatgtgggcaccagagattcttacggcccgagggatgacattgaagcccagagaaccgcagccatatgctgcattgccggtcgacggtgacacagcgctgtgtgcgtgtgtagacgatgacggtatattgagagatgagcttgttgatgaacaccctgtccagagagctagtcatgtgtcacccccacaatgccgggggaatcacccaatggcgggagactcccgcccagaatgcgtccaggagaaggacttcgggggcggtactctgtcatgtcctatgaagacccggaccacagtcaattgaaaaagtgggagaccatgctcctttgcacctgggagccaacaggtttgtccgcagtttttttttaaaattttagtcttagaagggaggggacccccctggaatgcgctatgatctctattgcaacctgggcgacctgggcggtaggcatattcattggaacaggaggggagagtatcctgcgcgcgccgcctcttgtgatagcatattttttt

SEQ ID NO: 3734 - DNA, 551 bp, Hordeum vulgare
ttcaaattctctaattcgtcattacaaaatgtgacaagacatatttcttttttggggggtttacatatgaaaacgcgagaaagtaatgtaccaaataaggcttgcaaacaaggcacctacaggttccacaactggcattgtactttaaccacagctacaggtaaataagtaacgtgcgttcaggtgatcagtttacttagatttgactgaaacagagtggcaagagctgtctgcacaagtgcagacgcgaaagcacaccattcttcaattgaatatagaccggccttcataagattcggaaatgacaccccatgagtcctcttccatgccactttcttggcgtaattgtcaagttcattggtgatccctgacgaatgatgagtagagatacttgattatcctcattggaaagggcttcagaaacaagcctttcttgcaatctgcccccagcctctacactcccaaacttcactatctcatccccaagcagcaagccatccaaagcagcaggagaaccatctgcaatgtcatcaatcatggcaaaaggaagt

SEQ ID NO: 3735 - DNA, 511 bp, Hordeum vulgare
cgctctcatccgcgtctccgccgtgctgaccacgcgcccttcatgctcaacctggattgtgaccattacatcaacaacagcaaggccatccgggagtccatgtgcttcctcatggaccctcaggtcggacgcaaggtctgctacgtgcagttcccccagaggttcgacggcatcgacgcgcacgaccgatacgccaacaggaacactgtcttcttcgacattaacatgaaggggcttgacggtatccaagggccagtgtatgtcggaactggatgcgtgttccggcgacaggcgctctacggatacaaccctcctagcggccccaagaggccgaagatggtgacctgcgactgctgcccgtgcttcggccgcaagaagcgaaagggcggcaaggatgggctgccggagggcgtggccgatggaggaatggacggcgacaaggagcagatgatgtcccaaatgaacttcgagaagcggttcgggcagtccgcggcgttcgtcacgtcgacgt

SEQ ID NO: 3736 - DNA, 512 bp, Hordeum vulgare
aacatgaacaaaacgtcaacaatacaaaacttgcgtcaaactgttcttctccctatgcacagtcttgagaacccttaacgcgatcagcagttgatgccgcactgcttcacgtcaggccccttggccttgacggtgaaggggtcgatcctgacccagagcagggagaagatggaggccagcagcacggaccagatgatgacgatggtgggcgtcctgttctgcctccccatgagacccttgaggaacgggtagagatgcacgatcacccagaaggcgaagaagagcttcccgaatagcggcccccacgactggtacccgttgttgatggcgtcggagatgcccgccaccacgccgatgatgttgatcaccagcagcgtcgtcggagggatgaggagggtggtccacttgaaggcgtagagctccgcgaactcgtcgtcctcgtcccccgtggccttggaggtgacggtgaagttggtgtcgatcccggccaggaccttgagcaggccctggat

SEQ ID NO: 3737 - DNA, 518 bp, Hordeum vulgare
cttagaacctcttgtcaatgcaacaatacctctctattgtgcttcagttttgtatcgacttggtaagtaacagcatacgcatatatttggtgatctaaacgctcttatatttctttaaggagggagtactaatgtagtttcattcaatacatttcacatggaggtaagaatgcttcatatattttgaatatggtttgatgagaaacaaaagaacaaacctgaatggttatgccttacaccagaactgtacctaaatatgatcgatgcactcaaaattatcagaagttcctttgaatctttagagcattagcagtgaaagcaattttagaacacaggcagctactccaaatctagtgaacatagtaagtttacagagtaaatcatcacaggttccaagcaataacaaaagcgtggtgtgtttgcataggctcatgtactcaacttactgctagttatgttatttgatgcagcagggagaattgtgaagaatcagaacaactcgtggagaaaggaagaga

SEQ ID NO: 3738 - DNA, 541 bp, Hordeum vulgare
ttagacaccttagcaaatacggagtatattacagcttctgagcggaacgctggcaaagttattggttgcacgaggcaccagcggtccaggcctgtacaatctggcaaacttaattaatgaagccggctcaagcactagtctgaaagagtcagacctgcattgagacaatgttcgctgctggcgacatgtgaaacggttccactaggttagtactctagctgcgaagaagagaggttactgcgtcagtttggtgtggcttctggcctcttaagctcgtctctcagcctcaggacctcacggcacgtctctctaagttttctcttcagcatggccgttgcttcctgatacttcccatccatcagcgccctttcttctaccgcctctttaagccttccacggtttgcgtcgagctctggttgcaaccaccggatttgcatgcggagctttgtcctctctttgttgtaggtggaggcatcattttgcatcttgacctccatggtagatatctgacagctcaactcgtccatattagctttggcct

SEQ ID NO: 3739 - DNA, 518 bp, Hordeum vulgare
agcggaccgattgcaccctcttgccgaacctcagcttcgacacacaccattctaaacaaggcagctccggcgatcttgtttcaccagtgaagaagtttaagccatgcccggaccgcttcacggactatacaccttgccaagatcaaaacagagctatgaaatttcctcgggagaacatgaattacagagagcggcattgcccatctcagaaagaaaagctgcactgcctggtaccaccgcctaagggatatgttgctccgttcccatggcccaaaagtcgggactatgttccttttgcgaattgtccctataagagcttgacggtcgaaaaagccatacagaactgggtgcagtatgagggcaacgtcttcagattccctggtggagggacacagttccctcaaggtgccgataagtacattgatcaactggcatcagttataccgattgccaatggaactgtgaggactgcattggacactggttgcggggtggctagctggggagcttacttgcta

SEQ ID NO: 3740 - DNA, 538 bp, Hordeum vulgare
tcagaagttgcagcatgagcaagattacagaaactaataaagcaataatatttcttgacaatacatctttcaattaacagagagacactagttcatgctgagtgatgaatggaattaaattacaaaactgttacaacaatatactgctgccgatcaacagcaaggaagaaaccttggttgcttcattgctaccccggagaagtgtaggccattctgttcgcacctgaggactccgtatctcaattcctggacgccagcttcaaaggtgcatcccagaattccccgtgttagaatatgttcttgttcacgatgcggccgtctggtttccaccaacccaatactgcttcacagcgtacaagaccttctcacgcactaggggaccatcctcgtggtcaactaggttcgtgttccatctcatgccccgggcgagtttgttcacctttgtcaagacatcgacatcgtcacgcattataacagcgccttcaggcctcaagatgcggtccatctcaaggaggatgtcttccatgctgcacttatt

SEQ ID NO: 3741 - DNA, 518 bp, Hordeum vulgare
gatgagcgcgtcgagggagttcttccgtcaaccgtctgaggagaagcagaaatgcagcaacctggtggacggcaacggcaagcactaccaggtggaagggtatggaagtgacaaggtggagtccgaggatcaggtcctcaattggaacgaccggttgcatctgagagttgagcccgaagatgagaggaatttcgctaagtggcccagtcacccagaatctttcagggatgtgctgaatgagtacgcatcaaaaaccaagaaaataagagaccttgtcttgcgatcgatagccaagctcctggagattgacgaggattacttcgtcaaccagatatcaaacaaggcttccgggtttgctagattgtactactaccctccgtgtccgagacctgacctagttttgggcctcacgcctcactctgatggcaacctccttaccatcctttttgtcgacgacgatgttggtggcttgcaagttcagagagatgggaaatggtacaatgttccagccaagcctc

SEQ ID NO: 3742 - DNA, 545 bp, Hordeum vulgare
gacaactgaattaaaccaacctaagttgcttatgataatgatagataaaacccccactcagagacgataggaccatctctttattctacataggtaatcaatgttaacacgtactataacttacatcttcagggtgtcgatgaatctcttcccttgaaggaaatgttcaaagagtccgactacgaaatccttggccatcattttcctatatcttggtggtcgcttctcatccagcaaaccgggcgctggctccagcaccgtttcttcatccacggcatagaacacggccagcgaaagcctctccttctcagtgttcgtcaccactctgtgaaccgggctcctaaagattccattgttcattatctccaggcagtctgctaagttgatcaccagcgtgtgaggcttggctggaacattgtaccatttcccatctctctgaacttgcaagccaccaacatcgtcgtcgacaaaaaggatggtaaggaggttgccatcagagtgaggcgtgaggcccaaaactaggtcaggtctcggacacggagggt

SEQ ID NO: 3743 - DNA, 552 bp, Hordeum vulgare
  UNSURE (20): n stands for any base
gtacccccgggcctgcaggnaattcggcacgaggctattgttgattggcctggtctgggttattcagacaggccatcactgaactataatgctgatgtgatggagaattttctggttcagctattgaactcaccaaatagtcctgtggcggatgcagatggtgaactggtagttgttggaggtggtcatgcagcaaccatagctatccgtgcagctgggaaaggccttatcagaccatctgcggttgctgctgttgcacctacttgggctggaccccttcccattgtatttggccgaggttctgatatggaaacaaggtacgggcttctacgaggaaccctcagggccccagccatcggctggatgatgtacaatgttctggtgagcaacgaaaagtccatccagtctcagtacaagtcccatgtgtatgccaaccctgagaatgtgacaccggaaatcgtcgaaagccgctacgaattgaccaaaagaaaaggcgcgcgatatgttcctgctgcgtttctgacgggccttctcgaccctgtccagtcaagg

SEQ ID NO: 3744 - DNA, 378 bp, Hordeum vulgare
  UNSURE (29): n stands for any base
gcttacctggtgaactgcaattattgatnacggccgtatgcattttttttttacacaaattgaagctgtatgtatggacgtcagctccgtcagaagcaggctccggtatgtgtggcacccaggaactgatggcggtgctttgctctttctaaaagctcaggtgcaacaacatggcatgtcgatggatttaccggcaaaaggcgatatgagttgaactcggtcaggatcaccccagtgtagtttcctcaagcatgcggttcatcatcatgacgagaatgatccctgcaggaagtcgtagagctcctctgcaactgccaaggggtattcttcctgcggcagaagcgcgcccgggacctccacgaatttggtcacgccttt

SEQ ID NO: 3745 - DNA, 250 bp, Hordeum vulgare
  UNSURE (2): n stands for any base
gnacgcggtacacgaagtccccaaagcgtcatccggcctctcacggtgcggcggcggcggcgccggaggtgagaaagatgccgagggccgtcaggatccgcggcgacgagctggagaagacggagcgggaagcgaagaggcgaaacctgacagagaaggagaaggaggaggaggaggagtcgacagctctccaccccacgagccctagatctcccggcgaggtagctattcggacttcccatccaaagat

SEQ ID NO: 3746 - DNA, 557 bp, Hordeum vulgare
gatgattaaccccggttacattattcaatccacggctgctacacttgcatagggatatgatgtgagtttacaagactcaaaataagtactccatccatcccaaattaagtgactcaactttgtactaactttagtacaaagttagtagccattagcaatttagcatacaggttctgctctgctcgaaaatacatattatgtgctctaagctaagctgcttctacggtccaaaggcacccacaatttaaagtttttgtctgggaacacacgcacacacaaaaagattatccgaagttgaatttgcaattggcattaaagggttatttccattgactcatccatgaaggccagcaacgggcaagtacctctctcaggcccaagctcaagaatcataagagactgacattgcttctttacccatgaaagggtaagtgcatttcacaatgtcctctccaagatccgatacaattacagtcaagtttctagttctccggcgatgtttgatagcatcaaatattttcactgaaacatctttttcttcatataaacattttcct

SEQ ID NO: 3747 - DNA, 510 bp, Hordeum vulgare
ctcggagaaagacttcccggcgggggtgcatgacgccgccagcctgcggagctacaaggccaaggtgctcaaggccatggaatccctggaggaggcggacatgctgcagctgtctttccaggactcgtcggcaaccacggtgtcgccgggctcagtcgcccaggcctcgccggacagcgtcaagtaccccgaggacatgtggtcacggaccccttcgccagaagccgagtacgaagaggaggacgagacgggaacaccccgagaagccgaggaggccgaggcgaagatcgtcgatggggaggggagcagcagcatcgacatgagcgacgacgacaagcgctcctcgagcagcaagaagaagatgatcgtggcaccggtgtacgacacggaatttgccggtggtaacagcttggagcactccgagaaggaaattatcaccataaacgatcattcatacgaagccatctctgatgccaagagcagtccagaggtaactactgacagagagtt

SEQ ID NO: 3748 - DNA, 550 bp, Hordeum vulgare
gcgtcagtagtacatttccgatggatggatgggttcattacaagtgtgccgtttcctagctagctagctaggctaggggctgcaagtaagtaagtagaattatataccatggatggctctgtggcctatgccatgttcatcaggttacagttataggtacccgacctgtgtaagctgtgtagagaaccggatcactaagaaactgatgaagaagaagaagaaaaatacctacaagccgtggattacatggtgaagatttgcttttcggggggacaaaagagcggaacaaaaaatcagacatgatttatgttttgtgctccaagcaggggaagagcaaaaacgaagcctccctgtggatcctcctgttgtctaccagcatgatcttgtccagcttcgccttgcaccactgcagctggtcgccggtgatcctcggcatcctcagcacccgcgccaccagccgcatgtccacctgcgagaagaagaggttctggtccgacctgtcctccttgggcttcttgaacttcttcacgatgcagttccctgtcctcag

SEQ ID NO: 3749 - DNA, 549 bp, Hordeum vulgare
gggctgaggaattcggacgagggctaatgttgatcgcctaatggtgcctgaacccattgaggtcactggagcacccaagagctcctcatcgagggacaccactgcactgcccattacagggcattccttttttgcagttggagacagcatggttcctgaagaagaacctcttctgcagatgacggagtgccgtatttgtcaggaggaagatgacattaagaatctagagagcccctgtgcttgcaccggcagtgtaaagtatgcgcatagggcttgtgtacaaagatggtgcaatgagaaaggagatgtgacatgtgaaatctgccatgagccgtatgaacatgggtacactgcacctcccagaccccatcctgatgaaactaccatcgatataagtggtggctggaccattactggcacagcatttgacttgcgtgatcctaggatcctggcagtagcacaaaaccacattatggaagctgaatatgatgactattcagccacgaatgccagcactgctgccttttgccgttctgctgctcttgtttt

SEQ ID NO: 3750 - DNA, 551 bp, Hordeum vulgare
gaagccgcctgtcggctatattttaagttaacggttgggaccgacatacacggtccaaatggctttgttactttatacttacacaccactcaccgagactccctggccaacgccaaccctaacagaatccggaagcacaaactgggacacgtctcagaacgttacactcagggcaatgacgtaaagtacgtaaataacatggctctgcactggcactctggcagcaaaccattactcctttggtgattcatgcaagccagcaaatccgatgtcgccgctggaggcagccggtcgctcatcggcgggacatcttcaaggttgcggttcgtgctggggcgtggcaggagaatctggtgctatggtgaaatgcactcctctcccttgcccagactggaggatgaatgccacctcagttgctgccaacgcagctgcctcctgccgatgtctgcgacgctgcaatatactaattgcccaagccattatatagaatgggagaagaaaaccagcagcacgcagtaagaaaagtgaaaacattgctgaagtgtcatcat

SEQ ID NO: 3751 - DNA, 516 bp, Hordeum vulgare
aagcgttcatatggctcgccttccctgctcacccctcctcctcctcctcgtcttgtcgtcgcagctcgccctgctcgtcgccggcgagttcctccgcctgccgtccgagaaggacgtcgtcgggacgagatgggccgtcctcatcgccggctccaacggctactacaactaccgtcaccaggcggacgtgtgccacgcgtaccagatcatgaagaagggcgggttgaaggatgagaacatcatcgtcttcatgtacgacgacatcgctaacaaccgcgacaaccccaggcccggggtcatcatcaaccaccccaaaggcggcgacgtctacgccggagtccccaaggactacacgggggcggacgtgaacaccaacaacttcctcgccgccctgctcggcgacaagtccaagctcaccggcagcggcagcggcaaggtcgtcagcagcggcccggacgaccacatcttcgtctactacgccgatcacggcggcccagggatccttgggatgccgga

SEQ ID NO: 3752 - DNA, 557 bp, Hordeum vulgare
  UNSURE (21),(49),(50): n stands for any base
gacgagtcaccctgcaccggnaagggagcgcttgctccgactattgctnnggagctattttctttatatagcaataaaagcatatatttacagcaattacatacttgctgtgcagcatgtactgtagtatttacagcaatcacgaccgtatatatcgaccacaccatattttggatgactgatgtgacatggatcgatcacacagtctgatcagatgatcaaggatgaaggactagcagcgcacgcctgagacgcagccttgtccatgacctcctcccggacgccggcgttgcagatgttggctagcgaccgcatgtgcttcatcccgtactgcgtcagcgggccgcaccgctcctcgaacctccgcaccacagacttgaggcagccccagtcatccaccacaggctgccctgccggccgcacggtgccgagaaccttggcaccttcctccgagccgaacaggaggccgccgatcagctccacgctgctgtccacgcgagaccgccgcgccatcgtctccaccagccgcctccgtgcctcgactttctcggccgacc

SEQ ID NO: 3753 - DNA, 56 bp, Hordeum vulgare
tttttttttttttttttttttttttttacttttttttttttttttttttttttttt

SEQ ID NO: 3754 - DNA, 343 bp, Hordeum vulgare
gcccagcccagcagccgctgcttcactacactagccagcgtcttatcttttggcaactcaactcgcttgagcgaaatggccctggctggcaggctactcgtcctcgtcctcatcgccgtcgctcttctcgccgtctccatcgcccagcacaaggtgtctgcctcagggaccgaagagcatgaggataatgtgtaccgggtgagcaagggaggacagggcagtctcaagatataccagtgcaagccggtgtgcgagtaccggtgcagcgacaccaagtacaggaagccgtgcctcttcttctgcaacaagtgctgcaacacctgcctgtgcgtgccgtcgggct

SEQ ID NO: 3755 - DNA, 560 bp, Hordeum vulgare
cccgggcctgcagggaattcggcacgagggcaattatgagataaagaaagaacttgttaagcagggtggacgattagctgctgttaaccttgaatctagagctggcttgcttgcagctaggcagggtttggctcgtgcagcatctagatatgttggccttaggagtttcatgagtttacttggaccaataatgtggggcacactcttggctgatattgtgatccaaatgcttgggacagattatgctaggatcgtgcaggcaatttacgctcttgctcagatccggctcactcggtcgtgttacctagaacctcatgaagaatgatcagagcacaatcattactggataagcctagtactccatgataagctctgcagctctcggtggtgcatagataacagagcaattggcagatggtaggtagcaaggacagagaagaacagcaacagttcaccccttggaatttcagatgcgagactttgatgtaaaccttaggaaaaacagcatagtgtcaggattgaaactgtgtattagtagtagtgctagcacttaacaaata

SEQ ID NO: 3756 - DNA, 555 bp, Hordeum vulgare
  UNSURE (26): n stands for any base
gggcgcagtagtttaagatgaggggnagccgttattttacattgtttaaccgggacagaatggaatgcatgttctacaacttcggcaccccgtggaagtgtgaagccgatgtatattcatccacaactaccgccttcggagagtaggtggcccaaatggctatcgtgagctatttgttaagtgctagcactactactaatacacagtttcaatcctgacactatgctgtttttcctaaggtttacatcaaagtctcgcatctgaaattccaaggggtgaactgttgctgttcttctctgtccttgctacctaccatctgccaattgctctgttatctatgcaccaccgagagctgcagagcttatcatggagtactaggcttatccagtaatgattgtgctctgatcattcttcatgaggttctaggtaacacgaccgagtgagccggatctgagcaagagcgtaaattgcctgcacgatcctagcataatctgtcccaagcatttggatcacaatatcagccaagagtgtgccccacattattggtccaagtaa

SEQ ID NO: 3757 - DNA, 482 bp, Hordeum vulgare
gtctccccgggcctgcagggaattcggcacgagggtcgcaatgattcaacctttacttttatcctactcctttcaatcagggccaatgcctgttctcttggacgcaactgcaattgctcctgacaagatccttttgttggattcttatttttctgtcgttatcttccatgggatgaacattgcacaatggcgaaatgcgggctaccaagatcaagaaggccacgaggtgttcgcccagctgttgaaagctccacatgaggaagccgacacaataatgaaggagcggttccctgtaccccgtttggttgtctgtgatcaatatggatctcaggctcggtttttactggcaaagctaaacccatcagtggcatacaactccgataaccctgcccccggaggagacgttatattcacggatgacgtgagcttcgaggttttcatggaccatctccagcggttagcggtgcaataggttatatata

SEQ ID NO: 3758 - DNA, 505 bp, Hordeum vulgare
ctttgataaccgaagcgcataagaccccgtcaacacaatacaaagtaacaagacacgataaacaagaacgaacaatgcctctttactgtacaccacaagagatgagtgctttggtggtacaaaattgctctcctcagggtcacattcatatatatatatatatataacctattgcaccgctaaccgctggagatggtccatgaaaacctcgaagctcacgtcatccgtgaatataacgtctcctccgggggcagggttatcggagttgtatgccactgatgggtttagctttgccagtaaaaaccgagcctgagatccatattgatcacagacaaccaaacggggtacagggaaccgctccttcattattgtgtcggcttcctcatgtggagctttcaacagctgggcgaacacctcgtggccttcttgatcttggtagcccgcatttcgccattgtgcaatgttcatcccatggaagataacgacagaaaaataagaatccaac

SEQ ID NO: 3759 - DNA, 519 bp, Hordeum vulgare
  UNSURE (6): n stands for any base
cacggngtgtcttcaagatggccaaaaattcgaggaacatgaaatattcgtctcgtgaggtcagatcaacacgttatttaaggccgttcagccattgtagtttcaagagagttgctacccaggagccagcattagcagcgatggagaaatgtgcatggaaagacgcgatctgcccagtttgcatcgaatgcccacatgatgctgtccttctactctgttcatctcatgacaaaggctgtcgtccatatgtatgtggaactagtttcctccactcaaattgtcttgaccagcttatcaagtcatgcagaagctcaggaagcggtgatgatccaggctcgatagtgctcacatgcccgctttgccgtggtgaggttaagggatatacactggttgagcctgctcgggagcagctaaacagaaacaggaggacctgcatgcaagatggctgctcatacagcggtacgtacagagaactctgcaggcacgcacgaaagaagcatccttcagcaaagcctcgtg

SEQ ID NO: 3760 - DNA, 551 bp, Hordeum vulgare
gcatgttgaattgctattttagaagaaaatggttatgttatacaatgcaacagccaagagggatgcacaagaacagtgcatcacacaccagacaaaatggacagatatgaacttccaaaaaaactattcaaaccattccaccactttgctagcacctttaagtccatgaaagcattatgtttcttctgaatataggccacgcatgctccctgacaacagatccatgcaactgttactctgtcaggtctcaacttccataggaggtttcgttaatggcaatagcacgtcaattctcatgtttctgcgagcaattcaaagaccacagaccagcaaagtccacagtggccatttacactgcacgatcgttggtagcaccaaggtgctcatcatctccacgccaactaaatgccagaagctcctcaaactgcaacatggtagacaacaatccttggagcgttgacgagcttgtcgcacagatcatatcttgcaacgtggttctgaacatgagccgcctccatctgtaagtctgcagagggtccactgcacgaggc

SEQ ID NO: 3761 - DNA, 521 bp, Hordeum vulgare
cgttcttccggtgccaagaccagatccggaggtcgttgctatgctaacatcaggattgaccgcttcaatttctcttgaaaaggcaggtcaaatgacatctgggcaagttgttttagttacagcagctgctggtggaacaggacagtttgctgttcagcttgcaaaactagcaggcaacaaggttgttgccacatgtggcggtgaaagtaaagctgcatttctagcttccttaggtgttgatcgagttatcaactaccagcatgagaagatcaaagacgttctgaagaaggagtttccaaaaggtgtagatattatatatgaatctgtaggtggggaaatgtttgatttgtgcttgaatgcgctcgcagtccatggacgtctcattgtaattggtatgatctctcagtatcaaggagaggagggatggaagccgaagaactacactggactatgtgagaagattcttgctaaaagtcaaactgtggctggatttttcctggttcaacatgctcacatgtggc

(The sequence listing continues in the following parts.)

The invention claimed is:

1. A gene detection instrument for detecting expression or polymorphism of genes existing in a genome of Triticeae species, said gene detection instrument comprising a support on which are immobilized at least 50 polynucleotides selected from the group consisting of:
(a) polynucleotides with partial base sequences of chromosomal DNA of barley and
(b) polynucleotides in which a base sequence constituting part of entire base sequences of chromosomal DNA of barley is joined to non-continuous base sequences constituting other parts of the entire base sequences of chromosomal DNA of barley wherein the polynucleotide immobilized on the support comprises;
at least one kind of polynucleotide is selected from the group consisting of:
(1) polynucleotides with the base sequences of SEQ ID NO: 1 through 5780;
(2) a polynucleotide whose partial sequence comprises all of any one of the polynucleotides set forth in (1); and
(3) a polynucleotide whose partial sequence comprises: all of a base sequence of SEQ ID NO: n (where n is an odd number), or in the polynucleotides set forth in (1), and all of a base sequence of SEQ ID NO: n+1, or in the polynucleotides set forth in (1);

the polynucleotides being mapped on barley chromosomes for an entire genome of barley, and the polynucleotides being mapped on the support at an average density of no greater than 30 cM;

regions on the support in which said at least 50 polynucleotides are respectively immobilized being arranged in the same order as a chromosomal order of said at least 50 polynucleotides immobilized on the support, or information indicative of a chromosomal order of said at least 50 polynucleotides immobilized on the support being appended to regions on the support in which said at least 50 polynucleotides are respectively immobilized.

2. A gene detection instrument as set forth in claim 1, wherein the polynucleotide immobilized on the support comprises cDNA.

* * * * *